United States Patent 9,328,346 (POLYCOMB-ASSOCIATED NON-CODING RNAS) - sequence listing, part 107

SEQ ID NO: 21393 - RNA, 155988 nt, Homo sapiens
uuuaaaauucugaugucauuuauuggcacaaaaauuauucugauacaacauggugucuagacauggcuacacuuuauacuuugugcauuuaguugaguauuuguucugcucauaauuuccaauauguaccagaccuucccuguguucagcaccuccaugacaguauuucuguuuucugagcccuugcucuaaacagaguauuuugaccacugaaaacaucccagaacccugcugcagaaggccagugaggguggucccacugcacagugauccccucugugcaucugcucagccgaggcugccagcgaucugaauaaaccucccuacuagcggucaggucuugaauugaagcgugugagucgcagcaucacugggucugauggaagacagaccuuuuguacucauuuuggccuaucuugcaaacauuucugcugcuguccacagaccagugaggucuugggauagguggcaggggugaggucagcaucuucugugucuuuacagucuaggauccuaauccauguucuccacgaccugaggcuucuuggcugugcugaguuugcuguacccauguugagaggagcaacuaggucauucuuccaucagcaaguacuuaugaugaguucucuugugaguuaagucaaaacccguauuucuaaaguuauggaucuucuguuccccaaaaugaauggcuugauuuacgugguauuacuauguuucacuguccugggaaccaaaucaagccuuguguuucugacaauauauucuucaacagcagcuagaaaguugguucaaaccaacuuuuaauauacaguaguucuuuucauuuacauuucaaaauauuuaacaaagucaaacuuucucaccaugguuucaguuuaguggaagcauuuacuaaaguacaaaagccucagaaaaaacgugaugggcacaucugggccuccaguuaccagaaagggcaccuaagaaggcagaaagaaaaggaauauuuuaauaauuugagcuucuucaaagguuuacacagauaacuugaaaaugaaaaggccaaggucugacaacccuaggguauucccugagcucucccacagcuaauugcaugggacacacucaucauuuccagucaaggcuaaugcccaccgaggucccgcaaggacacuuccccagcgcccgcucucucaaguuucugccuucaagcaugccuugggcaauuaaucaaagcacaccccagaguggcccuugagguuagacucccagaucauaaaucugucuuuuuaucuccuucucucugucacugcucuagcuuuuucuuuccuucgcccuuccuguaucucugcacuggacugacagcaaaacccaaaaggaaccccucacaaacaaacaagccuugccuauucuccugaaccacuuaucuuaauguaauuuuaauuuuaguguuugccuuccaaguaugcauccauauuucucaguuucuuuuuuuauaacaaugggcacaugcaguaaauaugaauuuuuaaagagaucugagcucuaacugcccuuuacagauaccucaccaaaucucuuuuugcuacucuggcuuuggggccuaggcuugggaccugauugcuuauuuuaacaaagucacuuugagagccccacucaccagccaauauagcacuggcagagguuuucaugggaugucgcuuguuugaugagcagcucaacuugcguuggaacauccaaagugucaucaugagagaagucccgaccuagcacaggaggaacaaaaacauuucacucucuuccuggcaaucgaugcacuucuuguucccugugggcuuaacugucuaugccaacagcuuaucgucagacaugaagaugaaggauaccaucauaguuggauuugaaaaguuuggccaggugcgguggcucacgccuguaaucccagcacuuuaggaggcugaggcaggcagaucaccugaggucaggaguucaacaccagccuggccaacauggugaaacccugucuuuacuaaaaauacaaaauuagccgagugugguggcacaugccuguagucccagcuacuugggagccugaggcaggagaaucacuugaaccuggaagguggagguugcagugggccaagaucgcaccacugcacuccagccugggugacagagcaagacccugucucaaaaaaaaaaaaaaaaaagaaaagaaaaaaagaaaaauucggccgggugcggugggugaaucacuugaggucaggaguuugagaccagccugcccaacauggugaaaccccaucucuacuaaaaacacaaaaaauuagcugggcgugcaccuguaaucccagcuacucgggaggcugaggcaggagaauuguuugaaccugggaggcagagguugcagugagccaagauggagccacugaacuccagacugggcaauaagagcaaaacugucucaaacaaacaaaaaaaagacaugauuaaaaaacacuucucugaauuuggcugauuuuggacccaaaagaaauuuauucaccuccugaguuaaaugagauuaaacuaacauuaaguacuguuaucagucaucagaaagaagaaucagagacaauguuuaacugaugaccucaaagacacucuuugucagcugcauggugccaaagcucgucacuaacaccacuggacauggggcugaccaccacucagagaggaaagugugcucagauuuuaugucccuuuuaaguaaacacaugacacacucaccagugagcuuaucucgaacccuguuaauaaucuggauagcuuucuuauuuagggccucugguuucaccaaaccgucuccaacuggaauacacaaaaguagaaauaacuguaagaaugggagcaauacaacagguucaaugggugcccuguuuuucucaaauauucacuuuuguaaguguuaagcaauccuuccucuauguccgucuuuguccucagaauauaaugagaaauucauggaaccuuuucugcucaaaggcaguuuuguugcuucaucuuguugaccccucucaggguauaacacagcugcuauuuucuuaaugagcuagucacuggugcgguuccucagaggcugaacuuacugaaagaaugaauagauucuggcacugugguccccguuuucuuaugggcuggcucuccaaguuccacaccguccaaaauuucuaugggaaaagaaaucaauuaacagaaaauucaaacaccaaaaagccacuguugguguuagcaucuaauucucuacgcacucuauuccuuuaacgccugcccuaccuacccuaaaggggaaaagagaaggaaaguuuuauguuacucuuuauguauuucaaaguuuuaagcuggacauagcuguaaucucagcuacucaagaggcugagguggaaggaucacuugaguagcugaguucaagaccagccugagacuccauuugcaaaaaaaaaaaaaaaaauuuuuaaaucuguaaagccauuuucaaaugugaguuaauaauuauugaaaaaauuuggugcuuaucagaauugaaacauggauuuucaggcaaauugcauuaacaaaauaaacucauaggaauaagaacaggucaaaagccucgugacaaaauguguuuggacaaaaacugauaaagaaaauuaacuucggaaugugucacacacaagguugaaauguuauuccuuggaggaauuuucauaucagcucuggguagaaaaaguccucagguguuagguucacccuccacugauuauggcuuuuagcagagaagagucugaaaucagaauuaugaaguuuuuugaaugcuguccuuguacaucacagaccuucugaaugaagguagugauaauuauacuucuuuuuuuuuugagacggaguuucgcucuuguugcccaggcuggagugcaguggcaugauaucggcucacugcaaccucugccucucagguucaagagauucuccugccucccgaguagcugggauuacaggcaugcgcuaccaugccuggcuuauuuuguauuuuuaguacagaugggguuucuccaugucggucaagcuggucucaaacucuugaccucaggugauccgccugccugggccucccaaaguacugggauuauaggcaugaaccaccgcacccgggugauaguuauacuucuauuaaugauccauuggaaguucuuuuuuuugagacagggucuugcuguguugcccaggcuagucucaaacuccugggcucaagugcuccuccugggcuuacaggugugcaccacaacacccagcuggaauuuaacuuuuaagcuaaacaaccaaauccaccaccaucuggugccagcagaacuggcuguccuaguucccuucuguaugcuacagacagcauauaguagccacuugagaauuguuagggaggugggcccugagaaugaagccaguaagucucagcacacuucguuugagaccagccaccaguauaagcucccccagagacuguguguccuaugagccuggugauucaggcauucacaaauccugucacaguguccauguaugacauuauaagccaguaucccaauuucuugccugaaacacccuuuuccuuucuacccaucagauuccacccauccaauaaggauaaauuacccuuuggcaaggugggguggcucaugccuguaaucccagcacuuugggaggccgaggcgggcagaucacuugaggucaggaguucgaaaccagccuggccaacguggugaaacccuaucucuacuaaaaauucaaaaaaauuagcugagcaugguggcaugcgucuguaaucccagcuacuugggagacugaggcaggagaauugcuugaacucgggaggcagagguugcagcgagccgagacugcgccaccauacuccagccugggugacaaagcgagacucugucucaagaaaaaaaaaaaaaaaagaaagaaaaauuacccuuugucaggugaagugaugguuagaugccaccaacccaagugcucucuucgcagcuacgguucacagugaaguccccuuuucugaaucuccacagcccuacuccacacgaaagcacccgcaggcuccacggcagagucuccugcucucugacuauuucacgcagguuauggucaauucuguaaugcuuucugugcuucuucaggcgaccacuguaccucacauuuucuuuuugcaccccuagacauuauuuggcuuaguuuauuaacuaguuguaagugcucuguaaacauuuguagaaaagauauacuuuuuuacacccuaacaguaauucccaaaguaugaacuauguaggguguugcuaaaugucacgaaggaaaaaaggggugggauggggagugcggggaagaggggagggcuaaacaaaguuaaacaauuuuacucaaaaacaaacaaacaaacaaacaaaaaaaccccccaaaaccaguaacuucaaugcugugugugcuggaaacuaauacaaauaaaauaaaaguuaaacagcuugacucaaacacuccugagagguuuccacacacaaaaaggacucuggcucucagagggacacaagucuucuagaccccugcucugugagucgcgcuccuagaaacacuguuccaugugguuccaggguuccucccagcaacgcaaauaaauuucugcugcuuccaucuucccauuucugagcuauuaucaaugcuugaggaccaagguaauacuguuaauaauuauuccaacccagacaccauuagugagcugauauucagacauacuuuaaacuguguuuuuacagauagauuaaaaucagauaguuugauaaaaaucucagagcuucagguacccacuccaugugugaaacaguaaauaaaaaacauauuagcugcuuggugcucaguaaauauuucuagaccaaguauuugaaguucaauuaaaugcuuaucaggugauaagcuagcaguaauagcaccuuugcaaaacuaucacugucaagaaccacgagaaaacuagauuuacuuccuucauguucaguagccauuaccacuuuaaguuaugccuccuacugucaauaacaaagcccaucccauucuagaaacacucuggacaagggggagagccucugcagccucccacgggaugcacccacugacugaagcccaccccacucuagaaacacucugcacaagggggagagccucuguaacguccugcgggaugcacccaccgacugaagcccaccccacucuacaaacacucugcacaagggggagagccuuugcgaccucccguggaugcaccuaccgacugacuggccagcagaguaggaauccguccucguucgggaucgcuuguugccuuugguauuugcuagggagagaaauaaagaguauugaaacaugcuucaaauuuugacuugaaagaaacuugguuauuuucuuccagucauaaaaauauaauuguucguaaagcuauagccccaaaaaaagagaugacagacauauuacucaggaauaaguggguggguauuagcaugggaugugaaacccagggggacacucuauacuguugauuuggacuuagacaauguaauacagauaauauaaggucaaaguaugauuuaauuucaauggauuagaagcucuuuuggugaacauccccuaagguggcagaacaaaggguagaugaagauacugcugucccaaaucauaacuguuugcguuucuuauuaaaauuucagcuuacuacucuauauaaagcccagagaaaaaucacuaggauacuugguuaauacugaagaauauuuuaguaucuaaauugauaauggcauuuucuguuuuaguuaauaaaaauacuugaaguucuuuuccaggugucagaguuacucugugcaaauguaaugcaauagcucugcaauguaucccaggcugcaggcuugaaggggcauagguuuguaaaauguuaugugcuggauauugcuaauuugggaggcugccaaccccagcuuccacacacuugauuuuauuuuuuauuuguuuucuuuuauuuuuaaaauuaaauuuuuuauuuuuuuauuuuuuugagacaaggucucacgcugucaccuaggcuagagugcagcaguggcaugaucauagcucacugugccucaaccucccaggcucaggugauccuccugccucugccuccugagcagguaggaccaccggcaugugccacuguacccaccuuaauaugguuuggcuguguccccacccaaaaucucaucuugaacugcaauucgaauuguaauccccauguguugugggagggaccucaugggaggugauuagaucauggggaugguuccuccaugcuguucucgugauagugacugaguucucaugagaucuggugguuuuauaaggggcuuuucuccccuucacucuguacuucucucuucugcccccaagugaagaaggaaguguuugcuuccccucccaccaugauuguaaguuuccugaguucuccccagccaagcagaacugugagucaauuaaaccucuuuccuuuauaaauuacccagucucaggcaguucuuuauaacagcgugagaacagacuaauacaugccuaauuuuuucaguuuuugcagaaaggggucuuacuauguugcccaggcuggucucgaacuccuggccucaagcaacuccucugccuuggccucccaaaauguuaggauuacaggugugagccacugagcucagcucccaggcacuugaugauacucacuguccaucagccuccaguucagcaaggggucauagacaaaggcuuccagcacggccaugacacuguccuugugcucucgcagcaccuccaucacuguguggcaugugauucuguaguugccauccaggccuguaaccuagaaaugggacagagccacucaccacaggaguuacuaacucuccacccaaagcaagccgagggggucuguuacccucacuuaggaagcagacacaggccauguugacguaucagggugagaaugucuuaggagaaggaaucagggcaggacugugauccacaggaaaccaggucagaagugaagugguaagccuuucauagauaggucauuucuaacacaauaggaaauaacagaaaacugcuacaaaaaucacaaaggcacuuuggagaacugaugggcucuaacaagcguguucucagaaggcuguaacuguccugaucccauuuggaagcagcucguucccgauauccacucaccuccauagcauuggucaacauucuuguuagucuaaauggaaucuucucuggaaacuucucucgggucauagcaaccuacagaauaauaaaugggaaaagccaaaucaauguuuauuuucuuuaccuggagccagguggagcagguggcuuuccucugcaucaccugcacugauuuuaauuauagcagggaaaggaagcagcuuggguuuagugagaggacuugucacagggauuugaaagacaacuuaaaaaaaaaaagaaacgaacaacagaaaagaagagaaaacaaaaaggaaaaaagacaaaugugcaucguguccaggcucuugggcaacaggugguauggaggguaggggccuacucuacucagagggcaugggaacagcagcccuugcuccaaggggguuagaguccaacuaagagcccagauuucauuucuuagacugacuuaacuacagccuugguagggccagcagggguuaagaguaaggcaguuugggcuuaagucugccuacagugucagaggagggggaaaagugaucacccgggaagaugagguugggguucuagaacauguguucaccucaaagcaguccccaaagucaaugugcaggaucuucccacucagacgguccagcaucagguuggaugggugucuuugagaaacagaagacagaucagggagggaucaacagagauaacggaugaaaaaaucaauaaguacgugauacuguaagcuaggaguuggcaaacgauagcccucagccaauccagccccuccaccuccacuucugcaaguccaguuuuacuggaacacacagcacgcucccuuguuuaaguacuguuccaggcugcuuccaugcuacgacagcagagcugacuaguugugacagagaccaaagggcccacaaagccuaaaacgaccuauuaacugguccuuuacagaaacaguuugccaacuccugcugaaaugugggcuuaugugugaaucacagguugucccacuguacugagauacugugcuuuucugaggucuuuggugaccuaauaagucauuucuggcagcacuggcaccuucuggugacaaggcucuaucauuuuuacugagcagccguaacagggucucaucuccuuaagucccugagccaaucccggcaaccaccuggcuuuuaucaacagauauucugcuagacuuuuaaaaacaaaaaucuacuauuuuugugggguaaaauuauuuuuacucucaaauaguugcaugagacaugauuccaggagaaaaacaguagacaucagagaaccagucuuuuuuacauucuugugaguccguuucugaacauucguaaauuacauguucagucaguacacuuggacaaaacuuauuaugcaaaaauaucagaaggaucuacuuugguugguuucaauuacagaaauaaaaugauuuaucuuagcacaguggugacugacaaauguuucuugaaucaauaaaaucaauaugauuuaguauuuuuguuuuuuucuuugagacagagucuuacucuguugaccaggcuggaacacaguggugcaaucacggcucacuacagcuuugaccuucuggacuuaagugauccuccuaccucagccucccaaagagcugggacuacagguguaugccaccaugcuuggcuaauuauuuuuuguagagacgggaucuugcuaugcugcccaggcuggucucaaauuccuaggcucaagugauccucccaccucagccucccaaagugcuggaauuauaggcaugagccaaugagccugcccugcaauacagcuuuuaauacauuaagccagacuaaggagaaaguaguauccuugaacuauguggggcuuuauugagauggggucuugcuauugcccaaguuggucucauacuccugggcucaagugauccucucacccuggccucccaggaugacaggcaugagccacugcacccagcuugaacuauuuuuccuuuucuuuaguuugauguauucuucugauggcaucacaaucaauagggaacuaaggcuaauguuguaaaagagaccuuacauauacaauaccaauauuuauuuaccaaaaagccauauauuuaauuggaaaaccaaaugaaaccauucaggaaaacuacaauggagaaagaagacuaaaaaaaccaaauuaaauuacucaccuaucucccaggccuaaaauauacccaaccauugacaugaccgcuaaagaacggguauaauugguucuucggucaaaccacaccuagaacacaggagugcaugugaacuacgguucuggaaacuuuaauuucaacauaauuauacucuaauaagcugucuuugguuuguacuuuugagaccgagucucgcucugucgcccaggcuggaaggcaguggugcuaucuuggcucacugcagccuccaccucccggguucaagcgguucucaugccucagccuccugaguagcugagauuacaggcacccgccaccaugcccagcuuauuuuuguaguuuuaguagagacgggguuucacuauguuggccagacuggucuugagcuccuaaccucaagugauccgcuugccucggccucccaaaaugcugggaucacaggccugagccacugugccuggccuaaucaguuguuuucuuacaguccaucaauaacugguuagaauguauaacauuauaaagaccucauucacaauucuaacaaugaacuaugccuugaauuaaacuuaauuagaaauguguuagacuuaaagaucugaguaaaugaaaaauaucaguuuaaggauauccccuuaugaguauaaagauguuaacagccucaagaaaaaaaauagaugacgauagccccugagaagggacuuguauuaacaccauggaacuugagaaacaggccgaaagagcaaugaaacagaagaggagcccuagaaagaaauccaaggacacguagaauuuaguguuuaggcugggcacgguagcucaugccuguaaucccagcacuuugggaggccgagguggguggaucaccugagaucaggaguuugagaccagccugaccaacauggugaaaucccguuucuacuaaaaaugcaaaaauuagccgggugugguggugcgugccuguaaucccagcuacucaggaggcugaggcaggagaaucacugaacccaggaggcagagguugaagugagccaaaaucaugccacugcacuccagccugggcaacaagagcgaaacucucucucaaaaaauaaaauuaaaaaaaauucaguguucaauaaaaacaaaaucuucuaaauagcagggaaaggaugaauuauuuggccaacaguguggucauggcuagucauguuuaaaaaaauaaaguuacgccuuaaauuccaaacuuaguuaauuuuuuuuuuuuuuuuuuuuuuuuuuuggacagagucuugcucuauugcccaggcuggagugcaauggcacaaucuuggcucacuguaaccucugccucccugguucaagcgauucuccugccucagccuccugaguagcuaggauaacaggcacgugccaccaugcccagcuaauuuuuguauuuuuaguagagacaggguuucaccacguuggucaggcuggucuugaacuccugaccucgugauccgcccgccucggccuccuaaagugcugggauuacaggcgugaaccaccgugccuggucuuguuuauuuuuaagagacgaucucacuauauuacccaggcuggaguguaauggcuuuucauagguguggucuuuuucuucuucuuuuuuuuuuuuuuuuuugagacagggucuggcucugucacucaggcugaguuacagauugugcaguggcacaaucucagcuaacugcaacccuugccuccuggcucaagugauccucccgccacauccuccuaaguagcugggacaaugggcaagugccaucaugcccggcuaauuuuuuauuuuuuguagagaugggguuuugcgacgcugcccaggcuggucucaaacgccugagcuucaagcauuccaccugccuuggccuccccaaguguugggauuauagacgugagccacugcaccccgcccauagguguggucuuaaugugcaacagccuugaacuccugggcucaagcaauccuccugccucagccucccaaguagcugagacuacagguguguaccauagugucugacuuggguuaagacuuaaauguaaaaaaaacccuguaacuaguauaagaaaauauagguaaaaaaauaaccucaagguggagagggccuuucuaaauauaaaaccaaaggaagaggccaggcaccguggcucaugccuguaaucccagcacuuugggaggcugagaagggcggauaacucgaggcuaggaguuugagaccagccuggccaacacagugaaacccugucucuacuaaaaauacaaaagaguggccgggaacgguggcucccgccuguaaucccagcacuuugagaggcugaggcgggcggaucaugaggucaggagauugagaccauccuggcuaacauggugaaaccccgucucuauuaaaaauacaaaaaaaaaaauuagccgggcauggaggcgggugccuguagucccaacuacuugggaggcugaggcagaagaauggugugaacccgggaggcggagcuugcagugagccgagaucgcgccacugcacuccagccugggugacagacugagauuccgucucgagaaaaaaaaaaaaaaaaaaaaaaaaaagccgggcaugguggcacgcgccuguaauuccagguacucuggaggcugaggcaggagaaucacuucaaccugggagacggaguauguagugagccgagaucgugcugcugcacuccagccuggguaacagaguaagaccuugucucaaaaaaaaaaaacaaaacaaaacacacaaacaaacaaacaaaaaaaacaaaaacaaaccaaaggaagaaacuuuaaagaaaaggauuaaaaauuugguaacuucuaacuuuaaaaaaugccuguacagucauaucucuaaguuagggcccccaucggaucccaaaaucugcaauacucaagugccuuauauaaaaugguguaggccgggcgugguggcucaugucucuaaucccagcacuuuaggaggccaaggcaggaggauagcuuaagaccaggcugggugacacagugagacuuugucucuaaaaaaaaaaaaaaaaauuuauauauauauauauaaaauugcuuugagacaaggucucgcucugucacccaggacggagugcaguggcaugguauggcucacugcagccucauucuccuggauucaaaugauccuuccgaguagcugggcuuacagguguguaccaccaugcccggcuaauuuuuuuguagaaauggggucucacaggcuaggugugguggcucauaccuguaaucccagcacuuugggaggccaagguggguggaucacuugaggucaggaguuugagacuagccuggacaacauggugaaacccugucucuacuaagaauacaaaaauuaacccacauggugguacgugccuguaaucccagcuacuggggaggcugaggcaggagaaucgcuugaacccagggggcagagguugcagugagccgagaucuugccacugcacuccagccugggcggggaaaaaaaaaaaaaaagagauggagucucacuauguugcccaggcugguauugaacuccugggcucaagugauccuccugccuuggccucucaaagugcugggauuacaagugugagccacugcacccagccaaaaacaacuuuuuaauaaaauggcauaguauuguauguaaccuaugcacaaccucccuuauauuucaaaucaucuuggguacauauaauaccuaauacaaugugaauguuauacaauguaaacagucauucuacuauauuuuuaaaaauuuacauuucuuauuguuauauauauuuuuaaaaaauauucuauccacaguuggcugaauccacagaugcagaagcuacggauauggagggcugacuguguaucaaaaaccaaaccaaaccaaacaaaaacuccaaaccaaagaacacaccauuagcaaaauuuaaaaacuaaguuaauaggaaauuuguaacauauauaaaaaagacaacuaucuuuaauucuuuaauauauaaagaguucuggaggaaauauuaaacuacucauucuaacucugugaacuugucuugcucacccauuucauuuuuguuagaaaagucuggacacgcucuacagccaaucacagcaaagaagagccgcugugugcacaugaacagaugggagggccauccuauugcgaguggggguuccaggagagcgcaggucugcagggcccaguggccuaccucggagcuggggcuuuucagccacagcagcuuggccaggucguccccagcuguauuauugacggcaugcucaaacaccuccaccuucugcaucagagucaaguggucauaguccggagccaucugcaucaggacacaacuguucaguaagagagcagccuaagacauguaguuuggguccaggaagaaacaaggcuugggguccaggcagagcugaguucuaauuuccccaucauagccaaaggagaagggaaauaagaacauggcaaaaggagaaacgaagugaccacucuaaccugaugaccacuggaaccccaaggcauaagggaaaaacacgagacuucaccucaguuauaggccuucugugcagaugagaguacuggaaguuucaagguuuuggaaaacaagcaauucucuuucuuauuacuuacacaucuacuaaacauuauuucuccauauggccagugcuuuguauacauuaguaaauauauggugccgaauauuuaucugucuagucuucccuaggauggugaaaacaauuucucagcuuaaggguccuucaguuucuuacaagcuuaucugcuuuaggacucacuuuauuaaaccuucuucaaagcugauucucucaaagagauuuuucagugacagacauacagagaggaaugagaaaagcagcgcuacggagauucccugccacggaaggggcacuagcucucguggccgcaucacauacccgcaacaugaugcgaugcucgauguugagaaggaucuucuucuucucccuguagucccggaugagggcgugcagugugucacaguggggaacccagccaaugaggcccgaguuggucgauaaagggaugacagcguaucucuggaugcuggcgcccacagaaaagcaggguuaguguaccguaaagagaguauacccuugagcagcucagaacacaggcagacuguuuuuuuuuucuuuuuugagacagagucuugcucuguugcccaggcuggagugcaguggcacaaucuuggcucacugcaaccucugccuccuggguucaagugauccuccugccucagccucccgaguagcugggacuacaggcgugugccaccaugcccaacuaaucuuuuuauuuuugguagagacggauuucaccauguuggccaggauggucucaaucucuugaccucaugauccgccugccucggccucccaaagugcuggauugcaggccuaagccacugcacccagcccuauuuuuuuuuuuuuuuuuuuuuuuuagauggagucuuguucuguugcccaggcuggaaugcagugucacuauuuugguucacugcaaccucugccuccuggguucacgcgauucuccugcgucagccucccgaguagcugggauuacagaugcacaacaccacacccggcuaauuuuuuguauuuuuaguagagacgggguuucacuauguuggccagacuggucucgaacuccugaccucgugauccacccuccuuggccucccaaagugcugggauuacaggcgugagccaccgcgcccggcggcccugacuauuuuuaaugagcccccgccgcagcaggcuggugugaaguguguguugagggaugcuuugugaagaauaaggcaucacagaaagacagugcacugauggugcagugaaagcaacacaggucuccucaaccugcccaagaaacucauggcuuugggggaacaaucaagugacuaaaauaccucucaagugaauucucaugguuuuaacaggaagaggagugccagaauacggacgaugggaaagguuuggcuuucaucccacaaggggucagacccaucccaucuguagacucuccagucuacccgccacaaauugcucccugcuggauucuuuggagguuguuaaaggcauuucccaaugaaaauacccuaaaaacucuggaagaacuugguuauaaauuauaaaauuuuauaacuuaauuuuucauuuuuaaaacauuuaaaaaauauuauuuacuuuuugagauagggucucgcuguuaccuaggcucgagcacaguugccccaucacagcucacuguagccucgaccuccugggcucaagugauucuccugccucagcccccugaguagcugggacuacacugugcccagcuuuuuuuuuuuuuuuuuuuuguagagacagggauuacaggcgugagucacugugcccagccuaucuuuauuuuuugagagaaagggucuugcucugcugcccaggcuagaguguagaggcacaaccuugucucacugcagccucaaccaacugggcuaagaugauucuucugccuccaucucccaaggagcugggacaacaggcaugagccaccaugcccagcugauuuuuuuauuuuuuguagagacagggucucacuuuuuuguccaggauggucuugaacuccuggucucaagcaauccuccugcuguagccuuccaaagugucgggauuacaugugagccaccaugccuggccacuuaauuuuuuuuuccuuacuuuaguuauuuauuuuugagauggaguuucacucuuguugcccagccuggaguacaauggugcaaucuuggcucacugcaaccuccgccucccagguucaagcaauucucgugccucagccuccugaguagccgggauuacagguggccgccaccacgcccagcuaauuuuuguauuuuuaguagacacaggguuucaccauguuggccaggcuggucucgaacuccugaccucaagugauccaccugccugggccucccaaagugcugggauuauaggcaugggccaccgugcccggucaccuuuuuaauuuuuuuaaauaaauagugauggggucucucuauguuguuuaggcuggucuugaauuccugggcucaagugauccuccuaccuuggcauuacaaaauauuaggauuauaggugcgagccaccaugcccagccuuuuucuucuaaagagacagucuugcucuauuacccaggcuggagggcaguggcacaaucacagcucacugcagccuugaacuccugggcucaagccaucccccugccucaaccucuggaguuucugggacuacaggcaugaguuaccaugccuggcucccuaauuuuauaguuuuuuguuaagauauaauacaugacuacacgagacaaauguaggaaaaaaccagaagacuucucaaauuguugccauuucaggguuucugaauaccugagguuuuuccgaagagauguugggucauuggccagaaggguguuaaccaggccgaagagcugcaucacacgcucauccuggcgcagaucuucauggccuuuuagaaggaaaacaaacucauguccguugcugccuguaaggaacagugggagcggugaguguacaucagagguccucagcucuucagcugagagcaccacugcauucaagagaucccacagacuacauaugccuuaccuaaucacacguuccucacaaaaagaaaaaacaaucuuuagaauuaaugaaaagaguggcuuugccuuuuaugguucucaaugaccaguguuguucaaauuaaaacaaaacaaaaucuguuuuugaggaccaggaacgguuaggcauggaaaugaucauuccuguuuuccgacccacucuguccuccucuguucugagaagccugacuccuacaagccgcaucaccugggaucccacuugggcguggccaaugguggaaggguacuggcaggaggucagaggauggguagagggagaggucaggguaugugucccccaucaccagccuggccccaguucuagaagcuaccacucucucuggacuguagacucugcuagauggccucucuggcauggugacgguucuagcugggcuccuugcucuuucaguucuggagugugggggugggugagggcugaguaacaauuucucacuugugcuuguucaugagcgcuccuuguugauucucuuagcuuugcuuacaccucuggaaacaauuccuuucuuaaacucucuuuaauuaaacaccccaagaaccagccugacccacauuuuguaucagaagacaacagcucaugcagagauaaucaccuguggaccaugauuaauugguguuggugaauaaucacugcauuuaagaaacauugagcauuauuaagagcgagaggugaggcugggcgcgguggcucacaccuguaauccuaacauugugggaggccaagcugggcggaucaccucaggucgggaguuugagaccagccuggccaacguggugaaaucccaucucuacuaaaaauauaaaaauuagcugauuguguggcaugcgccuguaaucucagcuauuagggaggcugaggcacgagaaucgcuugaacucaggaggugggguugcagugagccgagagcacaccaccucacuccagccugggcaacagagugagacucugucuuggggaaaaaaaaaaaaaaaagagcaagagguggcugggcgcagugguucacaccuguaaucccagcacuuuggaaggcugagacaggcugaucacuugaggucagaguucgagaccagccuggccaacauggugaaaccccaacucuauuaaaaauacaaaaauuagcuaggugugguggugcgugccuguaaucccagcuacgcgggaggcugagacaggagaauugcuugaaccugggagguggagguugcagugagccaagauugcgccauuauacuccagccugggcaacaagagcaaaacucuggcucaaaaaaaaaaaaaaaaaaaaaaaaagcgagaggccucaaagugccaccacagcacucaggccucacuaaaacaucccccauaaguaacacucuaccccaagggaaauuccagagcccacuugcuuaacaaaucucacugugagaauccacuuguucauuuuacacaaucauuuaccacagagacuaugaugguaaaaaaaaaaagaaaaaaauuucaagagccagaagcccccguuucagaggagcuagcaccuucccugcuugcacccagcugccuccucccuggccucaucagucuccaacaccugccuuccacuguuacuucucugccuugcaugccuuugucauucccuuuaugugugaucaugcuucacauaagcccaacuacaugaaugaacuaaguccugaggacauaaugagaaauuugcuugcccucuauuuuccucucaaugagcaugggagagauguagcuaugauaggugaguagugggaauggcaagcaguaauuucagaagagggaaggggucucagccaguguaggagggagaagugggugacagaagugcacaaugguccuuacccauaagugucaauuuccggggccucugcuuggaugugaugacuugcaaagacggugcuauggacugaaugcgaaugauuggcugguuggggucauauguuccuggcacagccaauucaaggucccggcacaucagaaguuuuggggaaacauauugcagcucuaaggaugugagcuguaaauaauuaccaaaggauuuaguguucugccuccagggaagaauuuaaacgcaauuuaaguauuuuucaguggauugcuaauaacaauuacuugucccaaagcagaaguaaaaccagaugcuuuggaaugaguguuagaacauucauagacaguaaaacagaaaggacuauaaugacaguuaacccugccaggagccugaagauccuaccugaggcagcugcuuugagauucgucggaacacaugauaauagaggucccaggcuugggugagguccuugacauucccugauuucauguacuuccugcaccacucuugggccuccauuaaaucucgaccauaggccugagagagaaagcaggcacguuuucaaguuaucaaagucucaaccaacccaggaggcaaaauccccaggcugacugcagauauuccucaggagcccgcuguggccugaaaacacuggcagggggcuggagaaagcaagagcauaggugcaggccuccaacccuggagcuuccaaaccagcagcauggcuuauagggaaggaagggugagaggagagacgagaugaccucuugagaaaucuugggcuuuuccaguuaaaauucagaagggucccuguaacuaauuucugauguuuuaugcucugugaccuccaucagagcucguuuuauuaaagucaguggaaaggccagaggaaaagaaaucugacaaaggccuugggucacguccuuucauucuauaaaaacuuuucucauuucauuuuuuuuuaguggcagaauauuucuacaggguuauguccuuucguguuuuuuaccccauaccugauuaaaggauguuuccuucagagucugggggccccguuccaucauagcaugcaagggcuccagcaccucaaacaugccuuucacguuccuuuccccaaaguacaaacgagaugccucuuccaggccuucaugccacaucucaugccagaggauggccacucggaucagcuccucgcucaccugaagccaagagaagaaggagagaagcaucaagaaucagcuaaccucagaaaggucuguuuuggagacacaggagguacuauuuccagcagucagaggaagugcacagcaccaaugcgaggaagaaaaacaaucccacuugcgcccaccagcuaagggaccagggucuaugaagccccacaguggcuccgacccaccaucauggccugcuggaccaggguguugcugugcucacacauguucuucagaaucuuguuggcugcauugugccgggcugucgugguagacuuagaagccacugucaguggguagaugagggccugagggaaaaacagaagaaacaucuauaaaggaaauguggguuggggaagagcugguaugaauuuuaaggagaauaacaaaacaaguggugagugugacauuaacaucugcuugagacuaccaggaaggggcucagucuucgagggaacgcuuucuuuuuagcaaggcucccgggcccucugggacggcuggcuggacagacccuccugggccaggauggaacacauggcucccaguuccugcgcuugugucgccagggcagcuuuuggaaaggcugaccaccaaaccagugguuagaugagaaacugcccagagucuccacauaccugggggugguaccgaccaaugucugugagaagcuggugaaugagacgucccaccaagggucugggcguaucaauucuugcaaugagcugagguauaaccugguauucaaaaagacacaguauguagcauaugagacuugaaacaacuaguuauucuucuaggcaaagaucaauucuuuuaacuuguuucgguugaugcucugaaaugguucauucccuucccuuuaguuucuaaaagaaaauaaagaaaauauggacacuugacacugggaccgagcccuacuuccuuagcacuguauuaacacacacugccuugugacacugaacacagcaugcuuguaagaggagacacacagaagagagacuuggagccaccuucaccuguaaccaaguauccucaccuguagccagguaucaaucuggauggcuuucacccccuccacuaaggccucauugacaucuggccagugaccauaaucaaaccauaaggugagaacucugaaaaagaaaugagaaagucacagaaaauuuaguuucccaguuuuugccugccuguuuuucaucucuaaggcuccugagaagagagcuggcagggacuccaaccaguaacucucaaauguguuuggccucccaugggagcaggugucugugauggguggcagugcucuugacugaacaccguaagagucacccugagcaaaugagcauuucaucccaggucaccgaggggucaccauggcauguaugcaaacaucaaacagacgagccaggauaaccuuuagaaagccacaagucugcacauguaagagucgcuguacggcagaggcaacagggacaccuggcucuuagcuggcuggagauccucaaaugaaggaggauguggaccuugucaccuuuacccucuggguuaacugauuugagucauuuguuuagaccucuccaaguugcugagggauuuuagaaauacugugacuucaauaggcaacaggguggucagaaaaaaagaaauauugugauuaacagauggguuaauaaucccuccauaauaaaccacacauggagaguucucacuccacuucuccuccucacucucuguagguuucacccacacagguggggcccagucagcuguuacuccuuaaaugcagugcagaaaaaaggcacauacaucgaucuuggguguccugaucagggucaggaagggaaagaggacuuuuacgugugacuucuaggucuugccauuaacauggccuaccagaguugcauccuucccuucucugauaccugaguguauccuggagguuguugccucgugacaaggagauggaacggaagaagcccuggacggcaggcaccguguacaucaggaggguuuuggacagauccuguuggaacacacacguguuagcgacacucuugccucugcuuucucaucuguaaaaugggcauaagagcauacuaacuguaccuacuucaaagggugguuauaacaauuaaaucgguuaaugcaugaaaaaucuuuaaucauuaccuggcacauagcaaagacucaauaaauggcaacuguaucauaacuguuauuaucuugggcugacaguggcuuccugaacaggauggagggaggagguggagcugaggcucugaacacccggaucucugggccugccagcggcccuggcgcauucugaacugacagcccaaggggaaggggaagaaguggaaguggagagaaaaaggcagaggauggaccucccaagccccauccucagaguggacccgcagcuguguacagccacccacacacaggugcagcacguagagaaugagcucguccacagggaagcuugacaaggagcuugcucuucagcauagaggcugcgucagcuccccaaacacaaauauucacacacaaagcccuaucucaggcagugcuggaugguagauaggcaguauuuuccagcuccaucuggcacuucagauacagccucagguuccuuuuaagcuuaacaacgauuccauuucucagagagccuggcaccuugguugguuguuaauaaggaagaagggaaggguaccucagugaccuucuucugcagcggcgaugggguggggcuguucucggugcucucggccucgcucucacuguugcugcccucggugcuggcaguggugguggcaguggcggccgugguggcggcagugguggcguuggugauguuggccccgcuggcaugacgcaguuucuucuucucaucgcgggcuugguucugauguuuguaguguagcacagcuucgaaguucaucacugcccacgcaugccaggccugguuggggagaaaggcaaggacagacacuggagcugugaccaacagcagggcucagaggagcgcaaggucgaugcugaggaacagcugcuccugccuguucuguguguccauaaagcaaacacuucaaggagacacucagaaauggcuguuuuacuaaauucaacaugauccacucacuuuguggagcacuaacuauauaacguacuaugagugcacugcgagaagggcacagcaagaggagcaggagagagcucuugccucaagggaucucccggccuccuaggggagcucacgcacaaaccugaagaccuagguacucugcaaggcacaaugggaguagcaaggacaggcauuuggaaagcuuugucaagaagagggauuugggguaggucuggaagagagcugcagaagggcaaggagggaaacaagaaggcagcgguggggacuacuuggcaagggggaagaauaaggccagagaugugcagauugguucacgggaaacaagcccaugaaugugaccgugcaggggauacaugcaggcgaggagugagagcgaggccagcaaagcacgccuggagcaggcacagggcuggcacuuucacccagaaagcagagcugcacuggguauaaaguguacauuuaggggagagcagaaauggcaagcagaagugggggcaagcagcagucaucacaauauuucaagggagcaaaguuuugacaggucaccagauaguggacaaaggaagacaugaagagcauaggagccugacagagaaagaaucucacccaucugccuggucccaacaccuagcccacggccugacagagaaccagugcucaaugcuugaaggaagaaccgcuggugcuuauuuggauaaaggaauacuacucucucugggguucugagcggcaaugacucuacagcguaccaccacuugguuuagcgagugugaggcagaguuugcuuccaggcaugguaacuuugcagugauaguaggacacuacgugacccauuaauagcugaacuuucugaauaauugggaaauucguuuguaugccuugccaaaaaccuugaacacagguguauccguuuucucaacuaaggagaauagauugaucacaacuaaccuuuacuugaugaguaagaauucuacaaugacccagguuucaguuuucccauaccuucauuuauucacugaauaucucuuguguaucugcuaugugccuggcaaugaccuggggucaaggugaacaagacaaacaguccuggcaugcauacagggccaugacguugaugguagaauacaucauaaaacaaaagggacccacauuaggaaaagcuuuuaaaaacuaaaacuaaaguuccugaaaccaacuuuuuucuugugauuugcuuacuuccuaaaagcuuaaugaaugaaaguaacucugguuagaauacaacucugauuaauaagcuuccaguuaauaguguuuaccggauguauuuuccagcuuuggacaugcaagcuguccuagagagaguauuacucuuaugacaaaauggacauuuuucaaaccagaaugaagcaugccuaaacaaagguaagaucuguauuauaagugcuucugcaguccucagauacaaguuuagauuucagagagauuaauucacaaaguauuggcaagccaaggaaauacuggaaagaugucaaugacaucugccacaccaaguaguuaccagaaagccucucaaaaagaaauaagaaaguauauucucaccaaagauauacacuuccaaaaaucaccccuccaucaaucacaucuuuuauauauuuucuaauucuguuuaucucuuucaaaaguuuccuguaacauaacaggauguuacuuggaucuuuccaauaaaaacaaagaaaguuaaguucuuagcugaggagcaggcaaggaugcaaaucagaaaaacgcugaacaagaacagaugaccuaagggaagaugucacuccagagauuaaccauguguccagaugcucccaggaaaacaagcagcucagagucuguaagacagcagcaauccccaacaccacauacacauaauaaugguguaacaaguauuucuccaauaaucuuucuguauuaauuaaacuuguagggggaaaugcaggcucccugggccucuuauagauaggcuccagggacucaaggaguaaguucacagcaucagccuagcuccgcagaagcucagcuguaaccacgagcacacaggaggacacgagccagccagggugcugggucucacagguggccugcuucugaucaccuuguaccagcugcggucgugcucuguggcggcgcuguaguacugcagcacuuuggggauugugcucucauugaugcccuguagauucagcugccacucuccaaguuucaggaagcaucuggaagcagagaaacaagcccccaugacauucccuccucaaaacagcccuccuaagaggaccacaaauuguuaggggacacugaagcccuucugguauuuccucuuauucucaagaggcaaugugaaggagcuagcaaaauuuucagccacacgcaagaaaggagaugggcuuuuggaauacauuuuuaagauaccaucuuuccaucuugaccuuugucucucaaugacagcauaaaccauguaccugguacagauaggucuguauggacuuaccuaccccaaacccaauuuuuugugggugacaguugagaguuacuucuuuauugauugcuauauggcuucucccuuacuuuucccuuugccuccauucuuuguaaugagauuagcccacauuuacugacugcuacuguauuccaagugcugcuugaaaugcuuggcauuguacucuuugcauuaauccucacacuacuuuauaccacccuaggaaauagaaacuguuacuaucccuuuuauauugguaacugaggcauagagagguuaagucacuucucugaagucaaauaucaaaucugcagcacagaguggcacaguggcccacaccuauaaucccagcauuuuggaaggcuguggagggaggcuggcuggagcacaggaguuugagaccagccugggcaacauuaaacuuguaggaggaaaugcaggcucuaugccuguucuuuuguagagaccucauuucuacaaaaaacuagccagugugguggcacgugccuauagcuacuugggaaacugaggugggaggauugcuuaagcccaggagaucaaggcuauacucuagccugggugacacagcaagaccaucuuaaaaaaaaaaaagggaggggcagcauaucugacauuugaaaacaaggacucuaaaaccagacgccaggagaacagcacaugggugcucuugggcugcugaaccuaggaaagcaaguggcagagacuuugagagcaguaugcuuuggugguugccugggaucccuacuggaaaaggaaagagagaugucagcaaucagccacccaagaagccuugaacuccuccuugcugcagaagcugcugggaugacagggcuggaauaugacuugccccaggucaguggggaccucaccgggccaugagcuugugcaguuccugcuuaugcugcugguccucaguagcgauggcaugcugggccuguugcugcauggucuggacaaaaugcugcaugugcuggaaggcaucgaucuguaacaggacaaaggcacagagagccacuuggcuuguggcccagcuucagaggaagggagcuaccguucaucugauaggcaugagucaaccccucuccaaacagaauacccuagagcacagaaugaugaccccauaggacagaggaccagggcgugauacugggagagacugggcuuuucaaaaagauucaugacuuauucaacucaagucuuggcucuccuuugccaacuauaauuaccaguuuuauaagccuuggcaaaguuucaugccuggcuaccccaaauaaaaauuccuacaaaguaauuugaaacaacugcuuacuucacuaucaauauguuacccugggggauauuaggcuuuugggaauuguuucaggcuaauaaaacuuugguauuuguuuacaacaccaggguaccuuggacaguccagcggagcaaaaacuauggauuuaaaaaucauauagcacccaaauaagaacacagauuuggagugaaaacccgcaugcauucacagggaauagggagaagauauuagcucagcagacaucugguugaacagggugacuuaggggcaaaaucuccagagcauccuaaagcagcuagaucuauuuauacuaccggcuuguauacaaagugagcagagggcaugugagucaggaacagacagcugaacugaggaagggcagagacagaaucacagaucugggacuacuguacaagcccgccacauccaguugaaccagcaucuugauaagugcgguccauaucacuuuuaaagggaaaaacaaaucuuuucugguuuuucuagaggggggaaaacccacaaauagaaaaaaaaauaauaauaaagggcuucaaggauggagauagaauguacaaacaucaaaagcucaaauggaaaaauggcaaaaucuaaaugcauuaacacagggaaaggaaacauuauaugagagaaugugaaaaagaggcaauguguucugugcugcagaagaaggaaaaaaucaagacuucagauaaauaacaguucuccuuaugguaaaucauauaagagguauuuuuguuuguuuuaaauaaaaacauguuagccaggugcaguggcucacaccuguaaucccagcacuuuaggaggccgaggcggguggaucaccugaggucaggaguuccagaccagccuggccaacauggugaaaccugucucuaccaaaaauacaaaaauuagccgggcgugguggggcgcgccuguaaucccagcuauuugggaggcugaggcaggagaauuguuugaacccgggaggcggagguuguagugggccaagaucgugccacugcauuccaaccugggcaacagagugagacugucucaaaaaaaaaagaaaagaaaaaaggcugggugugguggcucacgccuguaaucucagcacuuugggaggccaagguggguggaucaccugaggucaggaguucgagaccagccuggccaauauggugaaaccccgucucuacuaaaaauacaaaaauuagcugggcguggugguggcugccuguaaucccagcuacucaggaggcugaggcaggagaauugcuugaaccuggaggcagagguugcagugagccgagaucacaccacugcacuccaguuugggugacaagagcgaaacccugucucaaaaaaacaaacaaacaaacaaaaaacauguuagugaugauggccuugaagaaaaugaaacucccuagcuugggggccaggaccaaccucagaugcuuuucaauauaaggaauuaauuggcaugaagagacuggguuaacccagagccagaaugacaugacaaacaauugaucaagcagcuaauccaugcaugaggacagggcaggcacacagauguuccaacacuuaacaagacaccugucucccucagacaucugucuucacagggauccauuacucaccaccaacuuugaaaaaugaacuacaauagcaucccacacuugggaagugauaaauguuccuuuaauuuuaauuuuuuuaacuuaaauuuuuauuccuuuagagacagggucucucacucuguuacccaggcuggagugcaguggugcaaugauagcucccugcagacuugaacacuuuugcucaagugauccuccuaccucagccucccaguagcugaaacuacaggcacacaccaccaugcccaguuaauuuuaauuuuaauuuuuaguagagaugaggucuugcuauguugcccagguuggucucaaauuccugggcucaagcaauccucccaccacggccucccaaagugcugggauuacaggugugaaccacccuuuaguuuuuuuuuuuucuaggagaacuacauugaccagucuuaaaucugauuuuuuuuuuuuuugaaacagaguuucgcucuugucacccaggauggagugcaguggcgugaucuuggcucacugcaaccucugccucccagguucaagcgauucucccgccucaacuuccugaguagcugggaguacagguaugcaucaccacacccggcuaauuuuugcauuuuuaguagagacggugcuucaccauguuguccaggcuggucucaaacuccugaccucaagugauucgccugccucagccucccaaagugcugggaucauaggcgugagccaccacaccuggcuuaaaucugauuaaaaaaaaaaaaaaaaaaaaaaagaauugggaggcgguaguaaaaaaacucaaucgccaaaaaggugauaacucagugugaucauugcauacgucacgcagguaggagcuaaacuaggaacucugaugguaggugcuuuucagagcccauaagcuaccugucaucaacaauccagacacuggguuuaaacucuuugguggacuuaauaaggagcugaacaaaauauaaacugccaaagcuggggaggcuggguauuaaguuuggauuugaagcccaauauuucguuuauccagcauaagagaauccaguaucuuucuacuguauaguacaaggcaacuuauuuucaaggaauuggaaauuuucuauuuaaaauuuguuuucuccauccccaggaaaugaaaaaagggaaaagugauucuuucccucuuauaaaugaaggaccugucacuuggaagaaggggcuucucauagacccacaggauuuuagcuaggcacaauauucugguucuagauugcauggguggguuugugggcaagaacaauggccuuggcucagugaaauuuuacagaaggaccagccugucucuggacucugugaagugucuugucuaggaaaacaugauacauauacccauagccugaugccuuccaggauaacagggucugcuuuucccacaaauacuuuccuuugccucaggcgaggcagagcaugauucuuguuuacaguggaggaaaguaaggcucagugagugucuugcucaguagcacaauuauuaaguagucaguuuuccuuggguagcuccuuaacuaugaagauaugacaucucuaguucugggcuugaagucccagcacuuuaaauagguuccugauuuuuaauuccacagaauuugggcuacuaagaaagacuauuccauggagaaguugggcuggggucuuauguugaaagaagccacuccuugcuugagauauuacccaaaagacuucuucggccugccuuaggcaagacagucaaagacuuggaggcuauacauaggagggaaaccagacuauacucagauccagcaccuucuguuuuucucauuugccuggaggaggucaggcuuugaaucagaaaugcucuggccugggaggcucacagagacugaaaaauaaaacaaaacaacaaaaaaacaaauaaaaucuccaagcugcauauuugaagaaggaaacuuaggucauugguacugcaguaaaucccaaagaccaggugccuggguacaggcuggcugaucccacucugggugguauucacagccacucugauucagucauguauaaaauuagucaauuucuagacccaguccccagaucuccuaagugugccuucugcagaaacacaacuucuauuuuaugagaucuucccacagcagaggcuccaguggcuggguuuuauuccucucucaucucagguacuucacugugggggucacaauggggagagaaggcuagugagacucccucuuccuuuuaagaaggaggaaggggaagccaaagcaggugaugacuuugccuccagggccuacuguuuauuaguccucagcaucauccaggcagauuguuuaaagaaaaaaacccccaaaccaggagccacaucuauuucccaagggcuugucuguacauaaagucagaagaauucuacauuggcuucaagauaacuuucccuccugguuucagcauuauacccugcauguuauuccuuuugaauccaaacugaugucaggagaggagacagaggucugaaaaacccaaauuggucuugugaaaguucuagucuguguauuuacaaaucugcucuuuuuuguaccaaacaguccaucuucucuuagggguagaaagugugcccuuucuaugucccagcacuuucuagauacaaauacauauaacugugaucacauucauugguuugaucaaugguauacacaccaucuccucaacuaugauucacucuaugaaaucaggccaaauagcuuuguaacaggaagagacucccugacauugugaguaggugguuuaaacacuguuucuuuucuggccuuaaagaggcagagcgaagcagauuaggcgagcauucuggagaagguggucuguucuggaugcauugggauacagaccuugcgggcacucuuccacauguuuuucauguaggcauaggucaccugagggugaacuguuggcagaggauggucaaguugccgagacggaucaacucccaggagcaacacuaaaguuuuaugagcaagagccuuaaaaauaagagaaacuggguuauagacagaacuggacagcccagggacaccauggggcccuaccugcccaugugggugggugguugucacucaccagccugccacucuugccgcacaggcuugcauacuugagccagguucucaugucuucaugagggcugaccacaagggaccgcaccauaaggauuuucugccaguccucuacgauacgcuggcagcccuggaacauucagaagugaagauuagauaugucuucugauacauuguuuuuguggcagagucuugcucugucgcccaggcuggagugcaguggugcaaucuuggcucacugcaaccucugccucccggguucaagcaauucuccugccucagccucccgaguagcggggauuacaggcgugugccaucaugccuggcuaaguuuuguauuuuuaguagagacgggguuucagcaucuuggccaggcuggucuugaauuccugaccucgugauccaaccgucuuggccucccaaagugcugggauuacaggcgugagccagcacgcccggccuuuucuuguauuuuuaauagagaugguguuucaccaugauggcaaggcugcucucgaacuccugaccuuaacugaucugccugcuucggcucccaaaguucugggauuacaggcacgagccaccaugccuggccuucugauacauuuuaacuucccugcaagccacagccaauuccacugugaaacacaacagagauuugcugauagaaucucagcuuucucagguuaaggguacugugagugaaauacccuuaggcagcaguccccaaccuuuuuggcaccagggacuaguuuuguggaagacaauuauuccacagauuggguggggggcggggggaugguuuucagaugaucaucaggcauuagauucucauaaggagcaugcaaccuggaucccuugcaugcgcaguucauaauacgguucaugcuccugugagaauccaauguggcugccgaucugacaggagguggagcuugcccaucccucaccuccugcugugccucccgguuccuaacaggcuacucaccgguccccggccccgggucuggggaccccugcccuuaggggcgucucagcaguuugagagaugguauagcauggguuuggagcuugaauccugccucugucacuugcuacccuaugugacuuugggcaaaucacuuaaccucugacagaucuguaggguggaauaaaaauaguaccaguuucauagggauacggugaggauuaaauaaauuaaaugauugauuucaauuuauuuugugaauggugaauaacacauaauacaucuucaacuuuaaaauuuuguuucagucuuucugguugaagaugacuaucacugauaaagauauuaaauuuaaaauguaucauucaaaguugaaaaaugaauuaaauguaaagaaguuuaaaaauuuuugaagugacauuguuuuuaaguugguagcauuuauauuucugaaguuauuaaagccuaaaccuccauuaagacuucugaaaaaaaaaaaaaaaagacuguugagaugccauguauguuggcaucuuagauucuuucuucuucauuucuacuagucucagaucaaaaaguauacacagaaggggaaaugcuucauuuaguuacacuuagaaauucuucuuucuuuuuuuuugauagggucucacucugucacccaggcuggaguaaaguggugcaaucauggcucacugcagccucaaccucccagguucaagcgauccucccgccucaaccuccugaguagcugggacuaugggcgcacaucacaucuggcuaauuuuuguauuuuuugaagagaugggguuuugccacauugccaaggccggucucaaacuccugggcuuaagcuaucugccugccucagccucccaaugugcugggauuacaggugggaucguucuugucucccaggcuggagugcaguggcucggucucggcucacugcaaccucugccuccaagguucaagcgauucuucugccucagccuccugaguagcuggaacuacaggugugugccaccaugccuggcuaauuuuuguauuuuuaguagauacgggguuuugcuauguuggccagccuggucuugaacuccugaccucaagcaauccacccaccucggccuccuaaagggcugggauuacaggcaugagccacugugccuggccacaaauucuuuauaauuaaaaaaaaaaaagaaaaaaggcggggcacgguggcucaugccuguaaucccagcacuuugggaggcugagguggggggaucacaaggucaggagaucgagaucauccuggcuaauacggugaaaccccgucucuacuaaaaaauaaaaaaaauaauaaaaaaaaaauuagccaggcgugguggugggcgccuguagucccagcuacucaggaggcugaggcagaagaauggcgugaacuugggaggcggagcuugcaguaagccgagaucgugccacugcacuccagacugggggacucagcgagacuccgucucaaaaauaaauaaauaaauaaauaaauaaaauaaaauaauaaaaaagugaauuaauuaucaaaggggcuuaagcuaauuuuacaucuaacaacuauagagagucagguuggggacggcugccuaaggguauuucacucacaguacccuuaaccugagauucuaucagcaaaucuccguuguguuucacaguggauuuggcuguggcuugcagggaaguuaaaauguaucagaaggccaggcaugguggcucaugccuguaaucccagaacuuugggagcagaagcaggcagaacuccuuuuuuuuuggagauggaguaucauucugucccucaggcuggagugcaguggcgcaaucuuggcucacugcaaccucugccucccagguccaagcgauucuccugccucagccucccaaggagcugggauuacaggugugcgccaccacgccuggcuaauuuuuguauuuuuuucuuuuagcagagaggggguuucucuauguuggccaggcuaagucucaaacuccugaccucaagcaauccaccugccucagccucccaaagugcugggauuacaggugugagccaccaugccuggccaagugaacuccuuuuucauccuuguugauaagaagucagacucagaaggggaguuccugagaucuacugcuucaugguaaauuccaugaacccauggagcuguccuccauggagauaaacuuaaaagucuagcgacaaugaucucaggcuuuuagcuaugauaagaugcagucugagccugacuggagaacccaaggcuagaagagacccagcgccaguaaggcugaccucucuaacugcccuaugggagggucuuaggaaccaaaagcauuggugcaacuccaaagaaaaguaacaaacauguauuuuuccacuacuauaauacugguuggggauuuuaauuuaaaugauuugaccacaaaauggcaguuuucuagccccagcaguucauuugacagcaagccauccacaagagccaaauuuccacuauaaauguaaugcuuuacuuucaggccuuggaccacauuuuuccaucccaugaagugugacaacaaugauuucgaaaguuaaaauaacagaaaaaaguacacugagugauuguuuuuugugacuucucaccaauaguuagguucucccagaugcugaaauaauuuggccuccuguaagccaaaaagcaucuugcugccucaagauaggaaagucacgaaggcuuaaggugguggcaguguccuggacccaguaaagucagacaggcaucucucuucccaggacucauuccaugccuccccucuccucuaagucuacauuuggaucaagucccacuugucagacugucagaagguucaucagaucucugcuguagaaacucuuuauuauaggcauuucaaagaauugggguguguacaaaucaagugggaaaugcuuauuuguggaauucuuucuggugcccaggagacaauuuuccaucaaaacauucacugggcauuucauaauuacuaauaaaacauguaaaagaacuguaugugcucauuucagagccauaaaugacuguauucauagauguuccuuugcccauugcucuuuccuguccaggggaaugugcccugagcuuccuaggcaggaauguguuuggagucaaaagguuuugucgcagccuacugagacgccuggaagcacaaacuucgauuggucugaagcgagaauuuggaauuagcaauuagguggggaucuaguugagaggaaaugguuuauaauugcggggauggauuaugauagguagggagacaaaugguuucuggagugguaaaggcuuucucucuuuuuucuuuugcugaugaacuuccuauccuacccacucaaggaaugggauaacuggccauccuucccagaacauuuagacuccugacucccagaccuggagugacaguuucucauguuaaaaugaucagaaugugagaaugaaaacacugauggaggacuugggaaagcuucuucucuacaagcggaaacugcaguggaaaaaaagucucaauagaggcgacaggaugacucugaccuaaguagcuauaaauagcaggaguuggccaaugagaaccuaaggcaaccccaucugaaaagcuggugcagguggccuccaaguguaguuagagcagugguucuuagcuuuggcugguggaaucaucugggggaaccugaaaagauacugauccugagucucuccccagaaauuuaauuggccuggggaauagccugggcaucaggauuuuaaaaagcucugcaggugauucuacugugcugcuaagguugagaaccacugauuuugagguuaugauuccuaacugacuggucacaggugucacuuacuaaaaaacauuuuuuuuaauuccuagagaagagaauaagaagagacuggaaaauuggucauucucucacagcuuaaguuuaggugaggagccuuugaguauucugcuuuguaugcaagccaagcaauacacugguggaggaggcaggaaaagcaaguugaguaagagccaggguggaggggggcacucacccagguccuggaagggguagggguaggugggugaacuggggcuuucuaccaagcucaccugcagucucucccaccagaucuggcggaugaucucucgucgcucggggacaaguuuguacuggauaaccuccuccagcucggacagcauguggcaagaaaccauggccugauggaagcaaaucgcauuccaaacuaauuacugcacgaacaauccaaaagacaggauuaauuuaaaucauuccuucuggugucaggguaucugccgaucagagaaaacaggcauguuuccagcagccuguaaguucucaauagcccauucugaaaaaaguauggaaauaagccucaaaaaugacaaugugcagaauaguugacacuuaccccauaugcccgacuguaacucucuccugccaucgcaguuaauucagcauccagcaggucccuggccuugucaaugcacuagaagagaaacaacccuugggacugagcucuggacuugggagcuuaggguuauuuuagggcaccccaacuagcuacagaaguuaucugucucacuuaaauuccagggaugaaaagagaaauucgcugaagaagggcauuuucccagaacugaauggcuugagaggagguauuauccaauuucucaucgaagacagaaauguauggcauccaaaacuuuaacaucuaucuaagguaacacacaaaaucuuagguggcaagggcaugggaaugugggcuguaaaaccgaaucauggguucuugcaucucaagaggacauaacuggggaucuaccuuuuuuuuuucuucugagacacagucucacucugucacccaggcuggagugcaguggugugaucuuggcucacugcagucuccaccucccggguucaagugauucucuugccucagccucccaaguagcugggaugcugggguuacaggcgcccgccaccacgcccagcuaauuuuuguauuuuuaguagagauaggguuucuccauguugguucaagcgauucucuugccucagccucccaaguagcugggaugcugggguuacaggcgcccgccaccacgcccagcuaauuuuuguauuuuuaguagagauaggguuucaccauguugggcaggcuggucuugaacuccuggucucaagugauccgucugccucggccucccaaagugcugcgauuacaggugugagccacugugcccagccuggggaucuacccucuuuuaacuuuuucuugcugggcauguuuaugaaaauagauucugcacacacuucaauggcuccaggugguagcucuggcuuccaagcacccucuguccuuaugagggagugucucuaaaauuggcagagaugcccaauccuguccacaugaacgggaacucuugugucucugacagagacaaccaagaucuugguucucaucacacaaaugacagccugggggacgccacagcacugcaguuugaguuuccucugugccaucaauuaaaaaccccucaugcagagcuuuucccguuuuugaauguuuaagguuaauuauagugucccaaugccuuaagugcucagaucauuuacccgggcaccucaucuaagucucgugucugacaggguggaugggauuacuucauuauuucauucugcaagucagcauacuauuugcaaguaaguacuagcuuccucggaagguaaucaaugugugacaugccugcauggccagaagacccuugugacugauuucugcugcacagugagacugcuggcucucugaauccuaccuuuuggugaaauacagcuucucucuacaacaagggauacaaugaugacccaacaagcuaacuccaaaagcaaccgagacaguagcuuccagaacacauuugucccccucagaacaauaaguagccccagcugaccugcuggcagucuucugaguacaaugaaucaaaaccauucaaauguacucacagagccgaguaaacaucagaccugaaguacaacagcuucuuuaccaaagcaccgugggcuuagaagcacuacaaucuuuuccucacugagagaucugggugcauguagguuuuuaccuguugugccaaggagaagagguccugaugcagugccagcacagcucuauaaaaugccccaucaugggugucccgagggaucauacagguguauucuuccaugcugucccacugaccuauacacacacacauagacagaaagcaucaaggggguuggcugguugggcuaaaggcagcaucucaaauaggucuugccacuguuauuuuccuuuagcuugggauauaaacaagacaaauaaacuugagccucauguaccaaaauccugcagagccccuauacacacuaugcagguugacguaacaaaaaaagccacaucugucuuccaaacacaggacuccauggcugcccagggagcaucuugacagaugaggggaagugcaugagugugaagucugcacaucaagugggcugaaugcagcaccucauuauccuagagaacucucucagguuucuccaggugcaacaaaauugcuuucuuccuuacuacugagacagcucacaguucaaugguauguugggaaauuacauuuuccuccaaacaauugaaaauagccauuacacagaugauaggggacaggauuagacaaauagcuugcccauuucauucuggcaauaucuuugccucaggagggaggagauaaauauuuuaagcgacuccauuauaacaaaaagaugggcuaggucacagcacagugcucucugugucauauuagacaggggaaauagcugcauccgggaagagguauucacuucuccugguggggugaguauguaucaaaugccaggauuuccaagaccaucugcagaaaagauaucagcuucauuagcugcaaacuacagggcugccaauuuuacaaggcauuuuccugccucucacuccagaccaucggcucauccauucucuaugccucugggcacaagcaaauagcuaacaaugacuccucaggaagcaauuuguuuuugaaaaauguuccggaucuagcccagagcucaugaaaggaaaagguauaagcucugugacucaagagggacagaagaagagaauggagguagaggguuauguaacuuuccucugggcuccacaggugaagcuuuucaccagggacacucuacauauccucucccuucuuaucaagaccaucucuggaacacauauugauaauccucuuagcuggggcccagugucagaaauugacaugucugcagggauugaaaagaaaucucugcuuuaacucugggaguaggagugagguggguaagaauugggcagcaaagaggagaauagagacaauaaauggugaaaauguuuguaauugcuggaaaaggugaagggcagauggggguucauuauacuauaaucuucacuguuauauauauugggaaacuucuaaaauauaaguuaagaaauauuaacaaaaggagauagacaacuguccucucccuuuacuccugcuugggauaaaaacaugacauggggagcuccagcaaccaugcuagaucaugaggugaacuuuaaaauggaggcacaggcugagcaugcaaagcagaaaucuggaaaaaggcuaaugauaauagagccaaaauacuagucuggaaacgccuaccucuagauuucauuuauaagagaggaaaauaaaucaguaacuugcuuuaggcaaccaaagccaaauccuacugugguauaagaagaaauauguuuggucuuugucccuagugccugguauagagcuaucgaaaacccucugcauuuccugagugauaggaguguuccuuauuauucauaaugagccccuauugauuaugcugauaagguagaaugguuuaagaaaaaauuuauuuauugagaaggccaauuauagagaugacuuuaugacuuuaggcauagcuggaugcaggaaccuaaagagacuucuccucaucucucuuuaaaacaaaaaaauuagggccaggcgcuguggcucacaccuguaauuccagcacuuugggaggccgaggaggauggaucacgagaucaggaguucaagaccagccuggccaacauggugaaaccccgucucuacuaaaaauagaaaaauuagccgggcgugguggcagugccuggaaucccagcuacucggagggcugaggcagagaauugcuugaacccgggaggcggagguugcagugagccgagaucgugccacugcacuccagccugggugacagagcgagacuccaugucaaaaaaaaaaaauuauguguguguguguguguauauauauauauaauugguagagacggagugucacuauguugcccaggcugauuucaaacucccaggcucaagugauccuccugcccaagccucacagagugcugggauuacaggugugagucaccacacccagccuucucaucucuuauuucugcuuucaacugaagagguaaauggagacacagagaugcauacccuaguacccugcugaauguguagguguaugaccccacuaaccuuacagaauauccaaaccuauugccaaagagauugguucuuugaguagcaugugacuuaaacuuugccuuauguugucucucccuccuucuccccuuccaggauggggcugguuaccagaaagaccaaguaauuaucggguuugaacuuucagcccuguccacugacauccaggaaaggugaagagguugaaaaugaaaggcaauaaaaacucuugaacaaugagcuuccagguugaugaaggugcugggagggugaagguaaaccccaguaccacaggacagaagcuucugcacuccagacccuucuagaccuucccucauuguaccuguucaccucuaucuuuuauaauacccuuuauaauaaacaaguaaauguaaguaaagugucuccuuuuguucugugcgcuguccuggcaaauuaucaaaccugaggaggaggguuaugggaacccugauuuacagcuggucagugagaaacacaaaucacaaccuggaacuugugauuggcaucugaaguggggcgauauuuugggacgagcccuuaaccugugggaucugaugcuauuuccaaguagauagggucagaaaugaacuacuugacaccccacuggugucugcugacaauggcuugguguauggggaaaagcaucuggcaucaguacucugugugagugugcuaaguguguauuucucacccacuaaaucucaauuuugauuuugugcaccguuuuccuuggccuccccacgaagauccaauuuuccccaugucuaacaaguuaauaaaaaucaucagguagaaaggacagauggaagguguagaaguagguggauacagaccauuuuuacccuuccauagaccuggaucuccaccuagagccagcaccuuacucuucugaugcgagccccuagccucacucaccccauccuucacagggugccugugagggaagcuuuaccuaaaccccaugcagcugcagcagccauccgggccaucuuggcuugggucucaucauuaaccaggguccacuuuucacagcacugcugguggaguugaccccugaagaaaaugaauuauauagucagauuaauccaaaucuccuuaaacuaccaaucuuccucuccugccccuuggguuaggugaggacuacacaggaacuggacaccuuuaauaaaaaagcacauucuacuaggucacauaauagagaaucaaugggcuauuuguuguuucuaugacccggugcucguaauuuuucugggugaguuuaucaaggauaggaaccaugccuaacucugugauaugaaauguccugaacaucuggcucccuucauaaauauuaaauaacuucucuccuaugccaaagaauucugggcucuuucccuuuggcaggccuacagagaaagcaaucugaagagacgcaucuggacauucauuuugggcucaaagcuauagggagaacuggcuccuaaaaguauuauaccaaugguuucagucugaaaugaaacccagaugaaaucaaucuguacagaagaaaggcuccacaauggucacaucuaccagaaggcuagaugcugcuuauucucagaauuuugcacaauugcugaaugugaaggaggacuaugagauauugagauauaaauggugcuuaagacaccccaauaaacaaaagagaacauggaagcccuagaauagggucuugcuauugacuguugaaacucccucucauguuucgcuucucagugaaaaaaaauaaacucggcuauuaugcaaauccgagucccugauuucaugugagcuucaagaugcagcuaggagacuccuuaauuuuuccugcuuucugaaagacaugcugcaggaugauuuaacuuggcacuggagguggagucaugaggaagggcacaaguucuaaguggcccaggucagaagccucauggaacaugagcugcucugcgcucuaaggugguguaggagggcggggauaaagaugcugaagucaaucccugcagaaggaaucuaggcugagcucaccaagaagcugacuguggaccacgucuaggagagguacucagggccauuauccagcaucgcaguacagcagauauuaacuuuguugucucucuggcacaugaucaagaaaaccagggacacaagcacucuggcucaauacagagcugagaccaaaaagaggaacugguggccaugaugcccuaugcauuuacugaagcuccauuaagggaacaggauaaaccucuguguugguuuucugccaccgagacuuagaaaucuucacuccugggcccugcuagggguucccuuagagcaguaguucucaaacuacuaagugcaucagaauccccuggaaggcuccuucagauggcugggcuccacccucugaguuucugacucaguagugcugggauaggggcugagaaugugcauuuguaacaaguuucuaugugacgccaaaacugcuggaccaggggucacaguuugagaaccacuggcuuaaagcagaggcacagcucaucugcacagcauauuuuuguagggauccugacuagagguagaagagaaagcugcaugaucuccaaaugguccuuccaacccuauaguucaaaauuuacagcuggugaacacaagcaacuuggaugaaugcauccuucaugcaagcugucccuccuaacucagccucccucuauuauuuuuucaggaucagcugauucugugccacaggaccaaggauguaguuuuucuuuucaucuagagcaggaagcaaguucagugcugaaaucccacaaauuguuaccccaagagacaaagcagggagcaauguaggaacagcaacucagaagggcaagcccuagcagugaacuucgcacggccuucaccaugcagcugugugggaacagcugucagagcuuggucaguacacagacaagagcauugcucuuccacaaacauuuguuacaaaaaauaaugcagaauauaccgaguccuaccucucaagggcgguugggugaggggcaaaaccaaauaaauaaaaaacaugagauuguuuauggggcaacaacuaggauauguuuuucugauaccuuucacuacacauagggaggacuggguaaaaggugcacccucugagacuuugauuuucucaccuagcguucuggcaaaaaacgcagaaagugcuugcuuuggcagcacauauacuaaaauuggaacgauacagagaagauagcauggucccugaagauuuaaaacaaauaaaaagcuuaggaaguauucuuucauuuggaauggcuccauggcuccucuuaggguugagggccuaugaucucacucccgaggaaucuguucucaauaccuagcuguguggggaacaguuugaggaggggguucacuuuaguucacuuuggcugcaggcguggcugccugcaccauagggcugggcagggcagggggugcggguugccuagcucucacagccuccuggaggcagauaagaauggggaaaugggaagggucucagcucacuguuaacuccagaucauucuucaugucaccucugaugaacaucugccucaggcauauucaggauauacgcacacaaaagaaauuuagaaauugcacucuaaacagaauugacugaauaaaccguaucagaaaccugcauaugaucaggaaaaauauucugcuucuuucgacucguuuuaaaaccucuuuuagucucccacauucuuaaauccuuuggucagcauuacuagccacuuacgcuuuauggguaacuauaaaacgggaaagaacccaagaggucagagguauuugggacugagaacggcaacaucaggagaucgauaucacucagcucgguuuucucaacuucugugagccucaguuucuucaacuauaacacaaaggaauuggaggaaaccacaucucaagucucuuccaauguauccaaucugcuccuacuaacccagcuaggaaaaguggucaucuuuaaugugaaaggagaggaguggaaggggaaggggccaggagagguuucaagagggaagaaacaguggagaggauuucaaaaguagaaaaagaggcagaagaagagggcaauucaaagaauggaacgaaugaauguaggacuuggagaagagugaauaauuuggccagagcucagauuaugagagaaggguucacagagaaaugugcugaagaagcgggcuggugccauaauaggaaagacuuugaaugccaggcugugauauuuauauguaaauccaauggcaacagugaaacauugcaguauuuuaggaauugauuagaguugaauuuuaagaacacuuccaucucguuuuaucuuucucauaacaagauaugauuguaugacagcugauaugaaacuagaaaaauuguuuuugaaauaaugugaauaauucuuauuaacauacuuuucuuuugccuuagaucaguguuguccaauagagcuuucugugaugauggaaaaguucucuaugugcacuguccaauacagcagccacuggccacauguggcuacugaacaccuaaaaugugguaugacugaggaacugaauuucacauuuuauuuaauuuaaaaauagccauaaggccggaugcaguggcucacacccguaauccuagaccuuugagaggcugaggcagguggauuucuugagguugggaguucaagaccagccuggccaacauggcgaaaccccaucuccauuaaaaauacaaaaaucagccgggagugguggugcaugccuguaaucccagcuacucaggaggcuggggcaggaaaaucacuugacccugggaggugaagguugcagugagccgaaaucacagcacugcacuccagccugggugacagagugagacucugucucaaaaaaaaaaaaaaaaaaaaaaaaaaaaaaaaaaagccacauguggcuagaggcuaccauauuggacaauacagcuuuagauacuuguuggacugagaaaaacaacaacaacaacaacaacaacaacaacagcuuuaguuauauaaauaaauaaagcggauuuuaaaagacaugcuuccuaaauuuauugagguaaaugaacauggaauuuuuguuguuguuguuguugcccaggcuagugucaaacuucugggcucaagcaauccgccugccucagccucccaaaguuuugggauuacaggugugagccaccacacucagccuuuuaauguuaauuuauaaaaauaaauaacacuuccuauaaauaaaaaaauaaaaauaaauaaaaaucuuccuaaugaugguuaaaucagacaagccacuuucaaauaauuguggaauauuaucucucucucuauauauauauauaugauccaaugccuaaggcuaaguucacuaacauuaaauuuucaugcaaaacauuauaacaucuucuaucuuggggauguaguaauaacuuuauauuaagaaauaacagccaaacuuggcaacauaaugagacccuaucccuacaaaaaauaauuuaaaaaaauuagccaggcaugguggugcauuucuguaguuccuucuacucaggaggcugaggugggaggauugcuugaguccaggaguucaagaccacagugagcugugaucacaccacuguacuccacugagagacagauuaaaguccugccucuuaaaaaaaaaaaagaaggcugugcacaguggcucacaccuguaauccuagcacuuuggaaggccaaagagggaggaucgcuugaaccccaggaguucaaaaccagccuagacugcacugugagacuccgucucuacaaaaaauaaaaaaaauuagcccacugugguggugugugccuguagucucagcuacaagggaggcuaagguaguacagaaagacuacauguagugaaagaucauucuuuuagaagacuugcuuugauuuuguccaauauucuuaaacuuuccaaggcaggaaaugucuaaacaaauaaaaauuugccuauauuaaauagacuagauuuauugauaugaugaaauaucaugcagcuauuaaaaaaaugaggcaguagcucuacaggugcugauauggaacaguggccuagacuuguuaagugaaaacagcagagugcaaaaugguaaaaacagcacauugccgucaauguacaucccugugaugggggucaggauauacuacccugaaauauagcacaccuuggcauacugaauauuuuaagaaaauggcagcaaaaaaaaaauuacucugacucuccccugcccuuaugcccugaagcaggucauaacaucuaggaaaaauauuuugaccuuccccugaaggaggucauaaggcccucaugugagagaugccuucccuauaccuggaggaaagguacauccuuauuucugaagacagggggucacagagaagaaucugaacaaaaaggccuacuaaaaucccccauacugugcuccucauuguacagguccaaguuagauaucguuuccucccgguaucuuccaaggcugauuagggugcuuccuauuacccacagcccccugggcuccuuuguugaugguaucacaauguauuacgacagccugguugucuguccuguaagcucugggaaggcaggggcuguaacugucuugcucacggcugugucccuagggccuggcacagacacuagcaaugaauacacacgugauaguuacuggcugaaugaaggaacaguggacccucaguaucauguuccagagaaaguagggauaaccuacuagucgggagguagcauggaacuuuguuuuagucauuuauuuuuuauuuauuuuuauuuauuuuuuugagauagagucucgcucugucacucaggcuggagugcaguggugcaaucucagcucacugcaaccuccgccucccggguucaagugauccuccugccucagccucccgaguagcugggaucauaggccugcaacaccacguccaacuaauuguuuauuuuuaguggagacgagguuucgccauguuggccaggcuggucucaaacuccugacuucaaaugaucugccugccuuggccucccaaaggguugggauuacaggugugagccacugugcccggccuguuuuagucauuuaaaacugcaauuaaacaguuuaacaaugauaguauagcauuuuauuuuaacuauuuuuuaaaaguugcacuuguuguuggaaacagaauggaggccauuuuuucccuucaacauucccaagcaacucuccaaaccaaaaccuagccaaauguucucaguuacgcauuacuguugcuugcaccuggaguaccuguuuccccccuaccuucuccuuuaccuaucuccuaacucucaguccuuccuccaggaaguacugcaaaaucacccugcuuccuccuuugggcuuucaagguagcauggcucacacauuaucaacauccucucaggcuauaauaacccucuguuuacguggcugucucaucaaccucacaggaaaggccuguuuucuuguguauuuuguuuccuuggagccuggcauagugcuggacacacaguaagcauccgauauaggugaagcaccugaagagggcagucacuguucuucuuuccuaaaaacaucugcaagagcuaauuuuaaaaaucaagguugccaaguaagaauaugagcucuucacugggucaguaaagaucaggagaguagacaggagaaguagaucccaggagcacccccaaggcuguccuguccuagagcauuauaaaguuuaagugaaggccuuccuacuuagcagcugagauagaauggagagagaaaaacaccaaaagugaaagaugauuccugagaaguaucaaguggaacaaaaugagucugaagugagaacuccgugugggggaagccuuccuuucaaauccaaagaucaaagagacgaagucucuugcagccacacaugccaucauucuaggaagcucaccauucccccaaggccucgaggcagcgcaugcggcccagcaucagcucugggucguccuuguugguguccauuuucuugucauaggccacaagggcauccucccacucgugcaguuucucauaccagguagccuggaucuccuguuacaugggaaagaaagacugcugugagguacacagaagaagggaucacauuguuuaauccacauacucucuuuccuaaugugcugcuguacgcaugacacuucaccuaucacaguuacgucugggcuuggauuaaaaacaacuucagacaaucuggaggagugcugcuuggggaagguggaaauacugguuccuuggcacauggauggaaugauccugggauuaucugagagcagacgucaggccauacuccucccccauuauuuccuucccagacacaugggucaucagaacacaccaggaugugcggacacgaggacaggggaaaucauuuagggauagaagaaaacgucgaccagagcaccagagcuguuucaaaggugccaucgcuccgaucugcuggagugcugacacugggcuacuugacagggauggcagcugcuuuccugauggggccagaaagaccaggccucaucugcauguuugcuggaggaaaacaacucacuuuuuaaaaccucuugauucucugcauuucuuaacacauuuuuaaacuuucaggaaauaauaauuuaaaauauaacaccaccacuuaaaauuuuuuggaaagucuuuccccuauucuucuagagucucccauccaauguucccuccugcucagugcuuggcagguuuaccagugucaggggccaaaggagggauugcauuacccuagcagauggugugccacgcugaaagaggguguuguccacgugaguaggaggugcuacagucugaaaguuacagacuaugacucuccaaaugaucaggagacuguuuuauaugcuuucugucugcccuccaucucaguuucucuccugggcuacuucaucaucagcucaauaaaugacuauuuuugcacaggcaaggguaguggcucucuagggauuucuuuaacaacaauaugauucugcagugaaauuuguaugauauaaugcagggcccacacuaguuucucccauuacccucuuccccuuucuaaauaaaacugauguuugugcaguauguagacuaacaacuacucugcuaagcugucuaaaauaaucuuuucuucuugaaccucugaaaagaggucauuuaugcuggagauuguucccuuguaccuacuuucccuggucugguucuuucuggcagagccggugcccucugcugccccuagacuaauucugcugccauaaagucuuugcccaacaucaguggaguuugucaaaaugagcguaucuggcuccacguaaggcaaacuaucucaacuucauuuuucaagccuguccaaaauaauaucuauuaugccuaaauacaaaauaggaaacuuagaaaagagugacuacaaaaacuguaaaauuuaaaagcacugguagauuucucauuucaaauuucuauacuggguggaaaagaaaaaaaaaagagcuggugacuaauguguggcauacacucagcaugaacaagcagaggggagagggggcagcauauggagugggucaguuagaggguaggauauuuugaauugcaauagauugcagaaacuauaagguuuaagcaaugaaucacacaaaauucuaaugagauugcuguuacauaaauuuugcugagaaagcacaggcucugccaagaaaaagcaaaccauugucaagcuuaauaugauucagcuaccuaaauauaacagaaaauccaccacggguuuagcaauaauccuggagcuaauggccaccuuuggaaccugaagauggagaaaguuucauugaaggcuggcauucugaguaugggguauaaaccaucugcuggcagaucaccugaauaccagaugucugcggaguccuugucucaaucagcacuuucugggaucuaagcucuaaggauaucaaaggagagaacaucuugaucuagguggaguacaugaagugcccucucgcccuacuuucuucucucugcaaacaaggauuguggcaaggauggaugagauacaguucuuucacuuugccaucaucuggagaaaugcugucuuagucuaguuacagauaauaugugcuaaggccgggcauggugacucacgccuguaaucccagcacuuugggaggccgaggugggaggaucaccugaaguugggaguuugagacuagccugaucaacauggagaaacccugucucuaauaaaaacacaaaauuagcugagcgugguggugcaugccuguaaucccagcuucuugggaggcugaggcaggagaaucgcuugaacccaggagacagagguugcagugaaccaagaucgugccauugcacuccagccugggcaacaagagcaaaacuccgucucaaaaaaaaaaaaaagauaauaugugcuaaagauggcaaaagauucccuuaaacguuucauucuaauuuacuagcccuucugugaggcaaaaugcuagaugaucaaacaaaagccuguuaaauauucccaauuuuucucacuuuaacauccugggcuccugaucaaggcaaaccacaguaagcaaccuacaugacuaacaaaagguuccucaucaaauauauggaccuagagcuucuugaccuuccgggaauucaauacuaaguugauuaaguugaugcuuuauguauuuuagaaguuaucaaaaugcccugccaagaccacaaagaauaacagaaacauuuuaaauauugguaggccaaagauggcaguagggaaguagcuauguaagcaauaacgaacacaaaaaugccucaaugucagauaucaauuauagcauuuauuuauuuauuuauuuauuuauuuauuuauuuaauuuugaggcagaguuucgcucuuguugcucaggcuggagugcaauggaacaaucucagcucacugcaaccucugccucccagguucaagcgauucuccuguuucagccucccgaguagcugugauuacagguaugcaccaccaugccaggcuaauuuuguauuuuuaguagagaugggguuucuccauguuggucaggcuggucuugaacuccugaucucaggugaucugcccaucucggccucccaaagugcugggauuguaggcgugagccacugcgcccggcuguauagcauauauuuucuaaagaacuggccauggugucuuccuaaguaucuaaugaggauuaacuguggccuagacacaaugcaagcucccacaaagauaacucagaucaggggcaaaugccuuggcucuaaugucagacugcccugguucaaguccugguuuugccauuuauucacucugucagcucagaccaguucuuaaccugcugggaccacagucuccucaucuguaaaaugugauaacagcaguaaccacuucauagcauuguugugaggaccaaauuacaugaaguauauaaacacuuagcaaagggccaggcacaugcuaagaguuugauaaaaucagugcuuacugcauauucgaaucuacccucaugauuuaucucaguugaaauagagucccggagguuccaagauggccgaauaggaacagcuccagucuacagcucccagugugagcaaaacagaagacaggugauuucugcauuucaccugagguacuggguucaucucacuggggcuugucggacagugggugcaggacagugggugcagcccauggaauguaagccaaagcagggugaggcaucaccucaccccggaagcacaaggggucagggaauucccuuuccuagccaagggaaguugugacagauggcaccuggaaaaucgggucacucccacccuaaaacugcgcuuuuccaacggucuuagcaaauggcacaucaggagauuauaacccgugccuggcucagagggucccacgcccacggagccuugcucauugcuagcacagcagucugagaucaaacugcaaguaggcaacgaggcuggcggaggggugcccaccauugcugaggcuugaguagguaaacaaaguggccgggaagcuagaucuggguggagcccaccacagcucaaggaggccugccugccucuguagacuccaccucuaggggcagggcauagcugaacaaaaggcagcagaaacugcugcagacuuaaauguccccgucugacaccuuugaagacaauagugguucucccagaacagaguuugagaucugagaggcgacagacugccuccucaggugggucucugaccccccaguagccuaacugggaggcaccucccaguaggggccgacugacaccucacacggcugggugccccucugagacgaagcuuccagaggaacgaucaggcagcaacauuggcugcucugcaauauucgcuguucugcagccuccacuggugauacccaggcaaacggggucuggaguggaccuccagcaaacuccaacaaaacugcagcugaggguccugacuguuagaaguaaaacuaacaaacagaaaggacauccacaccaaaaccccaucuggacaucaccaucaucaaagaccaaaggcagauaaaaccacaaagauggggagaaaccagagcagaaaagcugaacauucuuaaaauaagagcgccucuuccccuccaaaggaacgcagcucuuugccagcaacggaacaaagcuggacggagaacaacuuugaugaguugaaagaagaaggcuucagaugaucaaacuuuuccaagcuaaaggaggauguucaaacccaucgcaaagaagcuaaaaaccuugaaaaaagaugagacgaauggcuaacuagaauaacugguguagagaagacauuaaaugaccugauggagaugaaaaccauggcaugagaacuacgugaugcaugcacaagcuucaguagccgauuugaucaacuggaagaaaggguaucagugacugaagaucaaaugaaugaaaugaagcgagaagagaaguuuagagaaaaaauaaaaagaaacaaacaaagccuccaagaaauaugggacuaugugaaaagaccaaaucuacgucugacugguguaccugaaagugacggggagugaaauagaaccaaguuggaaaacacucuucaggauauuauccaggagaacuuccccaaccuagcaaggcaggccaacauucaaauucaggaaauacagagaaagccacaaagauacuucucgagaagagcaacuccaaggcacauaauugucagauucaccaaaggugaaaugaaggaaaaaauguuaagggcagccagagagaaagguuggguuacccacaaagggaagcccaucagacuaacagcggaucucuuggcagaaacuccacaagccagaagagagugggggccaauauucaacauucuuaaagagaagaauuuucaacccagaauuucauauccagccaaacuaagcuucauaagugaaggaggaauaaaauacuuuacagacaagcaaaugcugagagauuuugucaccaccaggccugccuuacaagagcuccugaaggaagcacuaaacauggaaaggaacaaccgguaccagccacuccaaaaacaugccaaauuguaaagaccaucaaugcuaggaagaaaccgcaucaacuaacgagcaaaauaaccagcuaacaucauaaugacaggaucaaauucacacauaacaauauuaacuuuaaauguaaaugggcuaaaugcuccaauuaaaagacacagacuggcaaauuggauaaagagucaagacccaucagugugcuguauucaggagacccaucucacgugcagacacacacauaggcucaaaauaaagggauggaggaagaucuaccaagcaaauggaaaacaaaaaaaaagcagggguugcaauccuagucucugauaaaacagacuuuaaaccaacaaagaucaaaagagacaaagaaggcaacuauauaaugauaaagggaucaauucaacaagaagagcuaacuauccuaaauauauaugcgcccaguacaggagcacccagauucauaaagcaaguccuuagagaccuacaaagagacuuagacucccaaacaguaauaaugggagacuuuaacaccccacugucaacauuagacagaucaagacagaaaguuaacaaggauauccaggaauugaacucagcucugcgccaaguggaccuaauacacaucuacagaacucuccaccccaaaucaacagaauauacauucuucucagcaccacaucgcacuuauuccaaaauugaccacauaguuggaaguaaagcacuccucagcaaauguaaaagaacagaaauuauaacaaacugucucucagaccacagugcaaucaaacuagaacucaggauuaagaaacucauucaaaaccgcucaacuacauggaaacugaacaaccugcuccugaaugacuacuggguacauaaugaaaugaaggcagaaauaaagauguucuuugaaaccaaugagaacauagacaccacauaccagaaucuaugggauacauuuaaagcaggguguggagggaaauuuauagcacuaaaugcccacaagagaaagcaggaaagaucuaaaauugacacccuaacaucacaauuaaaagaacuagagaagcaagagcaaacacauucaaaagcuagcagaaggcaagaaauaacuaagaucagagcagaacugaaggagacagagacacaaaaaacccuucaaaaaaucaaugaauccaggagcugguuuuuugaaaaagaucaacaaaauugauagaccacuagcaagacuaauaaagaagaaaagagaggcuaggcgcgguggcucaugccuguaaucccagcacuuugggaggccgaggugggcggaucacgaggucaggagaucaagaccauccuggcuaacacggugaaaccccaucucuauaaaaaauuagccgggcuugguggcgggcgccuguagucccagcuacucaggaggcugaggcaggagaauugcaugaaccugggaggcggagcuuguagugagccgagaucaugccacugcacuccagccugggcgacagaguaagacucugccugaaaaaaaaaaaaaaaaaaaagagagagagagagaagaaucaaauaucaaaaaggcacauaaaaaaugauaaaggggauaucaccaccgaucccacagaaauacaaacuaccaucagagaauacuauaaacaccucaacacaaauaaacuagaaaaucuagaagaaauggauaaauuccuggacacauacacccucccaagacuaaaccaguaggaaguugaaucccugaauagaccaauaacuggcucugaaauugaggcaauaauuaauagccuaccaaacaaaaaaaguccaggacuagacagguucacagccgaauucuaccagugguacaaagaggagcugguaccauuccuucccucugaaacuauuccaauaaacagaaaaagagggacucuucccuaacucauuuuaugaggccagcaucauccugauaccaaagccuggcagagacacaacaaaacaagagaauuuuagaccaauaucccugaugaacauugaugcaaaaauccucaauaaaauacuggcaaacugaauccagcagcacaucaaaaagcuuaucaaccaugaucaagugggcuucaucccugggaugcaaggcugguucaacauaugcaaaucaauaaacguaauccaucauauaaacagaaccaaagacaaaaaccaugacuaccucaacagaugcagaaaaggccuucaagaaaauucaacagcgcuucaugcuaaaaacucucaauaaauuagguauugauggggcguaucucaaaauaauaagagauauuuaugacaaacccacagccaauaucauacugaaugggcaaaaacuggaagcauucccuuugaaaacuggcacaagacagggaugcccucucucaccacuccuauucaacaaaguguuggaaguucuggccaggacaaucaggcaggagaaagaaauaaaaggcaauuaggaaaagaggaagucaaauugucccuguuugcaggugacaugauuguauauuuagaaaaccccgucaucucagcccaaaaucuccuuaagcugauaagcaacuucagcaaagucucagaauacaaaaucaaugugcaaaaaucacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaacgaaauaaaagaggacacaaacaaauagaagaacauuccaugcucauggauaggaagaaucaauaucgugaaaauggccauacugcccaagguaauuuauagauucaaugccauccccaucaagcuaccaaugacuuucuucacagaauuggaaaaaacuacuuuaaaguucauauggaaccaaaaaagagcccgcaucgccaagacaauccuaagccaaaagaacaaagcuggaggcaucacgcuaccugacuucaaauuauacuacaaggcuacaguaaccaaacagcaugguacugguaccaaaacagagauauagaccaauggaacagaacagagcccucagaaauaauaccacacaucuacaaucaucugaucuuugacaaaccugacaaaaacaagcaaugggggaaggauucccuauuuaauaaauggugcugggaaaacuggcuagccauauguagaaaucugaaacuggaucccuuccuuacaucuuauacaaaaaucaauucaagauggauuaaagacuuaacaacguuagaccuaaaaccauaaaaacccuagaagaaaaccuaggcaauaccauucaggacauaggcaugggcaaggacuucacgucuaaaacaccaaaagcaauggcaacaaaagccaaaauugacaaaugggaucuaauuaaacuaaagagcuucugcacagcaaaagaaaccaccaucagagugaacaggcaaccuacagaaugggagaaaauuuuugcaaucuacccaucuaacaaagggcuaauauccagaaucuacaaagaacuuaaacaaauuuacaagaaaaaaucaaacaaccccaucaaaaagugggcaaaggagaugaacagacacuucucaaaagaagacauuuaugcagccaaaagacacaugaaaaaaugcucaucacuggccaucagagaaaugcaaaucaaaaccacaaugagauaccaucucacaccaguuagaaugacgaucauuaaaaagucaggaaacaacaggugcuggagaggauguggagaaauaggaacacuguuacacuguuggugggacuguaaacuaguucaaccauuguggaagacaguguggcgauuccucaaggaucuagaacuagaaauaccauuuaacccagccauaccauuacuggauauauacccaaaggauuauaaaucaugcugcuauaaagacacaugcacacaugagguuuauugcggcacuauucacaauagcaaagacuuggaaccaacccaaauguccaucaaugauagacuggauuaagaaaauguggcacauauacaccauggaauacuaugcagccauaaaaaaggaugaguucauguccauuguagggacauggaugaagcuggaaaccaucauucucagugaacuaucgcaaagacagaaaaccaaacacugcauguucucacucauaggugggaacugaacaaugagaacaccuggacacaggauggggaacaugacacaccggggccugucguggaguguggggagcggggagggauagcauuaggagauauuccuaauguaaaugacgaguuaaugggugcagcacaccaacauggcacauguguacauauguaacaaaccugcacguugugcacauguacccuagaacuuaaaguauaauuaaaaaaaaaaaagaaagaaauagagucccuacagacacaguuuaucucuuucauccugaagacugguaagucagcaucagacuguuaugaauuggagaaaaaacagaaaaggaaaguaacuuucugaaggucagggccaauaacucccuagccaagucucuaccuccugcuuuuccaaaaagaaugaggugcuuaccagcucuccaaaguguuucauggcauauucuaacacuccggccgcugccuccggcugcuguagcuuauuauuaaugcugagaaaacaaagggaaaagguaguuacacucaacaggucugaggguaggagaugugggggucauuugugggcagaugguucaccagcacuuugaggacaaugucuugcagaugcugaaagaguaucaauuaucuauuaccauccagaaagcucaguuuaaaucguuucaucugaaagagguuugugcucuccucccaugauucugggggucaguaaugggaacacucaucuugcugcucuguggcccuuccuuuaagagcagagacuaggcugggugugguggcucacgccuguaaucccagcacuuugggaggcugaggcgguuggaucacgaggucaggagaucaagaccauccuggcuaacaaggugaaacccugucucuacuaaaaauacaaaaaaauuagccgggcgugguggcaggcaccuguagucccagcuacucaggaggcugacgcgggagaauggcgugaaccugggaggcagagcuugcagugagccgagaccgugccacugcacuccagccugggggacagagugagacacugucucaaaaaaaaaaaaaaagagcauagacugguuuccucucagacgccggcaggcaggcaacaugugucuguuucugaaacaccagaaaccuuggauacgaaauuaucccuguuguaguacacaaucauaugagacuccucugaacuuuuuuuuuuuuuuuugagaccgggucuugcuauguuguccaggcuggucucggacuccugggcucaagugauccuccugccucagccuccugaguagcugggauuacagguacacaccacagcaccuggcuccucugaacuucuaagucuuaacuucucaucaguugccuucaguaguaggaauaacaaaauuaaucaaaaccaucagacucugugagugacacagguggcaccaagguuggggcaugcacgucaaugacagaacccugggagcuguggcaaugcagcccugcugaccguucugacagagcccacccccuucaaauucagaugccucccuagacccucuucaggggcuguucccuuccacccuuugcagaaggcugccaagggaccauaucuagaguuucuugaacuggccucuacuguagagaagcuuuucacuaaugacacccugcucugcugaugccaucuuuaggcuggaggacuguuaccacacugggacaacugggcagugccacugggaggccuggugccugcaguugguucaucagaggcugcuaggaggccuugaaaacagaguagccaugggggcuuagauccuuauuccuguaggaacuuaugcaacuaagcucaauacuaaauauaagccugaguuauggaaggaagggaaagaggggagggugaaggagcucgcuugagaaauccacaagaccacaaugauuauaucuguuuaaagguagggagcaaaaugugacacaucaaccugggagucuagacugguuuaaugagcaaggauccaguuuacugcuuugaguacaaacugucugcuugaccagaauuaauuuuuaagugguuuugggaaauuccaggauuugaguucaaugugguaauauggcaagaaauugcuguuauaaauauuauuuuuaaaaauccaaauuccaccacauuucuuccaauaaaaccaaaggaaauugcccagaaaucuaaagaagcuaacauuugugaaaguaauaaucuaaugccucauguuuacaaagcguuuucaaauaaucuuuccaauccaucacuucuuugaccccaugcaucccuaagagugggaagggagagguguuaucagaccuguuucacuaacggggaagcuaaagcccaggaaaggcagggauuuuccccaaggcccacaggaaucaggaaaguccccacaguaaaucaagcaccuuaugccucuuuguuaaggaaaaguugggggugaaacagccuuggauuuggagucagaagaugggguuuuuccccaugucagacugaucacaugcugacgugauaacaaguuugagggagacacaucucaccacaugugaugguaaaaacccaaucaucaugcauaaauguauacaaaaggauugaaacuuggguuuaacuuucuggaggucuaauucugccacuuauaagcugugugaucauaaauaagucguuucaaaaauuuuaauuuuuaauuuuuuuagguacauaguaggacauauuuaacucaucuuuuuugaauguaaauuccuuaucuauauaacagggcuaauaucaccuccuccuucagaggguucuucggggaauuaaacaaugaacaugcaauugcuaagcagguccuucaccuguguuuguccaagcauaaaagcugcuaaaacacagugauaugcuugucugcagaaauaacauacaccuacgguggagacuuaaguuaggacuaggaagucaucacugcgaauucccaauguuuccugaguagaacuguucgaguguccaguauccaguuucuaggcuccagauucguuggggaagcuaugcggcuggugcuucuugagcugguacuaagcaaggcaaugaaccagaauaugcuccauaaguuagccugcuacaaaauucggagauguuuuuaauuucagagugaaaccacggcaugaugguuucccuuaggaagcccuauaugagguuuucuaagcuaagaaugaaaagcaagucuaaagggaccuacuccacuguagguucauugggaagcaguucccaaugccacuuggccccauaaaucagguacugggcuuugugcccaaucacauggggcuggguaaacuguacuaauaauauuacuagguauagauuugggauuaucuaguuccuugaagccaaauaaagauuuuggaagcauaagaaaacaggaaaaaagaaagccaguggcugggcacagugguucaugccuguaaucccagcacuuugggagguugaggcaggaggauugcuugagcucaggaguuuuaaaccagccugggcaacacagugagaccccaucucuauuaaagaaaaauaauaauaaaaaaaaagaaagccaguauauagucuauauauuuuaaugauauggucccuguauuauuacaauggauucuugggaugaaggccaucuuuauuucaauccuauccuuuucuuuuuuuuuuuucuuuuuuuugagagauggaguuucacucuuguugcccaggcuggagugcaguggugugaucucaguucacugcaaccccugccucccagguuuaagugauucuccugccucagccucuggaguagcugggauuacaggcgcacaccaccacaccacacacgccgggcggccuugguaggaguaaaaaauuguucugauaaggaagauaaaguguucuucaccugaaccagaagaaacuaacucuaagaaacgacauaaaaaacugaggccgagguggguggaucaugaggucaggaguucgagaccagucuggccaauccagugaaaccccgucucuacuaaaaauacaaaaauuagcugggcgugguggcgggcaccuguaaucccagcuacucgggaggcugaggcaggagaauugcuugaacccaggagguggagguugcagugagccaagauuaugccacugcacuccagccugggcgacagagcuagacucuaucucaaaaaaaaaaaaaagaaaaagaaaauccaggaguucuaacaacugucuucaaucuugugcucuggaaaacauucuauuuucuuuucuucuuucuuucuuuuuuaaagagacagggucuugcucuguuauccaggcugaaguucaguggcacaaucauggcucacugcagccucaaucuccuggcucaagcaauccucuggccucggccucccaaacugcugggaugacaggugugaggcacugcaccuggccuccagccuauuuuuaaauuuuaacauuaccgaagcucgauucauuccgaggagaaaacaacaaaaacaaaaacaaauacaagucuuuuccuaauccacucucccaauuaucacagugcauaaaaaaugaguuuuacaacaaacugaucaaaauuaggaaguagugauuagggaccucgaaagagaaacaaauuuuaccuuaauacagcuacagccuugauauaccaccucuaaggacugaccagcauagcuuugcaaauuaaaaauguaaaaacauauggccuuaacuccuuuaagagagaguccaggccaggcacgguggcucaugccuguaauuccagagcuuugggaggccaagguaggaggauaaccugaagucaguaguuugagaccaggcuggccaacauggugaaaccccaucucuacuaaaaauacaaaaauuagccagguguuguggcacaugcuuguaaucccagcuacugggaaggcugaggcaggagaaucacuugaaccugggaagguugcagugagccaagauugugccacugcacuccagccugggcaacaagagcaaaacuccaucucaaaaaaaaaaaaaaaaagagagagggagaguccuaugacuuaucuguauaauauuucccaucugaauguguggaggcaggucaggcugcagacagagcucagugggcaggaaagagggcaacaggcugggcucacugggggaccaggccuuuaccaguggccauuaaacuugggggugcaccuugggauccaugauaagcucuuauugagcaguaagaacauaaucauuaaaaaauuacaacuuuggcugggcgcgguggcucacgccuguaaucccagcacuuugggaggcugaggugggcagaucacgaggucaggagaucgagaccauccuggcuaacauggugaaaccccgucucuacuaaaaauacaaaaaaguuagccaggcaugguggugggcgccuguauaguccuagcuacacaggagacugaggcaggagaauggcaugaacccgagagguggagcuugcugugagccgagaucacaccacugcauuccaaccugggugaccgcgagacucugucucaaaaaaaaaaaaaaaaaaaaauacaacuuugggccaggcgcgguggcucacgccuauaaccccagcacugugggaggccgaggugggcggaucacgaggucaggaguucgagaccagccuggccaacauggugaaaccccaucucuacuaaaaauacaaaaguuaguggagcgugguggcgaacgccuguaauugcagcuacucgggaggcugaggcaggaggaucacuugaacccaggagguggagguugcugagaucgcaccacugcacuccagccugagcgaaaaaagcaagacucugucucaaaaaaaaaaaaaaaaauuacaacuuugacuaaacucaugaaaaaugaacacucucgcucugagaaauuaauuucuuugucucugauuugagaaccugaagguaagaaggucacuguccauauccacucucuuuucuuuuuuuuuuuuugagaccgagucucacucugucacccaggcuggagugcaauggcacgaucucagcucacugcacccuccgcuucuuggguucaagcaauucuccugucuuagccuccugaguagccgggauuacuggugcccaccagcauaccuggcucauuuuuguauuuuuaguagagaugggguuuugccacguuggccaggcuggucuagaacuccugaccucaggugaucuguccgccucggucucccaaagugcugggauuacagaugugagccaccucgccuagcccacucucuuuuuuucacaacaaggucugguucuguuauccaagguggggugcaauggugcgaucucaggccacugcaaccuccacccccuggacucacgcaauccucccaccucagccucucaaaggccuacaccaccacacacauuauuauuuuuuuuuuguauuuuuaguagaaaugaaguuuugccguguugcccaggcuggucucgaacuccugagcucaagugaucugccugucucagccucccaaauuguuaggauuacaggcaugagccaccacgcccagccacaccuacucucuugauuguucaaagaauaaagagauuuuuagugaaccagcugcuaucagccuguguauuuauuuccucuucccccuuuuucacuuuaauuuccuacaggacuuucucccuaagcuacauuucucuuauuuccuucugaggaguucccaugcacgccucuaaagcugcuggagaauacuaauuauggauguggaugcucuggacagugaagucagcaggcuuauuaauccuggugaucaagagagucuguuaucuuguuugggaucuuaauuuuuucuucuuccuccaugccuucuggcacuccaucacgggaggcaacaagaagaagauacaagaagaagauaccaaaauaagaagagagcucaccauaugugccaggcacugcgcuuauuguuucuauguauuauuucgacccugugaaacuauuauuaauauucucauuuuauauaugaagaaaacacagcccaguaggucacaggcuauugccuucccuuaaaaggugacuuucucuuaaaaauguuaccacggaaaaguaucuuuagugccauguugagguaaagagaaaaaaguaucuuaaguaauaaugaaggguauacugcaagcucugcaaugggagggacaggcggugucuuagcuuucuccucuuggcaucaguaggcacccaggaauuagcuguaaaaugaacgagugugagcaaugggugggauguuuccauuaacucucucucuagaacucauugugcaggagaagggagcccuccugugccuucauuuuaacuuccucacuaacauuccucucuuacucccaagcucccaucucacauuuuuuauuuccuuccagaagcuacuaauaugccuccagccuuccacgugacaagucagcaugccaucacagcaggcuuuucaaagacagccaggcuuauaguucaggcugcaaagugcaggacaagcaagucucugugaaaaugcaggaguucacagccacuaagucccagaucuccugccuaccugggugauacaaagccguccuuugaauuaugucccuuuucuaaugagaugugguuuuuaugagacugaaggcagagacuguauguucggcuccugugaagaaaucaccuuugcucaaaagcccccuuagcgaggaacucuuguuuuacggggcagcugggaguuuuauaaagcccauucuauaaacacccccuugggugccccucagucuuucccuauuaaugcugcaggcuuauaaagggcaaacuguucaaagcuccagcccaacagaagaggaguacguaacaccacaaaccagacccugcugaugcuggucugguggaaaagaucugaacacaaacaaguuuaaagaaacugaggcuugucagcaacgugccuauaacagugugcagaaaugacaggucaaucagauuucccaucuccucuugacgccuacugaggccaaaaggaaaagagaacugagucccaagaauuuucuaaacuagugauucccacugccucccuaacaugggugugggguauguugguauucuacuccaguuuccaguuauaacauccaguugcuaucauacaguugugaaucuguagaacaaacagaaacugccuauccgcauaauagaauccagagcccacaaacugaaccuggcguuaggaagacaacgaagacaggcggaaaggagaacauggugaaucuggguaucaggggcagaaggaggccgcuguacagacauauucauucucauucauucuccacucuccccaccccagcccaagauugaauucugauuaaaggaggcugaauugcagagccuccuuucaucaaauucgaguuuugaauugagcugggaaaguucuuggcaaucaaggaaaacauuuucuagagcugagcagaacuaauacuaagaaauugccuugcugccuuccuauagcaaacaucacaccauuacgcugaacaucuuauccccacuauccagaaaccuuguucccaaggcagggcaagcaugcgagcugagcagcgggugguucagcugugcagacacuucccccggcaaaggcccugucaggagugacgguagagcagcucacgugggcaguggcgccugcugccuccccauagcccuuuccucucaggcucucccuagcagguuuuuuuuuuuuuuuugagacagggucucacucugucacccagacuggagugcaguggcgcaaucucggcucaccgcaaccucugccucccaggcucaaggauucucaugccucagucucuccaguagcugggauuacaggugcgcgccacuacugcccagcuaauuuuucuauuuuuaguaguagagauguguuuucaccauguuggccaggcuggucuugaacuccugaccucaaaugaucuaaccgccucagccucccaaagugcugggauuacaggcaugagccacugugcccagcccccucacugccuuuuauuggaggaggaugagauugacugaaauagugggucauuaacugcucaaggacuuaaugcugacccacagcaaagcagucuaaacgccuuuccugccaccugaagagaaaccuggagaacauugucucuggaagugcccucagucacggcuccacaggcuucuggacagaugcugaguccacaguaacuugacauggcagugccuccuugaguggcccacuugguuaucgcccucaucccucagucuuggugccgcgugaccucugggguucagagcaaagugaugcaagccucuuccacacaaggcggcgccugucggaaaguccucaggcagcaaggagcaucugcaggcacagcuggggcaacgcucaggcuuccccagcgcucccaucaggaauguaugagaacacacccacuggcuucccaaauggcuguggaccuucuuucuccugucuauuucuagugcagaccacagucugaguuucauuugguucccugucaagugagaauucucugaauuccccuggcgccaggcuggugacacaugcaucacagcugauggggcuguggcaggucugacugaaguggccugaccagccacacugaggccacccuggacacugcuuuggguccuaaccacuguaucaagcaguuucucucauggagugguaacugcuugagauucuccugucacuucucccagcacugaggcuuagcucugugcccaacgcaggauuaacaaccaaauagucugauuccuucuagggccaggaagaucugggguuggcuaggccuugaugucuuuaucaggaagcuaccuugggaaucugggaacaggagaauggucuggggaacucaagaaugaacagacuaauguagaagagaaaggacagcagggcagacagaagcaaaaugaaaacaucugaaaagugacggggcagaagguugggagggcugccggaaugcagacaggaggggaagugaagggaaacaaagccagaaucagaugaugaagacaguaccucugggucuggcagggcuggaacuuaggaaaaagaacuuuauauauuaagagaaggcuggccccauuacaagguuucaaagcuggggcauuugguguacuuggagcucuuggggaccuaaggcaccaagauaaaaaaaaguuuggugcaagagagguggccagcuuuagacagucaaaauagguuucuuuggcuaggcgcgguggcucaugccuguaaucccaccaccuugggaggccgagacaggaugacugcuugaggacaggaauucaagaccagccugagcaacauagcaagacuucgaaucuacaaaaaauuuaaaaauuagcugggugaggugaucugugucugcagucccagcuauuugggagacuaaggcgggaggaacacuugagcccacgagugugaggcugcagugggcuacaaucgcaccacugcacuccagacugggugacagagugagacucugucuccaaaaacaaaacaaaagauuccugaugucucaggcucagaguggccuaaaaauaaaaagaauucuuacuaugucuucauccuuguuucugucuggucacaguuuaaaugguuugucugucacaaugccuagaggacacgcuaaaucuguaugugagaaagugugagcccuuagaauaaagaggguagaauguuaacaguuuuugagauuaggaagugcgugggggaaugggggcgcgugugcaaaaaaacucaucuuuucaagauuggugaguggaaguaccacuuuuuaaaaagaaaaaaauggaggagggaaguugauuguaauauaaucaccuuuccaagauacuuuuaccugcgcauauucugcauaaaugcauauuuuauacauacuggugaugaaaguauagauacaauuuuguaugcugccuuuucacuaacacagguauuuuccacuccauucagucuucauaauugcuuuuacuggcugcauacccguuuccucccacugauagaucccauggcugguuagcagcagcacuuguuagauaccaggccaccaggagugcugcugauggcucccauucagcacucucuaugcuaagugaacuguccugcagaaguuuacaaagucagcucugggaauccuagugcccagccucggagaggaauacugcccagcgaugagcuggcaagcuggcccauuugacucaccgucuccaggcaucuccugguuggauauagggcccagguaccuuagcacaacccagaauaaggcagagagaggugcacaaccccagaaugucaaagcacacgacuuuugcuggccagguuugcaacugaggagccugucagaggcguguuguaaaaaugaugaauggcugucacauuuccaaggcucuggcugauuuagggagcuauuggcaggcacaccgcucccagcaugucagccaguuaauuacuuccaacuuuaucuuacuugucaacacuucuugacaaauuggccauuaucuuuuuauucuacaacaaugagcacugcuccuuuucuugugaugccugcagguucuucucccccuuucugcuucuucacauccagagagaaacaaagagcucugagagagacuacuagaaagaagcagcagucaggaaaaggauggggaaaaggagcaaaaggggugggcugauagagugacuccaaagcuaauguucaucucucuugacucaaaacugaggugauauuuuggguaaaguccugauuucuuggcuucugaauguccaagaacucugacucaguccauuauguggauaaaguugggaaacaaaacuuaaacaagcuggcaccuagugaucuggcagcuuguaacucuucacauuuaauuguagaagcagaugugagcuggucuuccacucuauuaaggaguugggccacaguguaggaauaaugaugcccauucuggguucagggaaaagaaaaaaccaugcccaccuucuugguaauggaugccucauggaagagaacuguggcacucuauaacuggauuaccaggauucacagccagugaaaaguccagaaauguuuggagagaccaguggugccccuacugauaucaucacugcaugaacagucagagguggccaugaggcagagcccagcaccuacuagauuucaucaguucuaagacacacauuuuuuucacaccuuaacaucucugaaauugggaugcagcauacaauucaagguuucagagcacugggacacaguguaacugcuagcacuuucuuucccucccccaguguuauauaaaaaucagaagcaguuucucuaagucagcauaagagcagucccauuaaaucuccagguagucugaaggauaagcuagcuuuuguagaagaguuuagggauaccacugaaauacagcaaguuucuccccuuagaagggucuuguuuuguaacaauagccccucuguccuuuuggccagcuuuaggagaaaccccagaacucuccucuucuuacaauuccucgcugauggcgagguuucuccacugaagagccuucccugggguucauaagacgcucugcaagagcaagcuguuacagugacccugggggaagucuugacagcagcuagaaguaaaugcaugcucuacugauaacuggugagagauguggccucuugggcugaaucuaaaagugcauuugaaaaaaaaaauggggcuacagcaaagauacaaacugcuucugcuuuugcucuuuucuccuacucuuugcagcauggagcuuuucuacaaaggacacagauucuuacaggcacacuggcccuucugaagucagcacgaacauagaaguuuggaaugugguuuuuuguuuguuuugagauagugucuuguucuguugcccacgcuggagugcaguggugcaaucauagcucacugcagccucaaacuccuggacucaagugauccuccugccuuggccuccugaguagcugagaccacaagcgcaugccaucaugccccacuaaacuuuuuacagagacaaggucuugcuauguuacccaggcuggucuugaacuccuggcuucaagcaauccuccugucuuggccucccaaagugcugggauuauaggagugagccacugcacccagccuggaauguguuuugcugugagcaaaaccucaccucuguggacugacugcuuuuucuuccagcagagguacagaaaaagaaaaggaccgcauaucuuuucuggaagccaggaaacaacuguaaaagcaggaaucauacuuucaagcagcacaauauuggcacccuggaaacauguguuuagaauuaagacaaagaguggguuuuguuugcccauuuagccccuugccugcagacuguaaaacccagucacccuugccauuaauugguugcucaggcauaacuggcacaaauccucuaacauucuuaaagaaugaccaggccuguuuuccaguuuguggugccuaagucaggguggagaugucuaacccaaagagaagcucuguaguucagagaacagcuuggugggguggacaugugaucuuguccugcaaccccugacaaggucuuaucucuagcuaagggugauuuacugaaauugcaauauaauggacauuugauuucccuuuggggacagaugagcuuuguuagguuacuggggauaaaauauggggacuacagcugcccagaaauaaggcagguuuuuuuuuuuuuuuugacggagucuugcucugucgccaggcuggagugcagcggugcgaucucggcucacugcaaccucuaccucccgaguucaagcaauucucuggccucagccucccaaguagcugggacuacaggagugugccaccacauccagcuaauuuuuguauuuuuaauagagacgggguuucaccacauuggccaggauggucuugauaucuugacuuuguaaucugcccgucuuggccucccaaagugcugggauuacaggcaugagccaccuugcccgcccgaaauaaggcaguuuuuauggggacauguuacuuucuucauuuugucaacauuagcuguugcaugcagccccuagggccagugcagguugaaguaaucagacaugucauuuacacuggcuucuggaauaaacaggagagggagaaaaccugaucucagauacucugugguccucuugcugaucaucuuccuaaguaaaaaaaaaagugaugagacacagccuggugaugucuaggaauauguaugcaauauauuauacaauaaggaagcuaccucaaguuauugauuuaaaaaauggggucaaagccggauguaguggugggcaccuguaauuccagcuacucgggaggcugaggcaagagaacugcuugaauccaggaggcggagguugcacugagcugagaccccaccacuacacucaagccugggcgacagagccagacuccaucucaaaauaaauaaacaaauaaaauaaaaauuaaaaagaggguugaaacaaaggaucucaacucucccaguuuucacuuucuuugauucuaugacuaagaccugaagaaggaaaacugaccccaugcaggacagaaugugaugcccuacagcgaagaccucaccacaguaaaacacuggaaacguccauggagagagacuguaagucuccauaauagauauuuagggggaagagaaccuucucuuugaaauucauuauuucauuugacaaguucuaauuuaguaugcauuuugucuuaggcuuuaugcuaagugcuagaugcuagagguacuguggaaaauaagagaaacauguucuuugcuuucgcagagcuuacagguuagagaaguagauacacaaaaaaguacaaaccgaggccaggugcaguggcucacaccuguaaucccagcacuuugggaggccaaggcaggcggaucaccugaggucaggaguucgagaccagccugaccgacauggagaaacccccucucuacuaaaaauacaaaauuagcaaggcauggcagugcaugacuguaaucccagcuacucaggaggcugaggcaagagaauugcuugaaccugggaggcggagguugcagugagcugagauugcgccacugcgcuccagccugggcaauaagagcgaaacuccaucuuaaaaaaaaaaaaaaaaguacaaacugaaauaagugcuuuuguggcaaauaccaugaagagaacagagugcuuagagaaaaacauggggauuuauggggauuuauguuagacuagaguagucagcaaauacuuuuaugacgagacaacaauuguguacuaaauaauacaauacuacuacuugguacaauacuacuacuugauauuugcuagacguugacuaugugucagauacuaguucaaguguuuuaugugcauuaucuauuuuuacacaaacauccuaauucaaguauacauaaauauaggagaauauaacaccuaaguguacaguuugaugaauuaucauaaagugaagacaucuuuguaauuaccacccagaccagaaacagaacacaaccagcugccagcagcucagaggcacugagcccccucccaaucacugcuccccucuguguccccagaggucuguaaacccuacucugacuucuaacacaaugggguuguuugcucaguuuuugagcuuaauuauauaaacauucaacacuauguuugugacaugcacccaggcugcugcacgucgcaacagcuuuuccuuucuauugcugaacaguauuucacggugugaauauaccaccauuuaccuaucuuacugcagaugaacacuuggauuguuuucaguguuuggcuauuacgagggguaguacgcggacacucuuguccaugucuucuggagcaugugugcuugcacuucugcuggaaaauaucuauagcagaauuguugaguuacauauaaggauauguuuagcuuuauaagauacugacagauuguuuuccaaaguggcuuuaccaauuuacauuucuaccaauaggacaugaaaagcccaauugcuucacaaucucugucaacauuugcuauuuucagccuuuuccauuucagcccuucugguuggugugcaguggcauuuuauuaugauuuaaauuuuuauuuccauaaugacuaaugagaugggauagcuuuucauguauuuauaagccuuuuggauaucuuugugaacuaagugccuguucacaucuuuugucaauauuuuauuuuuuucuuuuugagacagagucucucuauguugccuaggcugguuuccaacucuugggcucaagcaauccuuccaccucaaccucccgaguagcucagacuacagguacacaccacuguaccuggcuucuuuuaccaaucuuuuuauugugcuaccuuuuuccuccuuauuguuugauaagaguucuuuauacacucuggguauaauacauauacaauauugaagauaauagaaauauuucuugccuuucauucucuucauugugucuuccaaugaacagaaugacuacuuuuguugcauuucuuaauauuuuccuuuaugauugguguuuuuucuaucuuaagaaaucuuugcuuaucuuaggaagccacuuaaucuccuacguuauccucuauaaauuuuauuguuuuacuguucacacuuaagaguuuaaaucuccuggacuugagcuuuuguguguggugugagguaacgaucaacagucuuuucuuucagaaaaaggaucacugagggaaaaaaaaaaauuuucuucccccauaaggcuacugagcugacuuagcaguccuuuccucaccacucuguggugcuaccuuguuauaaaucaagugucuauaucacauggcuugagaggaaaggaauaaauacauaaauauaaauacacaaaauuaaguaucucuacauaugugggucuguuucuggacauuuaauucuguuccauuuguucauccaugucacuacuguacugccuuacuuacugcagcuuuaugauaaaucuugauauguaguaguguaacucuuccaaauuuauuuuccuuauccaaaaauaccuugguuauuuaacccuuugcuuuauuuaauucucaugaaaagccugugguaugagauaguuuugauuuuuaucuccauuucacagguuggcaaacucagagaaguaauauguccauggccacacagcaaccaagugcuagggagggauuagaauccagauuugucugcuucuaggccuaagaacucaagugcuauauguacuaccuccuuaauccuaaugccaaaugaccccgucaggguauuuaauaugaaugcauuacaauuuuaagaaauucucacguucuaaaucauucauuugcggugaaaaaaucuuguuugggcugugugugguggcucaggccuauaauccuagcacuucgggagguugagaugggaagaucucuugaggcuaggaguuccacaccagccucaacauagugagacuccgucucuacaaaaaaauuuaaaaacaggcaggcguguuggugugcgcuuguauucccagcuacuuuggaggcucaggcaggaggacugcuucagcucacgaguuccagguuucaguaagcuauaugauugcacuacagcacuccaggguggguaacagaaugagacuaugucucuaaaaaaaauaaaaaauaaaaaaaaauuguuuggcaauuaccaaggccacuuuccugguggaacucaggaaaacaauggaacaagagggaaaaaccucuaggauuccuucccaugucuacagaggaucagucccgcuccucaccugggcuccccgggcacggccccccuccaccucuccagcuuuagcuucugcugccauucuucuucccuuugacucuuaggccacacucgacuacuuacauucucccacuaguccaagucuuucacauagcugcaccuuugcuuacaacauccucucccauuccuggcuauuuccuccuuuuucuuuaaaaccuagguaucacuucucuagaaggcccuccuuguccucugugucucccauccuagcaugucacacuguccaagaguucagcugucuaacuagacugccagacacugggccagaauaaucgcuggauugugcaacuugaguggaggcuaacagagcuauaaaguccugacagaaaucagagagacuuuuuuuuuuuuuuuacuauauuccauaauuuaaaacugacucuggccaggugugguggcucaugccuguaauccuagcacuuugagaggcugaggcuggaggaucacuugagcccaggaguucgagaccagcccuggcaacacagugagacccccaucacuacaaaaaaaaaaaaagaaaagaaagaaagaaagaaagaaaaaaagauaguugggugugguggugcauaccugcaguccuagcuacucgggaggcugagguggauggaucacuugagacugggagguugaggcugcaaugagccaugguugccccauugcacucuagccugaacagagugaaacccugucacaaaacaaaacagaacaaaacaaaacaggacucuaagagaaggccugagagaaaagacuucuaauagguucaggacacauucuuugauagaaguggcaaauuagaaagcucagggaaaagauggaaauaucuucugugauggacuuggacuuucaguugagacaggaaugggauggagugcuagaaaggcagauauguggccgggcaugaugacucacaccuguaaucccagcacuuugggaggccgaggcggguggaucaacagaucaggagaucgagaccauccuggcuaacauggugaaacccugccuguacuaaaaaauacaaaaaauuagcugggcaugguggcaggugccuguagucccagcuacuugggaggcugaggcaggagaauuggcgugaacccgggaggcagagcuuccagugagccaagaucgugccacugcacuccagccuggacgacagagcaagacuccgucucaaaaaaaaaaaaaaaaaaaaaaaggcagauauucaacggcuguauagaguauggcaggcugugguuuuuucaaagacuucagaagaagugaaauauuccuuugagauacacaauuaaaacuaacagcaaggcagcuucuucugagauguauucauuccacaagcugagagugggcagcagucucuccaacggggcauuuucaagcaaaugggaucugaugcuccucucuggauagaaggagagaccaccccuaggugcuccccugcccugugacccucagacuaccuuggugccagcccaaggcagugcggcccaaacacugugaagucuuuugagaaccuccagguugaguacaaccucacugacuuuuuucauuaagaacaaaagcuuaauuuucauaaacaccuuuuccaggagcaccaagcuagcccucuuucaacaccagcaaaauggagaaaaggaaaaucuaaacaguauccaaccuagguuuuccagauuuugucaguuaauucccauuuuuaaggucacucugcucacugaaaggcagaagaaggauuuaaaagccucuuucagagaaggcaauaccauuuuaguccuccacauccuucaugguuuucucuacuggcuuagcugugcucaaaacaaggacuucuuuuuccuucauuuagauauucagaaucuaggacaucauaagguuguggauguuuuagaaaauagauaaucuucuggcaugagaaauauccuuaauuagcuauuuuuccucaaaacuggagggggggugaguauugacauuuggguagcuuaugcaauucaagagcuucugucuucugucuucaaguauugccuuauguuagaaauaaguuuccagaaaauaaaugucaaagaccagacacucaugcuaaaggcuagaugcuuccaauacaaacuuacgaaccuccuccuaccuuuccuaaaagggacuguuacaugggguacaaauaugaaugauuaauuuauuuucugcccacauauaagaaucaauucauaacacuuuccuguuugggugagcuacugggaagaauaaacaaaagcuggcuagaacuccacaaaguuccacuguucuuuugugcuuucucugcugcacuguuacaugagaguuccaaggcagcagggucacgugggaugcuauacaucagugguccccaaucuuuuuggcacuagggacugguuucguggaagacaauuuuucuauggaccaggguggggguggggagaugggggaugguuuugagguaaaacuguuccaccucagaucuucaggcaguacuuagauucucacaaggagcacgcaaccuagaucccucacaugugcaguucacaacaggguucacacuccugugaggaucuaaugcugccaccgaucugacaggaggcagagcucaggcgguaaugcucacucaccugccacucaccuccugcuguauggcccuauuccuaacaggccauggacaaguacaggucugcagccuggggauuagggaccccugcuauacaugacuguaugguacauagcacuucuguggcaugugguuuaagcucagugucauuugauggccaggagauccacuugaaaaucccuauuuuuagcagaccuuguaggaugccaauauuuggggccagagucucguuacuaaaaugaaugcuauggagcuaaggcuguggugcccagcugggcuagacauuugcaaaaagagagcagacuggcagacagugccaauucucaacagaaucuuuugauuagaaugccaaguugcuauaaggguaucaguaacauccucacccuuuagcaggcaaaggaggcuggguaugugagaaaacaaacucugauccaccugauccuccacugcuuuuugauucugagaaaaaaaaaaauuguucaguaacuccagcugccugaacagaaauuacuuucugaggagcuagaagcccugacuggaaaagagcucugggggauuauggcaugggaggagagcugucaggcaucaggcuuaugugggaaggacccacgcugacuacaacaguacaaguaacugccugaguggcuccauaacauggaaacagcaaucguauguuccaaagacagaguuacuguuuuaaggacagaggaaccuuuguauagauucuuagugaaaagcuuauuuuaaggauguuugcugaaacuccauguuuuucacauuucuuuucaaaagagcauuguccuucauauauaguacaugaaaaauuacaauauucauguuuuuuagauacaaagucauauacaaauagaggaggaauaauuucaaauugcaaaccauaccagcaaagaaagagggaaaugagacucuagauauggauuuauuaggugacagggauucuuuucucuauauuuuaauauauuuuccaaguuuugaaccacgggcuaaggaugggccuguucucuguccugccuagaaacugacagaagcaugggugaccaaucccagacaugcuuggcacugcugaguuuucaucucuguuguaaucuucugacaccuccuugcaaaauaucaaguguuauaugcuaauacuggcccucucuuuguugaaggagaaagcauguaaaaagacaacuguccaaacccuguggcuacaaagucuuuuuuuggcuuccuaagagauuuacucuauucuucuauuucuagaacuuuucuaaguuggaagauuucaaaugugagauaguguuagauccagguugaguaaggauuuuauaaaauacuaaauaaugaucagagaugggaauaaucagccuagauaaaagcauauucagcaggaugucaaaauauaccagauccucauauaaacagcauggauuacauuaacaggccucccugggugaguagcgucucuuucgccuaccuuacgcucaccccaugguuauauaaccuuuugaacggaauuuggaaauucuucugacccuguccugcuugcugauagaguugagccaguggcuggcaggggcauaaucuaauaggcgaaacuggaaacacacaaauucacaguccucuugucuuagcccagagacuguacaggcaaggaaagaaagacucgccccaucucccuccuccccuccucuggccuaaguugccgcugacuucacccaacaggcaccugacccucccagaugagcugggaggggcuaaagccuggugcagccaugguagggguggagguacaggcagcaaacaauauuuaagaugcugacuuguggagcauucgggcuuggaaggaaagcuauaggcuacccauucagcuccccugucagagacucaagcuuugagaaaggcuagcaaagagcaaggaaagagagaaaacaacaaaguggcgaggcccucagagugaaagcguaagguucagucagccugcugcagcuuugcagaccucagcugggcaucuccagacuccccugaaggaagagccuuccucacccaaacccacaaaagaugcugaaaaagccucucucagcugugaccuggcucugcauuuucaucguggccuuugucagccacccagcguggcugcagaagcucucuaagcacaagacaccagcacagccacagcucaaagcggccaacugcugugaggaggugaaggagcucaaggcccaaguugccaaccuuagcagccugcugagugaacugaacaagaagcaggagagggacugggucagcguggucaugcaggugauggagcuggagagcaacagcaagcgcauggagucgcggcucacagaugcugagagcaaguacuccgagaugaacaaccaaauugacaucaugcagcugcaggcagcacagacggucacucagaccuccgcagguaaggagaccaguccccugagggagcguggagugccuccccaucuacagcacugcuucuacauauccuggucaucagaaccacuacuggggccucuuuuguggguacacuuucccuuuaguaaaggcuuaugcaguauuuccuuugacuucuaaugcuauguaaguuuaccuaacaccuucacgggucucuuuuauccacacaguguuucagccuaccaucuuggagugcugagauacuacaugguuugcccaaagucacccagcaagucuuagaagcaggguucaagucuuccugauugguguagcucugcuacuuccucaccaagagcugacaggcuauaucucaagaaauuccaaggaagcaccaaacuguaacagcuguuccucuggaagcaaaguuuugccagaaacaguucucugguguuccuaagauuuaccaggaaugagcauuaauggaauuuuguguccucucucuguaaacguaacucuucucauuggcucagaguuaaguguagagacacauaaccaugugaagagucccuuuguguucaggaaggaugcggcuccuuaagguuccucaauugugauacgucuauuuuuuuccauggucuuaaaugaauuucuccgaauacaggauuuuuuaaaugcaaugcugaaauauagacuuaauaggccaaaaauaagauaaauuuaaucuuucuuuugcaaaauaacuuuuauuucugguuagcucagcucaggugggccaacaugaauuuacgguuuagagauaaaaauuugguuuucugaaauuaucaggaaaauauuaguuguaaggagcauauccuauagacaugucauuucuugcugauauaaaaaccauuggucccauuauaaacuacaugaagaacaaagacaugaucagcuucuacugacuaagucaaugguuaaccucagcucaaauuaagaaaaaguuuuaacaugaaaccaagcuugaaaauucuguuaccugaaccaacauguaucaaucacuuucuaagcauggacuuccgggcccucaguuugggauuagaaagguauucucaggccauuuuccagacaagugaguccugauuuggucugugagaugaaaccagacaugcggaagaccaggccagacagaggaaucugaccgugccacuuccugcucauccaaacaggaggcuuucucaccauccugcaaggagguucuuggggucaagugcagcucucccaccaggucucuugcucuucuugcccaggacaucauuccuuauuuuucuucucuaugaccaagugcucaguuacccuuauauucuauaaguagguagucccuuagaggaagcaguaaguuggugcuuucaccacuaagacgaaaugaagaauagugauggcgaaggcacacguacucuaccucccuuucccaaggugcucugcaagagaaccuaugugccucagacaacucccaucugccaucuuggugcuccucucuaaggucccagugcaguggucaccaagaaaagcaccccgagacauagcaggcaggaagcuucucuuggauaguaagggccgcagucucugaauccuaucagaaaaggcugucucuuccacuaugcucuuugauauuuagaauacagagcuuaaauccugcauaaaguagcagcuccauggcccuagaguaaaaaaacuggccagucugaugcucucauuucauuguuuuaacaaaacuucugggaggaaggccucaaagguucuucugaguguuuugaggugcuagcuggauggaaggggaaaauaugugauaauaaaaucuaucucccuuaauuauggucucagguggcaguagccaccaucucugaacaacaacaaaaacaaccaaccaggaaacaucaacaaaaccagacucuaugagauauucacgacugauuuguuauaguggcggcugucuaagaagucugaaucuaucugacaggaguaucuguuacguggcccucauacacuguaacauuucuagaauucauggcccagcuauagcagaauaauuuauuucagaguuaaccugaaaccaccuguuggaacgucccacuaaugcuauccaggugaagggcuucccuaccccucugcuccaccgcuaguaaagccaaaauacacccccucuggaucuccccauauccaccucucccaaaugcagacacugauggguaauuaacaccacugagaaucccaggguagaaauaaaggcucagucucuaaacacucaacucagauggagccacugggucuaaaugcucacccugugguuuguucucuuguagaugccaucuacgacugcucuucccucuaccagaagaacuaccgcaucucuggaguguauaagcuuccuccugaugacuuccugggcagcccugaacuggaggugaggucauuacagucacuggccaugcccuaauaccuguccuucacccccucaaggggacuacaacaacagggccauucacaguuuaaagaaaggaaaauucggcugggcgcaguggcucacaccuguaaucccagcacuaugggaggccgaggcagguggaucacuucaggucaggaguuuaagaccagccuggccaacauggugaaacccugucucuacuaaaaauacaaaaaaauuagccaggcaugguggugggcaccuguaaucccugcuacacaggaggauugcuugaacucaggaggcagagguugcagugagccgagaucacgccacugcacuauaaucugggagacaaagugagacuccauuucaauuaaaaaaaaaaaaaaaaaaaaggaaaacucaaacacaagcaaacacaccaaacaccacagagcuaugcaaacacucaguuuaugcccugcacuccaaacccaggcaucuguuuggccccuucaaaucauuaucagucaaacaacaagccuucuaacauagaucagaucauucuuauaaccaccacauaacuuaguuuaaaucucuugccauguccuagaacagcuauuccuugggggaggagaaaagaaaacacgaaggcagcaucaaauuaucuggauuuucacccaggcaugguggcucacaccuguaaucccaaguuuuuugggaggugaggugggcggaacaaucaccugaggucaggacuuugagaccagccuggccaacaugcugaaacccagucucuacuaaaaauacaaaaauuagcccaguguggugacaggcacucuggucccagcuacuaggaaggcaggagaaucacuggaacucaggagguggagguugcagugagccgagauugcaccacuguacucuagccugggcaacaagagugaaauucugcuucaaaaaaaaaaaaaguaucuggauuuuucccuccaagcuucaugugcacucacccccgggcccaauuugcaucguucuuccagagcaaugcaccacccaccccagcucaccagcaguggggcagcaucacugcccgagugagccagugugacugcgggagugcacacaucuacuggcucugcagggacaggaacagguugggaagccugcccucuugcuccugccuucugccccugcaagucccucaccagaguauccccucugcuucagguguucugugacauggagacuucaggcggaggcuggaccaucauccagagacgaaaaaguggccuugucuccuucuaccgggacuggaagcaguacaagcagggcuuuggcagcauccguggggacuucuggcuggggaacgaacacauccaccggcucuccagacagccaacccggcugcguguagagauggagguaagcacaaggccaggggccccaugacuggaccagugccaccacacaugaccgcguacaacuccgggggugccauuccuauucugauucaagacaaaucuguauauucauugugaugguuuuccugcaaguuguaauggaguugaggaaaaauagguauuuuuccuuucugcaacccccccaaccccccgacaaaaguggggcugcaggugggacaggaagaggccagacccaggccagaguagagcaaauucaacagucagcugugccgaacacuagucucugcucuggccgagcaugagguccuuuaggugcaaaucuuacugauacuguuuggggacccuugcugaaggucugaaagcacucacuauauccucauguuucucuuacagcagcucugugugggauucagcaaaaacauagcugcaccuuauaagcaggaaagugaggaauauagaaagagagacuaaucaaggccauauggugaaucaggaaagaaguucgagccuuguuuucugauucccagguuaacacaguaaacuggagguaaacaaguaauaaagucuuauuagauucacaccuauaaaaagauguuuggcuaugggacugucaggagagaagggguauagagacagcaugaaauggagccugcugcacuuucuuuaaggcucugcuccuccugacaggacugggagggcaaccugcgcuacgcugaguauagccacuuuguuuugggcaaugaacucaacagcuaucgccucuuccuggggaacuacacuggcaauguggggaacgacgcccuccaguaucauaacaacacagccuucagcaccaaggacaaggacaaugacaacugcuuggacaagugugcacagcuccgcaaaggugagauuuggggggaccggaaaggagaaguucagguacaagcucauaaucccacuugaggagaaagagugaauuauaacuguacaguugauauuccgguuuugguauucuuucugacccuggcucuaacuccuuaccugaugucuggucuaucacagucaacuuacuagcacugggucuguuucucaugccagguggcuacugguacaacugcugcacagacuccaaccucaauggaguguacuaccgccugggugagcacaauaagcaccuggauggcaucaccugguauggcuggcauggaucuaccuacucccucaaacggguggagaugaaaauccgcccagaagacuucaagccuuaaaaggaggcugccguggagcacggauacagaaacugagacacguggagacuggaugagggcagaugaggacaggaagagaguguuagaaaggguaggacugagaaacagccuauaaucuccaaagaaagaauaagucuccaaggagcacaaaaaaaucauauguaccaaggauguuacaguaaacaggaugaacuauuuaaacccacuggguccugccacauccuucucaaggugguagacugaguggggucucucugcccaagaucccugacauagcaguagcuugucuuuuccacaugauuugucugugaaagaaaauaauuuugagaucguuuuaucuauuuucucuacggcuuaggcuaugugagggcaaaacacaaaucccuuugcuaaaaagaaccauauuauuuugauucucaaaggauaggccuuugaguguuagagaaaggagugaaggaggcaggugggaaaugguauuucuauuuuuaaauccagugaaauuaucuugagucuacacauuauuuuuaaaacacaaaaauuguucggcuggaacugacccaggcuggacuugcggggaggaaacuccagggcacugcaucuggcgaucagacucugagcacugccccugcucgccuuggucauguacagcacugaaaggaaugaagcaccagcaggagguggacagagucucucauggaugccggcacaaaacugccuuaaaauauucauaguuaauacagguauaucuauuuuuauuuacuuuguaagaaacaagcucaaggagcuuccuuuuaaauuuugucuguaggaaaugguugaaaacugaagguagaugguguuauaguuaauaauaaaugcuguaaauaagcaucucacuuuguaaaaauaaaauauugugguuuuguuuuaaacauucaacguuucuuuuccuucuacaauaaacacuuucaaaaugugaguaucuucuuuuuaaauucuuaccauuaccacuuacagcaggauaaaaaguuaaaguuaaaucagagggugagcagugacagaggcccgggguuuguuuugguguucagggcaaccaagcggggagcagaagccaaaagggaacagguaagggacaaaagggcagcaaccaggacaauucuucauaaaggggauuacacgucuggggcugggcagugaaggcauccagccuuaucagacccucuauucuacuuaggauagagaagcaaaaacaggccagcagaccuuacccuaaugcucggggcuaaccaaguaaaaguggugugugugcgcuuucuaacaaauaaccacucaauccucuguccccaagaaagcaaauauauuuacugauaugugagcuuuaaggagauggggguaguuuauacuaucucaguguuagcccugauuugggauuacaucucggauuuaauuugcccuguagcagauagguuaaaaaagucaauagguugcaagacggauugaacuaguagcaagagaacaauacugucaacagaacacaguuuuuuaaagcaaagacaaaaaaauaagaaauagcugcacgcgguggcucacgccuguaaucccagcacuuuaggaggccgaggcggguggaucacgaggucaagagagugagaccauccuggccaacauggugaaaccccuuucuacuaaaaauacaaaaauuagcugggcaugguggcaugcgccuguagucccagcuacuuaggaagcugaggcaggagaaucgcuugcaucuaggagguggagguugcagugagccaagauugugccacugcacuccagccuggagacagagcgcgacuccaucuaaaaaaaaaaaaaagaaaagaaaagaaaagaaauagcugaacaaagauguuuuuguguagggcuacccuaauuguuucaaaaagaauuuagggaaguugacucaaauguauauacuaaaauaagcucugaaaaagcagacaacuuggugaagggaaaauaagaguaggaaaaauaaaacaaagccuguggggguugggggaggguuaguaguaaaaacagguaagaugucuggaauuuguuggagguagaccaggaauuuagcuucaagcucucuagcagccacugugaggaaggaauucaaucccuuacugcaaagcgaugucuccaaggccagauccaaguaguggcucagggacauaaaaccaacagugggaaaagaccccugagaagaauuuccaugaggcucacccacagaacuagggguagugcuaugagcaacuuugucuaaggcuguuucuuaaaacuuccuucaguaaagacgacaguauaccaccacaaccgggcuuaggaaaagcagcuuuacaaaaucagaaguaaaaacugcaauuggaagcaaaaaaagaaaggugaugggaagacacaggagaccagcagaagggaggcagaaaugcaagcugagcugacuuagcugaggacacccaaagagccgagcacacuggcuuuccccaguaacagcauucauucauucacucauucauucacuuuuuuauugagacagaaucucgcugucauccaggcuagaguacagugacgcaaucuuggcucauugcaaccuccaccucccagguucaagcaauucuccugccuuagccucucaaggagcugggaauacagaugugcgccaccacacccagcuaauuuuuguauuuuuaguagagauggguguuucaccauguuggccaggcuggucucgaacuccugacaucaagugauccacccaccuuggccucccagagugcugggauuacaggugugaacuaccccgcccggccuggaacagcguuuuaaacaaaggacaagaucaaucuccagggaauucugaggauuuacuuucaauuauauuugcuuacaaagcuaaauaaccuucuagagcacuuuuccaggccucugacuauauuuuucugcuacaaaucugcauaacuuuaaguuuuuaugauuguaucaaauaugcggaaaaauuaaggguggaauugggaagguuucaaauaggucucaaacaggugagcaaggaaauuaauaugcaaaaugaguuaucugaccuuaaagugaucauacuuaguuaccguauuuucuaugagcuaucaagugacagcacauuaccuaagccagagauggaaggaagaaaguggauuuucacauuuacugugccugaugugaaacugaagcaugccucagaggacggcauguuuuuaauuauuccuacaugguauuucagaaaucaacauuuucuccaaguccaauuuauuugggcaaaaacaggauucuauuucuaucuuuucgcuaacuuuuuaaaguguuaaaggaacucuuuuaaauaucuucucaaaagcacagcuaggaaaggacuuggcuauuugauuacccucucaaacaaaggaggcucuauccuccuuugauagagccacacagcaggcucuaucagccacggugaaggaacuuacuagccagaugauuuuuucuaaacuaucugcagugaaaugaccgaccauuuagcauucacaugaagauaaugagaucccgaaguugauauucucugauaaucauuaggggaagugaaugguuuuuuaggagcuggagcuaauguuucaugcugcuuguaauuuccuaacagcagaaaauuuauuaaacgaacuauuuuuuccauacccagaagacugaaaacugucuuaacagaggagcgaacauaaccacaucagagaaaagaccauuagauuucagauuaugcucugccuuuuauauucacaaaacaccagaggaggaagaugcaggcaucaauagauuuaguugauaaaaccccacugugcccuugaguacccucugaagcccaggaaccagcacauucuacuccagcucuagacagcgcuaucuaacccagacauaaaaccuaucuuccuaggcugccauggccacagaauugcuucucaacuaaauuucacuggaacaagaaaggacagguuggaaaacaacaggagcccaggugauaagggucaacagaaaugacaaucauggcuagauuccuggggagagccaucugcaacaacaugucauuuaaacaugcuggccagacccagaggcagauuucacagagcagaagucuucaagugacuccagugaaguggcaccaggcagugggagaagagaggucauuuugcaugaaggcagcaauuaaaaaggguuuauggccuaccugaugagagauucuagaauggcagggguggggccuuucuggaacuccaguucuuuguaguguagugcuuuggcauaugcucggcacuuggcagcucucucacccagcagaacaaugccauugucaucucucaguggcagggggcccuggagaagagcaaaaccucacagcacaggaaaauggcagauggggcacaaacaagagaaggcuguguggaugcuucucuccucccaccagcugguucccugucagccuccaucuggacaauggggaaaagucucaccuugucacuguguuccaugaauucagccaaguuuaagagggucugugugacuucagcgaugucuugugaggugagggccaacucgaugcuucugaugagcucauccuguugaucuucauucaguucagaccagcaggacacaaaugcagcauugaagagaucccugaaggcagagaagguggaaaauggagagaccucccgugccucugccugcugccucaaagucacaccuaucaauucgcuuuuggcaucacugauuuugguuauacaaaccagugcuauacagaccagugcuguccaagagaauuuuccuguccaauaugguagccagugaucacuaaagcacuugaacuguggcaaguguggccaaggaacugaauuuuacauuuuauuuauuuuuaauuaaccacauauggcuagugucuacugaauuuuacacugcagguacagacauugugauauucagggacuuggggggcgaguggcagggcggggagaagagcagagcaaagugacuuuucuccaaaggaauauuucuuggcaguuuuugcauuauuucucuucacuggaggaaaugggaaaugaacaguauagggacuucuaacauagaaguuggcauuaacaaaugcagaaaauaauaaucauuaaaugauucuugggauguuucugggacaaugucuaaauucuuaaggucagaaaugucaaaggcagcaucugcaauugcuuucaaaauauaaccagaauccuuaguuggauggucauaaaaaaugacaacaggacuagaagcauuagcaaauaggauccaaauccuuaaguucuaaaagauuuucuaagccaacaguuggggccucacaaagacauggaaccagagguuccauuucaaagauuacuaugaccacuuuacauuaccacaguaccacaugauggacacauuugccaucccuuacaucuaacauuaauucuguccuccccacuguucuggugacugugcggggaaggaaaugggaaaaaacaggauauaccuacaauggauagauuuagcauuugaugccucuauaccuauuuucuguuacauauuaacagguuaaguuagaccaauguguauaauuuuggaauuugauagaaaaaacaaaauuugaaauccaaaggaucaaaugaagaccaaaaaaagucuguuauaaauuuaaaaauaaggccaggcgugguggcucacgccuguaaucccaguacuuuggggggcugaggcgggcggaucacaaggucaggagaucgagaccauccuggcuaacauggugaaaccccgucucuacuaaaaauacaaaaaauuagccgggcgcgguggugguggccuguagucccagcuucucaggaggcugaggcaggagaauggcuugaaccugggaggcagaguuugcagugagccaagaucacaccacugcacuccagccugggcaacagagcgagacucuguuucaaaaaaaaaaaaaaaauuaaaaguaaguuuucggagccagguaauuacagucgcuggucauccuggugacuugggaggcugaggcaggaggaucucuugagauuagcaguucaagaccagccagggcaauaaccaagaccuucaucucuaaaaucauaaaaaaaguuuuccugaucuaggucagaggccacauuggaucuugaaugaacguauuugggacuaaggggauaaaaacauuguguauaucacaagccucucauggauaacacugugcucagaggugacuggagagaaaagaggaauaauaaauacaucagcugaguacaugauaucuccacacuacggaaacagggaaguccuagaaacuauuuuaaagcauuaaaaaauacuugaaagaaauuagaggaugcaaaucauggcaucaaaccaacagucucaggggccaucacuacugcuaaauauauaucauaacagcaaaccagcugcugacaaaaaugaagugaaaugccuugcuuucugcuucuugccaaugcgaagggcugcuuauuaauuaaaucaccauuuuaugccucauuauaaauaauuaauauccaaugcagaaaaauuuaagaaauaaagaagagaauaaaaaagaaaauaaucacuccuuaagccuucccuaaagauaaccauugcuauauuacuuucuaaucuuuauccuauucacauuuauuuuaauuuucaauuuuguauuccauuuuauuuacuuacauuauauuauaaaucuuucacaugcauuagaaguuuuauaaaccaaaaaaaaauuuuuuugagaugcagucuugcucugccaucuaggcuggaaugcaggggcacgauuguggcucucugcagccucuaaacuccuggacucaaguaauccccccgccuuagccuccugaguagcuaggauuacagcuucaugccaccacgcuuggcuaauuuuucauuuuuguagagauagagucucgcuagguugcccaggcuggucuugaacucuuggccucaagugauccuccugucucagccuccuagagugcugagauuauaggcaggagccacaaugcccagccuguaaaccaaauuuuaaauggcuguuuaagauuuacuauuuaggccgggcacaguggcucaugccuguaaucccagcacucugggaggccgaggugggcagauugcgaggucaggagaucgagaccauccuggcuaacauggugaaaucccaucucuacuaaaaguacaaaaaauuggccaggugugcaccuguagucccagcucauugggaggcugaggcaggagaauggcuugaaccugggaaguagagguugcggugagccaagaucgcgccacugcacuccagccugggaaacagagcaaaacuccgucucaaaaaaaaaaaaaaaaaaaaagauuuacuauuuaaaacaauauuuuuuuuggcgggguugagggaugagaaauuaccugauagguacgauguacacuauuauucaggugaugguucuacgaaaagcccagacuucaccacuaugcaacauauccauguaacaaaccugcaccuguacuccaaaaucuauaaaaauuuuuaaaaauuaaaaaaaaaauggugaugacucaugccuauaaaucacggcacuuuuggaggcugaggcaggaugacugcuugaguccaggaguuugagaucagccugggcaacauagugagaccucgucucuacaaaaaauaaaauuagcugggccuggugcgugucugcagucccagcuacucaggaggcugacgugggaggaucacuugagcccaggagguugaggcugcagugagccgagaucgucccacugcacuccagcccgggcagcagagacccuguuuccaaaacaaaaacaaaaacaaaaaaccaggcggggcgugguggcucacgccuguaaucccagcacucugggaggccaaggcagguggaucauuugaggucaggaguucaagaccagccuggccaacauggugaaaccccacgucuacuaaaauuacaaaaaauagccgggcgugguggcgugugccuguacucccagcuacucgggaggcugaggcaggagaaucgcuugaacccaggagacggagguugcagugagccacaauugcgccacugcacuccagccugggugacagagcaagacuccaucucaaaaacaaaaacaaaaaugaaaacaaaaaaaccaaccaaacaacaacaacaaaaaaagaugucuaaagugaugaauaucccaauuauccugauuuguuuuauuacacauuauaugaauguaucgaaauaucacauguacuuugaaaauauauguacaucuauuauguaucaauaaaaaaaauuuuggccaaguggcucaugucuguaaucccagcacuuugaaaggccaaggugagcagaucacuugaggccaggaguugaagaccagccuggccaacauggcgaaaccccgucuuuacuaaaaauacaaaauuagcuggguguggugguacacaccuguaaucccagcuacacgggaggcugaggcaggagaaucucuugaaccaggaggcaggguugcagugagccacaacugugccacugcaguccagccugagcaacagaacaagacucucaaaaaaagaaaaaauaaauucuggcaaauucuauuuuccaaagaugucugcaacaguggcuccugucccauauagucuguuagaauauuacuucuccucucucaagaggugggugcccaugucuucuuccuuugagccugacugcgccuuuguggcugccuugagcaacagggcaaggcagaagugacucuucaugacuuccaagacucuuuaugacuuagaucauaaaaacaccaugcucuucuacuaccucguucucuugggacacucacucuugaagccagucaccaucugugagaaggcccaagcaaacucauggagugaucccauggagaggaaccaaggcccccagccagagcuggguuccuagucgagagucaccugcacuuugccagacacacaagccagccuugaaugcggauccuccauccugccccagucaaaccaucuccacugacaccauguggagcagaggcgagcugucccaaaaguccucccaaauugcagauucaggaguaaaauaaauaacuguuauuguuucagaccuuuuuuuuccugugguauuuguaacaaacagcaauaauuagaauaccauuguuauuggaaauagguuacauucaacuauuacacaguugcuuuuagaguuauaaauaacuuuguaauuaaaauguuagaccuaaagcuacuagaaaaaggaauuuguggucuacuagcaagguuaagauagaugcuacaguaugagcuuguugaauuugucuuucucuuucuuuguaucccacaaaauuagaaaaauuaaaaauaccagccccuugauuauuacuucuaauaaaaacuaauuuguauauaucguuuucuaugugcugaucuucuccacccgcccugacacacuauaccuggccaucggguuguaggccugugccagggcccagcaggagcgcagggagggcgaugaugaguccuucagcagcuccaggcucagccgucucagccauuccagccagucaucuuuggagacccuccuggcagcgccccaggccugugaucccacaggugacaauggaaaacaaucaguuucaagggccaauugaaaaaaguccucaucuauuuaaugauuauucuacuuuuagauuuauaaaauccaucuuucacgauaaaauuccccuagaguacaaauacaaaagaauaauauuuaauuaagaacagcaacucuggaacauaccacacuguggaaaaagccuguuucacaacuccuuugugcuggacucugacugcagcaaaggagcacuacagaaccagaauacaugggauugccacacucgggugcauucgacaaagccuaaugggcuccagcagggcaugaagggagcuguguccucugcauuagaacaccagcucaucugacagugaagagucacgcaagaagagggaaaaggcucagguuuacaccauagugaaucauguugcaaccaggugagcagugagcccaaagcacauggcacugugguaaaacaagaaaaagggguugaacagauuuaauuucuacucuauccccuccaacuucucucaaaacucugaacucuccagacaucaagaguuacuaccaggggcagcuuauucagguggguggaaaggcugagguuuuggagaacaguauaguguagugggcaacagcuacacuugacucaauggcuucaguucaaaucccaguuauauaacauaauuggcucucugaucuuuggcaagucacuuaacuccccugugccuuaguuuccucaucuguaaaaugaggauuauaguuucugcuuccugggguguuuuaaguuaauaaauguaaugaauuuauaacagugcuuggcacaaaguuaguacuauuugccuaguucucuaaaguuagaaacaccugccugggauccuggcucuuccacucagcagcuguaacacccugggcaaauuacuuguauuuugcagcugagccucagagugccucaucuaaggauaaugugucuaaauggcuuagccggaauaaaggagcaaaaaaugauuguuauuauugucaaaacaacaccuauuugaacuggccuaggccuaacuacacuaaaucccuaacuuuuaaaauauguucuucauagauuuuuccagcaggacacaucaauccucccuaaaugggggaaaucauguaagacagagcagaaggucucaaacuuuggacuagugaagugguccagugagugaaaagacccccaggugcuauaccaucaaggacucaaccaucaccucccugggauacacuggagaugugcuguugcuucuaaagaguuacggaugaauagaauuagacaaccuaucacuuuaugucaaaaaccgaagcagaaauguuacaagagacaaacuaaauaauaccacugaccauacaacgagaaccucugaaugagaaggaagagggagacuagauaccaaagacugauuuuuagaccuugcucuguugagcacaaugggaacauccaguccuuuccugcccacagauaccugguuucuucccuacaagauggguuuguguguagcuguauuauauuauacagcaauuguuaaaagcugcacauaaacagggaaguauuacuaguuucuuuuucccucuaaugaaaugagguugggccuggguaaggcagagacaauucaacacagugguuaagagagugggcucuggagucaugcuaucuaggucaaaucccagcuccaccauugaugcuaguugacacugggcaaauuacuuaacccgucagugccucacgguccacaucuguaaagugggacagcaacgacagcaccuaacucaugggguuaucaugaagauuaaaugaguuaauauaguguuccaccacagugcuugacacacggaaagcacucaauaaaugucaguuguuacuauuacuugauaaauggcaguaaauagguuuucaaaaaaucauagcuuaauuuauugacuaggccaagucccccauguggcccuuucccccugcucuguaaaacauuaucaacucucaauucucuggguucuauaacaacuguguaaacacgagcugcuuccucuugccauccacccacugcugaucgccucaucuggugaugcuggugccuguucauggaaugccagcuuacucauggugaagguaaacccaaacagauuaucauucagacagacaguaaagcugcugaaaauucuggaaggcauucuagaaguauacauaaaugguuuuuauguuuucuguaucacauaaaucuaauauuaucauaacaaauaaaauggugacugagguggcaaauuguuacucugaaaguugguuaagacugauaaaugcaccaaucccuaauuaucaucacaugauuauaaggaggcacaauuuacuucugaacaaugaggucugcugccuuuuuuugucguuguuguuggugagacagggucuugcucuguugccugugcuggaguggugaagugggaugaucacugcuuacugcagccuugaccucccaggcucaagagauccucccaccuuagccucucgaguagcugggacuacaggcaugcaccaccauguccagcuaauuuuuguauuuuuuguagagggggaauuuugccauguugccccagcuggucuugaacuccugggcucgaguaauccucccgccuggcuucccaaaguguuggaauuacaggcaugagccacugcaccuggcccccuaccucuuuuuuuuuuuuuuuuuugaagagaaucuugcucugucaccugggcuggagugcaguggcgcaaucauagcucacugcacccuggaacucaugggcucaagugaaccuccugccucagucuccugaguagcugggacuacaggcaggugccacucugcucagcuaauuuuuaaaauuuuuucaauuccuuuuuuuuuuuuuuuuuugagacagggucuuacucuguugcccaggcugaaauuaauuuuuuucauuuuucauuuuuauuauacagaugguguuucacuauguugcccaggcuggucucaaacuccugcuucaagugauucuuccauuuuggccugccaaauuacugagauuacaggcaugagccaccaugcccagcucccacaauuuacuucccaaugaaauagaucugagagugagcuguggaggauucugucuagaguuuugaacuugaucuacuuucucaggugagauaaacuaagagucuuucuuuugucuaucuggcaagguuuaugcuuauuuuuuccaagucuggguagaaagcaaaacuuccuggaagcaaacuagauuacugaggaauuuccuaaaauagagagaacaaagcucuaaagcaggguggacggcugccugguuggaaggacauucugaaccuagucaggaugaaaacaucuggguggaaauguacaucuggccuccugccuggccccucccuccagugugaggugucagcaggguggccucaaugauuaccugggaaugccaagugacugauaaccuuuuucuuccuccuaaagucucagaguagcaguuacaaaauccccagagggaaagcagcaucacuccugacccaggaauauuuuacuaccuccaucuuaacccagcaaacguuucuuagcaguggucacuugaagcuguuugugugaguaaagacucugaaacaacaguaauaaacccccagugcuccgcaaagcugggcgugagcccguacacaugcacaaaggacuguguucaaaucuuuauggguuuuuccaaaagaagugaacgagucagcuaggacacagucuugcccaguucuucaccucuaucugcugcugcacauggagugagauggcuaauagaugaaaaauaacacugaaaucuaaacuggaaguugcuuacagucaccagaaacaugaaagacuaaugcaaaauggaaaauacucgaugugguauauuuauuuaaaguuggugaaguaauuaugauuauugugcucugauucacuagagaugcuuugaaacugccuguuuuuagguggauagcugauggcauacauggugaaaagcuggucauaucuuaggcuuuggccagcagagauaauucaguaaucacuuggaaacaucuaaaaccucacuacucaaaguaugguccauggaccagcagcaucacauuagcuggcagcuugucagaaaugcagaauaucaggccccaaaucagacugccaacaacagaauaagcauuuuuacaagacucccagcaacugguaagcccaaugaguuugagaaguuugaaaagcacuguuugaaagagccuucaucagucucaaugccaacuagggggcucacuagcuuuguucccuucauguaaaaaaugagaauguauuugcaacaaaagguucuaccauccauauuccaagggagcacaaaaggacauuuuguucucuacuuuuucucuauucaaaacaaaauuacaauuuaggcaccuguaaaaagacaaaaugaucuaaguucaugguaucuagauuucuggaaaaaacaccugggcugguuuucgguugcccaguuuaaacaguuaaaaguuuugaguaagugagaagagcagagcucuccuuucccagucaccugaaacaauggacuugccuuuuggagguugauggugcugacgugcaguuucuucauggguccuguuuccacugguccacuagccaaugcauccccuuggccacuccuaagcauccgaugcugguaaaucaaaggauccuccucuucaucagcaaguguguaucccuacaaccaaagauuuauaggaaacaccuauaacucuacuagaugcuucugguuuaggaaauauccuuaaauuuugggaggugcagaccugguagagccaggauuucaguaagaaguaaaaaguugcacauauggacaaaaugaaccacagaugggcugacuccccaacuguagacagucuuugcuagucacuccuaguuacugacaagcacugacuuaguauuaagaucaagcaaccaugcaacuagcaaagauaaacaauugucggcaaugggaaaagugauaaaguguuuggagcaaagguggcaaacagcccccauccccuggcuuuuuaaaacuuuuuaaaaagaaucaucuauucacuuauuuauuugugccacucccuaccugccuaucuaaucgaaccuauuuauuuacuuauuuuuuugagacagagucuagcucugucucucaggcuggagugcaguagcgcaaucucagcucacugcaaccucugccuccuggguucaagcaauucucuugccugagccuccugaauaguugggacuacaggugcacaccaccaugcccggcuaauuuuuguauuuuuaauggagacgagguuucgccauguuggccaggcuggucuugaacuccugaccucaagugauccucccgccucagccucucaaaguugugggauuacaggcaugagccccugugccuagccuuuaaucuacuuugagauagggucucacucugccacccaggcuggagugcacuggugcaaucacagcucacugcagccucaggugauccucccacuucagccuccucgguaacugggaccacagguacccgccaucaugaccagcuaauuuuuuguauuuuuuguacagaugggguuuuaccauguugcccaggcuggucucaaacuccugggcucaagcaauccaccugccuuggccucccaaggcgggagccaccgcacccagcccucugccuguuuuuauauagcccaagagcuaagaaggguuuuuauacuuuuaaaugguuggggggaaaaaaaaucaaaagaagauugauauuuugcaacacaugaaaauugagagaaucaaauuuagguguccauaaauaaaguuuuaguggaaugcagccaggcucaucauuuacacauuguguauggcugcucucaggcuguaguggcagagcugaggagcugcaaaagagaccacauagucuacaaaacuggaaaaaaguuugccaaucccuaauuuacagccaaaaagcuacacaaacucccauagccaagauuacaagaauaucaaguaguaaagacaacagggacuucagaacagaaaagaaguauaguucaccuugacaauucugcagaugagcacaucauagcgcugaugauugauucggugucgcaccagaacuuuauucaccauuggaaugaaaauuugguacuaaaacaggagggggaagagaugagaaacuaucauuuuggagaguggagaaaaaguagaggaaaaaauauuauacaacuacauuaugaccauuucuucuggguuuguggcuagcucugugauauucaaaagaauccuucuucccaucucccguuauaauccuaguucaaguccccaucaucugguuuaugaugguggccucuuaacagaucuuugcuucugcccuugcccccgcagccuauuuucccacauggcauugaguuaucauuuaaaaauauuaagucagaucuuauuuuuccuguguucaaaguccaccaaaaacuuccagucuugcucagaguaaaagccaaaguacuuacaauggcccacaauagugauuugcauauuuuagugggcgucagaaucaccuggacagcucaugaaaccagagacugcugggcuccacagcuagaggaucugauucaguaggucuuaggugagaugaggucuugcucuguugcccaggcuggagugcaauggcacaauuaugggggucacugcagucuggaacuccugggcucaagcgaucccucugccuuagccuccugaguagcugggaccacaggcacguguuccuacgccuggcuaaguuuuaaauuuuuuuguggagacagggucuugcuaugucuggaguuggucuccaacuccugaucucaagcaauccucuugccucagccucccaaguugcuggaauuacgggugugagucacugugccuagcucaagaaucugcauuucuaacaaguucucagguauguagacacugauacugcuuguccaggaaugauauuuugagagcuccaggccuacaaaaucuagucucuacuauucugccuuaucuccaucaccuuaacuacaagcacuuccccauugcuugcuccucugaagucacacugcuuuccugcugugcccugaacucuuugagcaagcugccaccucaaccuuagcacuugcuauuucuucuccuugcauccaauucuuugcaaccaggccuuuauuuuaucuaggucucugcuugagugucaacugaucagaggucuucucugucuacccuaaauaaagagcacuucuccccacuucaacccaucacucuuaagaaacaaacuguuuauuugcuuugcuucaucaggauggaagcucuaugagagcaaggacuuuauucuguuuaccguguuacccccagaacggcacuuagcucacauagguugcucaauaaauguuugcugaacacaugaaaagaaaaaaagcaaguaauuccacguucucugaugguggcuggcaucagacaaagucugaguggcucacagacaaagucuucuuuccaaauaaggcagaagagcaccugucuguccagacucccaucuuaccuucuuccccagcugaaaaacaagugaagacagcguguccauggcuguggagcgcaguucugggcucugguccaguguucgaacaauagggugaaugauccgggaggcauagucagugaaauccagggacuccgucaggcgguccacagucucuagcgcugcccuacaacaaucacuaacauacaguaacugcuaacauacaaucuccaaggaagagacgugacugagggugagcuuaacaaucagcaccaaagggaugggaaugaacggcuucuaagguauuuuggaugacauggauccaacauuuauuccaaugggauagggacaguuaagauuuccauaaaccugggauauuucuagacuaaaauaaugugaguugaaauaacaaaaaaaauagaaagauggccugggaacuuaagaaaugaacauuuucaacaaaacauuaaagcuuaaagauugcuagucccaaagaggaggugcucacuuucgagauggcaguggagcuucaggggcaucaaacaacuuaacaauaggaggcagcaguaaaugcagguagucauccagguuggcgccaaacagcuggauugcagccaguaacugcaaaagggagcaaaagcauggugaugaauagucaggucccaaguaucuaaggacacgcagcggguggugguguagacaauucaaaguucucuggggacugggaaaacucuuuauuaaauggccuugaacuauauccuuuugauagcacuuucuuccccucauuuuauuugcuuacauauuacuuugcuuucucugugcuuauuugaguugauaaggaauccguugcuggaaaauaaagaaaauuagucugggauaaaauauuucccaagauuaauccauugaaacagauacaaaacauaaggauaaucaagagaggauuacagacauucuguaaacugcacacauuggguauuaguauucuugggauucugucuuauggaaugggcaucaaccugucacucagaaugaggucucagcuuuuagcugaucacccagggacucagaggaaaucagaaaaucucucuggaggaugacguaggcuacucaccuugauagagacaaugcggccugggcuguugucaugcaugaagacacgcagcaugugugggaucagcuggggcagguagagcuuaaauucacccccaagagcuaccacaauuugcucaaugagaagaaugaucgugcucugaauugagguguucaugacccagaauuccuacaaagagagaaaagucagaggagcugagucaggucccuuucugaugauauaugaacaaaggaaucaagauggccagaaaagcaaaacuguagugagcauggucugcgccgagaucaacuccucacuccccuccucccacugggcccuucuuguguccuauguugcagcuacacuggacaaacucaauugcauuuccccagaugcaccaggcuaccucaguccucugggcuuugcucaugcugcuuccucugccuagaaucccacuucuugcucagcuaagcccugucugucuuucuagaccuggcucuagccucacuucucccaugcaggcuuucuucuucuccuuccaugauccacuuggguccuuugcacucccuuugauagcgauagcaguuguaagacuuccuuugcuuugcuguccucccucuagacuguaggcuacuuagggacaaguauccuaucucuguauccccagaaucuaucaaucagagcaucuggaauauucuagaaugaacagaugacuaagucacucaaaaaacucugaagugguccaggguggacuuggaccuuacuuugguaucaccugaucucuaccagagggugacuccaguauuacaaauauuuccuggcuuuucuggauuuagauuuugcuauuaauagauagcaucugauaucugucccuucccaaaaaucuauccaucaggccugaacagugccacaaaaugagccccuuucuacacccacaugguuauuuuccacacaaguuacuaaaauaaaaacuuggccaacuggccacagauccugccucagugcugcaaagcaaauuaguccaagccucuaacuccaggaaaagauaucauuucuaucaacucaaaaagacagcugccuaccaccaucuuuaaaaguucuggaguaggaaauuuaaugauaauagaaacccuacuaaugauggcaacacaugaauguuaauauucuuggagccucuaaauaguucaaaguagaaguccauaacaacaaggauaacuccucagaugaaaggcuuuauaaaaagauauaguauuuuuauuuaaaaagguaucuuuaaaagcauaaugguuuagaaagcaaaaacuauacuagaagaugcugguaaaacuuccuuucucucuacuuggagagaaguauucucucugaaaaagcuguguuuucuagguuaaaaguguugccaaagaaacaccacagauuucacagccuccagagucugucugauguucauccacuugaacccuacucugccuucuuuagagaaggccaaccuaccucccagcugcauuaucaucagcuccucacaggggcuucucuaccucaaagaugucaggcagccugccaagggaugucagcuggaucacuguucacaaagacuauuuucuucccaggcucgggggagcucauuaaaaugcccagaaucaacagucaaaggaagagcccccguugcaccuucucuaucugggaugaaaugaaagcuguauuuugcaggugugaggcucccugccucaauucccuguguuuuggucaucaaccuguuaugacuauaauauggucauauuguauccuuguuuagccuucuuggggggauuaagucacagauuacuucauccuccucccaugaggacacugcuucuucccuugccccuccucccacuaagacuagccaucggccucuuuagcauucugccuaaauccuccuuguacagaggcuucugugguaagagucagggaauagagcagcuuuuaauuauuuauacauguagggagguuuucaguucugagauccaggugcugggaaguuccauuugaaaccagccauuuugauuuuaguccugcuaaaaucaaauaguccagccauuuugauuuuaguccaaacuaacuacaaaggucuggugugaaagaacagaaaucuuccaacucuuugaggacaugccaucccugugaagcaaucuuccccguagagacauuuaaauuauauagaacacaaggaaaaaugauauugcccauggggugucuucuggcaccuacuuaaugcauguuauaaaauccuggaaccugagccuuuucucaugugccacugcagucaaaaggugauauguaugguuuuggagguagcaggguaaagcaucaccuuguuccuuggugcccaacacguguccaucauauuuaacagcccuaagaaaacccaaucccuucaugguuuaugagcaguaacaaagagggcuuucaugaaaauagaaaagcacccuugugauauuaaaguaaaauugcuuuguugugugugaggcaaauaacccaauugucuauuucuggcagaacaauuacugcaggauuucucuucagccuucaugccuuguaguuuuguaccugggaaccuggagcaacagcccuuccucccccucaaaauccagugggcuuuguuccacuuccuguacuaagacuguaacagcucuacaaagauccgugaaaaaaagucuaugucauucaaacuugcuucugagccuuccuugacccaaacauggaagaggccaaagcauuaacuucuacucacucucaugagggugacuauuucauccauauaaggucugauguggcucuucacaaaggacaccaacauucccagcugcuggaacaaaaacugaaauggacaagaggucaaccagcugguaucaugaaggacauugaacccccaggcuuaccuuaagcucaugugaacaaauaaaggcaacuauggaauggguuuccacacuacacuaucuacugagaauauauuucaaagacccaagcuuggcuagguuuggaggcucagugcuuugggaggccaaggcgggaggacugcuugaggccaagauuucaagaacagccugggcaacauggcgagauccugucucuacaaaaaaaauacaaaaaauuagcugggcacuugccuguaguucuagcuacuggaugcuaaggugggagaaaugcuugagcccagaaguucaaggcuguagugagcuaugcacgugccacugcacucuacagagugcagggugacagggugagacccugucucuuaaaaaaaaaaaaaaaaaagacacaaacuuaaauggugauagugguggggacucaaaacaauugucagagguuuuuacacacaaggcgagccaguuacugcacagcaggggcuuuguaacccucauuuaaccucccugugcccaggcucuuccaugggaaaauggagauaauaauacuuaccucauagacuucuaaggcuuaaaugggauaauucaugucaagcacuagaacagggacgugaauacuauucagugcucaaugaaugucuguaucauugaaggauuccuggaauuacuaaacuuaaaaauaaaccugaaaguuuuuaccaacuguaaauguaccuuuuguuuauuuggcucuaauuaauuaccacuuccuuccuaaaauaaauacagcuaacucuugauuauggguauuguagcucauuuauaguaauuaacucauuacuuaggucuuaauuaauuaacuaugucucugagagauuaugagccaaaauaagcaagcaaacugggguagggauaggaugaggagauucuacugaagucaguaccuuuuagguguaggaagaaaaaacaugcacuaaauaaagcugggaauaaggaagguguggguaaagaaaaucucaacuacuuuccagguuaaagauuugucuucaagauguagguuuuauuuuguuaugagcuucagauaguauuacacgccaguaauaaguagcaaauaauauuugacaccccuucccccaauuuuuuuuuuuuugagacagagucucacucugucacccaggcuggaguacaguggcaugaucucggcucacugcaagcucccggguucaagccucccggguucaagccauucuccugccucugccucccgaguagcugggacuacaggcgcccgccaccaugcccggcuaauuuuuuuuuuuuuuuguauuuuuuuaguagagacaggguuucaccguguuagccaggauggucucgcucucuugacuucaugauccgcccgccuugcccucccaaagugcugcgauuacagucgugagccaccacgccuggcccccuuccccaaauuuuuacagcucucucugccuuuguuucucuccauuaacaaggauaauuuagaaaaugaacauauguauuuucacuccuauccacaugcaagucggguaaguuggaauaaauaaaaagcauuacuuaaaaaaaaaagugcuaucucaaacagugaguaauggauuuauaguacucauuacccaaagaggcaagaucgauaggacauacaggauugggcuuaaagaagaguuugaacauauucccuaaugauaacuuugacuucuaaggugauuacagccugguccccauguggcacacauuugacucaguaggcucauuucuaccuaucuccugguccccaccauuccccaaauugaaucacuacaguuuuguagugauuccccauacaaauauguauaguggucccuauacaaauauguuauuacaggccgggcgcggugguucacgccuguaaucccagcacuuugggaggcugaggcgggcagaucacaaggucaagaguuugagaucagccuggccaacauggugaaaccccaucucuacuaaaaauacaaaauuuagcugggcaugguggcaugugccuguaaucccagcuacucgggaggcugaggcaggagaauugcuugaaaccggaaggcggagguugcagugagcuaaggucacaccauuguacuccaaccugggcgacagggcgagacuccaucucaaaaaaaaaaaaauguuauuacaaagaucaaggaaaaugagacuaaauauaaagguucuucaggcaaauuuuuauuaugcaaagccugaaagaaaguagaaaaccuaagcuggaggaaaacaggccuacagcgauggcggggaggucagagaaaacugagagacagaaagaggaaacaagcuuccugguccuuggugccauuuuauuaggcaugauuagggagcauuuccguggcuuauucauaaggaguagcugcccaagggacauggacaggcaagcaccucaaugcugaguagagagcuagaggagcugccucuucuuccuuagccuuucacauguguucucuuuuugcucggaacaugaguauuuuaaaagaacacaguuuugcuccugaaaauaugaugcacuagaucuccuuccaaacucccccacuaugaaaagccuaaaauuaaguacaaaaauauaaacaugauuauaagauuauuagaacugaaguggccaggcgcaguggcucacgccuguaaucccagcacuuugggaggccaagguaggcagaucaccccgagcucagaaguuuaagaccagccugagcaacauggcaaaaccuugucucuaccagaaguacaaaaaaauauauuagcugggcauaguggcaugugucuguagucccaguuacuuggaagguugaggugggaggaucacuucagccucagaggugagguuacagugagcugagaucaugucacugcgcuccagccugggcaacaaagugagacccuguuucaaaaaaaaaaaaagaacuaaagccucucacauaaagccagacuuucaaagagcuacauauuaagagaaauggugaguuaaaaaaaaaaaaucuguccacugguaaaaggagauaaagaaauuugccaguugugauguggggucuaggcagaaaaaugccuccccuaagaguucauaauuucaggcaucuauuguacagguuuagggauuuauuuucacuaacuguguggccugggaaucucuaagccaagaaauuaaaguucucauggaccaccuggcagaaguaaaugcacauccucucuggaaagaugcaaauuuagagcagauuuucuaguauugcuccagggaaagcccaguugaauaugcuauaugauucgaaauuauaaaacacgugaggaaacagaccacuacaagcaugacuucucagaaacaauauacacaaucagacccacuaagaguuuuauauauaauagaaguauucgacagaaaauuuagucuguuuaaaaugccuuaaaaaaagugggaauaaggcugggcacgguggcucaugccuauaauuccagcacuuuggaaggcugaggcggguggauugcuugaggacaggaguucaagaccagccugggcaacaugguaaaacccugucucuauugaaaaugcaaaaaacaaaaaaaauuagccagcaugguggugcacgccuguaguuccagcuacucaggaggcugaggcaugaggaucacucgaacauggaagguggagguugcaguuaaccgagaucguaccacugcauuccggccuggcagcagagugagacuugaucucaaaaaaaaaaaaaagaaaagaaaagaaaagaaagaaaaaaaaaauagaaggguauaaggacaaaauuccaaaaaagauaauagaugagaauuucucaggaacugauaagauaccaauccucacauucaggaagcccuccaagucucaaacaggauaaucaaaagaaauucacaucuagauauauaauaguaaacacuucaggauaacaaaacaaugagaaguaaagccacagaaaaaauauguaaaagggauucacgauuucucaacggcaacaaaaagaagucagaaagugggaucguaucuacaguuguaggagaaccuagaauaauauucuuggcuaaaaaaauaaauuuuuuaauuuaauuuuuaaaucuccaaaugaagauuuaaaaagagggugaaauaaagacuuauucagauaagagcaguuuauuucaaugaaugcuccuaagaggaauuuguccuaugaagaaagaauaugauucuaggagaaagcucuaauauggaagacagggugaugagacaugaaauauguguggaugaauauaaacaaacacgacauaaaacgacaauaauguuuaauaagauggaggaagggggccuaggaacgcaggcacccucuaaaacaagcuuguccaacuccucgugcucuagaagcuagaaaaagcaaggaaaacaauucuccccuagagcuuccagaugggaacacaguccugucaacaucuugauuuuagcccagugagaccucaugucagaaauauaaccuagagagcuguaagauaagaaaucuguguuaagccacuaaauuugugguaaucuguuauagcagcaauaggaaauaauaaaggaaggaagaaaacgagguauaaagauggugacagaagcuagacguugcuagauaagauuuuauuuauaguucuagcucuggaacuauguuaaugucuuauauaacuaaaacaaaaguuaauuuuuuuuuuuuuggagauggagucuuccucugucgcccaggcugaagugcagugguccaaucuuggcucacugcaaccucugucucccggguucaagaaauucuccugccucagucuccugaguagcugagacuacaggcaugcaccaccaugcccggcuaaucuuuguauuuuuaguagagacgggguuucgucauguuggccaggcuggucucaaacuccugacuuugagugauccaccugccucggccucccaaaguguugggguuacagaugugagccaccacgcucagccuaaauuuuuuguaaacucaaggaaauuucuaaaaauugaaaauaaacagaaacaaaugaguauaacuauaagccaaguuggcugcacaaucacucaagaagaauaucaacugaaagucuuaaacuacauuuagucaucuuauuguuaauacuaacauuggucauuuucuauuuacaucuauaaaauauauauauauguauguaaucucacuaaaagaaaucagagcuccuuggaaauggcuaugcccagguuugagugaaauauacuugauacgcuuggaguaauuuuuuuccgccagaaagcaagaaagucuaccgggccauguaaaaaggacacaacagccagggugaucaggacaaucugauugugaaaaagauuggugccugcaaugaacagaaauauuauauauacauauauauauaguguauauauacauauauauauucuauauauauagaaauacucuauauagagagcucuguuucuuuuagugagauuacauauauauauguaucuuucuuaaacacacaaguaguaaaguaaaugaccaauauuaguauuaacaauaagaugacuaaaugacuuucacuugacagucuucuuugagugacugugcaaccaacuugguuuacaguauaaauaaagauaaauuauauauauauauguaucuucaugaguucauacugauacuccaaagaaugaggguaggauugggaggugggaaggugccuggcucaccucugaaaagcuguuagaggcuugacucauuauacuaaaaaauugauaaauugauaaauaaagggaaagauucaugcauguauucugcuuuuccuacaugaucuacacuucaaauuaccucaguaguugauuauauaaaguucuuuuuuaaaauuuauuuaaaaaaaauuuuuuuuuuuuuugagacggagucucgcucugucacccaggcuggagugcaguggcccaaucucggcucacugcaagcucuaccucccggguucaugccauucuccugucucagccucccacguagcugggacuacaggugccugccaccaugccuggcuaauuuuuuuguauuuuuaguagagacaggguuucaucguguuagccaggauggucuugaucuccugaccuugugauccacccgccucggccucccaaagugcugggauuacaggcgugggccacugcgcccagccuaaaaaaauguuuuaaauaaaaugagaugggguuuugcuaugcugcccagguuggucuuacacuccuccugggcucaagcaauccucucaacucagccucccaaagugcugauauuacagccaccaugcccagccaaguucuuuauuucuaaagaacuuucuagcuaauaaauccagaaggaauaaucaaauuagaaaaucaccauuuuggggcacauguucucaggagcuccugagagauaugucauggaaaaaaacauuuuuuuuaauaaaaaaaauauauauauaaguaagaaaaucaccauuuugcagucccuaaucaaauaacagcucuaggaaauaacuaccaaugaaugcuaaaaugacugggaaaaaggcugauagggaacuuuauaacagauggaucagaugacaauauccgaacccacugaucagccuuuacaucacuagcagugggucauauggaaaauaucuguuuacuaaauguugaaauaggagguauacaguacuguaaucuaugaaguaucucuugucaaaagaacagaaccugaaucuaaucaagccucuaaaucuaacuaguuuauaggaaauuaagacacuucgaagauacaaucagccaaauccaguaugagaaacaggacaaaugaccugguuucuucuacaaauacaugacuuuuuuuuuuuuuuuaaguagagggaaaagguaaauaaguagugaaagaauuauauacaucaaccaaaugccagauguagaccuuauauagauuuuuauuugaauaaaccaaauuacaaugaauuuuuaagacaaucagggacaucugaagaaggguugguauuaaauaauacuaagaaaugauuguuagcuuuguaggugucauauuugugguuacaugggaaaaaguauguauuggugaaauaauaugauaccuguaauuugcuuuaaaauacugcagaaauguauguacaugugucggggggaaaggcgauggagguaagagauaaaaccaaauugacaaaaugcuaguaauuacugauggguaugugagaaucuaauauaauagguugucuacuauauucaugauugaaauagucuauuacaaaauguuaagaaaaauuaaagguggccaaugagugaaggcaaaagaugaaauaaaaaauaaaggcucaaacaaauccagaaaaagacaaaaaagaaagauaaacagacaaagcaggacaaaaagaaugcacuaaguaagaugguggaaauaaacgcaaacauggccaggugcagugguucacaccuguaaucccagcacuuugggaggccgagacggguggaucacuuguggucaggaguuugagaccagccuggccaauauggugaaauccuaucucuacuaaaaauacaaaauuagcugggcaugguagcaugcaccuauaaucccagcuaccugggagggugaggcaggagaaucacuugaacccaagaggcagagguugcagugagccgagaucacaccauugcacuccacccuggcaacaagagcgauacuccgucucaaaauaaaauaaaauaaaauaaaauaaaauaaaauaaaauaaaauaaauaggccaaauauaacagcaaucacaauaaaugcaauuggccuagaaugcacugguuaaaagacaaacauuuuuaaauuggauuaaaaagauaaucuagcuauauuuacaagacagcauccaaaacaaaaagucacaagacaguuaaaaguaaaagaauuggaaaagacauauaccuccaaaaaaaagcugguacagcuauauuaauguuacguaaaauacguuuuaagguauuauuaaagauaagaaggauuauugcauaaugauaaaagagucaacuuaccaggaagauaucaggauuuaaaauuugcaugcaucuaguaauauaaucucaaagauacauaaaacaagauugacuaaacuaucagaaaaaagcccaccaauguaaagggagauuuuugucucacuucucucaguauugauagaucaaacaaacaaaaauuagaaggacacaaaagauuugaacacaauaaguaauaaauucaaucuaaugacuuauguaaaacccuguccauaacguuagcaaauacacaaguauucccaaggauauaggaaauauuuaugaaaaucaaucaaccacuagaccauuaaagcaguuccagcaagcaugaaagaaucauaaacacaaugcaauuaaguuagaaaucaauauaaaaaagagaaauuaaaaacccuuuaaguuuacaaauaaaauacccacuucuaaauaacucaaggguaaaagaagaaauucuaacacuggaaaauauuucuggacaauaaugaaaauacuacaucacuacugaguaauaaaggaagaaugaauuacugauacaugccacacauggaugaaccucaaaaguuuuaagugaaagaagccagaugcaaaagaccacauauucuaugacaccaauuacaugaaaugcccagaaaaaguaaaucuauagagagagaagcagauuaguaguugcccagggaugaggcagaaacagaaaaugacugaaaauggacaggagguuuuuuugcuggggugauuuaaguuuucuaaaauuagauuauuagugauaacugcauaacucuguaaauauauuaaaaaucaaugaauuuuacgguauguaaauuuuaucugacuuguaaauaaauaaauaaauuuuuuauuuuaaauuuuccccccacauaucuuacgguauguaagcuuuaagaaauuuuggaaagcaguuaauacuuggagugaaauucauagccuuaagagauuacauuagaaaagaagacugacaaugacuuaacauucuaacacaauuuuuuuuaaaaagcagaaaaaguaaaauaauaauagaucaacaagucaaaaauugguucuuuuuuuuuuuuuuuuugagacagaaucuugcucugccauccaggcuggagugcaauggcacaaucucagcucacugcaaccuccaccucccagauucaagcgauucucccaccucagccucuugaguagcugggauuacaagcaugugccaccaugcccggcuaauuuuuguauuuuuaguagagaugggguuucuccauguuggccaggcuggaguugaacuccgaaccucagaugauccacccgccuuggccucccaaagugcugggauuauaggcaugagccaccgcaccuggccgauaguugcuucuuugaaaaaugcuuuaacaaaucucuaguagaaaauuaaaacauaauccacucaguucuggggcauaaaaaaagaucuuaaaaaaauuaaaauguaagagaacagugugaacaauuucaugucaacaaguuuuaucacuuagacaaaaugaacagcuuccuaaaaaaaaguagccaaaacugcuucaaggagauacagaaaagcuaaacagaucuuugagcccauaguuaagaaagagaaaauuauagaccaauucaaucaagaacacagauccaaaaauucuaagcugaacugacauaagaucgaaauuuaaaaauacauuauaaccaaggugguuuuaauauaagaaugccagcauucuuacauuagaacacguuaucagugugauucaacauauuuaacacauuaaaagagaaaaaccauaugacuauuacagacuaaagaauucaauauacauucauaauaaaacucuuuaguauucucuuuauaugagaauauuugaccuuuauaaagcuaucuagugcucauuuuggcagcacguauacuagcauuggaacaaucuagagaagauuagcauggcccauaugcaaggauaacaggcaaauuugugaagcauuccguauuuuuuuaaaaauaaaaauaaaauaaaaagauaucuaccaaaaagcuacaacaaauauuauacuucauggugaaaucuuaacagcagucccauuaaaaucaggagcaagguuauagauuuccacuaucacugcaucuaauuaacauggaaguaggccggguacaguggcucacuccuguaauuccagugcuuugggaggccaaggugggcagauagcuugagcccaggaguuugauaccagccugggcaacauggcgaaacccaaaaaaucagcugggugugguuguaaaugccuguagucccagcuacucgggaggcugaggugggaggauuauuugagcccaggagguggagguugcagugagcccauaucaccuauugcaaccucugugucaccagcuugggcaacagagcuagacccuaucucaaaaaccaaaaacaugguaguagaggucuuaugacuuuuuuaguacuuauuacuuuuccuuacugugucacuaaguggugguuuacaagauuaaaacuaaaaaacaaaacuuccuuuuuuaauuuuucuuccccccacccccgcccccgcccccgcccaccagacuauauaauuauauagaguaaaaaccugagagaauuuacagguaaauuauuagaguuaauaagaauuccggccaggcgugguggcucaugccuguaaucccagcacuuugggaggcugaggcaguuggaucaccugagguuaggagcucaagaccagccuggcaaacauggcgaaacccugucucuacuaaaaauacaaaaauuagccgggcuugguggugcaccccuguaaucccagcuacucaagaggcugaggcaggagaauugcuugaaccugagaggcagaggcugcaaugaacugagaucauaccacugcacuccagccugggcaacaaagugagacuuugucucaaaaaaaaaaaaaaaaaaaaaaaaaaaaauucaauuagguugauaguuauaaauacaauagaaacaaauaaacaguaugucuauacuccagacacaaaguuaggaaacauaauuucuaaaaacaugcuaucuccucuaaauguacaucauguugacaauaugaucagagggaaaaguaacuaauugagguaucuuuuaaacauaguacucuuacuguacacccuuaguagaguguauucuaagaauaacaggaacuacaaagcuacucugaacuuuacuuagaucugugguugguaguaguagggacauauaaucuuagaaccauuuugcauauucugugguuuaaagaaagacacaagaaacagcaagagugagaggugggggaggggaaaauuccucuucacagaaaaaugcugccagcuaauaaaauggagaaggaauagcaaaauuagaaagucaucacuuugcaaccaccagugugauaaucaacucaagugaggauuaucaacggaugcuaaaaucaccggauggaagguagcugaggaacaggauagccauggagucucaaagugucaccccacagauuacucacuaauggcaaaggaaaacagauaagcuuacaauggagagaucggauaaacaccuacucggccgcaugcucgcacugaggaucaacaguaaugggaccaacugguggcaguaugagauccaguaagaagcauucaacuucaccuguguaguauuuucacuaaaaauguuacgacuuaaaucucgucaugaaggagcaaccagaaauccagacugauuuucuauuuguggggcaucuacaaccggacugaacucuagauuacugagaaugacaaugcuuuuccucccccaggcuauucaucuuuuagccaucuuuuucuugagacagagucucacucugucguccaagcugaagcacgguggcucgaucucagcucacugcaaccucuaccucccagguucaagggauucuccugccuuagccucccgaguagcugggauuauaggcgugcaccaucacgcauggcuaauuuuuguauuuuuaguagagacgggguuucaccauguuggccaggcuggucucaaacuccugaccucaggugaucugcccacuucggccucccaaagugcuaggauuauaggugugagccacugcaccuggcccuuuuagccaggacacuggagugagcugauuguacacuuuauauguugggaguuaagggggaggaaggcauugggcucaggggcacagagaaugcacaauuaagaagcugaagcacagauggaucugugcauguguggugcagaggagaaagagaaggauugggguuugagguacuuacuucccggauggccccaucacagacucgaaugacguuaaggaacgugggcaugaccuggggcaggaacugcacacauuugagucccagggacuugaagaugaaggugauggccuggacaaccauggugugaugaugagagagugacuggucucggaagauccgcaucagggccaccauggacacagcuggguagaacucauccagaggcaaguuucccauguugaccagcauuucacuagugcuauagucagcuaggacaaaacaacagagaguguuagagcuacacauggcaugacgugacuucaggcagagcaugguuaguaacaaacaaccuccuaacagacauuagcauucauaucuuucuuccuaguauguucuaacacuguugggaguucaaggucuauuaggaaccaaugaauagccucucaccaucaaggaguaaacgguuuuuggcuuuucuauuacucaaaccacaaaagccuaaaacaguacaugauggguugguuuucucuaaauugcucuguuuaauuuagcuucuuaccguucacaacuucauaacugaaaccaucaauaaaaauaauuacucccccaaaauaaaguaaagggaauuaaauuaggcaaacaucuguucagcagcuccuugguuccccuagggaauucagacaaguugguaggcaaauacuaccuaccugacuugaacaguaaggaccucaaggacucugacgguggcagcgggggcaguggcaagggagggagguauacuaacaugaagagugcagcgaggaggguaagaacuaaacagaugaagagcugggcugacuggugccaugaauaaggaagaacaccaggagcagcauggcucaggcccugcucucaacagcuauggggcugacagaaugacaucacaggcaugccucucuaauaccagaagaggaagaaaugugaagcaauaugaucccaucuagaaaguucagaaacaauuuauuuugggguaauaauauuuuccuggaauaguugggagaaucaauguuaacuuucaaugucagaaauaggccugcccugagggaauauggguuaagucuagaaaacccuccugcaaccccauaccccacccccauucacucaggcuacuugucaaaaggcaacgggcuauacaaaaaguaucgaggugugguggcacacgccuguagucccagcuacuugaggggcugaagcaggaggaucacuugagcccaggaggucgaggcuacaucaugccacuguacuucagccugggugacaaagugagacccugucuccaaaaaaauaaaauuaaguuaaaauaaaaacaauaaaaggcaaugggcaacagaccaccagaaauuauuccaccugucuaacuggaaccuugcacucauucaccaaccucucccuauucccccucccugagucaauuaaaaauaaaacaaaccuuuaaaaaaaaaaaaaaggcguccaggcacaguggcucaugccuguaaucccagcauuuugggaagcugaagcaggcagaucacuugaggucaggaguuugagaacagccaggccaacauggcaaaaccccucccuacuaaaaaugcaaaaauuagccaggugugcuggugugcaccuguagucccaguuaccugggaggcugagacagaagaauugcuugaacucgggaggcagagguugcagugcuguauuccagccugggcaacagaguaagacucuccaucucaaaaacaaacaaacaaaaaaaggcagugcagcucuugggccagaccauuucacggaaaaaagagccccaaauuucugauugcugcuaguuuucccuauggcccugagccucgccucugauuucccuaucaauuaaaacaggaagaaucaauucuauccucuucuucuguagauaccaugggaaugagaaccaucaaagaggcacuaagaaagaaugagagauagauagaggugauggggugauaauguguaucucuugcauuggcaucaaaaagcagacagacuuggcaugccaacccuugacaaagaaucuagacagacaugaggacucuggccacaaugggaagcagcaacccuuccgggauucaagaagaaacuacugacuuuucauucaaaaguugcuacacgagccaauauccuauaauuucucaguaauccagcuccagacuuucuaaacacaaccagcaagggcucugugagugagaacuuggcaagucuuucauggcuacccccaacuuacaggaauccugacuugacuuggauucugacaggcugacagcagaggcaucccgggacuggucuaucaugccaauguucacuuugugcuuguaaggauccaaagccccuaaaagcccuaacacacggauggccugcgugggaaaggggagggaaaaaagaaaacauucaucacaacaugauuacaacaaguaucacggauacuccucucagguuacauaauccccaguucauauccaaaugaccagcuacaugaacaaaauuggagagggacaggaagucugacugacacugucagagcauguuaaugcugcaaccaucucucucuugccaucgucccagcaaagucuuuaaagaccaaguuugccacguccccuaccucucugcguguacccugguucugcucagucuucagaaaauucaguagcaccucaagcaaaguaggguacuuccuguagggcucuacuacauagccagugcuggccaccaacugucccaggguccacagagccaccuggauaggcacaagaacacgauucaaugagccaguacgagagaaaagaaagcauaguugaacucuuuguauaaugauuauaaugaaguguuagaggcuguaagaagaaaagagguuuccaguaaagacacuaaccaugagcagaaaucccaaaagggcauaaaaccaagguugaucaagcacacaacccugcaacaaucacuggaucaagagacaaagaaaauucccaccuuucucaaagaaaacacaucauucuuccauaucccaaaugauuaacaggagauucaaaaggaaauuaagauuuuuuguuguuguugagacagggucucacuggagacuggaaugcaguggugugauaacaguucacugcagccuuaaucuccuggaaucgagugaucuucccaucuuagccuccaaguagcugggacuacaggcacaugccaccaugcccagcuauuuuuuuuuuuuaguagagacaaagucucaucaugcccagguugcucucgcucuggagcucaagcaaucuuccugccucagccucccaaagugcuaggauuacaagugugagcugccaugcccagaaauaaauuaagacuguucuuaauuuuagucuagucaucuaauagccucaaauugggaaagcagaaccagggcugggcaaggaugagcuaaacuucuguuccuucauaggcaguggccaaggcuuucuuuuucccucugagagcuacggcucugacaauugaccugcauuuucuuuuguauagacaaaauggcacuagucagccccgauaauuacugaaacugacucugggucaggacaacagguaauucugguuucaaaucuuucuaacuuuuacucauucaacaaauauuuuugagcaccuacuaugugucacacucuguucuaggcacugggugaggacacuaaggugaauaaagagaagcaaagucccuggacucauggggucugucuugcucaaucaggaagcaguaauacucaccugccuuuuggccaacaaagaggaauccuggagcauguccaugaugauaauaaaaaguucaucaacccauuuccucauuuccaggccacuaaccugcaaaaugaaaaagaggguggcagaaaggguuagaaauucuggcauuagaaaguauuuuggaggccgggcacgguggcucaugccuguaaucccagcacuuugggaggcugaggagggcagaucaccuggcaucaggagcuccagaccagccuagccaacaugguaaaaccccaucucuacuaaaaauacaagaauuagccaggugugguggcacacaccuguaaucccggcuacuugggagggugaggcacgagaaucacuugaacccaggagauggagguugcagugagccaagaucacaccacugcacuccagccuggacaaagugaaacugucucaaaaacaaauaaauaaaauaaaaaauuuuuuuuaaaaaagcccucucuuccuuucuccaccaucauggugugugccugacucugauucuugccauucuucucacaagacuuucagaauuaagcaauuccuggccaagaaacaaaaguaaaaucgucccauuccccaguggauucggaugaaaacugguaauaaaaccagguacaacuccaaaaaaagacacuggagaagaaccaagcagggucuauaaggaauugcacaugagauggcacacacauuuaugcugucugaaggucacaaugauauuaccauaucaagcugaaaaugucaccacuaucuggagaguuggacauguuuuauugagaauauauuauuucucucugaaucuguuaugaaugcauuguuggcuggguuccgcaauaaauaugugagaccuuucauuuaaaaaaaaaaauaguauuuugacuuccuuagagguuaguuucuuuuccacccuaucuccgcuauggaaaaaguagcugccccuuuaccugugccaauucuccuauuguugccaggacauuauugaucacaccuggguuuggaucagggucuggaucuuucaguuucaaaauuaaugccuagagaaagaaguuaugagaaaaugaaugcagauuagacucuacuagaaaccuuucuuuuauauaaguaaaauucacccaagagaccaucucagucauaaagaaauuccuucuaggcuuuaugaauccaagauuucucuggaauguaaauucucaaacuuuucuccauaugaagucuaagucugacaugugagagagcugggaagcaccauaaugugaaaguauuucucaugucuccucuaaaccgagucucagugauuguucauccagauuaacauacauuauaaaggacuucacgugacucuaauguguugagauuugaagguuguuucagauuuucaagcucauuuuuuccucauuuugggcgagcuauuuuaugcuacuaucuaccuacuucuccuuuccaaacaucugcgaugaugugccugaagcauuaacucuuaccucuuguaaggacagcacuuuccugcaacugauaagauucuugguauucuuuaacugaaagugcuugauauggcccuuuggucuccaagcgugagagcaaagaaaucaccuacuuuguucaguguacuagugaacacugaaacacucccaucuccccauaugagcugaugacaacgcacagagaaagcaccagccucucgguuuguguuaccuucagaauaggcuccauguaggggcggaugagucggggggcauuggagaccaggugccccagcaugcgggcacucugcucuuugauucuuccaaucccacugugcuccaacucugucaaaaucuguagggaagaaaggcucauauguucucuauggcagaagacauucuagagagagacuguguccaacagaaaaaguggcagggaacugggggaaaaacccagaccuccacgacagaugaaguagcugcuagauacucaaugagcaacagacuuuucugcaacaggcagaacagccuuagauacagcugugacaggaagaaaaacuauucgaaaaccugcucccuuuccuuuuaucacagcacuccaaugucccauggcccucucuaaagcagagcuuuuaaccauguagcacagccagagaagacugagaaaaccaacagggagagcugugaguaggguucuauaaaaaugaggaaagaagguagggccccuugggagaaaaaucuuuguccagacagcaaauuacugaagacuacaaauaauggcaaaggaaucaaagaacaguuagaacagcuaugaugccaagagaagugcugauacucuguagcuguuuggggcauaucuagauaaaccucaauagguggggaucacacuggcaggaucccccgaagccuuacugacuggagauaacacauugguucuagcugacauccuuaggacaccagcaaaucagcauaucuugcucauggugacauagacagcauaauauagacagauuucuggauaaagcugccagaaggaaaucgaugagcagugacaaaagcagaugucacagagcucagguuaacucagcuacccagaggagucuacaauuuaacauuacauuuugucuuagguuacugacuuaauaacccgauuuuucuggauuccccuggcagccuguuuuccccagucauagcagaccacagggaaaagaaaugaaggggauacugagaauagaccugcagcaccaagaagacauggcugacugcaaggaaaugugccucacggagcagagcccaacuaucugcagcagugcggggccaauccaaagaaccccagguucacuuagagcccgagagccucacugcauccuaauaacaauaaccaaugcccacccugaugaccaagaccgcaagaaaggccaaagucggccaggcacgguggcucaugccuguaaucccagcacuuuaggaggcugaggcagguggacugcucgagcccaagaggcagagguugcagugagacgagaucccaccauugcacucuaaccuuggugacagagugagauucugucucaaaacaaaacaaaacaccaaagccuuuaccaaggcaugaaaauguacaccucaauuuggaaaaaucuauaucaaaguuuaaaaacaaaaaagaguaauuuuaacauuucaagggcuaaauucaguacauaaauucauucaaaggagcuucacacucugcaauauugaaaaaaugaaauggccugauagcuuaauaucagcuuuaagaagauuagagccagccgggcgagguggcucacaccuguaaucccagcacuuugggaggccgaagcgggcagaccaugaggucaagagauugagaccagccuggccaacauggagaaacuccaucucuacuaaaaauacaaaaauuagcugggcgugguggcgggcgccuguagucccagcuacucaggaggccaaggcaggagaaucgcuugaaccugggagguggagguugcagugagccaagaucacacuacugcacuccagccuggcgacagagcgagacugugucucaaaaaaaaaaaagaaagaagauugcagccacgccuggcuuguugacugcuauauucccagugcccagcaguaccuggaacauagcauguggucaaaaagucugcugacagaaugaacauauugauauucucauuaggagguauuucuuauuuuuuccuuuuuuuuuuuuuuuuugagauagggucucacucugucacccaggcuggagugcaguggcacaaucacggcucacugcauccacaacuuaccaggcucaagugauccucccaccucagccuccugaguagcuaggacuacagguaugcaccacuacacccagcuaacuuucguauauuuuguagagacgugguuugucauguuccccaggcuggucuugucaaacucuugggcuccugugauccgccugccuuggccucccaaugugcugggauaacagacaugagacacugcacucagccguuuaggagauauuucuacgccaaauuaauuuagcaugauuugagcuggcaggcucaacagugauuucacguuuuuuuuuuuuuuuuugagacagagucucgcucugucgccaggcuggagugcaguggcgcgcucucggcucacugcaaccuucaccuccuggguucaagcaauucucccugcaccagccuccagaguagcugguauuacagacgccugccaacaugccuggcuauuuuuuuuuuauuuuuaguagagaugggguuucaccauguuggccaggcuggucuugaacuccugaccccaggugaucuggccaccucggccucccaaagugcugggauuacaggcaugagccaccacgcccggccuucaacaaugauuucuauuccuuccuauaacugaggaauguuuuuaagacuuaaaauggcaggcacuucuaacgcaggccggcaguuaaauaaaucauuacgcuaaaaauagaagugccaacauaaguacaacuuccuaauuuguugacugaugauauaauuuacagccacuuuauaacaaauugugaacaaacauuucucuagagugaguuacauauauuaaugauuuucuauguuuaaguuccuuauauguuauaaaaaguguuuacuucaaaacaaaccaugaaggaggaucaggaagcaaacagugagcaauggggacaggaaaugacugggugagcaacauagagacccacaagaggcagguggaaauaacuucaccaggcaggacugguguauuggcaggacuccauguauugcucaccaggaggccacagaucuuacucaguaggugaagacaaaaacugaggagccaugucuccagagcaauucuaccuuacgcuacagaccaagcagcugagcuuggcauucucauauuauuuaagaacgaaagccaggaucacagacuggagcaaugacuauuagaacaaauaguggaaacggucucacacugguuauuuuugugaagaacaacggccuccgugcuugaccuggcaccagcaagaaaagcaggagagcugaaggauagggaggcgcugggaagucugacaccaucugcagcagaucaacccagcaagcaaagagggccaagaaaugggaucacuggugacuugccaggaaaaagaaagagcugcaugagaggacucugaaccaccuuagagucauauugacaaagggcucaugaggugaugagcacuggaacugccauuauaaagccagggaaacauuuggaccuuugcagacaaaugcggcuuuuaccagguaccucaaucuuucucccccauccuuguccucaacuccgcuuccucaagcaguucucacagcgagaguccugucuucccugccugugggucuggccaucaccucgguuaccuggaugagcaucuugcgcaggaaaggcaugacaaaggcaggguucaugcuacugagucggcccacagugcagauggccagcucccggaucucaaacaccuggucauucagagccacaaacaaggccugcaaguucuccgccugggccaggugugcaucaaagcgcucguccagggacgccaagacacaguagcgaaugucagggucugcaagagcaauggagccuuugaacauuuccucaugaucccaucacuccagcccuucccagcuucuaccuccacugccaucagcguagugggaagauuccagaugcuuuuucucaucuaaccucugucauucuuuucucuacucacaagaguaaaagacaaaagaauuaaagguagauuaucuuacaccaaaggcuacaguagccaugccuaacacgccuuggcagagaaauagcugaauaucagcuuuuugagccgaagaacucuagagaggccauguaaugaaacuggcuacucccaauuguccuaagcuccuuaacuccccuagauuccuucugucuggcaagccuuaccaggaucuguuaucccaacuacgagcaguuugcuaagcacaucugccaccacuugcacugcggucuggcuaaccacaugagcauggccacugaugagguggauggagggugugagcaggcgggagcaggugcgggcagccuccaugcggaucuccuugugcucacuguucaggaaaugauccgcacaguggcgaacaaauugggucagagaguggccuggauagaaaggcagagagaaaacagaauaaacacugcugcuguagacagguaggucugcagcuugcuagcugaauuuuccauuuugaggcuacuaauucuacuuucaacuagauauugaucaauacgauacugacccggaacucuucuuuuuuuuuuuuuugagacggagucuugcucugucgcccaggcuggagugcaguggcgcaaucuccacucacugcaggcuccgccucccggguucacaccauucuccugccucagccuccugaguagcugggacuacaggugccuaccaccacgccuggcuaauuuuuuuuuuuuuuuuugguauuuuuauuagagacagcguuucaccauguuagcuaggauggucucgaucuccugaccuugugauccgcccgccucggccucccaaagugcugggauuauaggcguaagccaccgcgccaggccugacccagaacuuuuaaaggguaacaagggggauuucaaucagcagaaagguaaaaggggguggugaaggagcaaagagacagauaaaagguaucccccaauccuagccuuuuuauauucccuuuaaauaauaaauuauuuuguuuuauuccaacucaaccccuuacauucucagaggauaauacaauucuugaucaaauuuaccuugccucuuuuaguucccggauuuaaauaccagacaaagagucuguguaggcuggguuuaaacauagcuacuuucuauucacuagaaauaaauuaucaugggugugaaucaauguuaaguggaggaacugcaauagagaaaccauggguggcugucuccagacagcauguucaggcuuucuguacuugcuuguuuccccacauucuugaccaauacuaccuauaugaucuuaaauuucaaaaguaucaacuucucccccugaaauauaucucugugggguauuauuauggguuuauuugcaguuuagaacuacacaguaugguacuuuuagaaaucauaccgccagccgggcacaguggcucauggauauaaucccagcacuuugggaggucgaggcaggcagaucacuugaggucaggaguuccagaccaaccuggccaacauggugaaaccccaucucuaccaaaaauacaaaaauuagccggguguggugacacgcgccuauagucccagcuacucgggaggcuguggcaggagaaucgcuugaacccaggaggcagagguugcagugagcugagauugugccacugcacaucagccugggcaacagagagacuuugucucaaaaaaaaaaaaaaaagaaagaaaaaagaaaucauacugccauagacauggaaacacccaaaagccccuacuuauacauuuuaaagcauuacauaccaucucagcuacaaagaaguggaaaagugaggaugugagggggaucugucucugaagcauuauuuccuuggaucaacguauacuuucccucaaaccauuugcccccaaacucaguaugggacaaagaaacaaaaguaggaauuaccaauacguggaaagagucuaggaaggaugagcugcuacagaaucagcuacccugucuuuagcaccccagcaagauccaggaauccuagauaccuucauuccuuucccaaaguuuccagcaucucucacuaucuuggcaagagccguuguaauuucuuaccuucaaauucaaagcugccaagcguucggagggcaagagugaugcugcccacaucgcuggccucagggagggucgugaggccaggagaggccagcugaugggccaggcccuugggcaugccuggguggcgaagggguuugugcauaaggaccagggacagcauuuucaguagcccaucuugaauguccuucuuuagcuguggaaucugacggcucaggucguagagcacugcagugagggcagggcugaggggaaggaaacaagucacauaagggcugggcacaugacacucagucuguucuugggaagaaacagcuuucucucccagcaaggggaucaggccucuguucuucagaguagaaaggauauuauaaaauaagaauaaaaguguaaacucucuuggcuuagucucaggucuccaaacaaucuaugaguuucugguucuugccacagaagacuugcucacuauaauucagccacuacagaagaccaagucucaacaaacacucugggaagcagauuaagaacacuguccuuauuuuacagaugaagagaacuuaguuuaggaagcuuaagcaacuugcucaauaauaauauacacaauauuugcaaauauuuauugaguacuuccuauaugccaggcauggugcuaagagugacuauaccaugaacccacagcaacccuaggcaauaagaauuacuauugcacccacuuuucagauuaaaaaaaaaaaaugaggccaggcgcgguggcucacaccuguaaucucagcacuuugggagccgaggugggcggaucacaaggucaggagaucgagaccauccuggcuaacacacugaaaccccaacucuacuaaaaauacaaagaauuagccaggcgugguggcaggcgccuguagucccagcuacucaggaggcugaggcaggagaauggcgugaacccgggaggcggagcuugcagugagccaagacugggccacugcacuccagccugggcgacagagcgagaccccuucucaaaaaaaaaaaaaaaaaaaaaugaggcucggggaaauuaaauaacuuagucaagaucauauagaaagcuagugaugaaacuaggauucaguacuagccuguguguuuagucuaagcuauccuguccauccaguugaaugugcaaacaaccaugccucauucuuuuaacagucccaacacugggggccaagccucacgcugauacagggcaagcucagguuucugacacccaccuuagucccacugccagcaugggcuccagcagcuccuugauauccugcuggaugccuggccccauugcucgagccagcaugcugaugcaagugaagacuguggcauccaccugcauugccuucugccuccuguagagaaauggagaguggcuaguugagacauaaugacauucuuuaaugucccaccucaaaaucaccuuggggcaaggagagcagguuacucaggcagggcuaccacagauggguaugcaaauuguccagagcacaguucaaagggacccaucacaucacaauuacuguagauuuguacauuucuacaacaauccagcagauggcaguaaagugucuuaaggaaggggccuuuuuucugaauucacacagcuauaccauauggguuauuguggugcucaccaagauaauuauguaggaagagagcugaacaauguguucaucagggacaagaaggcaguacacagccaucauauggaaagaaauucuucuaugaugagaaugcugggcuuuagaauggggccaggcgcagcgacucacgccuguaaucccagcacucugggaggcggagguggguggaucaccugaggucaggaguucgagaccagccuggccaacauggugaaaccccgccucuacuaaaaauacaaaaauuagcugggcgugcuggcacacgccuguagucccagcuacuugggaggcuaagguggguggaucacuugaggccaggaguucgagaccagcccggccaaaauggugaaaaccugugucuacaaaaaaauacaauuauuagcuuggcauaguggcacaugccuguaaucccagcuacucaggaggcugaggcaggagaaucgcuugaaccugagaggaggagguugcagugacccaagaccgugccacugcacuccggccugggcaaccaaaguaagacuccaucucaaaaaaaaaaaaaaaaaaaaaaaaagaaugaguggggcguauuaauucaccacagcaaucuucgcuaauaaacagggaaguauaaagacaaccugagacaaaggaugaugaacacugacccccucgccuuagcgaagacaccccagucucuccaucuggcaggaugcugagggguuuucucauauuuuauucgccaggagguuuaaagagguggaauaacuuauucaacuucagcgaugaggaaaaagaugacccuuaggucccuucaguuccagucaaggauuccucucuuuaggucuuauaucaaaauaagacuuuuaaaagccagagaaaaaagcaaaacuagcagauucccaguaaauaauaacacugaaaauagcauuggcaucucacauguucucaggguauucaaccuccccaaauauuucauauauguuauuucauuuggaaaagcuuagaauucaacuaaggaagggcuguucuucauaugauuugcuauacccuggaguuuaaugaugcaaaaaaugggcguaagcuccguggaucugaaauagagcguccuuccucuccaaccaaauggaguggaaggugaaaucauaacagaggugcuuacuuaugggcgaaguccuuugggggcagggccgcucggaugauguccagcacgcgaggcaaauagaccuuaaacucagaccucacagccacagaaaguagccccagggcuuggaaggccgcuguacguuccuucuccuucuugacacagcuuaggacaugguucaugguaucuuggagauacuggguaucugagcacagaaaagacaaaguagauagcuccaggucaggguuagggucuacauaucaacagucaaagguccuauaaagcaauucaguuuaagaauaaauuaagaaaguggccaggcacaguggcucacaccuguaaucccaacacuuugggaggccaaggagagaggaguguuugaggccaggaguucgaaacagccugggcaacacagugagacccugucucuacaaaaauaaaaauuagccaggugugguggugcaugccuguaaucccagcuacucgggaggcugaggcaggaggaucacuugagcccagaugguugaggcugcagaaaggugugaucgugugcagcacugcacucaagccugagugacaaagagccugucucaaaaaaaaaaaaaaacccaaaaaacguaaaagguugccaaaacaauaucacagaauugucuccauuacuguuacauuuucacacaagaauuacaugcucuugcugaagaaauauaugucaaaccuuguuuaaaaacagaagaucaucuaaacaauuuuacauuauaaugaaauuugaaguacagucaugggccgggugcagugucucacacauguaaucccagcacuuugggaggcugaggaacaucacuugaguccaggaguuugaggccgcacugagccaagagccaugcacuccagccugggcaacagaauaagacccugucucagaugcaguggcucaugccuguaaucccagcacuuugggacaccaaggcaggaggaucaccugaggucaggaguuugaaaccagccuaaccaacauaaagaaaccccaucucuacuaaaaauacaaaauuagccggacauaagggugcaugccuguaauccuagcuacucaggagacugaggcaggagaaucgcuugaacccgggaggcggagguugcggugagccgagaucacgccauuccacuccagccugggcaacaagagcaaaacuacaucucauuuaaaaaaaaaaaaaaaaaaaagaccccaucucaaacuaauaaaaaaccaguacagggucgggcgcgguggcucacgccuguaaucccaacacuuugggaggccaaggcggguggacugccugagcucaggaguuugagaccagccugcacaacaugaugaaaccccgucucuacugaaauacaaaaaauuagccaggcaugguagugcgccuguaaucccagcuacucggaaggcugacgcaggagaaucacuugaacccgggaggcagagguugcagugagccaagaucgugccacugcacuccagccugggcaacagagcaagacucugucucagaaaaacaaacaaacaaacaaaaaaacaguacagucgugugccacuuaacaacguuuggguuaacaauggaccauguauaugaugguggucccauaagauuauaauacaguauauuuuuacauaucuuuucuaugucuauguuuagauacacaaacauuuaccacuguuuuacaguugccuagaauauucauuacaguaacaugcuguacaaguuguagcccaggagcaauaggcuacaccacagagcuagguguagaguaggcuauaccaucuggguuuauguaaauacauucuaugauguucacacaaggacaaauucuccuaagacgcauuucucagaauguauccccaucguuaagcaauauaugacuguaauacugagcacuguuugcaauaaacaggccauuccauucagcauaggccuggaaaucauuuugcuauuaccuagagauuuuuaugacaguuauauuuaauagaagaagauuuagucuauaauuuggaaagccacauguauauuuucauuagguucacauaagccagugugcauggguaggcgauucucauacaauccaagcuaaaguguuauuucuccucugaaggcuggaauuuccugauucuugcuucuugucuauuuauuucuucucuuccauugauguuggucccaaguccaggcaccaguaguacacauaaaauaggagagaagggaaaaccacacaucccuuaggaaguuagggauacugaaagcuaccagaaccacauuuagacaaugaauuagacuucuaaaauagcacaugcuaugacugcauuuacucugagaaauguuuucucccauggcucuuguggucaaaugacaaugaggcaugcuggggcuugaagacaggugaccaaggagauacaacccuaaaauuagagugggucaacaagaaaaacuaaggggauagcauuucggcaggaaacgggguaaaaucaagagcauaauuuccuggcaaggcgccacagcucaugucuguaaucccaagcacuuugggaggccaaggcaggagaauugcuugagcccaggaguucaagaccagccugggcaacacagugagaucccaaaucaucucuacaaaaaauaaauuuaaaaaauuagccaggaguggagacucaugccugugguccuaccuacuugggaggcugaggugagaggaucgcuugagcucaguaggucauggcugcagcgagcugagaucgcauuacugcacuucagccugggugacacagcaagacccugucucaaaaaaaaccccaagagaguauaauuuucuuuccuggauuuagcauccugagauuagaaaucugacuguagagauucuaguucagucuuggaguauuuuuuuauauuucuaaagcuuauaacauugagaaguuuaagcaauaacuuccaaacugcaagcuuuaaacaaauaguacuuaugcaaugaagcaaauacuuauacggugugcccaggcugaaugucacuggcauauuuuagcauauuuaauaaaacaaccuugacuaaccuuaaaaaagagagcaacaacaauaacaaacacccacaucaaaagaagaaaucuagggcccucugagccuuuguauccugcugcuaggcagccuucugaacuuacaaggguaacuuacaaggguaaugugccagacuuugaucaaauuuggccuaguuauuaguuccuuuugaaccacagacuuucaauccaagaucauuuaaagcucuacugaacagcagccugucuggucauuaaaaaagagaaaagcugcugggugccaggccagaacaauagaaacuaacaaaauacgggugauuuuccuucuguuauuucucucugguucagugguuuuauguggcgaauugucauguccucacccaacacguucuacuucuuucgaacagcguguuuaacaccugaccagcuacauuucuccugugguuugucuggcuggguggcgugaagugagucugugugcuagggaauagggucugcugagggccaggcuggccuuuugcuuauguuccuggcucucaauggguccugaaugcuucacuaagcacaggcaaugagcaccacgguaaagugggaagagauguucaagacugggugccuacacucagcaaguagagagguaagacaaggacauuaaguaugaacaggcaacuagagcauuauaaauuuuaccucuacccuauuuccaaaacauauuugaaguagcuugaggaggcuguaauaauauauaaugguuuccacuuauuagggcucugugccaggcacuauaguagaugcugagacauuaaugcugcucaucuugggaggcagagauuguuauucugauuuuacaagucaggaagcugaggcccagguaggucaaauaaucuguccaaaaccucaugguuaagggcggaggugggguucaucucaggucugaugccaaaccuuuccacagcugagggcuaugauggaagaaggcaaggacauuuacagcuggagcaaucuaggaaggcuucguugagaaguuggacucugaguuggggcagcuucaggagccaaggauugaugcugccugcaaguggugaggcagcuuggugaccaccucagggacagaagcaggacgauccccaaacccucccugacucacaaagcuuugacguagaugcugcacaguagcuacaucaaaacugcccuuccuuuggucucuuuuaagucuacuugugaacuuguuggcauccauacaugaaaauuugcuuggccauagaauugccucucuguucugauuguuccugugucugcugccucugacauuagaaaaccugaacuaaauagcauugaaauuggacaugagacaaagaaaucagagauuuguuggcguugcuucaaaggaaaagauauuuggcuuuucuggaaucaccuguucccuguuuacccugagauggguaaugaugucuuccauggacauccucaccugugaaggcagaaggucggaaugcagccaagcggggcaacaaauuaaggauugucauuuggaucagcgaguucuugcuauuccugcauuucagcacccacuggcacaccugagagaggaaggauaaaggguuggcaggggaaaagugagguguggagcuuaggaaaagagggaaagggccucucaccacuuaccugaucaaauuucuccuccaucaagucucugcaacaccggcucuccaccaggguggacuuagcuggacugggggaggucccaaaucccaugaggccuuggugagagcuguaccccagcagccccaccaaggcauuugacugcuggggcuguacagccuggaaacuggugaaggggguaaugugacgagguuuuguuccgaagcccaugagaucuuugcaguacuugucguguaccagcugcugcugugugauuucuuccauuucuucucucagacgcuauauauaugaggaggaaaaaaaucaucuuuacuuaugacuggcauucaaacugggcacuguggauucuacagacaauuacauuugccuaaucccgaaacgcaacuacuuccaaagugaaggguggccacucuucauguuuaggguuacaauuuccccagaaccuugcaagggaccugauuuuguucuaaguuaggcagaagagcaccaccuauugaacaauaaagcagcagcagagggcugccuugccaaggguucucaccucccaggacuccucacuugguuuggaagggcugacuugcauacugcugugacuacugaccuaggccacugcaaugaggcuugcaaaggugaugggagcuccccugccagcauccuguuaaggacugucugaucucuuucuucucccuagaaacccagguaaaaacuuaugcaggccaggcgugguggcucaugccuguaauuccgguacuuugggaggccaaggugggcagaucaccugaggucaggaguucaagcccagccuggccaacauggugaaaccccgucccuauuaaaaauacaaaaaauuagcugggcgugguggugggcaccuguaguccuggcuacuugggggcugaggcaggagaaucacuugaacccagcaggcagagguugcagugagccaagauugcaccacugcacucuagccugggcgacaagagggaaaucugucucaaaaaaacaaaaaacaaaaacuuaaccaaauaauuuucucagaauccuaggauuccacagguaguauggaauaagcugacugagaacucaugucuauuaccuuuacaaugggcugcuuaaucacucauccugagucaggcgcaagggcucacgccuguaaucccagcacuuugggaggccuaggugggcagaucaugaggucaggaguucgagaccagucugaccaacauggugaaaacccguuucuacuaaaaauacaaaaauuagcugggugugguggcacaugccuguacucccagcuacucgggaggcugaggcaggagaauugcuugaacccaggaggcggagguugcagugagccgagaucacaccaacuguacuccagccugggcagcagagcaagccuugguuuugggggccaggggagggggguuggggacuacucauccuccaagacuccaaauugagaaggagauacaaguuuuccaaacuucuaaacuuuucuugacacacauauuuucacuuuucagaaaaucuuguccucucgucaaagucaccagugagucuuuuuuuuuuugaaacuaaaacacuccaucuuuauuuauuuauuuauuuauuuauuuuuuauugaucauucuuggguguuucucgcagagggggauuuggcagggucaugggacaauaguggagggaaggucagcagauaaacaagugaacaaaggucucugguuuuccuaggcagaggacccugcggccuuccgcaguguuugugucccuggguacuugagauuagggaguggugaugacucuuaaugagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuaccucuuucuacacagacacggcaaccauccgauuucucaaucuuuuccccaccuuugcccccuuucuauuccacaaaaccgccacugucaucauggcccguucucaaugagccacugggcacaccucccagacggggugguggccgggcagaggggcuccucacuucccagcaggggcggccgggcagaggcgccccucaccucccggacgggguggcuggccgggcggggggcugacccccacaccucccucccggacggggcggcuggccgggcagaggggcuccucacuucccaguaggggcggccgggcagaggcgccccucaccucccggacagggcggcuggccgggcggggggcugaccccccgaccucccucccggacggggcggcuggccgggcggggggcugaccccccaccucccucccggacggggcggcuggccgggcagggggcugacccccccaccucccucccagauggggcggcuggccgggcagaggggcuccucacuucccaguaggggcggccgggcagaggcgccccucaaccagugagucuuaagcugcuaaauccaauggucaauucuuaguccucaucuuauuugacuuaucugcagcauuucauccaacugauacuuccaccuccuugacgcccuuucuucaccuggcuucucagacucuaaacucuccuggcucuccuccucccucccuggcuguuccuuccccaucugccuugguccucuucaucuccugaccucagguuugcagacuccaucucuucuccaacuguacuaguucccuugugcuucucacccagucucaugaugaaauaacaucuauacgcugacaaugcccaaauccaucccccuugcccagcucucuccccagaacuauucaguauccucacucaggugcccaacaggucucuaaguuaacagguucaaaaccaaauucccagucuucucccgcaagccugcugcucccauuucagucuucccacugcagugaauggcaacuucauccuccuaauacucaggccaaacaccuugacacuucuuucucuccaucuaccuccaaaccaucagcaaaucccaaauucagaauccaguugcuucuugcaacuccauagcucccacuguggucugagccacaaauaucccccacuaagaccauggcaauucccuccuaacuggauuccuggcuuuaguccuugacccucuaacaauccauucucaacacaauggcaagagugauccuuuugaaauaugaguuaaaugucacuccacugcucaaagcccacuuauagcuucccgcuucccacacaaaggcccuaugugauaugccccuccuucccuuagguguuccucugaccccauauccccacacacuucuccugcucacucugcucagccaugguaggggagcugcuacugcaguauuugcugcuccucuaauacaccagcacgcuccugccucagggaccacugccuagaaugcucuuccccagauaccuguagggcuuuuuucuaaccuccuucauggcugugcucaaauagcaccguguuuuaaaauguaauccuuaauccaggugagcauacucuauuccccuuccuugcccuacuuuucuccauagcucuuauaaccauaugauauauaauagguuuuuacuuguauauuaucuaucuucccuuauaagaauggaaucuauuuuguucacugcuggauuauucuagcucuuaggacacaguguagcuggcauauacuaggugcucaauuaauauguguugaaugaaugaacaaauuaugaaauuuuaauaccuuauauuuagauaguuucuuuuuuuuuuuuuuuuuuuagugacaaggucucauuauguugcccaggcuggucucaaacuccugagcucaaacucccaccucggucucccagaaugcuuggauuggauuacaggcaugagccaccaugcccagccuuggauaguuucuuauaauuuacaaaccaccugcacaagaacuauuucaaugaaaucugacaaccacucuaugagcuaggugauacuguccuguuuuaaugggaggaaacaaagaucucagaggugccuagauuacaguggaaaacauuauguuaaacucaggagguaaaaucugaagguuaccauuuauagaaugcccacuauguauuaggugcugugcuggacacuucacacacauagucauccccuuaguauccauggggguugguuccaugacccacugcgauaccaaaaucugcagaugcucaagucccuccgauaaaguagcauaguauuugcauauaaccuauguauagcuucccacauacuuuaaaucaucucuauguuaguuauaacaccuuauacaaaguaaaugcuauguaaauauuuguugcacuguauuuuuaaaaauuuguauuaucuuuaaauuguuuguuuuuuccuugauuuuuuuuuucuuuuuaaaaaguuaaaaaaauuuuuuuguagagacacggucucaccgucuuuugcccaggcuggucacgaacuccugggaucaagugaucuucccacuucagccucccaaagugcugaaauugcaggugugggccacugcacccagcccuggguauuugugaaccaugacuaguugaauccagauguagaacucauggauauagagagccaacaucauauagaaaccgcacaagagcccaaugagguagguaagagccccuguccaaagggagaaaaaugaggcuaaacagguaacuugccugagucgcacagucaucagagcgguggggaucugaagccagacuccuccugcuucugcacacugcugcaugcgcugcucccacaucugggcauggcuauuaucuaacaagcacugugucuauuauaagcaggaauccccgggguaaaauuucacagcucauuuucuacagccagucucacagauggagcuuuaccucccaaauauauccugaaucaacuacuucucaguaucugugccaccacuccuagucaaagccaccacugucacucacccagacuaccguaauagcuucgucuggcagccgugagaaugcaaccuccaacuacaaggcgcauaaccaagggccccagcugcugcucugaaacccaucacuaaguuugugccaacgucacccauugcucccagccaaugacagaacacaguagggaugcuaaggcuauccugcucuugggagacacagaccucucugacagccaacuuuggcuugaggaccccgcgguggcccugcagaguaggcuagaacacuucuauccgaauuuuacccucuugcuuacucagggucagaugugcauugugguccgaugcuucucccagcuuccuccccauauucucuugaaggcuguuucccuaauaaaauccaugcacuuuuaaauccaccuucucaagccaacacaucuccuaauuggucucccugcuuucauuccugccuuuccccacauuuuuuccuauaagcagucagugauuguuagaaacgcaugacaucacauuauucgccugugugcauacuuccaauguuuaccccugugaaagcucguguuuacugugaaccgugggccuauuaauuuggccccuccuucccucucccuugcucccgguacaccagccauacuucccuuucuucuguuucaucaaugucucacacucuuccaccucaaagccucagccuggaacacagucccccggccugcugcaagguagcuccuucgugucauguggacccccgucaaauaacaccaccucagggagggccuuccuugacccuccacucacccccuccccaucacucucuauucuauucugguuugacuuucuucauagaacuugcugcuaucugaaauuaucuuauuuacuuauuuauuauguuuccugccacaaaaugucagcuccaugaggacauggaucucgccuugccucgcucacagaaugguacacggggagccuggacuccccucugccguggcuucucaccucucccuccaugcugcugauucggaccagcucguuaaggaucaacaaggcuccauggauccgaucaucccgauucaugcccuucucuuuggccaaggucucaucaaaucccuucucugcuucuucaaaugugugcuauguagagagacagggugccuucauuagagacagaguacaaacccagaaagaauacaggcccaucccaucuacacuggggguucugaggugcuaccacgccugcucagugccuagugccagucaucaacaaaacuaacugaucaaucucuuuuauuuaauucagcuucaauuuuuuuuuuuugagauggagucuugcucuauugcccaggcuggagugcaguggcgcaaucucggcucuccacaaccuccaccuccuggguucaagugauucuccugccucagcccccugaguagcugagauuacaggcacacacuaccacgccuggcuaauuuuuguauuuuuaguagagacagggcuucaccauguuaaccaggcuggucucaaacuccugaccucaagugauccacccaucucagccucccaaagugcugugauuacagguguaagccaccacgcccagccccagcuucaauucucauaauaagccuuugaggaagauaccaucaucaucccuauuuaacagcuaaaaacacaggcucaaagaauuuaagugacuuguccaagaucacacagcaaaggcaagacuggaacccgcaucucccaaucccauguucagagcucuuuuucuaauauaagacucacugauaaguucccucugcagcaguaaucagcacaggccucauuauacuagagcagagagaaauggcacuuucuaaauuaguaucauuuguaucucacugauuuugagacaccuauuuuuccguauuuuaacaucucugaaaagagaugucuuuuuuuuuuuuuugagacagagucucacucuguugucaagucuggagugcaguggcaugaucaugacucacugcagccuugaucucuugggcucaagcaauucucccgccucagccucccaaauagcugggaccacaggcguguaacaccaggcccagcuaauuuuuuuauuuuuuguagagacgggaucccacaugcugcccaggcuggucucaaacuccugagcucaagcaauccuccugccuuggccucccaaaauguugggauuacaggcgugagcauccagcugagaugucuuauaauuaauuauuaauaagaagaagguacaaaguuggccgggcacaguggcucaugccuguaaucccagcacuuugggaggucaaggcagguggaucaugaggucaagagaucaagaccauccuggccaauauggugaaacccugucucuacuaaaaacacaaaaauuggcugggcgugauggcacaugccuguagucccagcuacucgggaggcugaggcaggagaaucacuugaacccaggaggcagaggcuacagugagacaaaaucacaccacuaaacuccagcuuggugacagaacaagacuccaucuccaaaaaaaaaaaaaaaaaaaaaaaaaaagaaagagguaccaagucacaguuuaauuggcauauuugcauucuuagucauacauaaaauaauguauagaauaaugguauggcuaucaauagauguuugcuuuaauaaaaugcaauaaaguaacuauugauucauacugagcauaaaaaauucauuggaggccaggcgcgguagcucaugucuguaaucccagcacuuugagaggccaaggcagguggaucaccugaggucaggaauucgagaccagccuggccaacauggcaaaacccugucucuauuacaaaaauuagcugggcgugguggcacacgccuguaguccuagcuauucgggaggcuaaggugggagaaaaucgcuugaacccaagaggcggagguugcagugagccgagauugcgccacugcacuccagccugggcgacaaagcaagacuccaucacaaaaaaaaaaaaaaaaaaauucauuugagagcaaaccaaaacgugauucuugcuccauggcaagggcuuguggcugcccuuuaggccaggugauucucuacgcagaugugcuuugcuaguggugggaauggagccaucuccuuacccuguaccacugaggcuucugcaucuccuucggcucacgcuggguugugagaaucagacaggcacgaagggcggcuacagcucccucacggauggccuguuuggggucccacacggccacaaaaauguugucaaagaaggguugcacuugcuggaagaagaagguagggacgcugauggccagcucacggagaaccaggaccuggagaaaaaagcaaaccgagaacucucauugguaccagaguuuuguucucucaggaguacagucucuugucaucuuagagccauacacaccaggaacagagaaggcuugcucacucuucuagcuaggaaauucugaggacagaggaaggaaagcaaaauugauuaaacaucucagugcucauuauccuagguuguuuacaaacacagaaugcuuguaauguuugaacauaaguucuggaagugcagauguguuuuauguuuucuuuaccacuauacuaacagccuagaacucuaccuggaauacaguagguauguaguaaauauuuacugaauggauaauccuguuuaauguuuaauccuguuguuauuuuuauuugacagaggaagaaacugaaggucagaagcugccccagguuacagaguuagguaggaaguugcaaagccaagacuugagccaggguccaaguguguguccuuuuccugguaccgugcccccuccucacaguacugccuccuccgaagggcagcagacuggaaagcacgcagcugaugcuucugauccccaccacaccaugcuagauucccucuuaaggacggacucuaccccaucucacagccuggaauccuagcucuucuaaccagcuuuuuuaaggaaugagccucagaaggaagcaaaagacccccccaugacaccaucguuccccaagccuggcugugcuccucccuguagacacucacagcugcaugucuccggcccucauugcggucagcacccagccauuccagggcucgcuucaccucaaauuccacguacucagcgguaaaaguguccccugccauggcaagacggccaauggccuuggaugccauuuccaugacaacugggucauuggaggggaggagguuccgaagauaguuggcaaaucugccaauucggguggcauucccaccuuccacuccuaugaggcuagcugcaaaagagaggaaggcaaaaggugaugauggggcguaugcuggccaggaaaguacgcagacuucaacuaaaagcuggugagugccggccaggcacgguggcucaagucuguaauccuagcacuuugggaggcugaggcgggcggauugccugagcucaggaguuugagaccagccugggcaacauggugaaaccccgucucuacuaagauacaaaaaaaaaaaaaaaaaaaagaaaacaaaaaaauuagccaggcgugguggcacacgccuguaaucccagcuacuugggaggcugaggcaggagaauugcuuggaccugggaggcagagguugcaguaagccgagacugcaccauugcacuccagccugggcgacagagugagacucugucucagagaaaaaaaaaaaaaaaaaaaaaaaaaucuggcgagugaacccuccauucuacuuugaguacauuucuagauggcaaggacagauacaauuuucauuuuaacccagauauuuaauacuugugccagaaauauuuacauaaagcaaaauaaucucaugcuaguauaauuuucuccccuaccccccaaaaagggaaaacaacugggacuggauaauaauucacaggacugaugaccaguccuuagaaguuaaaaaugaccugccuggccaguugugguggcucacaccuguaaucccagcacucugggaggcugaggugggcagaucacuugaggucaggaguucgagaccagccuggccaacauggugaaacccugucucuacugaaaauacaaacauuagcugggcaugguggcaggugccuguaaucccagcuacucgggaggcugaggcacgagaaucgcuugaacccaggaggcggagguugcagcaagccaagauugcaccacugaacuccagccccggcaagagugagacuccaucucaaaaaaaaaaaaaagaccugccuuuuauuaacuauaccgauuccacuuuuccauucgugagccccacuaugcgaaacccugcucuacugaggaagcagagcccacaaaaggcaauaugaaggaguggaaagaaagcuggcuucuagucucagcucugguaaacugucugaaaagucacucgaugguuccgagacuccacuuccacaucuaaaaauacguuuuuccuguggcccagggcugcugcuagaauuaaaagccacgggcuucuuaaauuucauuaagcaaauaugaacuaguauccaguaaguggcagacacagggugcagugggcacaaaggugaguguguuguuuuugugaccagagacucuguccuuaccuauggccaagaugccaccuuuccucucauuggcaucugagcuggaaaccaauucaaaaaugugaugguucaguuggucauagaagcgaguagacuccucuugacucaucugcaaaagaagauauaaucagaacaauuucuaauaauucucuaacugugguggugggagugggcuggcaucuaaagauuagauccugagaggcaggagguauaguucaaaccaaagaagacaaguuacugcccauuucuauaggauuacacuguagaguaccugaacuugcaaucaucugauuauuuaacaaauauuuauuagguaucuacucuguggcagaaaauguccuguccuagguucuuucuaguaccagggauaaaaggagaaacaagauacugucucugaccucaagucuggucucuauuuagaaagccccuagcucucaacucuccaaacccaucccaaucacuguuaucagacagaaagcauuugagggugugguaugugguaaggaaaaaauaaaaaguuaaaagaaacagcuaagucuauucuggccccuaaaaugugaccacaaacaagaaaaaugcuacaaaaaugugcaacugcugcaaaagaaccugcauguuuuauggaugugacagguugggugccuuuauaaaauaaucucuguuuuccaaauccucacuuagcuguacaaaaaaaaauguaaaccagugaugguacauuuagcccacacaucccacaaugacuggccccagaucccagaagcaccucucggaguuccauggugacauagugcuggagcuccuuggcggcuuuggcccugguuuccucauuccggcucuuuaggccacuggcaaacugcugcaggacgcucacauugcuagaugugguggcagcggugguggcggcggcagguccgguuccaagcaucuugcccugagguucuuuagagagaaguuuccuuuaauauucuggauaagaaaguaugaugauaaauuuacuuauggcccuggucacccaacacagaucucccccuagcccuugucaggcaggggauucuaaaaagguugagagaucugauugaggaacauuuagaaagccuagauucauuaaacaaugacugauguuuaaaagaggcaguguaguagggagguuaaauugugggcuaucggccuagccuacuuggguuugaauccuuggguuauauaccuugagcaguuugggaggcugagccuggaggaccaccugaggucaggaauuugagaccagccugcccaacauggugaaaacccaucucuaugaaaaauacaaaaauuagcugggcgugguggcaugugucacccaggaggcugaggcaggagaaucccuugaaccugggagguagaggcugcagugagccgagauccugccacugcacugucucaaaacaaaaacaaacgaaaacaaaaacaagguuauauaccucaagaaagacacucaaaauguguuucuucaacuacaauaggaagauaauaguaccuaguucauggguugaugugagaacuaaaugacuuaauacgugucaaaaaguguuuaaaacagugcagggcauauacuaaguucuuaauaauuguuagcuauuauuauuacuacuacuacuacuauguacauggcaaaaugccagguaacaaaugucaggagguagggaaagaauuaaaaaugacuaagacugccccuuuccucaaguucagucuaaaaagagagauuauuauucuacagcagcacuaucuaauggaaauuuaggccgggcacaguggcucacgccuguaaucccggcacuuugggagcccaaggugggcagaucaccugaggucaggaguuugagaccagccugggcaauauggugaaaccccgucucuacuaaaaauacaaaauuagccaggcguggcagugcgugccuguaaccccagcuacuugggagguugaggcaggagaaucacuugaacccaggaggcagagguugcagugagcugagauugggccauugcacuacagccugggcaacaagagcaaaacuccaucucaauuaaaaaaaaaaaaaagaggaaauacaaugauccacaaauguaauuuuaaggcugcuuguagccauauuuuaaaagguaaaaagaaacaggugaaauuaauuaccuaaaccaauauauccaaaauaucauuucaacauguuaucaauauuuaaaaaauugauauaguguccauucuuuuuuuuuagcgagucuucaaaaucuaaugugcauuuuacacuuacaacaaugucaauuuggacuagucauuuuuuuuuuuuuuuuugagacagagucucgcucugucacccaggcuggagugcaguggcaugaucucggcucacugcaacauccaccucccggguucaaaugauucuccugccucagcuucccgaguagcugggacuacagaugugcagcaccacgccuggcuaauuuuuguguguuuuuaguagagaugggguuuuauuauguuggccaggcuggucucaaauuccugaccucaggugaucugcccgccuuggccucccaaagugcugggauuacaggugugagccaccaugcccggccuggacuagucacauuucaagugcuccacagccacauguggcuggugguucuuguacugaacaacgcaguucuacaggggacuagcucuucaaauguaagcuaaaagaaaguaauuaguuccuggccggguuugggaggccgaggcgggcggaucacgaggucaggaaaucgagaccauccuggccaacacggugaaaucccgccucuacuaaaaauacaaaaaaaaaaaaaaauuagccguaugguggcgggcgccuguagucccagcuacucgggaggcugaggcaggagaauggcgggaacccgggaggcggagcuugcagugagcagagaucgagccacugcacuccagccugggcgacagagcgaaacuccgucucaaaacaaaacaaaaaacaccaauuaguuccugagcucauucccucauuccucaauuaugcccacacugccauggguguaacauacaccuaucccaaguauguucagcuuaugcuacaaaaccaauuucucaaaauucuuauuuuugaaagaauuuguaaggcacagaggaaaaaccugggaauaauugguuuuguaaagcuuucaaauacuccacugccaagaagaagacugcagaaagaaaugucauccuuuaggggagaagaaacuuaagaaucccugcuaagaaaacuacuccaguuuguguguaugugugugcguccgaaaggggggaagguggcuggcaagggauuucuauucucaggaaagaaccaguguaucuuuauaugaucugaggcccacaggccaucugcuccagacugaauucaauuaaacuuaggauaucugaagucaaauauccuaaugguguugauagggcuuaaggaaguuaagauuggaugggggaaacagggauggggcugggggagagggagagaagauguaccccaacgauguaaccaagcucaguuucggggacuggaucucugagagguguccacaguggaggacaaggggcugacacggacgcuaguguucccuggggcagagauacacaauuuuuauacguggcucaaaagaaaggguggcugugacaggcaaaagacccaaagggcaauaccagagcugaugggccggccuucgggcggacguaccgcgggccgaaggguccaggggucucuugggggucccggggaggugggcguugccucgaggggugggagucaaggccucagacggugcccaggucguggggccggcaauguggggaccccacgucccagacgggcggcuuccccuggcccccccacgggcaggcuggccgugggucuggacauuacgccgcccuagaggggucgugccaggcccuagacucaccgcgcggcuucggccaaggccucagcugccgccgccagcaccgguaccgccgcuucaggcccccugccccaccgcccgccuu

SEQ ID NO: 21394 - RNA, 984251 nt, Homo sapiens
uggggaaauuuucuucauuuuuaauuuacagcagaaagaauauaaagcauucagaaaacauuuuccauauuuuaagggcaauucaaaacauuuugcaugguuuccagcagcugaguucuucaacagauccauugauucaaugaugcuuuacaugcacaauuacaaaaauaaaacuuacaaaaaaagaagacaucuagacuaguuuuacaugcaagucucagggaccccccauugggcgccaacuacuguguggaacugccauaagcgaccgugcagccagagagggguucguauuauugucuuuauuucguucacacaguacagcugauuucgaauggguaacaauagcaauuaaaucuucaggagauagaauaagauuagcuauuaauuuuauaaugaaauccuacuccuggcacuugggaauucagauuauccaagaaagcugcgcuuaccuaucaucuuauauucgaaauuaagauucauaaccaagaaaaagcggucagaaaugcuucguuucaguggaagugcauuuuugccuugccuaggauucacaguuguacugguagguuacacugguaggcuuuaaaccuacuuccuauccccuccaugagaacccucuuaauucuauggaagucucuaccaucugucauuuucuaacguauucagcuaauaauguaacaugugaaacauuaaaaaaaaaaugugaggguuaaagcaaauccacugaggucauuacucugguuaaaacaucaguuauuuguaccauaauaaauggaauaaagauaucuaaauucaguauuaauagaggauauucugaaagagcuggcuuucacguucuauucccauuuaugaaugcaguuguguuuguaaauuacucaguguccuccuauaggucaaauuguguaaaauaauagguaucugggggacugcaacagcugcaacauaacccacacauuuaaaaacaaaauggagucaggucaguuuacaaauguacagguggcuacuaguuguggggcugucacuguugucaaagcugaucacaagcagaaagacauauacuguacaguaauucgagguuggcagugaaaggaaguaauuaaaaaacaaguacaauuauagaaaaggcaccaagagcacugaccccaguuuuuaccacaaucuuuuuguaucuaccuuccuuccaaagacaccaguuuaaaagcuuauuugugaauauuuuuaggcuucacaacaagccuugaguuuuaacucacaguuggcagccagaaccaagaaaaaacaucucagcuuuacaccaacugauccucagacguaaccugggaauuuuaaacuggcaucagcaaauacgaacuuuauucucucaauuuaacauuagcaguuuaauuguuaaaaacaucagauuucuuuggcuccucauuauguggaaauaguaauauaccaugccgucucuaaaagaccagucugcaucuuuuucauuuuuuuuuuugugcaauuuuauuauauuuucugauuuccagcaggagauauggaaacgugacauuuuucuacuuuucauacuauuucuuuugucagguuuuuuuuuuuuuuuuuuaucauucuaaguguucuuuguuggagugaguggaugguguuaagcuacauacugauucaucuuaugauuaucuguuuugcaaaaguaacuuaauuuucuuaagcaguauuagcauucacauuacuuggcaccauuggcaaaaaaauuuuaaauaaaauaaacuaaacuccugguagccaaaauuaaauguaaacauauccuuuuuuuuuuaaguaauguuacucugccuuuuuuccuaagucuaaauacaguagcucuuuuuuuuuuuuugcaguuuagucaugcuuuagcaaaauguucuccuaaagaacauuuaaaauaaaguacucuuauagugaaauaaaguuuuuuuguuucauuuuacagaccauagccacuaaugcuuugcuuuuguucauuucuuuuuucuugauuucaugcacauaucucuguuuuaauauauacaauauauacaaacaguacauccacauuuuucucgcucauucagacaaaacuauacaaauaauuuuaucuugccauguuauugaccuuugugaauaaaauauuuagcaauuaauauaaucccuuucaaauauuuucucacuuuucauuucuaccuucuauauauacacagaaacugcucaguuuggaugagauauagccaaaaacauggaauuuacuggccagaacgcagcaccacacugaucguuuagguggcaaauguccaggcaagguucaugauuccuuagaauuacuacagcuuccaagguuacuaaaaaaggcuacaugcguuaccaauucuuaaguaauucucauugcacaugaaaguaaggcaaaaaaauuaaagugcugaacaugaaaaaggggacaagaugauuacuacccucgcagguucuuggaaggugguggggacaagaaaauaguuuaaacucugugagcugcuucucauuauuucccaugcauuacccguuuaccacacaccugccccucugcaaauuuccacaagacauuaaaaaccugcagauuucaaaaguugcauuaaaugugcuguagagauuaaaacaaacaaacaaacaaacaaaaauaaacagugaaggaaaugagaacacacggacccaauaaagauuuuuguaugaucuaagcccuccacugagaaucagucccaaagauucagcuucuuggaaauaaccggcaggugcaggaacagcauucuuuuuuuguugcuaguauagccccaccuuuucuuaucuauauuuuugguauaaauauuuguacaguuccacacgauguuugaauacagcccuauaugagaaggaaauggcuucuuccugagaagaggaagccucuuucaauuccuccugggugucuugauuucccgugauccaacagaagauugaguuccaagaugucuugcugaucaaauuaaaaguuguccaugaaagugcaaaugcaaugaccaaaacauuccuguuaaaauccugcagcugaucuccccaaaacugcagagggauuuuguauguguguguacgugugugugugugcgugugugcguguguguuguuguugcaugucucugcuaaaaacagaaaugaaaacagucugaaaagcaaugucacauugcuaagggaugcugcuguaugucuucaaguuccuuggccuuuuucaauucuuucacucuggaagagaaacaaaacaaaacagcaggcgauaacucuauagugaauugugaccaaguaaaggaaagggguauuaccacucccucugaacugaaaagccaagacuaaaaccguuuugaggauugacggcaaaagaaacuccugugaaauuguuggggaaaauauucaaaggaaagacgugacccuacuuaaggugaaaaaaaaaucauucuaaagcuuugcucuacaucgagcgcucuaagaauagagcaaaaucaaagucuaauguauuaaaucaagugugacaaucacauguuuaucuuaauaaaaauuuaacuauucaaauaacuuucuuuuuagucucguggaccaccauuaauguccuaucacucuguaugauguaaauuagggaaacuguacaugcauuuauuuaguuuuuuuuuuuuuuuuuuugagacagaaucucgcuguguuacccaggcuggagugcaguggcaccaucucggcucacugcaaccuccgccucccggguucacgcaauucuccugccuuagccucccgaguagcugggacuacaggcgcccgccaccacacccggcuaauuuucuguauuuuuuaguagagacaggguuucaccauguuagccaggaugguuucgaucuccugaccucgugauccgcccacccagccucccaaagugcugggauuacaggcgugagccaccgcgcccggccuauuuagcuuuuaauauaucuagggauuaagcuacuacugcuuuguucauagacucaagauuguuagcuuucuugaaccuaaucauacaucuguacaacucuacuccuucacacagguuuuguggagacuuugauuuuuauaauuccuuacuuuccucccauuccacauuauaacuuaaaaagacauuuagguuccuccucccagugaucccagauggacagccauagggugcgauacugauaagguacuucguucuauucaucaaacauacuguaguaaacaaauuuaaauaacauuguuauagacugagucauggaaaguucacaucagcaaauuacuuauuaauuaucacugccaaucuguaauuuuuaauauaaaaaucagucucaguuuuuuuggauauggccaccugauguagauggggugcuggggaagcugcugucugcuguaagaguauuucucuacacugacaauuacgaaccugccuuaauagcagaaugaucaaauguaaggcaaugcaugugguguaagucacaguuugugguacugcauaccauauaauaacauuuguuucccaaaaauggaugugagaggcugauuuagccaaauaggagcaacaguuucuuaggacaccauacucuacugcaacagcaugaucaggaaaagguggauuugucguggugcuauacagagggcuauaaucucaaauauauuuuucugauucucuaagaggcucuccuauuaucuuaaguuauaccaguaaaguaaaacuuuuuuuuuuuuuugagacggagucuaacucuguugcccaggcuggagugcaguggugcgaucucggcucacugcaacuucugccuccuggguucaagugauucuccugccucagccucccgaguagcugggauuacaggcacgcaccaccacgccuagcuaauuuuuguauuuuuaguagagaugauguuucgccauguuggccaggcuggucuugaacuccugagcucaagugaucugcccaccucagccucccaaagugcuugaauuacaggcaugagccuaccaggcccagccucaaguaaaaccugauaauacucaggcagaaagaaaauagugugaaaaaaccaguaaucaguuauugcuauauuguauagguugagagucuggaauggcacauaugguauaauagcaauuuaagaaaacauuuauauuuaccacuuccaagcagaaucauuucugaguauucugcaaaguugauacaaucucuucauagagaagaugcucucuuuuagaagaaaagcuuuaugauguuaucaguaauacuaaaaagaauuauaaucuuugaaaacuugcuuacuugucugauuuacuuacuacauauaccaagcccuagcuugguccuagugugauuuuuauaaaugacagugacaaacaguguaucucuaaaacuguugaaucuuuuuuuguuaacaggcacaguuagaauacauugcuauguucaugaguagauccaaauaucauuuaguuuuaaauuuuauaauuaaauauaccauggauuaauuugggucauauuacaguauagaauuguacaucacuauaggucccuaauuuuggacaugcauacuugauaaauaaauggcuuuuuaaaaauugaaacaugcuauagucuguucaauuuuuaaacaugcaauaucuauacuaacaucccuuuggcuggaaaugcaaggcaugcacugaugccaacuucgcuucuggacaugcaauaucuguacuugugcagaccuaucugcugaauuucugcagcgugugcaugccacuucaaaugcuacauuuucuuucugcacuagcacagaccucauucacaaauaugcgacagugacuccaucacugaugagaugucuauaauuugaggaauucugaacucaaaaucugauagcauaaacacgacgauguuauacauucacaauuuuucucgaaugaacaggaaugcuuuagaaauauuaaguucaucauugagaugaaauaaaaaggagagugaauuauaagccagaaauguuuuaugugguuucauaccaaagaaucuauaaucagcuggucaggggagguauacccuaaacauuuuucuuuuaguuaaaauggucacauuuguuuuugcaguuuuuucaguuucuuucagaacuaauuaaaaaguuaaguuuucauaagguuuuaaaguugucaaguaaauacucuaugaaauuagugauggccucacagaccacgagguuaaggagaggugcauguccacguacaaugucuacgcaggaaaaaugagaacaaugcaauuuucagauauauuuuccaggcuuccacaacuccugaguuaaaguggagaauuuaguucuuagcuucaugauaaaguuaucauaguaugcuagcauuauacaugacaucaaaaugacuuaaauggcacaaacauuuuuuacagaaagucguucaaggaggaauuagaaaaaaaaggggaaaaugagagagaaaaaguauuaaauuccaauagcuauacagguuacuuaauaucuguuacuuuauguaguccucacaacacugccauuagcuccaauuuguaaaugcagaaucugagauuuauaggaauuaagcaaucugccccaauucacacaguuaauaaauggcagaacagggaauugaguccagguuugucugacuuccaaaccuauaguuucaacauuucacugucucuaaaaauaucucccaggauaacacagaaguauuuuaaaaaucauauuuuauuguuuuuucuaaaagacuuuauaagaaacaugcauuuggaaaauuuccaugguaugagaugaaauuaacaacaauuacauuuucucaauucuaaggugucaucuuuuauaagacacuauauugauuuuauuaauaaaaaacauucuuggugggggaagacccucacauaaaauguacuuauugauuuuacaacacaauuauuuagaauccuaaaaugugugaaaagaauguguguaagaaucaagggagauuuuuagcuuuauucuccaauuugcaauuuauggaccauauagauguuaacuuaccucugaaaguuaacaugaaauugagaggcuuacuaucugcccuagugaaaucauaaaugaaguuuuauguuacuugagaguagauuauuaggaugagacaguggggcuuaauuuuuguuuuguuuuaaaucaaaugucaacuggauaaaauaauguuugaauguuauauugccuccaaagaaacagaaaacaauuauaucaccaaagugauuuagaauaacauauacuagaauuuuaaaacaaauuuuaagaaauagauguuucaaaucagaguguuucaaauggcuaaauuuaugaucaccuuguuauuaguuaaggacaugaaugauuauucaggcagauguuaaaaauaaaucuuuaccaaugagaaggauacaaaauagaaguuuaaccauuauuaucucugggugauucuccuugguuauuuguauuuccagaauucacuacaauuaguaugugcugcuuuuguaauaauaauuauuccugcuuguuagcuuuuauuuucuccacuuauuuagagagaggguugaccagacuggagugcaguggaacagucauagcucacuguggccuggaauuucugggcucaagcaauccuuagccuuagccuccugaguagcuagacuacagguacacaucaccauaccuggcuaauuuuaaaauuuuuuugucuagacaggggaucuaaauauauugcccaagcuggucuugaacuccuggccucaagcaauucuccugccucagcccccaaaagugcugggauuacaggcaugagcugcuuguuagucuuaaaaaaaaaaagugaauuagaucguuuucuaucugucuguuacuaaucugucuuacaaaugcuguguucauauuauauaaaaacaacugaaaaauucauuggaaggaaaaaaauucaauuuuguagacugaaaccaaaaucaauggacugaacugguuucauuaacauuaccuauguuguaagcaaauuuuucaguauacaaacuugguaaauauagacaagaauuuuugaaauuggaauuagacuugaaaauccaggaccuguggucaccauaucuauagaacuuggaacacaggugcaugauaaacuuuuguuauguuacacacacuuagcuaaggguuacugagugcucaguucucuuaaggaauuacaacuguucgacucauucagggcuaagaaagaacugaaucuaaaaauguccaggcuaucuaaaaaaaaaaaauuauaacugcacuuacuucuaaauucacuuacacagaagacaggcaaagcagucuucccugagcucauagaggcaaugcaggacagaagcuacaguucccacagcgccagugcugcccucaggagagcugugcggccacauuucugacuccuaucaguaacuugcaaaguagaacucuuauuggcucagacucacaguaauuagaauagcaagacugaccuguuaccauucagcuauuaacauuaaagacaaucccaguauuuccccaagcauucuaggcugagaauaaucaccacucugggauaccauuguagucucaauucccccuucccaaaaaguugcaucguaauguacugaagugaugucguaagcaacagcacugaaagccagcaaaagcccacaggguuuacuuccaucagacguccaaugaucauuuaugaaucaaugaaguaggccugcuucagaaacuuguagcaaacaauggcuccauggguaaagcguaaggcaaagcugcuucauuacaucuacucagugaugcucagccagagaaaugucucaugagucaguggaguucagcgggaauauucucgcaaugcuggacgucaaaaauagacagggcagcggaugcggcuuucugauuauuaccuguugcuuugagagcugcaauagcuuguggggaauuuaggaaaagagagaucuugccauuuuccagaaaucucauuuggauugcaaaacaaaaaagacagagaggcccaauaagaaugacacagagcauguugucugcaauuuaacacacaccacuguguuccaaaaauauucauuuccuaaaagaggcaagugagacaaaauuacuuugaagauuuaaaauacauccaugaugacacaucccacauucacgucuuacuucucaugaacacaucgggccacuuagaaacuaugccucaugccaaauugagcuacggaagugugagaacacauuuguugacccuagagcacuguuuacuucucaguacacuuccccgcauuguuagagaacugucccuuggauaaaaguguacauaaaacagccaaaaguguaagcguaauuuucagaacuugguaaugacccagugcagcuaugacccggggcuguucucagaagcacacagcagagcugcucuguugagaccccuacuuaccagcuucuggcaaaguguuuggaaacccgguucucaaauaaaaagaaaauauguuguuugaaaauaugugacuaaaaaguguuauuucuucuuccuccaauuaagguuuuguuccaguaaaauaacugcaccugccuuuacugaacacaggugacuaggccagcaguuuauaagaaauagguuaauuaaauacuagcauucccacugcuuuuaauaacacccauagugauuguuacaguuuauaaagccuucucacagaaauagugucucguaucgggaaaggaggaauuugucuagaaauugcuuuucaaagagcggugucacucaucuaugagaacacuuucuacuauccacgaaaaauaaaugucuuagagaaguggaaagacauuuucugucuagaaaaacaggcauuuuaguuuuuauuuuuuuaggucaagcaagucucaauaccuugaggauaaaucuguuauguaacugaacuaccugcuaacauaugagguaucuugguuuuucucuaugcaacugaauaauauccuguuagauauacucaaaauccaaaugaaaguaucuuuucagcauauguacuuuaaaaguuucuuaaaccuuaaaaauccuucagucauuugcugagaaaucacuuuuguuaauuuaaauaaucucuuuguguagaacaaaaguucucuccuaaacacagcuauuguguccaagacaaaaaacagaaaaacaaaaaacaaaacaaccaaaaacccugaugacaguaucgagaguuuguuaauuucacuuuaaguuacuggauaaauuaagagguaggccugaaggaaagggggauaaaagugagcuguacucagugaaaaauauuuggugcuuuuucuuagccuuccccaagcaaagacuaaacauuucaagacacaagugguauuuucugauugcucugcugcuggaauuugucugucgugucuuaauucugccuuuuuagaucucccccugcuccacugacguaggaguuugggucaguauuaguguuuaacaaauacugucccauaaaauuuaauucuguaaguuuccagauauuauuuuucuuuucuuuucuuuucuuuucugggacagggucucacucuguugugcaggcuggaguacaguggcacuaucaugacacacuguagccucgaccuucugggcucaagcaauccucccaccucagccuccaguagcugggaaaauauuauuuuucaauguauaaaccauguuuuaaauauggaauacuuuacaaauuaacaaaauaaguauauuaucuuuuuuuuuuuuuuuuuuuuugagacagagucucgcucuuuugcccaggccggacugcaguggcgcuaucucggcucacugcaagcuccgccucccggauucacaccauucuccugccucagccucccgaguagcugggacuacaggcgcccgccaccgcaaccggcuaauuuuuuguauuuucaguagagacgggguuucaccauguuagccaggauggucucgaucuccugaccucgugauccgcccgccucggccucccaaagugcugggauuacaggcguaagccaccgcgcccggcccaaaaauaaguauuuuaucuuaacauaauuuccacgacuauaaaucuuccucagagaaugcucugccucccaagacuaauuucaacuuggggauuguuagagggagugccacugugacuucuccgauggaagaacgagggagagaagaucuuauuggcaaucauacaaagccauauauacgcuauuccuugguucacagaguuagcuaaauaucaccaggauagaaggaaccuucucagccccuaucucucaaacuugcauagaugucgugaggcauaaggggugucaugagauuccaacuuuccaugcaugaguaggaguuuuaggaguucacaauagaaugcagcaggcauuaaagaaauugagguugggauucugguuugcauugaaaagcaccuucugaaaaugugcucuuaaaaacggucauuaacauaccagaaacuaacaaguuucaaaaacgcauaagcaaccaccucccguaaaaauguuguccuugcagcaggugauauuaauugcauauaacaugcaugauacuacaaguuguaguugaacugaacacuagggcaugcaucuauucucuuggagguuuuuuaaaauggaaagaaagauuaucuauauauaugcagagggugagagggaauagagggagaaauggagauuuuuguccucuuuuuuucuuacauuucaaaaaaaacgucuccgagccagcucuaucacaagggaccugaaauauuuuaauugagaacaauuccuuaagucuagagaggauuaauuaguuaaguuuacguaagaguauagcugcuuuuuucccccaaaaaacaaauuuuuccuuuagcaauuauuuauaguuuuaaauaaaugagccuuuaaaucuuuaaaauuuuaaggcuuuuuaggcuuuucucuuuuuuuucuuuugagacagagucuugcucugucgcccaggcuggagugcaguggcacaaucuuggcucacugcaaccucugccucccggguucaacagauucuccugcacacgccaccauggccagcuaauuuuuguauuuuuaguagagacacgguuugaccacguuggccaggcuggucucgaacuccugaccucaagugauccggcugccucggccucccaaaguguugggauuacaggcaugagccaccauggccggcccuuuuaaagcuuuuaaaucuaggguuaaggucauuauuaagaagaacuuauaaaaacuaaauucuucuaucaucaaguuggcauacuacaaccugugggccaaaaucuaguccaguaucuauuuguauaaauaaaguuguauuagaacacagccauagccauucauuuauguguugucuguggcugcuuuccugcuacauuaaaagaacugaguaguugggacagaccauacagcccacaaagcuuaagguauuuacuaucuggccuuucagaaaaacauuugccaacuucuggguuaaaauauaauaaauaaagauuagcaccaacauaagucuaguuagaugggaaauaauaucuccagaaacauuagcaguuuuaagauuuuuugaacuaugaccuuuucucagaaaucuuaaagaugacuaaauaaaguauuaguguaagguuaagaagagggggcauugaauauaguugaguugauagagaaaauucccauguuauaauuucaacucauuuuuucucuuaagauuauauauaagaaacagguugucaaauuaaucuaaauucauuuaaauuaauuaaauuuugaugaauucuauuccuggcguuuuuuguuuuguuuuguuuuguuuuguuugagacagggucucgcucuguugcucaggcuggagugcaguggcauguucacagcucacugcagccucaaccucccaggcuuacaugauccucccaccucagucuccggaguagcugggaccacaggcaugcccuaccacgccugguuaauuuuuuaucuuuuguagagauggagucucccuauguugcccaggcuggcacugaacuccugggcucaagcacuccucccaccucagccucccaaagcacugggauuauaggcaugagccaucguaccuggccuauuccuggcuuugaaaaaaugguuuucggacacuaaaucuuuuauuauaauucaaacacauuauaguugcuucugggagacuguugccuuuugcccugcuuacaaacuagcaucauauucuaaaaucucaggaacuaaaauuacucauuguaauuucucuaaaauucaaagccuauuggaaucccugcucuuguuauguaaaauauaaauauucgagacauuucacaccacauuuucauuauucagcauucccaucaagugcuggaaggccaguucgcuauuuuauaaugaacguccuggguuuguucugaaagggcagccuuguacagugacuuaccucacagcaccagggagggagagauuuagaaaaugcaggcacaggagcaggguauagggaaacagucauucucaguaagaaauagauucauuaaaaaaaaaaaacccuaguacgaccuccuagugagccuccuugcuuuagaaauuuugacaaagcaaucguugagaaaauuucauguggcaaauuaucuuaaucacaaaaagccacuggcugaauguuuucguauaacgcagcguuauuuggccguguacguggccugccagcccuguuuucguccugaggcuuccuccaccgcauccucggcaugcccugcagugguuuggaacggcccucccuucuacucacucaugcauuuguacaucuaauguaugugacuguucuccugucauauaaaauagcaguguuaguaauuaggguuaguuuuuacuugauuuuaauucauucaaaauggaugugaaacuuacuggcauaccuaggcugcagccucaugcaagcaagcaaaaagcaaaauacugaaaauggaagagaagagaaacuggcuagcaggcagcuaaacucacccuuuuguacagccuaugguccaccagggggcuuuagacaguaaaacaacaccagagagcuauuagcacaugagggucacaacagaaaucuuacaaauagcuuuauuucaacaaaaaagaauauaacaugguuucuuuuuuggaaagaaagaaaaggagagugauggugggguacgugaaaugaguagguaaaaaaauucaucaauuuaagucuuaaaaaauuggggucauaugacuuagaaaugggauacuucugacugauuccugaagcuacuaucuaccuaccuuuuugagagggugucauaugagguuuuccuuuuuuuuuuuuuuuuuuuuuuuuuugagacggagucucucccugucgcccaggcuggagagcaauggugcaaucuuggcucacugcagccuccgcuucccagguucaagagauucuccugccccagccucccaaguagcugggauuacaggugcguaccaccacgcccagcuaauuuuuuguaucuuuaguagagacaggguuucaccaugucggccaggcuggucucaaacuccugaccucaagugaucugccugccucggccucccaaaguacugagauuacaggcgugagccaccgcaccuggccaagguuuucuaucuuaauaagauuuuaaugcuucuaaggacaacagacaugaauaguuucuuuuaaaauaacauuaaauaacucaacccagaaugaaaauaggauuacacacauccuaaagaaaauaucaguuuaaaacaaacuuccaggauagauuuuuaggauuucuucaagauugaacauauuaauugaauauauagaaaugggaagugaauacugaucuuauuacagaggcuauuaaaauuugccuauuuuucuaacaucuaaacuguaaauggucaaguaaagagccaauaacauuuuuuauuucauuccaauuaaugcacaggaauccagagcccguaucugauguucucuucauaaugaaccuucuuguuauccaucuuauaagguuauuaacaguuaaaauuuauacuuaaggcaaaaaucuucaugaaauuuuccucuaccaguuuacagaaagagaacucuaaaaacaaaagugaaaggacuccuuuguucagcuuacuuugugggggcaaccuuucaugaauuuauguuuuguuuaaauaucucauucucuuaacucucccaaaguaaacacgggacacagcuuuggcaaaaacaaaagggagaugaguguaggacuuuaugcaauuuugcucccacguuacccacacauucauucaaaguuugaggaucagacuagaagaaaggaggaaaaagucuagcacgacuuaacuugcagacauucugguuugucugaaguggccuaaagaagagugguguuaagguaauuuucuugaaaacaaaaucuaucuggaaaguauuaaccacagugucaugaaagaagaugugauucugcucaaaguggccaaagucuauugguuucagugcuggauaggaucuugcucagguuuuucauuuugcaggucgaagaggaaaagggaggaaggaacuaugaacguauuggagaauguaaggaaaagggcccaggugaguccuugaucuguucaccauauaaagaaaaucagcuacucucuuugguccuaagucccugcuaaguaaaagguaugauugaauaauaaaggaaagaggcugccuuugguaaggcuugcagaauuaauuucaugaucuuagagccauacccguuuuggggaugcauuuccuaacaggacuuccuguuucagaguacugacacugguauguuacucauuagcuaucauggugaaaaaucucccauccuugcaugguggaaaguaaauguugcugaggcacagggcgagugaacauuagcuucugcauggcaucauagcuggggaaaaccaucuaucuuagugaaugccguuuuuuaaguuuuuaugauguuaaugcaguggcugugcauguuuccuucuauggucacaaaaauaaauucuucuguuaauuuaaguaaaaguacaaauaacccauuaaaccuauuaagucuuaaaggcaagauauuuucaaagccggcaaucauaugguauaggaguaagaaaaacuaaagcaaaaugaaacauccaaggaauccaauuaaauaugaauacuaggacuuuugguauaauuaaauaggaagaggaaguaagacauuagagagucugcuuuaauguuugguauuauaaacugcacagcuccugacacacagagcaacaacccaaccacacagaagguggucuacacccagcucggauggccgcaguuacagacgucagacuggaauauucaccuggauaaagaacacaaaccacuuucaccagcccucugaaaucuaaguagagacgcuagucuucauaaagaaaucucaaauuugaggaacaaagagaaauuccucuggcuuagcuccaugagaagaugcugcaucccacagaaugcuggggucacaggaccccauuuccuacuaauugaagaugugcccagagucucagaugucuuucuuuuccugaacagcugcauuccagugaucucuccuguuccucaucacggaccggcuuuaauugauaguuuaauaauagagcauguuggcgauuacaugaccagcagagggcaccagcuaucugguggaaauucuacaucagaaaacuuguuuggaauucgugguuuucuuucccuuccuugagacuagaaacuguuuucuguuuggacacgcgcuagcauaguaaaggauuagagcaaagaacauacugcaauguggcauaucaaucacagguuaaagagaaacuuagaauuaaaagcuaguccgacuaaguugaccucacacccaaauuaaaacagaaaaacacgggcaugaaucuccauuguucaaacagcaucgucugacaugguuaccagcacuccaaggguagcaaccugaucccuaguuaaagagcucuaccgcccuauuguaauuugggacgucugcccugauuaucugcagggggauuagcuuuacauaggaguuagugaggguuaagaaggucaggguugcuucaucauucucccugagcagaauguauaaacaaggacuaguguaccuguggcgacagcggcgaagaaaccucauuauuuuucgagcagcuugauccugcuuuuugguuagcaaacugcuccugaaaaagucagaauauuauugucacaagaagguuacaguaaagcccaauauggaaaacuggucagcagugacagaggacucugaauuaagcaguucguguagcaaagccaacagcauauguuaaagauguauacaaucugaagggggaugagugcguaugcuguucccauaguaucgaguccgggcaucacuagaggagaaaggaggguguguauaggcgcucucagcuucaagacagacuauacaaagacugaaaauaaaaugucacuuaaauauucuuccacaauucauuauaagcucauuuugccacaaaaggcauucuggcauuagagaggcuuucuuaguuuacaaggugauucaccggaguugauacacucuuugggcuauuuuguaaauguacugaucaauauauuuuacuuggcucaacauuuuuauuacagucucuaaaauggaacagcuuaacccuaauuacucucccaaggucucacaugcaguaauucuacaauuucacucauuucccauuugugucaagaauagccuugucucuaaucggaauguagcaucauauacguuucaguuacauuaggauuaggaacaaguucuguuuagaaauaacuccaagaauaguuuucauauuuuauuuucacauugaaaaucagauuuccuucagccucaaagagcauguuuauguaaaauuacaugagugcuggcagcgggcuguacuuuuuuuuuuuuuuccuaaacaggaaauggguuaaacuacuauaauugagugguaacuuucugaguagaaacuggugcugccaaauucugauauaagguaaaauuggguggcaauaucaaaauaauugggugggagguggagagaaagagcuaaauauucaaaaccagacucagcacagguguacuuaucagccaccaugccuaaaacguucuggaacacagugacugccaaugcuuuaggcccaccccagacuccaaugucagcccaggacaagucuuucaaagaagucagaguucucuucccuagggagcuuuaccuccaugagcucuucuccacccaccugaguuucuguuguacaaucacagccguccggcgagccugccgucuuuugccacauuucuuauaacuucgguaguacuuuuggaugagcacagcagcccgucggcucugcuggaauuuuuuuuguucauaguaacuucggaauuugcucuggauaaggauggcagccugugucaucuuuuuauaaagugcguacugcaggggaaacaagaacaagcgacacaguaacaacaggggcugcacgggcucagcguccuucgagcuuaccgggaagggaagaagagaaaaugcuuuuccccucuauuaucacauucucuguccgggguuuaaucacaaaagaggcaaaugaggaaucuuuacaccuaccuuuccaaaauguaaaauauuacuuuaaggguugccuucagacauauauuuuuucccuaaaauaucaaaauaucuugcccuucuuggagaaaaauuuuaauagcaauacccuuagacguuuaugaaucuaaaaacagauuucgacaguaaaauuuuaaaugcuucggauuaauauuuucuauccaguuuugaaacacuaacauaauuuuuuuaugccuuccaauucccaccauacacaaaucuacuuagcauucagccucugauuuuuaacuaucauuccacacgacaaguuucugacugaguugcaaggucccaaauacaaggcuuaucaugaaacgcugacaccuuuaagccauuuuaaccuguaaaagaugaacacucguaagaccaacacgguggugaagccgugaaaccuggacggcugucacagagcugcggacgacccaggaggcagugccaggaguccuccacgcagcccgcugcagagcuacagaagugagggacgaaggcccagggugaauucucaacaucagucucuaggcacuaaaaauacagagcucuccauggucuuaaaaugcuacguccaaauuucuaaucaaacagaguaugacucuggggaugagaaguugcaaugaagcccuuugcuuauaagacggcaacuuaccgucgcaaggaaaaauauuccccagaaaaucccuguaucugccuaacuguaucucuggauguaugaggaggugaaaugagggagggaaacugacuucucagaauuguccaagaaccaggacccuucugcaagaaccuucuuuggucuuaucugaccugcuuuaccuuuucacuggucugaaagucuuugaagacaagaaugcugcagacuacagagccccugugguuuccaucgucuccaccugugcacacuacacacucagacccaucgggccacagugaagcgcuuugggaaaaaggguauuuacuuaguggccacagggcucacaggaacuggcuuagauggauuaacaccagccaaaaaauguccaguuauuaaugucgaaacccacuccagcugaauaaccacgugguccccagacgacagaggaacugugcuuagguggccuggcaagggggauauguuuacuccaugacugugccaucuuaauggcccucccuguagcuggugaugggugugaaguuugugacucugguggaaugguuugugagagggcuuggguguaucauuaccuucaaggcuauccaugucagcuugggggaaaaacagaaaauacaagauuaauguuacauugcugaauauaaugaaauuaaaaaccagaaucaauaaaacucccaaccaagaaaaaaaaaaaaggcaaccuggcuauauuaaugccuuccaucuuccaaaauauuuguuuuauaguuguuacucuuuccaaaaauaaugccuucugucuuccuagcuguagaugacaguuucuggggaggguuuuuuuuuuuaaaaaaccaaacucauauuuuggaaucaauaccuguuguaaucacagacuugaaaccuucauucuguguaucacuugugcucccaggaagccugcucaccaaacagaagccagugcggcucccugcuauagagcuacaggcacuguggugucagcguuugcacaauaaaccuuccuuuucugggaucaugaacucaacuggcucgaagccaaagacguccccccacccccauuaauagggcuuaauccuagagaagcuugaggaaacggcaacccauaucagaaauugaggcaaguccuggauuaugacaaggugauagaaucccuaauuucuaugugaccauuacacauauuagaauuuauuauuccuuaaauaaaaauuuauaacuaccuaaagcacaaucugauaaaagguucucgaaucuacugacaggccugaauuuuaucgugugaaccagucaaaacuccauuaggcaauuuuuaauauuuuauaaccaccuugauaaugagaaaggccuaauauucauguaauuucucugagcuucagcuucuucaucuguaaacuggaaauaaauacugcuuacuucaaauaauuguaaaaaggaaaugagauggggcaccuaaaaaaucuagugcauacuagcugccccaaaaauaugacuucccuuucccaucugacuaguuacauaacccuacaaggugguuugcaaacagaaauacugcaugaaagaguacuuagauaaucuucuugcaccuuuaacuaaggugcacaaaagcaguuuaagauguucugagcuucuucugauuuucaaagauuuuaacaauucuucauuuuaaaauggauaagaagcugaaaggaaaauggccaaagauuaaauaccuuauauaauucaaacucaaagguaauaaauagccagcauuuacuuucuccaaucacgguaucacacccuggauucccuacaguucucuaauuacuagggaguuuaucaaaguauuggaccacggauccucacugcaaagauacugguguuaggaucagaccaguaucucagguagguaauauuacuaaaagaucaaaaauuuggacaaaaacccuuuugcgguacaagucuaauugcagaugguuuuauuuuguuuuccucugguuuuuuuuugagacgagguccaagcuggacaucaacaccuggguucaagaagauccuccggccucagccucuugaggagcugggauuacaggcacacgccaucauguguggcuuccccuguuuuuguuuguuuguuuguuuguuuguuuguuuguuuuaucauggcaguucaaauuaagucucuggccgggcgcugcggcucaugcuuguaaucccagcacuuugggaggccaaggcgggcagaucacuugaggucaggaguucaagaccagccuggcaacauggugaaaccccgacucuacuaaaacuagaaaaaucagcugggcaugguagcacacgccuguagucccagcuacucgggaggcugaggcaggagaaucgcuugaaccugggagguggagguugcagugagcccagaucaugccacugcacuccagccugggcgacacagccagacuccguuucaaaaaaaaaauaaaaaaaaaaaaacaaccaaaaaacaaauuaagucucuguaaugagguacuagauguagugcucuuuagccaaaccaggaucuucaguggccuuggguggggcacaguuuccuucuguggugcaaaacugagguuuaccuguuuauauuuucuguaacaacgcugaauaacagcagcagcuacuucuugcuguucccgcaagggucggcccuuaaggguaaaguaaggagaaaaaaaaucaguaaugauuaacuaccagaaaugucagcuuuuuauuacuacucauuuaaugcaccuucucagaguugagaucccagguuuaccaaaaaauauugauaauuaauuauaaaugaggaaaaaugaauuuauagaauaaaccuuagacuauccuugcuucuaaauaaaacuaugauauuggaauguuaagcagacuaaaaauauauucccuuuuaaaguauuuaacaaauuaggcauuguacuguuugucuugccagaucucaacuaucuuuccuaagauaaccccaacuacuuuacuuuuggaucaaugauuaauggcuuuuaacacuuuuuugggagugguuagagacuacuuugagaaucuguagaaagccauggguccccuucccaccaaaaaugcacacagaaaaagcuuuacugcuuaauuuuaggaguucaggggcugccuggagucagcccccaggccuccaguugaaaaccccugcuuuaggucacgaccuccuagcagcagaggggucaccuuacuuuauauuaacugaauaauacgcauuaucauuaccaacaguauguugacauggugauaaccauuacauuauuggcuaacauuauuuuacuaaagcuucugagaauuauuuaaugugacauuaauaacuuuaauuaaaaauucuaugaacucaugaaauuuguuuuaaggaauaauaaagagacauuguacucaggauggcaagguagaauaggaaaaucaaggcugggugcgguggcucaugccuguaaucccagcacuuugggaggccaaggcaggcggaucacuugagguuaagaguucgagaccagccuggccaacauugugaaaaccugucucuacuaaaaauacaagaauuaggcgggugugguggcacgcgccaguaauuccagcuacuugggaggcugaggcaggagaaucaccugaauugggagguggagguugcagugagcagagauugcaccacugcacuucuccagccuuggcaacagaaugagacuccauuucaaaaaaagaaaaagaaaaaucagcauuguucugugccggaaaagccccauucccgcccuggccuaaccauggaugggcccuugucccagccaguuauucucuaugccucagauaacugagaagacuacgcuucugaaacucuucuaugaaggugcuuuaggaacuuuguaaacauuugauaaaaauuucauguuuaacuguuuaaaaauugguuguuaaaagcaaaugguuugggagaaugagaaagcucuggaaauggguagcagugacaguugcacagcacugugaauauacuuaaugcccccacacugcacacuuuaaaacagacaaaauggcaaacuuuauguuaugaauauuuuaccauaaaauauuuuuacaaagcagauacacacacagauauguuauauagugaaucuuaauaaauuggagacuuccaaaaaaauucuacaaauucagaggaaaaaaagaaauaguaaauguuuuuguucgcaugauucugacuuucaucuguccucucugaucuuaagaaugucacaaaacgaagguucuguucuaguuuaccuuguauuuccggaaagcugucuggacaagccuggcagccucauagaguucucucuguucaugaucagacagagugagcugagcaaacucauucucuaccuucucacugguagaugcacucaggaauucugaccaauccgcggcggagggaagguuagguuucucgaaagcgauuucacugacgggagagccaacagggcucaagcugguauuagaagaagggguuagaggcucguuauaugcacuucugaaacaagaggagaaaaaggagagacagauuaaugauugauuugcaccacccauuagauauuaaugaaugagccaagaugguaucugccagaagccacugugggcaauuaggaacaugccuucauucaguuaggcaaguugcuaaacauacccaguguccuucgauugaguaaguuuauacucaacaccuaucauaacuuuaguacuaugcuaaauacuaaaaccuaguagcaguacacucuacugccauuagaaaacuucagcugaauuagggggaaacauuaugcuacauuaucucucuuuuuuuucuuuuuuuugagacagaaucuugcucuguugcgcagacuggggugcaguggugcaaucucagcugauuguaaccuccgccucuuggguucaagcaauucuccugccucagccucccaaguagcugggauuacaggcgccuaucaccaugcccggcuaauuuuguauuuuuaguagagacgggguuuuaccauguuggccaggcuggucucaaacuccugaccucaggugauccacccgccuuggccucccaaaagugcugggauuacaggcaugagccaccgcgcccagcuuaacacgaucucuuaugcucugauagcaguaaaaaaaauaaugggagagguaggaauaggagcugggccuugaaaguggcaacagagcuuguccucaugcuuccuuccuuccuugguauggucuucuaugacacggcauucaucaaauacaaucagccuccccugccuccaauuacauccgggaaucuaugcuggguagugaccuccguaacuuuacucaccggaucugggcagcacugggaaggcagucagcauccgcuagauaacuggccagccagcucauuguacugcuaaugguggcagggucuguucuuuccaauccugaggacuccaugggcacaaaauucuccugcuugauucggucagguguggcuucaauaauguguucugccaaggucaucauguucaccugaagucagaaguucacagaacacucagguuagaaaggaaccuuacaaguuauccaggucuaccucccugccucgccuuggagagaaaaaaauaaucaggcaggagggcagacuuccaccucaauccaaugcaaugaaauaccauuuuaagguuauaacauaacacaccaaaaugugcugagauccugagaccugauuaucuccaagucauagucuggccccaaaccuuuaguccagucuuggagaacuucuggcuuguauguacucccuacucucagggucaaccaauuaaugacacugggcaguucuagaguaaccuguaauauuaaugaggugucacuauuaguuacauaaccaauaucuaaccacccccuuuugucuggccuagagaaccccggucuaggcugggaacaguggcucaugccuguaaucccagcacuuugggaggccgagguggguggaucacuugaggucaggaguuccagaccauccuggccaacaugaugaaacccugucccuacuaaaaauacaaaaauuagccagguaugguggugcuugccuauaaucccagcuacgugggaggcugaggcaggagaaucacuuaaaccugggagguggagguugcagugaaccaagaucgcgccacugcacuccagccugggcgacagcgcgagacuccaacucaaaaaaaaaaaaaaaaaaaaagaggccaggcgcaguggcucacgccuguaaucccagcacuuugggaggccaaggcuggcggaucacgaggucaggagauuaagaccauccuggcuaacacggugaaaccccgucucuauuaaaaaauacaaaaaauuagcugggcgugguggcgggcgccuguagugccagcuacucgggaggcugaggcaggagaauggcaugaaccugggagguggagcuugcaguaagccaagaucgcgccacugcacuccagccugggcgacagaguaagacuccgucucagaaaaaaaaaagaaaagaaaagaaaaaaagaauccucaaagcuggucuggauuaagauauucuuuaugagaaucagagauguggacugauucuuaaaaauguccuugcauaccucuuaggagugguaacugaaacacagcacuucggguucuuaagugaacugaaaauguucucgauggaacuauacaaagugacaaaaugcuucuccugccaacacgaaggagccucaacaacauccugcuaaguggaaacagccgcagugggcugcauggugcaugauuccacuuacaugaaaugucuagaaaaagcaaaccucuggggauagaaucagaucagugguugccuaaggcugggcagagacggacugcagaugggcacagggcaccgugcagugagauggaaguguucuagaaagggacuauggugaugguugcucagcuguauauguuuacuagaagccauccccugagcauuuaaaauggguaaauuuuaucauacguaaauuauaccucaauaaagcuguuaaaaaugcuuauuguggauaauuuuauaaauuuuuuaucauacguaaauuauaccucaauaaagcuguuaaaaaugcuuauuguggauaauuuuauaaauuuucaucaaagaacaauucguuuuuguaauaacaauaaaaauaaaaaauuuaagaaaaauauauugggccaggcgugguggcucaggccuguaaucucagcacuuuugugaggccgaggcggguggaucgccugagcucaggaguucaagcccagccugggcaauauggcgaaacccugucucuacccaaaaaaacccccaaaauuagccagauaugguggugcaggccuagugcuuucuuacaguaucuguaaucccagauacuagagaggccaaggcaggagaauugcuugaacccaggagauggaaguugcagugagccaagauggcaccaccgcacuccagccugggugacauagcaagacucugucucaaaaaaaaauugcagcuuucuuucaccuucucuauuggccgucuugauuugugacucaaacgguaggaaguaaaucuugcuuuauucuuuuuccaugaaaguauucaaauauauuaaaaguaagguggaauuucugaagccuaaaagguuaucacucuacaaucacuuuccuaaauccuccauuuuauaaacauguaacaauguaaaaacaucuuaaguaacguucucaguaguuggaccugaaaagucacgucacucauuucuaaauuucauggauugugcucagagaagacggccuuuaaauggguagcuuuggauuuuuauucaaauuuucuucguguccuaguauaugagcaguuuucauaaacaugccuuggacaccugaaaagaacaauuauauacguaguugcuauguguauuaacuacauacacacauauaguuauauauaaguauaucauauauuaaaucuaucauauaguaaauauauaugaaaucaagccuucugauuuuguuguucaacuuguucauaugcuuuucauaucuacuugaucugaaaaauucugagcuauguguguuaguagcacacugugauuauggguccacauuucuuuguauuuacuaguauuugcuguaauguuucaagguuauggugcuagguacacaauaguuuauaacugucauaucuucuagauaaacuguauguauauauauauguauauauacacacacacauuaauuugccuugaauuguacuuuuuaucuuucuuuuuauacucguuuaucuauuauagcuguuaucuaucauuucauuuucauuguuucucuuucauuucauuuugauuguauuucuuacaaguagcauauaguauauccugcuuuuauuuaaaaaaaaaaaaaaaaacaacccgaggccgggcaugguggcucacaccuguaaucccagcacuuugggagguggaggcaggcagaucacaaggucaggagaucgagaccauccuggcuaacacagcaaaaccuccaccuccaggguucaagcaauucuugugccucagccucccgaguagcugggauuacagggaccugccaacacaccuggcuaauuuuuguauuuuuaguagagacggaguuucaccauguuggccaggcuggucucgaacuccugaacucaggugauccucccaccuuggccucccaaaaugcuaagaauacaggcaugagccaccgcaccuguccuucuguagcccguuuuuaugcuaccuaccaacuuaacauuuuuuuuuuuuugagagagagucucgcucugucgcccaggcuggagugcaguggugcgaugucggcuagcugcaagcucugccuccuggguucacgccauucuucugacucagccucccgaguacugggacuacaggugcccgccaccaugccuggcuaauuuuuuauauuuuuaguagagacgggguuucaccguguuagccaggauggucuugaucuccugaccucgugauccgcccgccucggccucccaaagugcugggauuacaggugugagccaccgcgcccggccaacauuucuaacuagcauauuucagccuauccagcgcacaucuaucuauaucacgaguggaacaaaaucuguuacugucccugaacccgagagcuuucauacacuuuuacucucuucauuucccuacacucccugguuuuguuaaaauaauuuagaauuuuaguucuaggagauaguuuaaacauuauucgucuucuauuuaaagagucccuuccuaacaaauuccucucacauauaccacacuaucgauaauugcucaguuuuacuguuugauuguucacuccucuaugaacgguuuugccacuuuuucuaaaauuauuucauuauuuuuaaguguuaucuucucauuuggcuaaaaaacuuucuuuagacugcugcuuuuuucauagacacaugcucuuaauuuggcaagauguuauucucuaacagaucugugaaaauaggaaguggauuuuuuaaagguuauuuucuauuuccugcaugaacucuguuucagugaaggccacuuucaaaaagcugcucuauccaauggcuauuuaaacuuaaauaaaauuagaaacccaguuccugaguugcacuggcuauauuucauacauaugcccuuuacaauagcuagaugacagccaugcugaucaagugcccgauuccacauguggcaccaagugucucccacggugcgugguauggauagaaggcacguccaccacugugggaaggucuaguggaugguacuguucucgaugcucaguugguuccccucuuuugagcugcugauuuucgauguaaucuaacuuauuccuagauauuuauguuuauauaguucuagauugcucaguuuuggugucugguguggguuccaucaggaauuguguaaaacaggauuuggcaaaugauggcaggcugaauucagccagcugccuguuuauguaaauaaaguuuuacuaggaaacagccacacuccuccguuuaaugcuaaggcugcuuuggugcuguuagggccgauuaaguagcuaggacaaagucuguauggccuacagaaccuaaaaauauucacuacuuggcucuuuauagaagaaauguaccagacucuugucuaaaacauuauuugauuuuucugggcaguccucccuaugacugcagugguugguaggugauaugguuuggcuguguccccaccaaaaucucauguugaacuguagcucccauaauucccauguguugugguagggaaacugcaguggucgguaggugauaugguuugacuguguccccacccaaauuucauguugaacuguagcucccauaauucccauguguugugguagggaaacugcaguggucgguaggugauaugguuuggcuguccucaccgaaaucucaucuugaauuguagcucccauaauucccauguguugugguagggaaacugcgguggucaguaggugacaugguuuggcugugucccuacccaaaucuaaucuugaacuguagcucccauaaugcccacguauugugggagggacccagugggagauaacugaaucacgggggugguuuccuccauacuguucucgugguagugaagaaggcucuugagaucugaugguuuuauaagggguuuccccuuucacucggcucucauucucucuugccugccaccauauaagaugugacuuucgccuucugcuaugauugugaggccuccccaaccacguggaacuguaaguccauuaaaccucuuuuucuuuauaaauuccccagucuggaguauguccuuaucagcagcgugagaauggacuaauacgguaggucagaaguggugcccccggcaacuccccagaaaugggaacacauuggugagcaugcaagcuucuuucucauccucugcaaacagcagagggcuggcaugaaggggucccugggaugcaaugagcaggaauggcucagaaaucaggccucucccaagauaugcugaccaggacauaugaucuccuccacacaccucccucuccuuguaucacuucuacaggcaugggugcccuguugaauucugagucguuuuuuuucccuuuuacguuuguuuuagguugcaucaaugggaaguuggaaagagaggaauucaaacauguuuuuaggcugcccuuaugguccuccccuacauauuuuaauagauggaauuugcuuauuagccuaaugucaaguuuauuuugguauauauucucuuaguccauaacaaguuuaagguccugaaaagauucuggaauuuuuagauuuauuauaagggcaaucaauuaucagcuucaggaauauuucgcugcccucgugagagccucacgccauauaugcccuuuacaauggcuagaugauagcuaugccgaucaaggucacucagauaauucaaaaucuauccacgggcuuccuguucuagcuauuuuuaggucuugacuauauucuaacuaguaacuaguacuuaaaacagugaaaucaaucaaccuaaaugcaaggaggaagcagaugacguacuguaggguccucagugaguucugagaaguugguacaaagagggaaggcuuugcugagaccggggucacugguauucaggcccuacucccggugcccgauucaccgaaugaaaauguggccccaaggaaagaagauacuccaacgauguucugcacaaagccaacuucgaaggcuucacggggaggaaaaugacacaaccuucggaaauggaccauaaagaucacagcaacuggaacgcaccagccucugcgggcuuacccugucccugcuuuuuaccuguaugucauccaugggcuggccgcauucuucauuuucugcacuaucacgguaggaccccagcucuguauucaccaccucucuguuagccaucaucaggacacucauugguucccguggacgcaccugugaaggugcugccuccuuuccuacacugguccccuucggauuuccagucaccuguacuguagacacaccaauguaaagaucuuuggaauuccacuuuccuacaggcugagauccagaggcuugaaaugcugcagucucuggagugggaggggagaguucccggcugaagucccucacuccuucacuggggcugagugucucggggacagacugcuuagaacuagggcuuugcuuccugauauuuggcucuuccagacucagugcagugggaagcagcuucuccugccuugucuggaaguacucaggguucaauuuaugcuuuuugggagccggauaaucuuuguggcucucacugcuguaguaauuagaggguucagaacgaggucuucucagcucugaaaaguacaguagaaaggauagucaggacaggagauacaacuaggaauccucaagaaucaacacuuucucuaugccugagagacacaaagugcaaagccggaacucaagacacgucccuaacauuuaaauauccccaguagcauacaccagauucagaucuuccuccuccaaaauuauguauuucuugcaugaacauagaauuuuugcuacuuucuucuguacugggggagggggcagcacuaggcauucuuaaagaaaaaucagaaacauuaacaaaaaaacugaaauguaugugacuauccuauggacucugcugagggcagcugcaugaaagcaaacgggaucucugucaagcucugagaugucaugauucugaauucuuaccuggguuggugcuugcaauaacagugacucccuuggguauuucuggagagcugauggcuucgcugugccacugggccauccagcucucugugcugggcucuucgcuugcaggacaguggauucugggguucugucccagcugagccugcucaucucucugcaggugcuccagacacucugcuaauuucacaugaccccgugaccuggcaauucccaaaggcagccuuccuagagagucgggaaucgagauggcccgacggucccacuuguacagcacgacggcagcuuccaagugcccuagggcacacgcccacaucuagaagacagggagacacagcaagcguucucaaucagaggucaagaccagaccugacuuuugccauugcugccaacugacaaacugguccuugcuggcaaucucgguggggccauugaagauucccaucccaaaguaucuccgaaacaugccaugugucagcaagagacaacggugggaaccaggcaaauccuaugccagacuggaagaacagcaagggggggcuacaggaauccauuccuuaccagaggaguacaggagaagugguccacauucaaggggucaacuuccaguuccaggucaaugcuauccgcgugcuuuguacuauaagggagagcaccagaaauuaccacacuauucaccaccguuaaaaggaaacaccagaauauuauaaaaccccaccaagaugaaacccaacuggguauauaacauccccauggugaagaaacagagucccagggcaguguggacgcuccauuuggcuagggguccaaagaaaaugacaaguccaacauuuaauucuuaucucucuggguauuucuugggaagaaguuuauaaaacucccuuggaaacuguccaaggacaaagcccuuugcucgccggcuauaaaguggacugaauggguagauuucuuccacggguggcagugcucaggaagaaugugagcgaggaugugcgaggcugacccccagccagcugcaccacagccuuaccgccauuugaugagggucuggauuaggguggcauagcccugggcagcggccagguggaguagggucauuccgcggaaagucuuugaguggaucaagugcuuggacuucgcccagcaggcucggcucaucaucuucucgcauaccacgaccacacggcucucaaagcagcuccccaaggccccagucccagaagcacacugucacaaaaaagcgcacguuacgaccucaggacuaaaggcccucgaccccaucagcgcuucgauguaggggaaacaaaugcuuuacgauuagaaacucacaacggaaaacauaaaacacugaaaauaaagaaacauuggcugggcaugcuggaucaugccugaaauccuagcacuuugggaggccgaggugggaggauugcucgggaguuugagaccagccugggcaacauggugagacccugucucuacaaaaaguacaaaauuuaggcugcgcacaguggcucaugccugaaaucccagcacuuugggaggcugaggcgggcagaucucuuguggucaggaguucgagaccagccuggccaacccuaacccuaaccccaucucuacuaaaaauacaaaaauuagccaggcgugguggugggugccuguaaucccagcuacucgggaggcugaggugggaagaucaccugagccuggagagguugaggcuacagugagcugugaucgcgccacugcauuccagccugggugacagagcaagaccuugucucaaaaaacaacaacaacaacaaaaaacccaaacccccaagaaccauccaugaaauugagacuagaaugugcuuagcuucagcucaguagcacuucucugaaguccacagcucuacagacacgagucuaucuauuagggcugacacucugauuaggaacuucaugccgauucgucuuggggaaaguguacacagccuuaaacaaaaaaaagugguucuagccuuccuguaggcaguaaacuguugugagacaguggagcagaguagcuuuccuaauguuuccacuggcggguauagcggcucuuucacucucuuucuucuucuucuuuuuucuuuuuuuuuuuuuuugagacagagucucgcucugucacccaggcuggagugcaguggcacgaucuuggcucauuccaaccucugcuuccuagguucaagcaauuucuagcuaauuuuuguauuuuuagcggagauaggguuucaccauguuggccaggcuggucucgaacacccgaucucaagugaucugccugccucagccucccaagugcuagguuccuggcaugagccaccgcgcccagccucuugcuucuucugaaggagaauuagaucacuuagaugcggacuguuuuuuccuuaaagaaaugacuagaaguauccaauaauccaguccuuuauguaaaguaaaaagaauacugagaaaagcauuuagagauccugaaauuuaaguguuauuaauaacaauaagggcuauaggaaagagaaguuuacuaauuuuaaccacauggguuacuuccuaugaaccaguuguaauggaagaaaaauaaaaugaaaguuaguaacuucaacagcuuaugugagucucugugauagcaguuuuauguuuaacacucccccaaauaaauggcaccucuaggcuaauuuguaucucugguguuacuuaaaaaguacuuuuuuuuucuggcaauaaacuccauaaacuuuacuuacuacagaaauacuauggcuccucgcugauuuuuauuuuuaaauguggaaaaaaugccucccaaaauaaaaaaggcagaugaugggauuguuaucucagccucaucaaagcuguaaaaacaccuacaggagcagaguuaggugaucccaacaugccgcaaacugaccuugacucaaaaggccaaggcacagccauucuacacacacaagacacauucaugagcacauggaaauggccagagugaacgaaaagggaauuuuuuuuuuuuuguauuaaacaaaaacagucaugucucuaucccgcauggcaaacacggacauuuacugaaggcaacuuaaacugaugaaaggauauucaguagugguuaacaugggaugagauucuaggccaguugcauagcguuugagccagcugcguaguggcugagcuuuaaaaugacauuacauaccauuccuuuuaugccacuuuuguuggugaaaggaaaaguauuuuaaggagaucucuuaugugagccaugagguaaauuaaacaaugauuacuucuuuuauaaaacuuaguacuaucggccgggcacgguggcuuaugucuguaaucccagcacuuugggaggccgaggcaggcggaucaccugagguugggaguucgagaccagucugaccaagguggggaaaccccgucucuacuaaaaauacaaaauuagccaggcgugguggcccaugccuguaaucccagcuacuugggaggcugaggcuggagaaucgcuugaaccucggaggcggaggcugcagugagccaagauugugucacugcacugcaccugggcgacagagcaagacuucgugucaaaaagaaaaaaaagaagccuaucuuagccuuaauaauauucuacugcgugccaaguuguuucuuuccugcugauuucugaagacaggggagcaauaugaaaacacggggaggaaggaggcuagccuuuuggguguggcauaugauguucuuuuaaccuauuauuuaaaauauaacuaaacuugauauuuaugagguucauaaaaccaaaaauauucaccuaaaaacuuaacuguguaaaggaaaucaucauuugucuugaagagaaagagggggcauuauuugagguuuuuuuugcaacgacugaguaguggagauaagaaauaccaucaguuccuuuaaauuuaucucuaggguccccugagaaauaauuucucccugggagacuucccaaaaaugaacuuccuaaaugaaauguauauaaagccuucaagaccaaugggacucugaaacaauguuugguaauuuacucguacuuggcaauaucauacauucuuuauggaacuuacagaaaguuugugaaagaggcuguaauguauaaugucauucuacacugaaucauuacauaaacacuuucucugggcucuuuucauacugaccuugaguuuauaaaaggcuuaugaauuacugaauucaauuauguuuuauaccuacacuuaagauagggauaaaauacagaauagaaaguaggaagauucuaaauuaauucugaacccuagcaggucuaagucaccaucuggccuuuuuuuuucuucuucuucuuuuugagacagggucuuauucuguugaccaggucagagugcaguggagugaucauggcucacugcagccucaaccucccgggcucaagugauccucccacuucagccuccugaguagcugggaccacagggaugucccaccacgccuggcuaauuaaaaaaaauuuuuuuuuucuauagagacagggucucaguauguugcucaggcuggucgugaacuccugggcucaagcaauccucccgucuuggccuccuacagcgcugggauuauaggcgugagccaccaugcccagccagccucuauuuuucaauugguuguccuuaauucccacugcccuguaauuuaguagugaauucugagauuaauagagauaacuuaaggauuagggggguaaacaacugagaagcuccacauuccaaggcuucuuccauacugcacagauuauaaugcuuaaaagcacagguaccguaaaguacucccucaggccuucugccugaauacagggaccgcaucagcagcagagaagaggccugugauccauccacugccucgccaauccauaaacaugaagcgaaaugggagcugagcaucagcaccgccucguaccugugccuggcucccuccauucccgcucccgcugccgccuccacugcugccgccuccgcucgccuguuugugcugcugggaccccgucaucucggccauccuccucuccaucugcuccagucguuccaggauggacauccugaacugguuaucuagggcagagcaggaggaagagugagguuguguucuggaagaaaagcagucaacacguggccucgccagccuugcgggaccagcauccaaaugccguccguaacuucaccaaaccagagaggucuccgccagccagaguuccccagcacgaucgugaaucugucaccaccucacacaggaugguggcaccuucagcagcccgaaguucucggauaaaagaccagaaauucucuuuuugucaaagaucaaaaagagguucagguuccugcccccuaguuucuuugucaaauuccccaacggaaacccugacaugagaucugguagagagcccucuagagcaaguaaaauaaauaaauacaauuuaaauuaaacuaguagaagaaagcaaucacagcaagaaaggaagguauguuagacaaaaaaaaaaaaagguaguauaucuuuuaccaaaacacugaguuuuuacaaaaaaaaauuguuuuaaauuuuauuuccugagccaagcucuagcuuuuauaauuuauuucaggaauagcaucauucagugccugagacuguuacacccuuuuuugagacagucucacguugucgcccagacuggagugcauuggugugaucuaggcuuauuugcaacuuccacuucccaggcucaagccauccucccaucucagccucccgagcagauggaaccauaggugugcaccaccaugcccagcuaauuuuuguuuuuguuuuuguuuuguagagauggaguuucaccauguugcccagguuggucucaaacuccugggcucaaggaaucaaaagugcugggauuacaggugugaaccaccguacucagccacauuucuuucuuuucuuuuuuuuuuuuuuuugagacagagugucauggugucgcccaggcuggagugcaauggcgcaaucucagcucacuguaaccucugccucccggguuaaagugauucuccugccucagccucccaaguagcugggacuacagaugccugcaaccacaccucacuaauuuuuguauuuuuaguagaggcgggguuucacuacguuggccaggcuggucuugaacuccugaccucgugaucugcccaccucggccucccaaacugcugggauuacaagcaugaaccacugcgcccagccccacauuucuuuuaacccaugucucaucggagacaaacauaaauagguacuucacuucuacaucagagaaacaacaggaauuacuguuggagcuaggauugaaacucaaagagaaaacacguugugauucuguaccacuuuacuaagauuagaacacgucucuccacauuccugcauuuacacacacaugugcaugcacacacaaacauacacauguuagaauugggucaccuauccauguacauaagaggaguuaaaucgauguuaaaaucaaucaugcccacgcucgcuucauauauguauaucuauauacgcuuaugacauauauaucauauauauguuaaauauauauauauauauauagagagagagagagagagagauugagacuuugagauggaaucucacucuguugcccaggcuggagugcaauggcaugaucuuggcucacugcaaccuccgccuccugaguuuaagcgauuaucuuggcucagccacccaaguagcugggacuacaggcacaugccaccaggcccagcuaaucuuuuuuguauuuuuaguagagacgggguuucaccauguuggccaggcuggucuugaacuccugaccucaagugaucugcccgccucagccucccaaagugcugggauuacaggcugaaaccccgugccuggccacaccucacaaauuuuaaggaacacugugccagauauucaauagcgaagaggggaggucucucccuacucuagcacaggcaggccuugguaagugaagaaggcaggauaacguaauaaggagggaugggauggggacagaguuuagacaagucaggaaaggugacacuucgaguuugcucagaaugaugagaaagagccaaacauguccagaacugaggccugguaauagcacaugcgaaggcccugaggcagggcuuucagggagcagaagaccguguggcuggagcacagagggagggagagcaggagacgcaggagacgauagagcuggaggugugcaggagucagaccagugaauggcugugcagagcccuggcucugccauauaaaagcuguguagcuuugaacuuagaacaaaaccuuucaugccuccguuuccucaacccuuaaauggggacaguaguuacaccuaccucagagggcuguuaaucuauguaagugcucagaacaugauaaauccuagguuagcaugcuugccaucaccaucaucuuuagacaaaugaagucaaugucuguggaagcugacugaacagcugugaccacauauuucuccuccaacuguugagaacauaacuauuuucaaaauacagucaucugaaucaugcaaagggauaaucuggagaagaaauauuuuaucaccacuccuuaccauccugacuauaaauuccaagacuagcgagcaaagcguacgacgguuccaugugagagaaaacaacaggcagagauagcacucacagaaugcuuccugcacaccaggcaccacugcgucacugugcagauauuaacucauuuacucuucacaaccaucacgugagguagguguuguuauuauccucauuuuccagaugagaaaacugaggcacauggagauaacccaucugucuggccccagggcugggaguauaaccagauacgccaagaagaaggaagggugaugggaagaaaagaugcauaggcaugaggcagucuuaccagaaggagacaauauucucacucucuagaaagcuuagcucuacucaaaagacagucaauacccagucagcaguucaguccucacuucagaucaaacugauuuuacuuuacuaaaacacaaaagcaagaggaagguugcuuuuuaagaaucuugauauuauuuucuggccaggcaagguggcucacgccuguaaucccaccacuuugagaggcugagacagaucacuugaggucaggaguucaagaccagccuggccaacauggugaaacccagucucuacuaaaaacacaaaaaaagcuagcuggguguggugguguaugccuguagucccagcuacucaggaggcugauacaggaaaaucgcuugaacucaggagguggagguuacagugagccgagauggcaccacugcacuccagccugggugacagagugagacucugucucaaaaaaaaaagaaaaaaaaagauuccucauauuaauuucuaauaaacuacuuccaggaacaacaaugcaagaaagauacuuccucuuuuaaagcgaaaaauaacgucuuccuuccaauugcacaacuauggauggacagacacaggcaaacuuggaggauccugccacuaagugucucacucaguggcaacuucccacagggagguaacucugaauacacacugugugggguaaccugcacacggccguucucauccugugaccaccagcagaaaacacaagaugacuacagagguugcgcuggugucuuuacuccagaugccaugccucuuuguuagaaaucugaaaucuugcagaucacaggucucuuccaugugaagccuaagaaguugacucuucaguuagaguucaguuccaagcagcauggcaguugcccuuugcaggauauuauaaacuccucugcuuauuccugaugcugcuaagccagacaaccauugaucucggaaccuacuuggagaucguuaugcaucccauugaaaugacuugacugaauuuuaaaccuccauagccacagaucugugauuucuucugcaagucuacaaaucuugcaucugguuaacgaguuuucagcauccauuucacuuguuccagagcacucuggaaccaaucugcaacugaguggccaagaucaacauccgguggcagacaaaggggcagaaaagcaccaaaggugcucucugagcuguggucagccuggagcgagccugccugcugcccguggagguggcuuugugcugcagugugcugcagugcgguccccgcaucagcuguccccugcccauccccccgccaagcacgggcacugcagaaacagaccuucccugacaucacugagucaggcccugcccacggcgucacccggucaaccccuccaacagucacagugacucugugugugccacagaggugaccagcuuuuguuccccagcugcauucccuguugcuaugccaugagugcaugauauuaagcugcucugagaagcaccucaugaaaauacucagaagcaauuaugugccucuuaacaaaaucauaucaugcauaacggcaucucugagccucucaauuccaaaggggaagcgagugauaauuaaaauaaaaaaccaaucucaaaugcaaaugacugagcuggcacccagggagugcggucuguugcacugugcuaugcaaguucagagagacuuucuccucacauguccuuuccucugcacggggccagggcccagcucuugagguuguaaggcuuagauggauaaaaugauggucuuuacaucuccacacuagcaagccaaaagcaacgccuuuacgcuuguuuugguuuuacagcuuuauuaggauaauuaaaacacugugaaauauuuggcaaauugagagcugugcauugcuuuaacuguaugcugugugugauuacgggauauagggaauacaauuacuuagaagcaaagaagaauuucugauuacauuagaguaaauaaguacauuugaaagauucacuuauucaugcacaaauauucacuggagcaccuacuauguaugcaccaggcaguagggaguacuuagaacagcagugaaaauauccuugcccucuuuugucgaccaacagauaauuucugcagcccgaacaaaccuggaguuuuaaauuaauacaaagcagaggcugggcgcgguggcucacgccuguaaucccagcacuuugggagaccgaggcagguggaucacaagaucaggagauccagaccauccuggcuaacacggugaaaccccgucucuacuaaaaauacaaaaaauuagccgggugugguggcgggcgccuguaguuccagcuacucaggaggcugaggcaggagaauggcgugaacccaggaggcggagcuugcagugagccgagaucgcgccacugcacuccacccuaggcgacagagcgagacucugucucaaaaaaaaaaaaaaaaaaauuaauacaaggcagagaaaggggaguaggaauaaugcguagauuuagggagcugaugaguuugguccuaguucuuacccaugaugcuucaaacaaagacaacagggugagcuuugagggcuuccaaguggauguccuuaggacaguccaagugaagcagcugaacuacuccaucgggagaaaauucugcacagaaggaaaguuacaagugcaaguuuccaugggcacaugaggcucagagguggcucaaggccacaggaggcuccagagguccccgcaaagaaagccagcugcucuagcuccacuuccugccuggcgguucugagauuuuuaguucuuauccugaaauauuaggcuauauccgucgcaccggaagaacaaguuccugcuucaucacagaacaggcacucuauauuugcugcagcgagugaacucugggcaaggguacagaaaagaggugcacagaggccuguuucuaguaacacaggcuggccuccuguugaagacaugaggaugacagacgcauaacccagagacagacaccaccauccuaagcauuuuacccaagaaaauaaaaauuuacauaacauuucuacacauacaugcuucaguaaaaaacaguauaaagagccaccuacuuagagccuucuagguaucaauacaaaccucacaaaaguuaguugcaaugauacccuaccuucaagugggaacaaugaccaaacuuuuguggccacauaggaggcuauaaauaaauacauauaguuuguauccugcgggguguauaggugaauguuagauccagaacuacacugagcuaucagccauguccuccccagcgaaacuauaaacuuucugagggcauggaagagcagggcagaguaggaaaaggcaaaagcaaaaaaaaauccuuugacagacaaggaaguaucaaaugauacaaaauaaagugucaacugggcugagguuccccaacucuuaaccccucuggguaagucccauaacuccuggaucuaaagacucaggcaaagugagcucugaaugaugucuuacuucuggugcagaaccucugggugugagucucagcuucccuuccaguggcagacucuccgugcgugacccaccugccuguucccggcuagaggccgugugcugugagucugugugugacccacccgccuguuccuggcuggaggcugugagucugugugugugacccacccgccuguuccuggcuggaggcugugugcugcccuagauggcggcuucugcucaucccagugaccauuccucuagaccagagguucucaaacuuuaggagggcuucuuaagacagacugcugggcccuauucccagaguuuugguccagugggucugagugagacccagaggcugcauugcuaacaaggucccaggcaguucugaugcuucuggucuagggccacauuucaagaaccgcugcccuaagacccuggccuguuuccacagugaaagaaugacuccucucuccuccacccaagugccuguuaagaaugaucccagaaccaccugcucaaacagaagcagagauuccuacccagcauggguaugugaggcaucaccucaugugaaccaugccagagccauccgcaguagcucuguugacaauaacugggugcacauuuucuucucaagcaccccaacucagaccaggcgauacucgaaaacgauuuaaaacccagccaccugcacugcugucugcaacggaucaaguacuccucuaccauucccauugcaucugaccucuuuauuacuuuguccuuuacucagcugacaacaugggcugucuuuccaggugucugucuccgccucucguguuucucuaaagcagucuauuuuccugaaagguuccagggaaugaggaaggauacauucaccuucaugcaguaguuccuucccgcuaccuuccagacaugcacgcgcauguaaauccccggacaaaaacucaaucauucugacggcuuucauagcaaccguccggcuccugauucauucaaagcuucucuucaugaaccucuucucccugugcuccuuuuuuguggaagcagcaguuucagccugggcagcucugagacagugcaaagaacacuggaguagaaauaagagccccagguuuaauccugucacugugugacuuuggaaaaaugauucccacuuugcaccucaauuuucucaucuguaaaauggggauauuuauauacauaucccuucuuguuugugaggaugaaauaaacuaauacaugcgaucuuuuuuuuuuuuuuuuuuugagagucucgcucuguugcccaggcuggagugcaguagugcgaucucggcucacugcaaccuccgccuccuggguucaugccauucuccugccucagccucccgaguagcugggacuacaggcaugagccaccacaccuggcuaauuuuuuguauugauggaguuucaccauguuagccaggauggucucaaucuccugacuucgugaucugcccaccucagccucccaaagugcuaggauuacaggcgugagccaccgcgcccggcccauacaugcaaucuuuugaaggaauaugacucucuuaugccugagcuaguagacuggggccuucugcccagccccaucuaugggagcaugguuaaaaaauuaaacauuuuuucgaguaauuuuagauuuacagauaaguugcaaagaucguagaguucccauaugccccucacucaguuuccucuaacaugguaucuuauguaaccauggcacauuugucaaaacuaagaaacuaguauugguauauuagagcuauuaacuaaauuaaagacuugaaaccgauuuuagcacuuuuuccaugaauguccuuuuucuguuccaggaucuaacccaggaucccgcauuguguuuaguuuugaagucuccuuaguguccuuggaucugugacaguuucuccauauuccuuuacuuuucaagauuuuaacaguuuuaggccgggcgcaguggcucgcgccuguaaucccagcacuuugggaggcugaggccgguggaucaccugaggucaggaauuugagacuagccuggccaacauggugaaacccaucucuacuaaaaauacaaaaauuagccgggugugguggugggcaccuguaaucccagcuacuugggagauugaggcaggagaguuacuugaacccaggaggcagagguugcagugagcugagaucacaccacugaacuccagccugccagucugggugacagagugaaacucuaucuccaaacaaaaauuuaacaguuuugaagaauacuggucagguauuuuggagacaucccucaauuuagguuugccugguguuuucuaacccuuagacuggguucuggguuuuuaggaagaguaucagaggugaggcacccugcucaucacauacaaucagagguauaaugauguccuggagaggucagccuccaucauuugguuaaggcaauguuugcuacauugcuguacugugaaguuacaauuuuucucuuuccguucuuuggaacuaagucacuaaguccagucccaacaacaagaggguaacuaaguuccaccucgcagacgggggaguaucuacauauauuauuuggaguucuccuguaaggaagauuuguccuuauuuauuuauguauuuagucaaucacuuauuuauaucaguauggacuccuguacauuuauucuaaacuuugggucacaaucugauacuguuauuuauuuuguugcuccaaguguuccagcuuuggccaucaggagcucuuuccggcugacccuuaugccccucugacgugcccucauccuuuuuucuuccuuuuagcacuuccuuccuuucuggcauuacaagaugcuccagauucaucucucauuuccccugugccaauccuagaacuguccauuucucuaaggaguggagcuuugguucuuuuuauuggagaacgguauuuagaaaugaacaucugggugcugagcguucauugcuauugagguaucacugcuucuaggccuucucgaugggaaagcuaggaaauauacguauauauguauauaucuaccuguauacacacuaauguaaacaugaguuccuacugaugucucugugucuacuauagcacugcaguguuuauuagagccuucugaggguauuuuuuuuuagagcugcggucuugcuauguugcccagacugguccugaacuccuggccucaagcuauccuccugccugccucagccuuccaaagugcugcaauuacaggcaugagccaccaugcccagcuggcauuuuaaaaauagaucaaaugaugaugaaaguaacuguguguguuaccuagcuguaauaaaccgauaaaugaaaugcugaaaagaaaccuuauugauauauuaaacuaaaaaaaaaagagaccuucagguuuaacuccuguaucucaaaaguauaagcauagguuauaguauaguaguauauucauuuaccuuauuauacuucaauucuuaguuuccaacaauauuagaaagcauaaguauaaauagaaauagacucauaaucccagaauagcuuugaguauuacaacgaucaagaagaagaugaaaaaacucuuccaaacaauggcccaagggucaaggaaugguuaguuggggcuucagauucccuuuucuuuugcugggucgaccccauccuagccucuccaucacagcuguuccacgaagugucacacagcacagucaugggacaucuuuuccucuuucucugacagggguuccuaaccuucaaagggacucacuuuaaaaugucccaaauuaauauucauuuaaauguuuaaaauuccuuagcaauguuuuaaagacagagacaauuucaugaaaucagacacccacaguguguucuaaguuuagaagggcugggauuugcugcuguaaaaguggagaaucccgagugucugggcgucugcugugagugagaaagugucuaugccaggaaaccagcuccuagccagauuucccaggcccucaggccccagcagcaccuacugcuuccucuggauuuuacacaacucacuuucaaucuucaaaucuaaucaauuuuccugguuguacugagcaauacaccaggagaugguuccugauauuuuaucagauaauuuaguuuaaaaaauuaagucccuccucugucugggcgugguggcucacacuuguaaucccaacacugugggaggcugaggugggcggaucaccugaggucgggaguucaagaccagccuggccaacauggcgaaaccccaucucuaauaaaaauacacugcacuccagccugggcgauggagugagacucugucucaaaaaaauaaauaaauaaaaauaagguaaaauaaaucccuccuccugaacauacaaaauaaaauguaaacucuuuguugugacacagaauggacuguucuuuaccaaccaucccaggcuacguuucuaggguucucucauaacucaauguucuccaaaauuccuggcucacgaccaggaauuuuacuuaccucugggccucugccgaggccaaccuuucuccucauccaccuggugaacuucuuaacucuucagaguguggcucagacaucacuccaauauuauuaauaauaauaauagcagcuacuggacaucuacaguaagccagacauuuuacauggauuaugucuaauccucaaaaugacucugaaauaaagauuuuccccuucauuuucggaugaggaagcugaugcuaagaaaauuuguuacuuacccaagagcauaccacuuguaaguaucagggcagagauuugaacacagacuggacuccagaccaguguucuuucugcuaugccugguaaaccuuccacauuuugcccuggguccuaacaguacugagccaaugaagggauaguucuuuuccuaggugucauuccugcuagaggcuagaaugugagcuuuuugaaagcagggaccuugucuuguaucccuagcaccauucagaaagugagugcauguggaaaggauuauuuucuaauuuaagcuccugggagccuauuuauugaugaggucauccaaacucuggggcaagaacccugagcagccuccgcuccccaggugcaguccagguggcucauauaccagugagcagcuuuaucaccuguccaggggcaagagaggauggucaaagugauccaaggccagcagagcugacuuggaaagcaagugucugcccggcuggcugccaucugcuuuaagcucagggaaggaaaccacgcagcuacagugaagacucuggaagcaaggcuggguaugaggugacuucuucacaggcacacacuggaacuucccagcagugucacuuuucuauagccacugaguuucucaugaaaaauaccaaacccuaacuuuggccugguggcucacgccuguaaucccagcacuuuaggaggcugaggcaggcagaucacuugaggucaggaguuugagaccagccuggccaauguggugaaccccgucucuacuaaaaauacaaaauuuagccaggcauggugguaggugccuguaguccuagccacucaggaggcugaggcaggagaauugcuugaaccugggagagggagguugcaaugagccgagauugcaccacugcacuccagccugggcgacaaagugagacucugccucaaaaacaaaacaaacaaacaaacaaaaaaaaccacccaaccccuaacuuugagauguucccccuuuucaagagaaaaauggacuauuuggaauacaaaugacuggcagcgccccucaaugaaaggaguggcuuucguuaguuaccaagguguuuaacaagucagccagguucaacuguuguauaaacaugagguuucgaucggguuaaacaaaaggaacacuuucuagaacagccccagaaagcguccaugaauaugaaugccugcacaucagcuaaugaauaauaucggcaaacgugagaacuuguuauuacaacugcugagcugagccaucucaggucuuguugccagaggagaagaaaaaguuuugccuuggcagguaagugaaugaagaagcaaucgucaaauaccaucugcuauuuuaaaacacguuauuuguagcucaagugcacaugugcucucccacugccauccaucucucauuccacuuacagcccuuggcugcccuggcagggagagcugaggaggcaaaggaggcaugccugcaacuauuucuguagagcacugugagcgcugcuuaggaagucuccuaaauuuuuuaggaagcucagaaggacagggaaaaugaagucacuuaauucccucccagaauaaauggugccacgagaguauauuaagcugcuccucccuggcaagccguuuaagauguccaagugcagagggaaggguaagggccggguggagaugaggcacaagcuguaccacucugauuuuccaaagcaauggcuaaauuuagccguagaaaaaaccgccauacuccacuuuuugaaaacucucugacucuguauaccaaaacacuagaaauggcaaugagcaaugcugcuuaggacuucuucauuugucauaauucugcauccauauuucuucuuccugaucuuuguuuuacacuauccccauauucagucuuggacuuguucagaaaaaucauucaggauacugccaaaacaacggaccaacagugauuagacaaaauguuacaagggcagcaaagcaaacugacaaucaucucucauuugaaaucuuucaauacuagagcuaggggugucucagggugaaaaucucaaaccuauucuccaaggaacauucaggcagccacaucacaacacagucucaggcaccgacggcaccuccaccacgcaggagccaacucugcugucagugaaguaacaaauccaacuaaagacaaagguaguaaaacugcagcuaauuggcaugaagcacaaaagagauuuggaacucccauacagauucugcacccaccuuuaaagagucuacaaaagaggagaacaucuuaaagucggcuaacuuugcagaaagcaacaaguuuggagcacacugccucaacaguuucagugcacagugaaaaucagaaauauuauaaacaagaauugagacauucuaaaguaagacuagugaaaugaauguagaagaacagagaaagcguauuacuccuaagacuaaugaggucuuuaaaaaaaaaaaaaaaagggcugaccgggcucaugccuguaaucccagcacuuugggaggcugaggcagggggaucaccugaagucacgaguucaagauuagccugagaaacauggggaaaccagucucuacuaaaaacacaaaaauuagcugggcaugguagcaugugcccguauucucagcuacucgggaggcugaggcaggagaaucgccugaaccuggcggggcagaaguugcagcgagcugagauggcaccacugcacuccagccugggugacagagcgagacccugucucaaaaaaaaaaaaaaaaaaaagugcuguaaugagaccuggagaugaacaaugaaugaucuaaccuggacaugaaggcgugauuuaaauggguuauauaaaggaaaauggaaaaugaaaauccuaacacuuaagaagggaaacugcaaagacagaaacgacaaagugagcaggaauugucaggagguauggauacaauaauuaagcaccagcggcuuguuugguggcgccuagcaugaucaaaacaccacuugaaauccuuggggaagaacuauggagaauccggccagaacggacucauuccacaaauguuuacggaacgcccacuguguuuacggaacacccacuguguuuacggaacgcccacuguguuuacggaacgcccacugcuggcuaagacugcgccaaggcucuagggaacuaagggugaacaagacaacucaaguuguuagccaccgggacuacaaaaacccaacacgauaugagccuuugucaccagaaacucggucucauauacaugaacguaaagagaaauuguguuggcucagugaggccagugacuacguucaucccagucaccgcuacauuccugaggccuagcagaaauuccuggugcacaguaggcccucuguaaauauuuauugacgaaaugauuuaauuucaacuaucggaaauacacaacgugaacuucaagaagaacaagguacagaauaacauguagaacaaauauuuguuuccaugagucauuucuaugaugggcuuuuuuucagccaaguuauuaaaagcagcuccuucauggucaccuuuuagcuaauaagaauauauccguuuuuauuuuuuuauuuuuuuuuagacagggucucgcuuuguugcucaggcuggagugcaguggugcaaacaugacucaccacagccucuaccuccugccuuagccuccuaaguagcugggaccacaggcaugcaccaccacgccuggcuaauuuuuuguauuuuugguagagguaggguuucacuauguugcccaggcuaaucucaaacuccugggcucaagugauccucuugccucagccucccaaagugcugagauuacaggugugagccacuacgccuggccucaaauuuuuuugacauggacauaaauuguacguauuuauugcauacaaccugauguuuugaaguacaugaacguuguggaaagauuaaaucuagcuaauuaacaaauguacuacauaguaaugcacuauguacaaauguacuuuggaguacauuuguucauuaaauaaugacacagcuaucauuuuuguggugagggcauuuaacaucuacccucuuagcaauguucaggaauauaucaugaugaacucgagucaccaggcuguacaauaaccccuugaacugauuccuccugucuaacuguaaauacacauucucugacaaacaucuccccgacguccccauucccagccucugguaaugacuauucuauuguccacugccaugagaucaacuuuuuaagacucugccuaggagugagaucauguggcauuugucuuucugugccuggcuuacuucacuucacagaaugcuguccauauucagcucugauguuggcaauggcaggauuucauucuguuuuauggcugaauaguacuccacuguagacacagaccacauuuuccuuacacauucauccacagauggacacucagggugcuaccguauccugguuauugugaacaguguugcaauaaacacaggagugcagaucucucucugacauccuaauuucauuuccuuuggcuacagacgcaguggugggauugcuggauccucauuaguugugccaagcucauucuccauacauuauuuaggacugcuauuggcaaggcuuggcucucagaacuaacucuagggggaccaucugcacagacggugcuaacugucuugcuaacuugugagaguuaaagcccaagacguuccaaaaauauguauuuuucugaauacuggauucuacaugagagacuucuguuccagaacucacaaguuuauuaauuauaauguuuuucauagugcuacaaaaucuggaaaacauauagguaaauaaguccuucccaacuuaguagaaugaaauguacauauuuuaaaauaaauagcuggauucuggauaaaauaucuguccaauauuuuaucuuuauuauuaggggcuaauaaaauagguccuaauggauaaaaugacuuaagaauauuagcugggcacagugucucaugccuguaaucccagcacuuugaggcugaggcaggaggaucacuugaacucaggaguuggagaccagccugggccacauaguaagacccuaucucaacaaaacauaaaaaaauuagcugggcacgguggcaugagccuguagucccagcuacucuggaggcugagauggggggaucacgugagcccagaagguggaggccacagugagcuucaaucaugcugcugcacuccagcccgggcaacagagugagacccuguuucaaaaacaaaauaaaacaaagcaaaacaauuuuauaauucaucauagacccuucugauaaauagaugauauuuuuaaaaagucaauauaccacauaaauauuuuauucagaaauaaacuauuuccccaagggaaguacaggguuucagaaaauuuuuagucauuaagcuucuuccgaguagugucaggaugcuugugaggauucuuucaugucucggcuccuuaugccacaucagaauacaucaaggacugcucucccaugccggcacggcacucaguuccucugaguaucccuuggcacccuaccccuagaccagagucauccuccgauuuuugcaaauuucaaaucagugaggccugaacaaauguaugaauuacugaggccagcauuaaagcaucccuuggauuacguaaaaaagcaaaacacuuaagggugcuuucugugaaagggggauguggcuggcacaguggcuacaccuguaaucccagcgcuuugggaggcugaggugggaggaucacuugagcccaggaguucaaggcugcagugagccaugacugugccacugcauuccagucuggcucagagagagagaccgugccucaagaaaaaaaaaaaaaaaguguguggcuaugggaugcagcuugacuucauccaguuucaggggcuaugcaaucugcagauccuuacagaacccccccaagugguugacggaaugguuaaauaauggaacaaaacguuaauagccaacuccgguggcacugugcacuguuucugaggauccucucucucgaaucccuaauaccuccagaugcuccuuagucuguucucugcucuuccccccuuuuccugauuuuccuucccugucccagcccauucccccgggccucuuuauuucccuuccugcucucacuuaacugguaacaauccugugugagguggcuaacaaaaauacuugugauuaauagcagaucaggcaaaaucaggacucaugauguuacagacaagaauaaaagaaagcuccaggaaaacuguuucacagaaaacacagacuaaacccuccaaaauggugaaaugugagucccaaauggggcugaacguagcaaacaaagcaaaagggggcagugaguuucaagaucacacuacgucaguugcuuuggauaguaugacuuucccugguacuaggaucugaaauaaauuucucccauagguccuaauaagaaggaugcugugggccaaacgugguggcucacaccuguaaucccagcauuuugggaggccgaggcgggaagaucaccugaggucaggaguuugagaccagccugaccaacauggugaaacuccgucucugcuaaaaauacaaaaauuagccagguguggugacacgcaccuggagucccagcuacucgggaggcugaggcaagagaaucaccugaacccaggagacagaggcuugcagugagcugagaucgcgcccaaagccagagccugggugacaaggcaagacucugucuccaaaaaaaaaaggaugcugugauuuaauagauuucaacauccuugcgacaaaagcacuacuagguuucaagugacuguuuauuacuguuugguauuaaggaacaccaaagcaccauuucaucgaagcgauucagcaaagguccaaugugguccaacuucacagcucucggaugcucugaugaauuggcuuaaagguagaccauucagaggaauacaugcugauuucuaaaucugaauguagaugaguuggauguucuaaauuucuugaaggaaaagcuuucuauaguucauugguuuuaaguugcauauuacuaaaucacucucaacauucucuucugcaggucagugggccuucacuuuucaagaagucucuuuacugcaaugaaauaacacauuaguuucuucuguuuucagaauugaauguaccuggaguuuggcuaaaagucagugucuugcauagauaauaucuuuccacaauucgugguggaaagagaguagcugccaauuuuuaaaucuguucaaccauaaacacaauaaucaagugacugcccagccccuguucauaacuuggccucuucaguguggacccccgaguggcugcggugcucaccgggcaauauccccuaugcugauaugaaauauacagauaagagaaauuuaagagaaacugaaacuucccuuguuagaaaagagcccuuaacaacaauucuugcgcuuucuguucaggggcucuuugacaauuauaaaggcugugaguccucuccuagaaacauacguacauauaagaucuuguauucaauuucagggggcucaaagaaccaugccacggccucagaacuauuuugugaggauggucuaucugcugaagcauuuccuagguugcauucugcagaacauuucccacgagcuauugaucagcaaacacaaaauguuguaucaaagauguuuuggaaauacuaggugaaacacaaacacauuuacaccucauuaagggaagacuuuucugaacccuaauaugcuaacagaugcuauaaacugauaaucgccaauaguagguguguuucuuaaacuuaugugaaacuuuuuguggggugggggcuggggggcaguucuuacaggcauuuccugaaacuaauuuucccacagaagaguuugggaaggaaacuagcccuaaggauaccuuuuugauauagacagucuccgaguuaggaaagucuugguccauacucuuccuccucuuucucucaucaggcucaggugcuacuccauccuagcacagacuccaauaaaauuacguggaugaauggugcaugccaaccagagaucagugugggaaaugguuugacccaaugucuccccacuaucauugccucucucccaucucaggagacucccucacucacucuguguggucagucaauuccacuucagacaaccuuugacagacagaaucacuucuuuaauccaaccucuccugauaugguuuggcuguguuuccacccaaaucucaucuugaaugguagcucccauaauccccaugugucguggacaggacccagucggagguaacugaaucaugaggguggauuuuucuccugcuguucucgugauagugaauaagacucaugagaucugaugguuuuauaaagggcaauuccccugcacacguccucucgccugcugccauguuaagacgugccuuugcuccuccuucgcuuucugccaugauugugaggccaccccagcuauguggaacugaguccauuaaaccucuuuuucucuacaaauuacccagucuggaguauuuccucauagcagcaugaaaauggacuauuucccuauccuuguuuuaauuaucugagccaccucagaaagauuucuuucacucucuuuguuccauuugggaauaaaaguaagauugagcuggaugugguggcucuggcauguaauccuagcacuuggggaggcgaggcagguggacugcuugagcucaggaguucaagaccagccugggcaacauaugaaacccugucucuacaaaaaauccaaaaacuagccaggcacagugaugcacaccuguggucccuguuacuugggaggcucaggugggaggaucacuugagccugggcagugggaguugcagugagccgagauugcaccacuacacuucggccugggcaucagagucagacccugucucaaaaaaaaaaaauaguaauuauaaugaauaauguuggaguuagguuaucaauaaauuuauauuacuuauucuaugcaacuuuacucuaaaacauuagagaacuagacuguauuuucagagaaccauuuugaguucuacccugugaauuaagaaucuucaccaaaacuguuuccauuuaccaaaguuauuuuauauauuuccuuauuuaagcagcaucacuuaauauauaaaugcgagguucacucuuucacuuguuuugcaauacauacuuguauguuauauauugauagauuuuauagauuauguaguucaauguuuuauaauaugcauauauaugugcacacacauuauuuuaauuauuucucuccugcaaaugcagaguaucuauagugggucccaaaagguuuuuguucucuggcuagccugggaaccuaccugccauuuauugcacuguuuuucugggaaauauuacucaacugacuuaaaagcuuucagaaucaucaguuuuaggcuaaguacuuccuauuuuuuacaucauuagauaaaacaucuuacacacgcgcgccaggggcauugguucuggcuagagugacaucgcuucuuucacuagaaaagaggauauuuaaauaaauucuuuggugauuaauccaaaccacaguguauaauacuaaggaauugaaccauacuuucuggaaaugguccuagaaauuguuagucaauauccauuuaaagauucacuaaaaggugaugggcucugguuccucuuucucauuuaaaaugggaccaugagaauaaaagcaaggaagaaagcccuagagugaguuucuguagcuucaggaugguguuuucuuuaggacuaugacaaucaagugugaagaccaaaaccuauugguuccuucacaguuggccccccuagcgucccuuccuucaucccugaucagggcaccuuacuucuuccuuggggagugcaauggacugaauguuaugucuuccuagaauuccuauguugaaaucccaacucccaacgugaugguauuaggaagugggaccucuggaaggugauuaggucuugagaguacagccuucaugaaugggauuauauaugggugcccuuauaaaagggaccccagagagcaacuugcccucuuuccaccuuguaaggauacagcaagaaguuggcagucugcaacucagaagugacccucaucaugcuggcacugaucuuggacuuucagccuccagaacugagaaauaaaucuguguuguuuacaggacaccuguccaugguacuuuguuagagcagccugaacuaaggaacugcacccgguuuagguggcgcagagcccaauucuuggcuccagggguguaugagccaggccuuaugaaugagaggaccauguccccuuauucaagagauuagacacgugacucaagaugggccaauaagagaugagacauuuccuggaacuacagggaaauaagagcugucuuccuggagacaucugguaauuuggcagacgauaagccuguagcucagagugggccaucuugcugcugccauauuggggacccuucccugcuugagaauaaaauuaacauagaggaggagaguggggugggggcaaugggggaggccuaaugacaucauuguacaucuagagcuaguucuagcugaagauaacacuaauucuggacuuccuaagagucaauaaauucuuuuuuuuuuuuuuuuuuuuuugagacagggucucguucugucacccaggcuggagugcagugguguaaucguggcucacccgcagccucaaacuccugggcucaagcaauccuccugcuucagccuccugaguagcugggacuauaggugugugccacuguguccagcuauuuguuuuaaauuuuuuuuaaagaugaggucuugcuauguugccuaggcuagucucagacuccuggcuucaagagauccuccugccucgaccccccaacaugcugggauuacaggugugagccaacacacggccaaguucccuuuuuuauguaagccagucugagguggaguuuugucacuugcagcauuagaauuuaucuacaaaacaugugauaaaugacaguagcaauaaacugucuugcuuauucaaaacacugauucaauguugacugccaaaacauucaguaagacaaggaaagguauacugagcucuggccuggcuggagacuaucuguugaauucauacauauggagguaucuuaacucuuucaggccuuaugcgacugcuaaauguggcgucauaacagacacauaccacagaaaagaaucacagcagaauagcugaauugaaagagaauuaggaaauauccagucuaguggcuuucaacuuuuuuaaacugugguccacagaaagaaauagaagccagcacacacacucccauauggaaaccaaaaagcuucccaaaucaauacuuacgcuuacuaugugcaaugcacucugauuuuaaaaucugaugauggugaccaugcuuuucugaaccacuaauggguuuggaaaacagguaagagagccggagauacaagguaauuuacauaagguuucucacugagugaaugguagagcugaaacacccagugcccauccugcuguauuauaugaaagagaacagcuguuaccuacacacaucccuagacagugggcuucuggccaauauucucagucugggaaaaugauucaggugucaggccuauuuuacacugguacaguguccaggauuuuuagggccaccucaagaccaccuaagugaaaacucacauccaccaguuggcuuuagauucacauccacauagauugauuuucgacccucucacuccuccuugaacugaccugcaugggaaaucauuuggaguuugugccuaaaugaccaacaaacaagacugaaccaaaggcacggaguaggaucacguuugucuugggcuugaagaaacacauuucauuacagucuccucacccuaucuaaugaguagcaucacgcuggauaacuucuuugccaacuaacaguauucaugaaacuucaagucccagauggcauuaugcuaggcauaguagaagauacagcuuagguggggccccucugcaccccauaaacagcuguuaaucuaaucugggaggggagaaaaaaagcuucauuaauaagacuugagugaggcucaaaggaaaaaagagacagaauuuaacauggaguaugggugacgguaggcacaccagcacaccagcacaccagccuggcugcgugugacagagggcucaugcuguguggcugaggaugggguguggccagcuggagagugaaacaugauguaugggguggugaaagucaggugaaacacgaaagcugaaaaaauggagagaaugauuaauuuuuaguaguugauaaauauuaguuuaauauaauggagaaauuuauuuacaugacuuaucaucaccuuccacauuacaaaaacauuauguagcuuuaugaucagcacuuuaacuccuagaaacauuuacccucauuaaacuccguauacuuuaccuuccucaaaguaauauuuaauuauuaguuuuaauuugcuaagcaacugauguauaguaggugcuucaaagaugagcugaccagucucuccacaucaugucuaaagcuaugcucuauuuucaauguuuauaagacaauauaaaauuaagcaaauuacagggaucacgauacuuuauaaacuaaaauuccaguuagucuaucaaaggaacuuuacugaaauaaagcauuacacaagaucauacuggcauucucccccuccacugucuuuuucuuuuuuuugaaucagggucuugcuguugcccaggcugcauagcaguggcaugaucauggcucacugcagccuugaacuccugggcucaagcaauccuucugccuuggccucccaaagugcagagauuagaggugaaagccaccacgccuggcuauucuuuguuuuguuuuguugagauggggucucacucuguugcucaggauggagugcaauggcacaaucacagcucacugcaaccuccaccuaccaggcucaggcgauccucccaccucagccuccugaguagcugggacuguaggcaugcaacgccacaccuggcuaauuuuuguauuuuuuguagagacgggguuucuccauguugcccaggcuggucuugaacuccuaggcucaagcaauccaccugccucagccucccaaagugcuagaauuacaagugucagccaccacaccuggccguauuuuuaaacuuacuauucacaagguaucauaucaugguuuuaaugagucacuugcuguacugccuguggggugaagaguaacuaucuccugauggcgacggcaucuccuugucugccugucauguuaagccaaauguagucacauaagagaauagcaaagaaaagauggucauuugacuucagggcaauucacucaagaagaggagaagacucuaacugaaggucuccaugacuaugaacgccaacauccccaugacaugaugugacacuacccauugguaucacccagcaggcuaauaagcacuucugaaauguuaaaugugaguaauacuaacuugugguuuuuaauguaauucaauacaucacaucuggacuucucccaccaucacgccugugaucucagcacuuugggaggcaaaggcggguggaucacuugagcucaggaguuugagcccagccugggcaacauggagaaaccucaucucuacaaaaaauacaacaaauuagccgggcauggugguguguaccuguagucccagcuacccaggagacugaggugggaggaucaccugagcccgggagguggaggcugcacugaaccaugaucaugccacugcacuccagccugggagacagagugaaaccuguuucaaaaagagccucacaccuuucacucgggaaacuuucauaucaaccaaugcuuuaacuuugcuaucuuucucauauuaaguaaauaauacucaguuccacuuguuauucacguacuggauucuagaacagccccacaugaauacacugcagcagugacagcucuuaguaaaggcccaguucaguccuaaauagaagacuaaagaaaagccugggccaggcacgguggcucacgccuguaaucccaucacuuugggaggcugaggcaggcagaucacaaggucaggaguucaagaccagccuggccaacauagugaaaccccaucuccaccaaaauacaaaaaugagcugggcaugguggcgcgcaccuguagucccagcuacucgggagacugaggcaggagaaucacuugaacccgggaggugcagguuguggugagccgggaucaugccacugcacuccagccugggcaacagagcgagacuccgucucaaaaaaaaaaaaaaaaaagaauagccugaaauaaugcauccgccaggguaucaccaaagccaaauccuuaaauaauacaaacaagacuguuauuaacgaguacaugaaauacuguauuuccauuugaguuguucagauuauaauuaaucaggacgaccucaucaaggucucucaggaauacacagcaguucucugcuucuuuucacuacuagguuaaauuuauuuaggaaaugcauacgcuguaaguaaaugcuauuuucuuggacauuaaacauuauuacucucuaaaucuaauacaaagaaaaagagaaacaaauuuauuugcuagugucuaauucuggucuuggaauaauaacuauuuuuuuucuaaacacacagcaggaaaagugcuucugcauaaugcauuucucuugauccgguucccagcaauaguuucucgauaagacacagauucugcagggaaacggaacacuucaguuccucaagguaguaagagaaaaagacuccuuguauguaauagccagacauuuuaucgauaaaacuugggagcacaauuuuaaaaagucagggguuggccucacugguggaaaaaauauaaugcauucauucaagcaaccaaacacaggaggcauuucuguaguuaucugagggcaccucucacguuuacugaguccgcuuccgggauuagauacuucaggcugccagcagaaauccuaucaaguaaaagugggcaaaauagaaaauggacuuuaaaauugucguccuucccuggugaggcaacugauuaagaagacagucugcaagaauaucaucauuucagaaaucuauucugauaccugauuuguagagaaaugcuuuugaugucugcaguaaucuacagagaucgaaaaagucucaaacaccagaacgccaucagcgccaccucuaaagaggcgcaauaccuagaaacccaaucaccagagcuccgaaaaugcaaaagggccaccccgagcaucuauccuggcccaucugcgcguggaaagugcucucuggucgccagucugcagggaagcaaagcucucagaaguuccuccgagccuuccauccacuuucaggacugcccugugcacgcgggugaaucgagcgucccuccgcuccccuggucuguaguuagagacagucccccgucgcccgaucccgcacccgcugaggagcgcagggcugugcccgcaccucgccucgcaccugucugcccagggaaaccgggagcuccgcgggccccgccgcgggaaggaggcggcacugggucccaaaaacccguguugaggagaagccgagcgccccaacacacucgccgccggccgggccgggcccccgcgcgccccgacgccgccccagccccgcccgcgcgcgcccgacacgcucguccccgcccucgcuccgacacagacacacgcgcgcguccucgcaccacuccagaagcucauccggcccgcgcgcgcacccagacacgcguggcucacacccgccgcacacgccccucgcacaaacacgcgcgccccucacgcccucggccacuccagacacacggccccgggccccacgcaggcucgggcgucgacacacccucgcggcauggacacgcgugucucccacccacuccucggccaaacgcaccccucccugcagccccucacccuugcuccucacacucacuccccacucucgccccagaaacacgccccucacaccgggcccgccggauccccacacuucccacucgcgccagaaacgcgcgcacccucguggccccucccugccgcgcguaaacacgcccgguccgcgcacgcccucccggccuggccccgcacacucgcgccagaaacacgcguggccgcgcaccacgcccccggcccgcgagcacgcguguccccacgccccggccccgcccccgccccgcgcgcgcccccgccggccgccgcccucgaccgcacgcgcccuccgccuagccccgcgccgccgcgcaccuacccggaccugcugagcucggcuccugcucgucaggcuugcgccgagccgccgcucacuggcucccgcgccccgcccggccccgcccggcccggcccagcccggccccgcgcccgcucagcuccacucgccgcagcuggaacgacucgcggggcuccggguaccgcggucuccccgccacugcccgagugcgccgcccggaccaauggcggggcgcggcggugagcucaccggaccagaccccgccccccaggccgcgugguccaaucggaggaugcgacgucacccggagccgggcagaggcuggugcggggcgcggagccgcucggcgcggggacugcgccggaacugcgcccgagccgcgcuggacggcgggggcccggccggagguugcgggcggagcgcggcccgggcguccccgcgcgagagccgggcccccggucccucgcgacgcgguccccgccgcuccgcccgcccggcucagcgcggcccgcgaauggggcggcgacgguucccucgaggccgggacggcucggagcccgacggcugcgcccgcugcccgggccgacggcccccggagccccgcgcgggccucccguuccccuucccgcggggccgccccgcgcccgcccugccuggcuccccgcgccgucggggccgcccgaagcuccgcgccgagggcccgcguucccgggcucgggcucccugcgcggccccggcgcgcccugcggcggcggcgucugcaaugcagccggcgggaggagccggcgcugcgcaacgagcggggaggcgugggggccaggcuggagggagggggccggggcccgaggacccggggagggccagggcggggcggaggacggugggcggggacgguggcggcggcuccggcuuuggggagggggugcggcgcugggcccccuuagcuggagugcaggcuccgcccacccuuugggucuaaccuccgcguuccaaaguuccagcuccagcccugcgcacuuggggacuucugcgugagggucucucgccccggccacaaaucccgagccgcaccucuuaaucgaggcucaggcgucccgagcggaucccgcuuucuuuuuucccugugcuguuugcagucccacggccucgcacagagaaagugccugaccccaagaccugugaugagaccgccuauuuuguuuuuguuauauacuaauagauauagauauauagauacagucaauuaucuguaaaaucggccaugucucugccaccuggguaaaaaggugucucgaaauugggggcggagucucuuuucugacccuacccaaacgcacacagaaacaaccccaacauuugcagagcccuuaagccuguacacccaaugaggaaucgcugguuagaggccgcgugaaggacacccugaccaagcuggguccugcccaugccgguagaucguccauggcuucccuugggggcugccacccacuguaaaccugagcaaguuccucuccuguuccgaagccugcccuggcaaagccccaguacauauuccaauccugcucuaggucaguauucccacugcaccugucuaccccucgcccgccccccgggucaccacgcaggaccccuugcacgcuccccccaccaccuuugcuaugcaacuccuccccuuuaucugcuagggagacuccuaugcauucaucaagguccagcucaaaucuggccacccucaguggcuuuuccugacgcucucagcagaaccaaaccuccagcuuuguuauguguugguguugcaguacacagugagugaguucuguuuguuuuccagggcggcaaugaaaggguagucaucagggacacauaggcucgggaaaccaaccccccuggguucagagugggcucguugcuagcugugugcuccacugucugugccuucauaucuauggugcgggaguuaaaggaaucaauagguggaaggugcauguaccagugccuggcacugauguacauucaaucaaaguuagcuaccguugccagcuuugccaaaacgggguacuugggggcgaggaggaguggcuggaggcugggguugggguggcuucuggguuucuggugcuguuuuaaucucgaccugggcacugguuuuaguuugugaaaaaucauugaguugcauacuuagaauaugugcacuuuuccauauguccaucauacauuaauaaaaaguguuucuagaaguuaguuguuuuucacuaagagcaggacagcccucaucuccuugagaacaagaacaaagccugacaucccagcagcuugcacagugcuggcggggcacgcuguaagugcucagcugaugguuguugaauugcucugaauggauugugagcaagagaccagcagggguggaggcugacaggagagacagcgccugccucuguacucuaaagugccggggaacucguggugauuuggauccaguucaggcaccugaagcccaguuaaagagaaggaaucuucagucuuuucucucucagguggggaaguucuuuuuccuguuguuguuguuuguuuguuuguuuguuuuggcagacacaaguuucagcccuggcaucccagcugucugaaggaggggccucagggguacccaugaccccucacccuuccugcagcagccccaccucugccgagcaggugggacagguggggucauggcugcagcagcccaggaggcacuggcugagcccugcugaguggguuggggucaggagccuggggugacguuucugcauggggaauguccugguauuguuucucggcugggcucguucuucuccuggagugccugccacucacugcaccacaggagcaggaggcuuccuugggucccuuucuuggaaagucaggcagagcuagggugggaugagcugggugcuccugaggcaagccccgagugcugccagcgcccuaaaacugaaucuccacaggugguuccuugugguauucauguucuuucuuccaaguuagaagaugagagaauaaggcacgcgcaugauucaagcauauuguuacacuggguuuuuauggggcuuugagcauaccuggguuguuuuguaaaauagagaaaaagaauacucaguuaugaguccauuggcaguaccaagguuaagugcaauuuuuguccuuuaaagcagauacagccgggcacgguggcucacaccuguaaucccaguacuuuuaggaggcugaggcaggaggaucacuggaacccaggaguucgagaccagccugggcaacauggugagaucuccucucuacaauuuuuuuuaaaaaaaauuagcggggugugguggugugugucuguaguccuagcuauuugggaggcugaggcgagaggauugcuugaacccaggagguugaggcugcaguaagccaugaucacaccacugcauuccagccugggcaacagagcaagacccugucucaaaaagggggagaaaaaaagcagauacagggaguugauauaucagcccuaacccugcugagggucucaggaugaacccaggggguggauccuguugcagaggaggaagaagggaauuucagucuguuggaugccuguuaucugccugcuguugugccaggcacucacgcugcugcuaagucuccugcaagcaggauauuccauagaggguaagacgaaagcuucaaaaagucagauaacuugcucaaagccacacagcuggaaagcaguggaucuggguuucacuucagagccuguguucauucugcccuauuccaagcaccuaaaaacucuuaccauuaaguagauaucauuuguuuaacagaacagucuggaaauuucuacaaaggauuuuuuuguuuuuugagacaggaucucacucuguugcccaggcuggagaguaaugccaugaucuuggcucgaugcagccuugaucucuacaaaggaauuuuaccacagugauuaaaguucgagaugcacaacagaaaguccacaucaacugauuucauuacaccuguuacauuucaauacacuccagggaaaugguagucauuaauauuauauaccaaauaucucugguugcuaucccugggggugcuuugcacuggccuguacccuuugaaguuagaugugaccaugugacuuucuugagccaaugaaacaugaauaaaucugauguguauuauuacagauagaagcuuuaagagccagugaccugcccaacacauucuuucccccggcccuggcaauugugcaagcuuguuuauaggaaaagguagccucugccagccggggccccugugugaccaugaugaguagggcccucccuagcaauuguaguuggacuuguagcaugaaugagaaauccaguccugagauugaauugguuguuacugcaguauaaucuaaccucuccugucugauaagaaaucagauguuucuguauauaucaacuuccaguaaaagaaaaaaucauaagauucugcucaaacuaagugacaauuuaaaaauaagagcaagaugcauauucaguauaucuuuaaggcuugaagaaauagaaaauauuuuaaaaagccacagguaaagcugacaaggcaauucaauggggaaagaaucgucuucaacaaauggggcuaggacaaugggcuauccacaugaaaaagaaugaaguugaaccccugccucacaccauauauaaaauguaacucaaaguggaucaaagaccuacauauaagagguaaagcuacaaaacucuuggaaaaaaaauacggcaguaaaccuucaugaccuuggauuuggcgauaguuucuuaaauauaucaaaagcacaagcaaccaaaggaaaaaauaaauaaauugaacauuaucaaaauugaaaaccucuuugcuucaaagggcaacaucaagaaguaaaaagacauuucacuaaaagggagaaaauauuugcaaaucucauauuucauaagggacuuguaucucaaauauaaagagaacucuuacagcucaaaaauaaaaagcaaagaacccaguuuuuaaaaugggcaaaguaucugaauagacauuucuccaaagaagaucaauaauaagggcaauaaucaauaaugcucaacauuugauuugaggaaaucaaagucacugaggaaaugcaaaucaaaaccacaaugagauaccacuucacacccacuaagugacuauaaucacaaagaaagacaauaacaagcguuggcaaggauguggagaaauuugaacuuuuguacacuggugguggaaauguaaaauggcacagcuacuuaggaaaacagucuggcaguucuucaaaagguuaauuauaaaguuaugaugugacccagccauuccauuccuagguauauauccaagagaaugaaaggagauguccauacauauggacauuuacuuagcaauaaaaauaaugaaguacugauacaugcugcaacaugggugaaccuuaaaaacaucaugcuaagugcaagaagccagccacaaguccauacauuguauuacaucauuuauagaaaauguccagauuaggaaaguuuauggugacaggaaauagaucaauaauugccuagggaggguggugggggggagcugaggaggaauggggagugacccugguucaugggcagcaggauguuucuugggggaugaaaauguucuaaaauuaguuuguggugaugacugcacaacccugugaaaacacucagaaacuuuguacuucaaauagguaaauuguaugguauguuaauuaugucucaauaaugcuguaacacacacacauagacaaaggagaauagaaagagaaugaagaaguauagaauagaaaucaauggauuuaacuugagaaaagaagacugaccgacggaaaaagcuaggcccaggucaggagagucugauggccgauccucccagugagucggucugggccaauguggggugcaguggcaggaggggaaucugaauagacaggcccugucccaugacuacucagugaggagaugagacuggcacaggggaggcccugagucacacgauggugaugcccagggcagaagaugucagaagacaggcaguuugacagugcuucugaaggucgugaaaaagccaggggugagucuguaaagucccugcuggccaugaugaugucccugacagcuggggauccuggcgagaacagcauucagaacuugggauuuuccuugcagaucacaaugguuggcugacucaggggaaagggggagcuuugcagagagccucaaacaucuccagcugagcugcaccugucagggccccugagccauccaggaagaaggaggcacugagguggggaacgggguccuggccuggggucagcagccugggcucugguuccaguuccgcacccccccuugccccccagaacuaccuguauggcaagcuccuuucccuuccugugccucaguuuccuccucuguaaaaucaguuuagacuacacugcaagguuguccagcccgcagucagugggcugcaugccagccaggacagcuuugaauguggcccaacacaaauucguaaaccuucuuaaaacauuaugaaauuuuuuugugugugauuuuuuuaaccuaaucagcuaucauuaguguuaguguacuuuaugugugacccaagacaauucuucuucuucugcuguggcccagggaagacaaaagauuggacacccuggacuagagucucaacauaauucuuuaaaaauccuguuuaauccaaauccguuguugcugcugaagggacaggucuaaggccauguugguggggggggggggggucacagugcguggccagcaugaccugacagagcaggugccccuaugcuucagcugcagggacucugggcuuaaaaucaucagucccaugagugcaguugcaugugugagcuuggccaacccacggcaucaagagaaaguacccauucucaucauuuugagccauucagcuuuggguuggcuuguuauacggccagagauaaugguccugacagugauguggaggauaguggggagaaacaguguuugcuaccaggauaugccaugauuggcgucauccugggaaggugccagcuguaauauggagggaggaagagaugcauuagccaucagcccaaaaacuggcagguuucuccuaauggacauaaugcagaaaagaauccaaggaagcggagugaaaccaccuucaacucauucucccugcuggcugacacaggcccauccauuccgccagcaacuucuaccaggcccccacuauuacacacauguuggauguuaaaauacacagcuauucuccccauuaaagugggcgaaaugcagagacaucucugcugugaaggggagcaggauacuaaaaagcggauugucccaaaucaauucagguggugggaaggcauggugaaaaagugcccacugggcugcaaugucagauggcccugaguucgaauccccagcggugugacacaggacaagucacuugacuccucuaagauucaggcuccucgucaauagaauggggauggaaagaucuggaauacggccgggaugaaguuggauaauaaacuuaaauagauagcccagggccuggugggugcccagugagggcucaggggauagaacccggaaaucaccaucacuucggguccuccuguccucaggaugugcuccagaucuuucaggguggcagaugccuuccugccacuuuccucccuaugcuguucgaaugagcuugccuuuccugccugcacagcagcugugugagggaguuggccaggaugcccuaggcagauugaguaaucccacacagguacaagagaggugcuccaacggaaucuuauucuguagccauucaggaguagcuggagugagacgaccuaggcccagaccucuuagcaugcacugguuuaacucacaggucccacccagcccagccugcaccagcaaagcaauacaggcuguuucuucuaagcaagaauucccacauguccaugcacuucuucaccuggcuaagggcucacagauccucccgugcagaguguaugggcugccacggccuucucuacggcucccugugcaggguccaacccuucucaagcuccugaagaggugcucaggagaccccagucuucaggucugagacagcaucagagguccuguggggcuacagucaacuuuuccaugaggcagaaagaccccacugagccuucaaagaggaugccguguacccuacagcccaguagagucacagugguaaaugggcauuuuaaucagaaaaguacucucaaaaaaugcacuaaaucaagcugucaugguguggcuuucuuauaaagcagauaacauuuauuuuaaaaaaaaaaaaaacuggcugggcacuguggcucacgccuguaaucccagcacuuugggaggcugaggagggaggaucacgaggucagguguucgagaccagccuggccaauauagugaaacccugucucuacuaaaaauacaaaaaaguagccagguguggugguggugccuguagucccagcuacucggaggcugaggcaggagaauugcuugaaccugggagguggagguugcaaugagccgagauugcgccacuguacucuggccugggugacagugugagacuccguaucaaaaaacaaaacaaaacagcaacaacaaaacaaaaacuuagagaucuaauuaaagagaaacaagugugcucucucauaggcaacaguggagucaaaagacugugacauuuaugagaaagccauuuugacaucaccauccucacagccacugagccacugucagguacccgugaaaaugagagcuggaaaguuguccuuuuagggaagcaacuagcuacucccuaagaauaauaaguaccaaggucaugaagagaggagcugugcuguuaccaacaggagacagagcaaucacaaaggaaggcccaauucugugcaagugcauuuuaaaugacagccgucuccugcaccaggggaggcagagcugacauauuuaguucagggagcauuugcagauaccuuuggugcuaaaugacauuacuuagaaaaagaaaaaaguggccagggaaaagcgcacacaugacacacacucgcaugcccccacccccugcugaucucucuuuggcacccugggucacuuugucacuguggccccucauggugcagccacagucccaugcaggccagcaccucacuggcucuggaaccaaugaaguggaggcuguccccugcuuggcucugcugccccccagggccuaagaagcaccuauguccaaagugaaauaccauggaucgugcucugucuccagagugggaacaagaaacgcagccccacccagugauccuccuggucuaaucucacuuucaagugacuuggaauaaugccagggcguuucaccaaauauaaaaaugagcacccacucacucuguuacugggaaugaaaaaaugagaacgccggggaggaaugaugucuuugagugcaauugggggccuuggagcuucaggcucccugccgcgcccucuucucucugcucagagcucgcucuugccugcugcuuuccaggggagggguguaaagacucaugaugaaugcgucagucauuuccaaguuccagagugcugggggcuuccagggcaucaggucccaccucgugggggcugugucugcagcauuucugggcuggcuccaaagcaccucugugcaggcccuguacagagcuaucuaccgguuucuccuggcuuuagcucuccugggugacccagaccagaccuucugaugucauaauaaacaucauggagcuuauaaaauuagagcaaugaugcauuuuuuaugccucaggaauuacacugaauuguuaaugucuuggaaaauggcugaaugcugcauucguagcuuuccuuucccuuaagggugaauuauugagcaggaaugcucucuccccagguccccgcccuggcucagagaucccugucugcacccagcugggcacuaauugcaagguccgauccauucccaucaguguugaggagaggaagagaggucuuguuggagaagaguagccaucgaggaggggacaguggugcuagggcuuccuucagccucccagcccccagcacaggagagggagacagcagagagggccggagggagggagcugguggcuuaaaauggagccguuuacaaccccgcacagcaaauggagccauugggaggacacuugaccgagaggagagcauugcuugagccaggggugccgucugcaggacagagacaggaggcaguguuguuuccagggcaucguggaccauggcacaggugagcaauuuaaaaaggugauuggaaucauauguuagaauaaugaccuuagcagucaaaggcuccuggaauuugucauuuaauuucauauuuuagguggacugaucuguaauuuaguuaauuucacaucuccaucuaggaaaacuggagcucugcacaauauuuucugcagacgacaaaguauucacccaaacuauuucucauaguaaaaugugcucuuuguccccagagaacugcugaauacuacauaagaucuguguaggagccaugcuuuaacaacaacaaacaccucagacacacaacaacccuuuccucccucgauaaagauacugaaaagaaucuggucucuggggugaggaguaggggaagcaggugcaagcaagugggugcagaggagugggaagauggcauuuuguguaggaaagaauuuaacguugcccaaagagaggucuggcuuuuguccucaccuucugggaggugaacucuaagcccuuggaauaucaugccugauuggaguuuguuugccugggauccuugugucacagaauggucuaaccauaugauuuaggguagaugcuggccacacuggauagguuuaggguagggguuggcugugccagaaagaccaacaaugugacuuaggguggggucuuugggucacgugguaucagcugacucuggaggagcuggagagggagggcagucaccugugugauggagccgcaauaaaaacucugaacacuggggcuauggugagcugcccugguuggcaguacuccauggguacugucacacaucaaugccaggaaagucaugcuuuucaugauuccauggggaagaggacaguggaagcuccaugucugguaccuuccuggacuaugcccuaugcccuuccucccuuggcugauuuuaaucuguauccuuuugauguaauaaugugcaacugugaguaugagagcuuuugaugaguucugcguccuuccagugaaugaucaaaccugaggguggucuaggguaccccuugcaguuggugcagcaauaaagguggucuuauguggauggugcucccuuuaacuugacagguggcuaacugauaugguuggcuguguccccacccaaaucucaucuugaauuuccauguguugugggagggacccagucgaagauaauugaaucauggaggcaagucuuuccuguguuguucucacgauagugaauacaucucacgagaucugaugguuuuaaaaacaggaguugcccuguaagagcucuuucucccuuugccugcuaccauccauguaagaugugacuugcuccuccuugccuuccaccaugauugugaaacuuccccagccacguggaacuguaaguccaauuaaaccccuuucuuuuguaaauugcucagucuuggcuaugucuuuaucagcggugugaaaacagacugauacauuaacacuugcacauucuuucuauauaugaagggcacuccuaugagcacacauuacaguuuugauagagaauuagccacugucaaguguguucccuccagauggaggcacagagggguuccccuggcuucucacaccucccggacacucaagcacuccucacauuaauuguguuguuccgugugcccccugcccugggcugugaguuccugggggguggggggaugccugguugauggguaaagccuugguucuagcagguacugcugaaugacagguggguggacgggcugccaccuaucaacgcuguuucuuccauauaguuuaugacccaguuugggggugaggugccugugaaugacaaccugaggcugggugcugggaggcuucaacagggccaugaugugaagcaccaggccuggggccuggcuggugaucauuacugucacugucacaccaguguguuuugaagcagcaggauuccugugcauagggagguuuucauggccccgacucaccuacucacucauucauucauucauucuuucuuucguucuuucuuuccuucaccaggcuaaugugggacugggucaggggcauuacagagggucagaugaggcucuccuccaggguccaugcaccacaaccuaccauguagugacuugccaaggaccggccugagaaacccccucccucucugaggccuagagagagggcugagcagcuccaggaagaaaagugcuuuuuccuuucucuuccagcuucagugagcugaagggaggauuucucaccagguggcccuuuaaaagcucugaaggcagccucagggcagguucaauaaagagguagcagagggucaagcuucugcacuuuggucuugggucauuugccuggagcuuguucagugacagggagacccaaagggaggugacgcugccugguuaguccuggacacccuacccagccugguucugaugucagagaggauauccggguggcuggauccuaaagcugcagucagcccugaggacaauggcccugaagauaccacuaggccaucuguaccucccuccuucccucccucccucccuccuuccuucccuuccucccucccuuccuucccucccuugaagaaaccuucaucgagacccuacugugucccuggaccccuacacuggggcacaaugauaauuaagacagaaguucuuggccuugggacucagcaauauugucaugcuuaucaauuuccuccacacccacagaugugcuuuauucagugccaccuccacgcagacauuucagacuucucuuucucucucucucucgcucucuugucuauuugcucucucagcucuggggcuacacccaccugccauugacuuuucacacagaugucccaaaagccccuuaaacucagcucaacuccugacugguccuccuccaaggugaaugacauggagccuccauagugaauccacccacaagaccuccugaugccaucuccucgguggcucucacacugucccugugcccccagaacugccaaguuaccaucaucucuagccaggaugauuuccuggucuccccucacccucucugagccuccuucaaucuguucuccauguggcugccaugugcgcuucuucagaagccaacuuggucacgucccugccucucgagcccucaguggcuuuccucuccuuggggauaaagccuggcacacacagcccuggcucugagggucccuccagccccuguggccugauucacugccugccccucugccucacuggcuucauggcucccucccaccacagaguuucugcgcgugccauuccugcggccuggaauguuugccuucucucuucagggaguuaacuugugcucaucguucagcucuugguuugggggucauuucuucaagaaaucccucccagaccuccucgagaagucaccauccuccaucauaagguccccaaaugcuuguuugugcgaagacagguggucaguucggauguuuccuccccuggacgggaagcucguugacugcagguccucaucugauccauuucuucugauacucaucacgugacgcagugccuggcaccuaacggguacuccacugacgguugucgugaauaaccgggaagcaaggacaggcucuagcccugggaggcagcuccaaaguagugcaggugcaacaggaagaggcuccagaagccucacauggcauagaggucaagagcggaugauggggucgcacugcugugugugacucucugcgccacccacucacuguugucugagcauccccaucuguggaacaggggccucacggguugccggaaagucucagugagucacuacacauggguacacaucaguacuucauggccagguccuggcagguggugcaugugcagaugucagcugcugucccuccugguggcaacucugugccagaagguguuuugcugaaagaaacaauccugguggcucagaagucugccaugugucucaagaccaaucgaugcagcuuggugccacugaagugaugcaggaugucaccagcucuucucaagaccaccaaaugggguguggggcugggguagaguuccuugcccacaugccagcacaucucaggauuugguaugacaggagacacucugaggccuccacuggguaccucccgaucugcugaugccagaacugguccuucugcaugagggccagggagcagagggcuagagccaggucacugcucccucucuccugccagugugaaugccgggagagugucagcucacuccgcggggacaccagaggcaaaacuugaccucgccaaagaaaccacaacccaccacacagaagccgcccagggcucccagcuggcucuuucuucuuauuuugagauggaguuucgcucuuguugccuaggcuggagugcaguggcgcaaucuugacucaccgcaaccucugcuucccggguucaagugauucuccugucucacucagccucccgaguagcugggauuacaggcgccugccaccacgccuggcuaauuuuuuguauuucuaguagagacgggguuucaccauguuggucaagcuggucuugaacuccugaccucaggugauacgcccaacucggccucccaaagugcugggauuacaggcacgagccacugugcccacuagccggcucauuucuuaucugccuuuguguccuagcuucuggggcaugggugaauuuggcugugggauggagaaggggaggcagacagagggaggagagcaugcagaaggagucaggaggugacuuccaucccgauucagcgauggcuuggggccagcagcugcucuuccuggggccuggguuccuuccagaagaaugaggagauuggacuaugggacaaguuccaacuccugaacaaccuccguuuguuuuugguguaucaacuguuuucccucugccacugauuuuucuuuuuuuuuugagauggucucgcucugucacucaggcuagagugcaauggcacaaucucagcucacugcagccucaaccuccagggcucaagcgauccuccugccucagccucccgaguagcugggaccacaggugccaccugugccaccacaccuggcuaauuuuuguauuuuuugucaagacaggguuucaucauguugcccaggcaggucuugaacuccugaccucaagcaauccuccugccucagcuuccaaaagugcugggauuacaggugugagccaccgcgccuggcuugccacugauuuuuuuuuuuuuuugagaaggaguuucacuuuugucauccagguuggagugcaaugguguggucuuggcucauugcaaccucugccuccuggguucaagcgauucuccugccucagccucccgaguagcugggaccacaggugccaccugugccaccacaccuggcuacuuuuuguauuuuugguagagaggggguuucaccauuuuggccaggcuggucuugaacuccugaccuuaugugauccacccaccuuggccucccaaaguguugggauuacaggcaugagccacugcacccggccugauuuuuuaaaaagucuccuguuauucaugaaguaugguccauaugacacauaccugccucucacuguuuuuccccuaacaaaggacucugauuucacaacaggugcaaaguuucagcagauuacugcuggggagggagccagucuucagccuaucaaagacuauuuugaauguccuggugucacagaugugggggacaagguugcugggcugcucagaagggucagagauauguguauuuuuaggagcuucugaaaggacagggcuuuguccuuggccccaguuagaggcugagcauuggacuggaugggaaggguguccucucaccuugcucaggaccacuaggaauucacauccccucagaggcugcccuagcccccaaccagcacuugugucuucucuucuccaugguggguguucugggucucaggaccacuucucccggcagcugcacacacagacuggcaccucccuugguuuccagggagauggauucugggagcccaaucccaguaaaggcuaaggaugucagcccauugcuggccuggaccagccagauucccugaccggucucucuguggucccagcuuugccaagaggccuuucuucaaggcugugcuuuuaguggaacagcugacccacauccaaaugcugugguagaauaaugggaguccggcugggcaugguggcucacgccuguaaucccagcacuuugggaggccgaggcagguggaucacuuaaggucaggaguucgagaccagccuggccaacauggugaaacucuguacuaaaaauacaaaaauuagcugggugugguggugcacaccuguaaucccaacuacuugggaggcugaggcaggagaaucaccugaacccaggaggcagaggcugcaguaagcugaaauggagccacuauacucuagccugaacgacagagcaagacucugccaaaaaaaaaaaaaaaaaggaauaaugagaguccgacguaaucgauuuaggagcuggggcguaauugccugagcaggccugccaggcaggcuuccggugaaucugcacgauucuugcacccagcaacaaccaguggucagggcccuggagcugucuccaccaggucugauaccaacacaguguuugggggugaaucacaguuuguuccugcuuuggggcucaccuggagccccugcuccccagcggggagccaugaagaaggaaucugucucugggacucagaacagaugugggacaucuccacgagcccagggacacagaagcugcccuccuggggcccacggaccuaucaaaagguuggcaagaccaacaccagaggugcaagaugggaaaagcaggggacggggccuugccuucugcugaacgagcaguggauggggcagugggaggcacgcgaucuccugggccaggcaagaguccaggaggcuccugcccuuucucaucugaccccacacuguggaaggcugugacucugagcucagagacagguauggugccgugucaccuggauuuuccagccacuucucugaauucugcaaauccguggagcucccucuugccucaggaccuuccuacccaccucccccugcuuggagggcucuuacccagcucccugcuuggcaucugaccugccugaccacguccuuuuuuuugaaacaccuucguuucuuagccuccaugggucacauccugcugguuucccuccguugcacuggcugucccccucccuccuuggccagcuccuccucugcuugguguccucauaccaggguagccugugcuugauccugcagccucuccucugcuucaucugugcuguuucacggagucuucgugcucagaccuagggcgcuaaacgccaucugcacgcggaggacuccuaaacgucaucuccauucuggaucucucauuggccuccagacuuucagaccgcaaugugaaccccgcaucucuaaugagguugucagcuguaacgugaccaaaacugaacacuagauuccccuauccccuuggguuugcugcuucuucagacuucuccaucucaggaaaugguuugcuguuccuccggugguugaagccccaaaucuaggcauuauuacucauuguccucucucguucuucauauucaaaucaucagcagagcccuucacuucaccuccaaacaaccccaaacccacccugucccucaggagucauuguuccggccuugucagagccacaaucgccucuugcccgaacggacgcaagagcccuggaguagucucugugccgguggagacacaauucauucuccacguggcagcugcgguguucuugcaaacauacaccuguguguggcaacgccccucccguggcuccccacugaccucagaauaaaagcccagcccccuacucuuggugaugcaucccauguggccucugcugaacccccuggcccucucccauccccgcaacccccuccaccuccccuuccucuauucugaccgcagcucccccaacgcgccaggcuugcccucucccugggggcuuugcuccugauucccuguccuggaauauuccccccacggucuuacuguggcuggccccugccugucacucauaccccagcuugaauaucaccuucucauacaggccuccucugaccucuccuggccuauaaagcagccgcccugguacccucucccagaccauccaggggaaguucccugcccagcagguaucaacaucugacaguuuccuuugcaucuuguuuguugucuuucucccccgcuagaauagaaacuacaggagaauaaggauuccccagagcccagaacagugccuggcacccagcagaugccgaguccauguugaccaggugauggaagaccaggcagcccagguggaaggaggugggaagacugguuaggacgugcacaauugauuaguuugggcugaauuaaggugguggcagagaggauggcgagaaguagagaaugugagagaaauaaaggaaagaaacaugcuaggcuaguauugggaugucggggagggagugagcaaggggugacuccuggguuuuugggugggauuauccacaggggucaggaauguuaucagagagguagguuggggaaaacagaaagaacggccauuuguccugucugggaccuacuggcuugcccaagagaaacgugggucaagcugcccuguaggccguuagauggauggccuggauccaagaagacaaacagaggggcagccaucccugcacccuaguaggugggagagcgagcccuggcugggaagaagcccucagggagcgugggcagggagaagagaguagucaggagagagccggccauggggacaugacagagaauuuuggaaggagaagcuuggagacugaggagcaagcaggggagugggagggaggggcagaaucgcacugcccagagccagagggcuucgccuggggaaggggccaucaauggggacacaggggcugggaguccucaaguggaaugaagacaaucaggccgugggguccacagggaugugcuguggucucggcaggagccaagcuggucaguguguucauggcagguggcugugggaggccgcccuauccugcugccccauggccgucccugagcauuccaacaggagggcauccugugaguggcuccuccaagccaggaacugaucuuucccauaucugcauccuucccuaaauacguauugcuguguauauaguaaaugcucaauaaacacugaacggaacuguacuuccugugaugcuccuuaaaacacaccaccugugaccucaggacggugccugcgaacuccucaaaacacaccaccugugaccgcaggacggugccugcgaacuccucaaaacacgccaccugugaccacgggacggugccugcgaacuccucaaaacaugccaccugugaccgcgggacggugccugugaacuccccgacaccgcggaguccccggagccuaaccugcgcggcuucuucacugcgcuucucacaacaccuagggcagaaccccgugcacaacaaacccucaggaggcuucugguauuuucugggggucaguuuugccuucagugaggccugacggcugggaucaugcccaggaccaugcccuggggacuaagccuacaagauauggagcccugcauugaacaguguuccucaaaugcucaugucuacagggaaccucagaaugggacuugauuuggaaauggagucuuuguaauuaguaaauuacaaauguaauuaguaauucauuaagacggguucacaccggaugggguuggccuuaauccaaugacugguguccuuaaaagaaaguagggacacagacacacgcagagggaggacagugcaggcagagacugggguucuguugccacaagccauggauccauaacgaugaucagcagccaccagagcugcaaguggccagagagggucccucccuagcgccuuuggugggggcacggcucucugggaccuugaacucuggcuuccagucuccacagccgugagagcacaucucugugugaagccagccaguuggugggcauuugucuggcagucacaggaacagcuggcugaucuugaccccuggagggucugagcugccauagucaugcacacucuggaaggagccaucuggcccgcagguggcagggaagccaauccugggagaggagccugcaucugcccgaguccuggggcguccuccacagagucaacuuugcuuccugccccaacggccaggacaggguggcaaaggcugccccucggccuuugcugagaggcaagcuuccuccuaaaggccauuucuccgcagggcaccauuugccacugcuccaaggaggccggaugggacccagcuccaaggugacccacuccuugcuacacagaggagcuccacacaggucugcuugguguggcuccagcugcaaauggcaggaagucacugucccaggaggaucugaggaccagaccucuugguccuggcugaggagcacagcuggcuccuuaggagccccaauggcuaagaugcuccccaaacuggaugcugaugcgacucccacccacugcggugcugaggaaagcaggccuggggagcacaugcacccaagcugacagacacccaccgcaauguauaaugacggaggccccacagacagcgagagacggguuacgaggagggcccugugcuuuggagcauggcacuggcugggcucggagaggacgugacuccugccacucagccucaggucccgagugcaagaccggcucacgccagcugcuucugucaccuguuacugcuaugcacagaaguacccaggggcccaugcgcuaaccagcuugugcuggccccaguccccacuccagguggaugccagaaagcucucgguggggugggcguccuuucuuccuuugggugaccccugggucagugcuucuccagcuccccuaaagagcucccggaggugggagaggguaggugggggcuuccagucuuucacuauggguguaauucaaaguagcucuuugaagucaagaccauucacccauacugucuaaucugaaaaauucuugugaauuuuguauucugcuccacaauacaaacuguauugguuuuaguaaagcaaaggcauuuuacauuauuuagcaaggaaauaauuuuugcuccucugucuuccauuaucugggacaagugaugccuuuggaauguguucucaguguacauuguauguucuuuuuuuuuuuuuuuuuugagacagagucucgcucugucacccaggcuggaggcuggagugcaguggcacaaucucagcuugcugcaagcuccgccucccggguucaagccauucuccugccucagccucccgaguagcugggacaacaggcgcucaccaccacgcccggcuaauuuuguuuuuguauuuuuaguagaggcgggguuucaccguguuaaccaggaugggcucgaucuccugaccuugugauccgccugccucggccucccaaagugcugggaucacaggcgugagccaccgcacccagccaacucuguguauguucucuuacagcaucccaugucaugcgauguguucaugggccagcugaggguugcucggaggugggcuggguggaucugagggagggagccagccuaggagcggccggcccaggcccacucagcagaaagcccuggaguguugccauuggaggaagaagcacccagaggccucccagggaccagugucccagcuagaauggccuuucccacugucccuggaauguaccccuggacucugggacagugugugaucucccagcucugguggguggaggcugguacuagaaucagcccacaaggaaaggccagcaggaccacagccacaugccagggacaggcccucucacaccuaagguggcagcuccgaagugggggcagagcuaggggcugccccagagacacaucuuccaucuguuagcacagagagcguggacggaucagaaggccaaaccaagaggccuuuccuucucuccacuugcuuagacaggagcgaggcucucagucuucccagacaccuaccccagggccaggcugccccagaagucacaggauaaccccgucugucucuggccagcugcaggggcaagcugucugggcucacccaccuuacacugaggcuugcccaggaagcaggcaacuggauaaugaaguuugagcuuuuaguccaugcuccccgcucugccugagaugacaggguccccccucaccccugaggccagaagggggccugcccaggagaccagccaagcccaggggagcugcacgcaggucucacuccaauccucucacccaggcaaggaggcucaguugccugagaagcacugaaaauagagucuaagucuaagcggcuuagugggguuccaagaagggccggcagguggggguggggacaggguacccuaaaucuucucaacuuggccuugggggagaaucagaugcuguaagacaagaaagaggcacacaaaaauuccgcucaccuucucuucuagggacccaggucacuuaaaggugucccaguguccuuggccagaagagggcccgccccauccccucagcuccagggcugcaguguugaacugccuggguuuauucucuuuguaaacacaggcacaggcgaggccaaaucuacacagacagcauccucuugaaguucagcacggcccuggcuguuguauccauaggaccuaucacagguauaagugacauuucccagagauccuccccagugggucuccaggguaaaccccauugccugccuaccucuagccuggaagaggucccccuugcaucuuuguaugaagagcuggccugcucagaccucccugggguccugugcaaauggccuggggucaggucaggacagaggaaauuuguucugaauccgcaccuuuguggguggaggagaaauggugaaaacggcaguucccgaagacccuggguuaaaggcagccgcucauucccucuccugccacccuugaugcccccucuucccgggcuaacccugcucaggcuucaggucucaccaagggggucguuuccucugugaaaccuuccuuaccacuaguuggauucagcuuuuugacagucccuccugcacucauucacgugugccugcauucauaucacaaauauguacugcagcccaccacgugccaacccugggcuaagugauggggguccagcagacagggccuuugacccuggagcucacaguggggcgcaggggaagggaggggaagaccccuaggucugggggaggcgcugcagcuccgggauccagaaggcugcgauuccuccucccaccuucccccaucuccacgcccggucucucccaggauggcugcgccccagcugagauuuuggggacgucgggucccugccccccggccccaacguggggacgaucgcccuccgcagggcggggcugcgcaaacaaaagcuacgccgcggggacaaaggcugcgccgcggggacaaagacuucgccgcagcagcugcugcugcugcugcugcuggcgcgcgcgcgcgcgcgcguguucucugcgccccggacccacgcccccccccggccuuuagccaagcaaacaaauucauguuuuagaucaaaugagggcagacagucucuuccccgcccucaaacauuuucccccgcgcauggcagaggggacaaagggcgcaucccacaugcagcagaggccaccgaacgagggagccagggcucgccgcccaccgaaggccugugguccccgccgcacggugcggcgcacucggaggcggguggccgggcucaggccuuccuagucccgcgguccucgcagucccugcuggggccccagaccccgcggggcgcggcgccgccagcaguuccgcgaagggccccgcauugcggcugcgcgucggcgggagggcgcgcgcgugggagagagugugugcacgcgcgccgccggcagccgugccccaguuugcuccgcgcugcaguccccuggcgcccaccccuuccccagcccuccuccccucuccgcggcgaacccgucuccacggccuggccagcgcggagggagaaucggcccagcgcccgcggggacgggaggggcugagccgagaagcugcggagaccgaggggaggggccgggagggacaggcggggaacggaaggcucaccaccgcccggccacugcagcauuggcccggacgcaaaguucauggccaggccccguggcuggccagaggcccgggacccccgcgcucccgacuagcuguucccgcggcccccuuugcgcugcgacugcggcgcugcuuccccuccccucccuuaguauuuaucaagcuggugaaaggcugggaaggcugggcccuugggugggugagugccuuguauucauuuagggggaaaaagaauagccagggaagacccgcuucuccccagccagguggggucuggcaguuccucugucccugccucccacucauuccuugaaaggacaacuggcccagaccaaaggaaagcguccuucagggcccugaucugcucucugcagggccccugggccgagguggaccccaggcugguccccucugguucagcagggcgcucugagcuggggguccaagcugcggagcuacuguuccccuagcugugcccuggcuggugguaacagaggcgaugcugcuggacgcccaggccuugaugucaucgccgccccaauuccugucacccuccuguguauccugcaggugcaggggugcuuauuucaacuuggaggcccacagaguucagagcucaaaguucugggggggggggcagcuagggagcaggugcccagcuuggcggcaggcccaucucgaggggccugggguggccgaggucccggggugugucugucaugaagcaguuggguggcuccccuuccccccgguuucuauggcagcauccucccgugccguagcuucugggguacagcuggcucucuggguuuccagggggccugcagauguguccugagcucuggggcacugccugacugugacuuugcucucugaaaaggcuccaucugccaggcaggguccuacaguggucccagcauccuuggguucauucuagugaggccggccaagucacucagggagagccagagcucuggagaguuccugacuccauuccccauuuguucugcaaaacuaaaaccagauuuccuaaacgggagccccuggucacccugcccuucuuuguuacauccuguggguggucaucacagcucugccuggcuccggccucagccagagaugcugccaagggcagcucggugccccagggcagcccaugcuaggguuugaagacccaaagccaccccagggaauugucuccugaggguucaccagccagggcagcugucggcacccucucucucggcuggggcagggacugggauaaggcugagguuuacacacugggugguucaggaaaugaacuauguacccaagcccagaaauccuccagcagccaacagcaaggggcagucugagaggugagacccagaaggccagcugugggugcggggugcgugaggggguguugcuuggagaacccaccccugcaaggggcucaggcucagcuuagcccagaccucaacauccugggcuagcaaggucuccagcaagguaccccauggagugucaccucugugggcucaccugauacugagguuauggacaggcaucccuccuaccgcauccccaguguacugggcucagccccccaggccuuggcuagcucugggccuccugacgugugcccaggugggaaauggcagccucuggcucuggcguccccagccugccuuuggcagcucuucucugcagagccccugguaccccaaggggaaccaccaacacucaccgacccccauggccaaggcuggcagcucuuggagucccugccucuccuugaccaccagguccugccugcucccuugaagcccacuggggucccugacacucuacccucugccacagucgugauccugggcuugccacagacgccguacaggccagagguggaauuaaaaucagccaagaagcuggaguugaggguauuugagggcuuccaggagaagauuuggcugguuagccccaaaaggcagaagcaagcccccaaauucgaaagaagcccaggccugagcugccuccccguccucuuucucgagaggcuuggggcuuggcgauggccucugggaacccuuuuugcuuccaggagcccgcggaaacaggccuggaggggcacagcgggugcuuggaccuugcugccugggguccuucgccagagccucuuagcugcccugggcuugcuuggccacucagacagcccagcaggcgugccagccacaggcccacacucacauacuuuucagucugucccagggagagacugagauugaggguggggccagccaguguccagacacaaauggcugacagcauaggcacucagccuggcgguggagacccagucggccuuccuuugcucacauuggcaccacuuccugccccuuucugggugcuuacucuucuuucacaccuugugcaagaguccccaagcaucccucucccuuggugccuggcaagacgacccaagcacuguucuuaccguccaacgacagccagucgugcugggaggaagggagcgugggcagagcccgggcuuuguacucaaacaccaccgaguuggagaugaucugguuguugaaggcaacuuguagggucacaagaccagugucaugggcugaaagcgagagaaaaagaccaggucaagggauggguggguaccuacagccuggugaaccacacagggccuggaauguccccuccccacuacccuucauugguuaauguccagcucuccuuaaugguagccuaugccugcucauucgaggcccaaacacaaugcugcuucuaggaaccuucuugguucgcccagacucagccagcuguccugugaucacucccagguacguaacugccccuuugcuuuguccuccgagugagggcaggagcugggugcucaguacagacuggcugaacaagugaaugagugaauggcccccaucccugccucauggcuggcugacuuccccucuugucccauccuuccuggguggggcucggguacaaaauuugcuuuggauuuauuugcgcuuauuuuguuucaccuauuccuacaagcuuguccugacucgaugaacagccagccaucccuuguauuuuuaguucuucugcuuccccgaugaaggagcuucagaugugccucuguuacccuggccccagcucagccccaguggguguugagcuggggaugcugaugugaagguugcaccucccuccaguggcccgacaguaagcucuggaagacagggcccuggcaggucucguuaacugcuguggccccaacacagggcucaacaaauaacucuauuuguggaauaaacgagguauguucucacugugaguaagacgaagccagccugcgguggagaccagcuucagcucuuggguugagguugccucuccauggcucauguuggcaucuugggggcuggccuguggcccacagagguggcccgugggcaauggugggugugcacacugccccgccaggccucaucccuggcagaugucuggguucugugccuucugcccugcuuuuccggaauaccagauacugauacccagggccuccccaguacagacuuccagggaggacaugcguggggaucacauuacugugugggcccuugguuuucagaagcuuauagagucgaggaagccguccaagccagccgcucccuaggacaagcagagcuccaucuuuccuccgaggacucugaugcagaucccagucccgaugggaaaaccagcucauugaccgguggccgcuguccauccuggguggauguguuaaggcagcagccaucuugccauuguccccagggaaggccuucgggagucacuguccaaggggacccauggguuuuuccucuguguuuuccacccuggcugggaaccucagcuccaggccacaaccugaaccaaaggacuccacaguggaggucacauaggaccuccgaggugccugggcagggagccccggccaaguccagaaccugcuauggcucuguuggcaucccugggcgggucuccaagcuuguggucgcaugccugcccuggagauuggccuggcuugccaacaggaaggcagguggccagcaccuacacccaucggagcccgcucagggcugcuccucuuagcagccuccuugggccagccuuggagaacucacggcuucucugggacaaugugucccagcuuggggucgggggggauggccucuucaacugcugcugcucuuccaccaucuucuggcaagugcacaaccugcagcaacgcuggaaugguggcagacuccaaggcauuucuuccuucccagagagacggagcagaggggaccuacuguggucuccggggucccagcccagcagcccugcuccugcaguuccaucacccaggaagcuuccuggacucgcucuucccuuccccgcucaugcaguccaucagcaaguccuggguccauccauugcucuccaucuccacugcagaugcuguaguccaugccgccaucauuuguugccuagaccccuucauuagccuccugucgaaggcaacaucagcgcaccugagacccgcuccugcugggagggugucgggaggcccauaauccagcaccgggggccacagcccagcaccccuacaggaaaccagggggaguguggugcccaagggagcccuucuccuuacaucuggaaagaucagcccucugccuucuuccuauggucucccugcuucuguucuuccucccuacaaccuagaaucaucuuucccacacacccagaaucaucuuuaaagacaucauuuagaucaagccacucccugcuuaaagcuaacagccucccauugcaaguaacaucaaaccaaacuccuuccuaugaugcagaaagauggacacgauuuauuuuaguuccugcuaucaucuccagucuuacuguauucagcuccccguaccccacucacuauccugcagccagugccuuucucaggcuuuagauucuccacguugccaaaccucuuucugccccagggccuuugcacuuccccuacccucuaccuggccuggaugcuucucccacuucccaugacuggcuccaucccaucauccaggucccagucugcgagaggccucugcucauccauguuccagaaggaaccuccuucuucccaggugaccuuauuaccauauucuacugcugggauacaguuuucaccaguuaucuugguuauuucuuuuucuccuuguuuguuuucugucucccugcaguagaacauuagcucaugagagcugggacuggcucugucuuaaucuucaugccuagugccaaggucagugcccaggauguuauggcggcucaguaacuauuuguugaaugaauuguuuugaaacccaauucuacaccucauuuguuguuuuuguuuguuuguuugcuuuuuguuuuuuugagacagagucuuacucugucuuccaggcuggagugcaguggcgugaucuuggcucacugcaaccuccaccugccagguucaggugauucuccugccucagccucccuacuagcuuacaggugccugccaccacgcccagcuaauuuuuguauuuuuaguagagacgggguuucaccaugucggucaggcuggucucgaacuccugacuucaagugauccgcccgccucggccucccaacaugcuaggauuacaggcaugagccacugugccuggcuuucauuuugaauuucaucuuuuguguucuggugaccucuuaggaauccagaguagggcucucuggccaguagagucuucuugguggauuccccuaucuucucccaagccugagucgccucuuuuccccagcaccuccucucacucacugcugcucacugcccucagcucacugcccuaacuuggugggcucccuccugccccugaagcacccuggagucuugcagaagacacacucagugccugcgugucuccugccaccugugacggugugggagcugccagggcaggacccugcucaucuguuuugcuugggcagguguguugggagacgggugggcauuggccaacuguguugccagugcccccuccucccgugucguuccuggcuugugcucauaagccucugagccucucuuuuuggugaggccaguuugauucugacuuccaaguguucauccuucgagcucagccucagauuccucuggggagacccaaagaugagguccccaagcagccagcgucaucuccggagcagugauucauuugcgcacugcacuccucccuggaccgagagccccuuacgaucaggggcccggugagaagcugggucuuauuguuugcuccauuccaggccccuacucugugcagagcaagcaggggcuacucaaaaguuauuuggcaaaugaagaaaugaaugaaugaauuaauacauccagugcuguuuuacagagcaauguguuccaauuugggccucaaagcagagauguccaaaggaggcccccuuuguggaguuagcugaagacagagugcuggcucuagcaggggagucccagcucucagugugccuugagccuuguggcuccuggucccuugguccgagacacauuauggcucauauaaugagccugaacagcuaggagggugaguggccugggcagagacucuaccugccaucucuggggacccagaaaugccccaggaccaggagaacugccuguugagacccaaacugcccugguacccucuccgaacucccccuugggaaaggaagagcgaaggccuccuuaaugggaacccuucaggaauggagcacugggccaggugcuucacacaccuccucucacucacugcucucgcccugcuggcaggcaguuuucagagcuguagaaacugaggcccagagaggucaggcacugagcuccagcaacagggaugguuucuggcugaucugggauggacccgaguguggcugacuccagccccggggccacacaaagcccagccuuucuuuuucuguagaggggucagauaacugagagcagaccuaagcagcccugcccugguccuuagccaggcgagaaccagguacaggaaguggcaucuauuuauaggccaggcaagucgcauucuggcagcagaugaugggugcacuguuuaauuccacagugcccuccccgccacucccgccgggccggggucccaucagcugcacacagcccugagcugugauaggcagacccggccuggcugccaccccggcuggcugugcuccaggccgagcagggcagcuaggugggccuucuggagccaggcaggugggggcugggaggggagggcugggccagcaggggguggggugggcaccuugggcugcugcacuggcuccugggaacuuuuuggggaagauggugcuggguucaagcagaggcggagugugcagccagcuguggagcagggguuuucugcucugguggcugcaagaagagccugagagagauggggcacaguggcucaccccuguaaucccagcacuuugggaggccaaggugggcggaucacuugcgucaggaguucgagaccagccuggccaacauggugaaacuccaucucuacuaaaaguacaaaaauuagcugggugugguggcacaagccuauagucccagguaccagggaggcugaggcaagagaaucacuugaacccaggaaacagagguugcagugagccgagauugcaucacugcacuccagccuggcaaaagagugagacuccaucucaaaacaaaaaaaccaacaaaaagaagagccugagagagaaggagaaaaggagaaauggguggugggacucagcuggcccagccugggggcaugguucaagggugggguggugguggcagacagcuggggcagccaaggcucaggcuggaccaccuuggguggaaccuagaaacacccuggggccugccuagcacuggccagcucuguacucccaccccguaccuuuccuccucacccccagucuucuacacugagcaucuucucuccuuucuaggcucccugacguuagaggacaggggugggucucccugccguuccgcaccccugcauccuuaccccccuccuguuuauggucagggcucacuggacaggccauccugagggcugguggugaugagauggggcagccaagggaguccugccagcaacagcccaggagcagaagacaugagcucuagaaacaggcuucagaugccuggagacucauucauuccgucacaaucuccaucccccucugugacauguccggcacucugccagccccggggauacuauggugaucaagaagauagucccugaccccaugggacaggcgaguggggaagcagugauggccagagaucaaugacaaguugaccagacagggacaccgugcuaagcagauaaugcuggagccuggggaagggcuucagaggcacagggacagcacagaggcugucccaaggguuucuugggggauuuuugagccccugaaauuggaagcaaauuauaugcaccuuuucugggcacaggguagauggcucuguuuuacauucucaaaggcauuugugcugauuauuguuagauugaccucccaucaccaccccaucucccuccgccccugccaggcuuucuccagccuucugcccccugcccagggcccucgggaggauggagccugugugugggcugcauugccugggcucuccuggcuucugguuggcuugggccaugggaggcacgggcaggugcagagaggccgccuugcugcagagguggucucuggccccagcucuuaccagcucuagucacccuuugggcugagggugguggccgcuucccacuguggccaguccuggauacaucgccugggccuggcuuauuccugcccuaaaucgugcucucaucacauucgcuucaaaaucccagucaagcgugccugugucccuguccuauauuaggucccugagccaaaggaggugacguucuaauagacuaucggggauccgcuucuucacagccgaggaaacugaggccuagaguaaggacaugaccugcucaaggucaccccaaggccaacuccgaguccagugcuccucaggccaucacacucaccuugggggccuggggggcggcuuucucaccugggcaguagcagcgcagcaccccaggcugaaucagggaugcaggcacugagaucuggucaaacaggcagcuguaguuauugcuggcuucuugccacgggccugugaugaggaccuucacuccucccugcagagaacagagaggggaacagaguuggagugugagccacugugggaggcagcauggggaagccccccugaggcuucacugcucagaugggggucuguaccccucgccccaugcagauucccaggcccucacuccagggauugcagugagccccgacuucugagaaccacagcuccaggacuacagcaagaggagagcccaaggcgcuccuuccccagccccucaggaagccccaggaccggcagcuccaaccccugaccuucucccuuuuguguaacucgcagauccaggcaggagggagugcagaguuuugcaaacccuuucagccuacgaugccccugagaaauggccuggaaggaagccgagggcagggaggggacuugcuccgucauucacuuguggacagacugagggaacuccaaguuuugaaaacaggccugagcaucuccgugucagcccagggaccagaaguucuuguagggaguugaggagagacccaggauccccaggcuguggggauggcaaggugaggggcuggagcaggacgggcugaagagcccgaugaagaaacagaggagcuaaaggagcuaagugaaggagacgcucagagacugcccugggagcugaguuuggggcucagagcuuggggcugggaguggaacggggcugagcaucugcccccucccccaacccugugcuaucaaagguccuugagucugugucacugccuacacagcuagccuggggucccacaagcaagcagugaccaugcagccuggcugggagcagccucgaaugaccuuccucagcuccaggggggaggaccccacccucaggaaccucccagggcgcccaggggcaggagagcaucggaagggcugggguacucccugacuccccguuccgaccagccuggggcugcugcagaaaguggaggaggaggguggccucauguccggggcccgggcaguccugcuucauggccauuguccugcuuagugaugagagagggaggugcgagguggacggcaccuuggagguccccuacuuacggcuuagccgaggagaggggcuggucacugaguagagggaggcucucccuggggaugaggaagguaggggugccggccucccggacucuccuggcuaaccuuggguggacccaccccagaggcgccauccaccccacccccaaaccaguaaacaccuuucccugcaguggggcggagagcugcuaggucagggcggagagcaccaccuaguguccaggcuggagaaggccgccaggcaggcuggagccugggaggugggggugaggagcugcugugagcccaccuuccccacugcuccaggccagagaagugauucccuaccccccaacuccgugccaaccagaugcucccuacuggucagucacucauucuugcuuggccucuccugggcccuggcccaccccugcccuggaggaagccccggccucuacaaggagccugcccuaggcgccccacaauguuccuggaacccaggccuggcccagggcaucugcagcaggagugaguguuuccagggaugagguggaaguagcuccucccauugcccagccaggaaaagagacuucuuccacggaaggggcucucccaggcuggaaagcauauuccaccccugcucuugcaugagccuggcucuggccugggaggucacuuuacugcuacggcagcagagagagcucaggaccgagaaacaaaagcaggaggccugcuccugcgccucaguagcuguguguccucaggcaaguggcccagccucucuggguggcaucuccuugcuaggggcccuucugaccacagcaucccuuguucugaugcccagggauauuugcagcuccguggaaguggcggggcauuggggggagugggugccuggcugagaagagugccggcggacagguggagccugacuuugggaugucuggaagcaccagaaggccagcucagggcaccaucccccaggauccugggaaguggaagagcagugacuucaaaaggccacagacaguuaccaugugagaaaaagggaaaaaauaauaaccgcaaucaacagcugcuagcaugaggcuggggcugcugccgggaacaaagaacugcagaaauuacuggagaacaucaggaccuucuccauggaaaccgccgcaggacagcucagcauccauccauucaagggaugguucccauggcaacagcccgccuggcugcgcugaacugguggugacgcgcgugccugaggcuguaauugcaggcucuucugcugcugcagcaggagugucaguggugggagaugacgcaggaggguuuuggggguggggagggggcacgaaaugccaucugaggucucugaguccugagauaaagggcccaugucugaugcagccagggcagaugcuggggcauagggggacgccucuggggugugugguggguguguguguguguguguguguguguguguguguguguguguguuggugaccagcugcagcuggaggugaagggguggacagagauaggagaaaugggagcagccugugggagggagggccacucagagaagagacagcaggauggccccggccaucgcauuccugcuagguagaugcauugagguuuagagcugggugggggugcugaguaaccguuuagccaaaccccauuuugcagacugggaaguagggcccaggccgacgagccugccuguagagcccucccugagcuuggcagaaccuggccagauuggacuccugaugcagucagugcacagacaggcuggcagggaggggacaggacgagggccagacaaagggagagaagugucaagagagaaggugcucucuccuguagaacccaggaugggggcaccccugcugugguguggagacaguggccuggguaggagaggacagcaaggaggaaggggcccuucacaaccucugaggccucacuguguggccagguggggccccaaagggccuagcuggguggcuuaugcgcauuuuccaaaucaagcugaauuucagcagcuuuugguuguggguaacuggaagcauugagggcuucuggaaaagcaaggcuggccgcucccucugcugggcugccaggcugccaggcugccauugcguuccuguuccugggccgcccucguguggcgagcugcugaacugcaggcccagaaaggacagaaggagucaggccugcuaaugucccacucgccaggacacccaggaggcuggggugugggucugcacccagcccagggccugucugacaggccaggaccucgggaaaagaggggacccuccucccaccuccuggcuucugcaagacauuaagggcuccagggcgccucuaagugucccgaggaccaaaucucccagguccuaggacugggagugccucgaggccacccccucucagccauuuacacguaaggaaacugagccccagagagucaggucucaaggagccaggaccagaagacagcucugaccguccccccgcacccugauccuggccuccucccugucccuuugcaucgcuuucuuaagcccagggucagggggcacggggaagaugcccaacuggccuucaugggguggggugggggguguggugggcacuccgaaggugccauugagcucagagucacugauaagauuaggaggucagggccgggugugguggcucaugcccgaaaucccagcacuuugggaggcugaggugggcggaucacuggaggccaggaggucaagaccagccugggaaacauggugaaaccccgucucuacuaaaaauacaaaaauuagcuggaugcagcagggugugucuguaaccccagcuacucggcaggcugaggcaggagaaucgcuugaaccugggaggcggagguuucagugagccgagauggcgccauugcacuccagccugggcaaaaagagugaaauuccuucucaaaaacaaaacaaaacaaaacaaaacaaaacaacaacagcaggggggucagaaacacggucacaccaaccuauaccaagaggaagcccagucugauccuuccgggcucuuccuaucggggaugggagagcugggggugucuguacacagauuuucuuagcuuugccagcggggaagaagggugaggaaguaugagcccccuucuuugguguucuccagccgagugggccgugggcagccaccucccaggcaguguccaaucagggcccguggugcaugugcuggucccugagcacccagaugggcuggguagaggucaggaugcacgugcuugucugcacuagguuauuuagggaaagccugggccacucuguccccuuccugugcuauucugcucuacagaaaaagcagagauuccucuacugcuugugucccucaggcaagaugcuuuggucuuuggaguagugguucucaaagucagauccccgggagcugaggcggccugggggcugggggagggugcacguuggaauccugcguccuaugaccuguguggaauuuugcagaaggccagguuuacuuaagaaggaucuucaggaugacucuucagaagcugugcccuguucaguuuugagagagauuuuugguuuuugguuuuguuuggcuuagagaaguagggugaaggcaguggauguagacgaucuaugauggugacuuuuucuuucuuuuuuuuuuuuuuaagacaguuucauucuugucgcccaggcuggagugcaguggcgugaucucgacucacugcaaccuccaccucccggguucaagcgauucuccugccucagccucccgaguagcugggauuacaggcacgugccacuacgcccaguuaauuuuuuguauuuuuaguagagacgggguuucaccauguuggccaggcuagucucgaacuccugaccucaggugauccacccaccuuggccucccaaagugcugggauuaugggcaugagccacugagcccggccaauggugacuuuugaauuuuuuuaagcaacccugggaccccuuuucaaaaaaaaagcaaagcaaaacauagauggacucaacacauaaauugagaaacggcagacgacucuggcuggagcugggggagcauuuugcuuccaaggauacccugacuuucucucuuuuuuuuugagacaggguuucacucugucauccggacuggagugcagugguacaaccacagcucacugcagccucaaccucuugggcucaagugcuccuccggacucagccuccagaauagcugggaccauaggcaggccccaccacaccuggcuuauuuuuuuaauauuuuguugaaaccaguucucacuacguugcccagguugguuuggaacuccuuggcucagaugauccuccugccucggccucccaaaguucugggauuacagguuugagccauggcacccggccaaagacccccugacuuuaaagcuacuugccccagugaaguuugagaaccacugcgugaaagacggagguguucaagcgccguggggacacaaggaggggaaagcaucaucuuugugguccagagcuuccucugaagggcagccacaggcaucccuuagcugcaggguggcgcaggggcuggcgaggugggugggaggggaggugacaggugguggcagcggcggcagcuuaccucuggguaagaccacucuggggaguagucggucaccaugaacacccguccgcucugcugcagcaugccuagggugcccugggccgaggcggccgagaccaccucggcgacgugcauguaggccauggugcuggccccgcccuccgagcugcucagcugcaggcuacccugcugggggcuacagcaggggaggcacaucucugccugggugaagggggcccgcgccccguccucugacugugagagcgccgugcugucccccgacaccagcuggugcccauagauggugcugcugccccccuccacggagaugaagucguugaucaggucggagaacugguugcugaaggagaugucaaagugguccaggcugagcuccauguuggaggcguugccgaggcugggcugggccacgggguagagucccugcaccacguugcccgggaggauggggacgccgccggcgcuucggauuaccccguuggucuccggcugcagguagugcucagagcugcaagccugcagcuccccagacuugagcaggaccucgcucccuuccgccgccugcgaggucuccauggugaccuccccuucugccgucauggccuggaaguuggccuggaacugcaugagguggagggaggaaguggacucgauccgcgucuccacgugaccgcugcaggagcugguuugggacgaggccuccguuuucaccgugggcaucacgaaggugcccccagagucacucaggcugcuguggguguucugcucgacggggagggguuugcuggcguccugcaggaagaagcucggggagggggucugguggaugugggggcuguggcccgucuggcugaagcuggacguguaguccuuguuggagucgauggcgcugaaguccaucugcuccaggguggugcugggacucaggccgccgcccgacggcaggaggcuggagccggcggucagggugagggagcuggcugccacagccgccgcggaggaggaguacgcuucuuuggccaucugcugcucgaaggagguguccucggucuugaucuccuuggugaggacggugguaaagcugaagcuccgcuccccggguggcgagugccggauguuggagcugaccaucucggcuuucaggccuccacccccguacgucuggcccugcuuuggguuauuaaggaaacagucggggucaaaguucauggugguuucuggaaucuuccggccaccgucgagggugguggagaggaccagcucuucggacacguuggugggcagcauggacaggcucuccgagcugcccguggugggaaaggcgaacuuguggccaucagagcucacggccaggacgaggcccugagaggcgucaggugagaggagguggugguuggggccagcggugggggacaugguguacacggccucauuggugaccucugacaugaacaccguggcgcucugggacaagcuccccaucacagaggccaccgccauaccggacacaccugugaccaccgggcuguccaccauguccgggucgcuguugagcccgcugcugauggacacaggggagcucuggguggugucggggacuuccaccugguugguggaggagaccucggugcugcucuggugcaggagcacgggcuuggccaccuugccguuccucuucucacggcuggagcccuugcuguggcugugcucgugcuugcccuccgacacgucauugugcugcaccuccgaguggcucccguaccccccuguccguggcuccaccuugggcgagaugaugcgguguuuggcgcuguuacacuugugaugcacgcugccgccagcuccugcggagaucggaacacaacacgcgcacgcacacgcaggcacacaugugcacacacacaugcacacacaaaagagagucagagcuaggaccgugguggaccugccccacagcggcuggggucccuggcaaaguccaggcccgguaccccaggcaggccacagacucucagcccuuggacacguaccccaagcccgggggccgucccacgccccuuugacccuccuccaaagaucagaggggcuuuggccuugaugcucuuuucaaauaggaagcauaugggaaguugggaaggagaagguggagagaaugucaacacccaggaaaguccccuccgccaucagagacagauaccacucaucuggaagggcuuuugcuggcaagaggggaucagccuggugagaguggcuacguucguauccugccccaccuccccuccccaacuucccacagcugcucaggccaugccccagugaggagccaccccuggggccuggcaaccagaggucaauggggaggugauggaaaugcagucucgggaccagcucucaggccccaggaccaaagaggguucucgacccugcuccagaggcggaaagguaccuaagcccaggccuacccucagcucucugggguacaaaaauccuucuagguccuaaguagggacagagcccuugcuccucauuucagacguacaagccucaggagccgaacguuucugagcuuggcaaagccucccuggcagcuccuccagccccggcagccaggacggcuuuucucucccucccauuggauauuuucaccauuuucauuucaucugauaagggucacuuuacuuuugaugaaagggcaaauucucccugauccuguuauggccucaccaccaagacuccucaaugcaccaagacugcguagagaagugacacgacccucuaaugggacuaucuaauuaagucagccuggggaguggagaacacacauuucaaagagcaaauaccauuaucagaaaaacagacacauuaggaaggagagcgcgggacgcuucauguucuuggaggagacagagguuaaagaaagagguugcgccugcguggugucacugacgcagggcacgucucccucaagaccccagugcccucuggcagaggaugcccaagagugugggccugaacagagaggccccgagccccagagcuccucgcuuccccaacucugcugcccccaguucuugccccacggaggaagcugucccucuggacacugcucccuccugcccagagcggacugccagccaguugcagggcaggacgaggcggaaggccugccuugugucugugcugggugcgguggugucgcccagucccugacugucccccuccucccucacuagaugucauggcuacucccacagaggacagccaugacggcugccugguagggccccucuguccccguggcgcccgccugccccgggagccccggcucacccaggcugccggugcagaggcaguuguggguccgcggcuggggcuuggucugguggcugucgaggaucugcugcaccagcuguuccaccgagaagccugagcugcuguucccauugcugcagguccacuugaugccauggacugugaagagagaggcaggggggcugucagagcccgugggugcagaggggaccuggguggggccaagggguaggacccaggcccucccugagggcagcccucucacugcuggggagcuggcuccuggggcgaauugaugaguaggggaggaggaggggaagggaggccaggcugcccccgccagacccccugcucccaucggggguucugagcucuuuagcucccccucacuauggugcagcccagggaguggaccgcauagaguucugcuuuuguuucccuaaagucagagugcacgaggcggcucuuccaggggugcuggaauggaagagaaagggaacaaggacagaaggagaguggacaggaggcugagggacuucccagccugugagcuucuuguggagacucaggauagaggugguggaccaacaagcaccgagccgggaggaccaaugccucucccaggaguguguggggagguggccccacccugggggguaagacucuggcuuccugcccucaccagacuucuuugccccaaagggagugcagaugcaggagaggccaggggagauggggacgggacugaagggcccacguggccuggacaucagguagcucagugcccagugcugacugauggcagccaucugaacagccaccccgggagcugggcucaaccuuccucccugcacuuuugcaguuccuggaguugggauugggguuuccccaccugccuggcaggaugggggcuggaagucuaaaccgacuuuuccagcagagcaguuuucucagcuggagcagacccggccaaggggucgcuaaguccugaguccggcacauggagcaauccagcugucucuaguggggccaggcucagaggcaguggauucgcagcuuuggggcuggagcuggugcuggggauccaggcgcggaggagccgggcacagggucgagauacggagaggucaguggcuuuaucgauacaagagcaauguccuuccuccuuuggcugaagcuccucucccaccagcuccagggggacagccgcuaacccucgcagcacuggccccaguucugugaagggcucuagaagguagggggacaaggagagcgucgacauggcagguaggagcuggcucgguucagacauggauuugaguccaaguuuuacuuauuuauuuuuuuugaaacaggugucacucuguugcucaggcuggagugcugugguauaaacacgacucacuguagacucggccucguggguucaagugauccucccgccucagccuccugaguagcugggacuauaggcaugugucacuacacuuggauauuuaaaaaaaaauuauuuguagaggccaggcgcaguggcucacaccuauaauccuaauacuuuggaaggccaaagugggcggaucaccugaggucaggaguuugagaccagccugaccaacauggugaaacccgucucuaccaaaaauacaaaauuagcugggcgugguggcacaugccuguaaucccagcuaccuggggggcugaggcaaaagaaucgucugggaggcagagguugcagugagccgagauugcaccauugcacuccagccuggggaaugagagcaaaacucugucucaaaacaaaacaaaacaaaauuauuuguagagacaaggaucucacuauguuacccaggcugguuuggaacucauggccucccaaagugcugauauuauagguguguaccuggucugagucuagguuuugaucuugcuguguggauuugggcaagucacuuagccucucugagccucaguuuccucacuuguaaagugggcauauaguaguuccugccuggagaacuggccaggagaaaacacgaucuacgugccuggcacuuugugcauacccaaaaaaaggguagcuguugucauaacaucacuagugaugauggugaugacaguaaugacugugacacccagcaggcagugcuggcccugccuggggccuggccgaugcuauggggacugggcuuguggcaggaagcuucuugcugugaaauccacagauggcucagccccggaacacugcggguagaucucugugguggccauucaucucaagccucuguuccuggguguagagcucucccuuuaauuauaacucugaugguuuuucuuuucuucuucuuuuuuuugagacagagucucgcucuguugcccaggcuggagugcaguggcacgaucucgguucacugcaaccucugccuccugaguucaagcgauucuucugccucagccuccugaauagcugggauuacaggcgccugccaccgggccuggcuaauuuuuguauuuuuaguagagaugggguuucaccauauuggccaggcuggucuugaacuccugaccuugugauccaccccccuuuggccucccaaagugcugggauuacaggcgugagccaccacgcccagccucugauaguuuuucaaaggaaaucacccaugugugaggcuugggaucuggcaggaauaccuucagggugcugcuuuccuucucugugugugcugucgccugacccggguguccgcucccuuuccuuccccucugcuucacucugaagaggcuccucugaggucugcagcacccucugccuccugcaucuucacuuauucucagggggccugggauucuggugggucacuaagggggauggguggggcugaguggcaccuguuugccaagccgccauguucagaacuugugaucggcgaacaugugauaggcgcaggcaggcagguggcagcauugacagcccacuuuucuucagguggacagugcuuucaucuugggcucccuggaggaauucuccagcaucccccuaagcaccuugucccugacagcuggagggaaggcccgggucaggggcuuuuuaaaccucaucauagcuaugggacccuuuucuuaaauaaaccucuaccaagaaauucaauacagaagacagauuacugcagaaaggaccugguggaggcaagaugaggggucacaggcucucuggccugucccuaugcccagggcacuccuuggcuuacagacauuuccagacucauuuuacagauaagaaaacagaggcucaggaggggaggugacagcccaaaucacauuccagaggccacagggcaggauuugagacucuccucuguaccgcugcacaggcaguggucuguuccagcuguggguccccuacucuggcuguacccaggcccuagauaggagauucugaugucauuggucugggguggugccagguauuuuuuuuagagcucugcagaggcuccucacgugccguuaggaugggagaacacgcagcucugucucacaugcuguuaggaugggagaacacgcagcucuguccuaagcuuaaacucagcagggaacugcaaguccaagagcagaaagcccugcagagcucaucacgggagccucucccugugggaacucggagcaggugccccuugccaagccaggccacauguucucugggaagaucccugcugaauuugaacuuggcugucuguggagaugagcuguuuucagggcagccccaccucuggcuucggccuucaggcuacaccccacuugagggucuugggucuuggcacagugaggcuuuugaauccccuggcuggcagagucuccuggcauuucagaucaggguccccucugcucugacaaccgccgaucaggccagguuucuccuccaguccugaugggggugcggcagccgcauucucucugccucuuguucuccuccuuauguugugaagguuauaaaaugaagacccagugaagggugacagauugcaagcagagaguuucuagaugcuuaaugcaaauuaccuacugucuuggcacauccaauaugcagauugucucccuccuugcucugguguuggggguggguggguggagaaaagccccuccucugagguggugaguuguuagcacugaauaucaaauaguaucaagacggcuuuuaacaugucaugcucugcuucccaacacggaaugaaucagugggaagggagauuucuauagggaaaaagcgcuuuaugaaaggaagguuaauagccacgcaugccggccgcccccucggccccuuccccuuuuuaaagcagcaaaagggaaaccgcguuaaaaguacacuugaucacgugaccucccaugacauguaaggucaugacaugucuuguaagggaggaggcacagaaagaggaauucccagaaagguaauguccugguggcucugggucacaucuguccccuccugcucacuguaccucaccgggcgguaccugacuccccguucucaggcagaauggccugagcugaaucccagacagagggacccucucugcagcuccccauaguuggagccuuggugguggucccuggucugcucaggugguggagagagaccuguaucccuaggaaggcugggucaggggaaguaccagagagaagaaagggcuggcauggggugggauaagccagaccccagcauggggcuccacaagacaggggcaggcaggauggucacacuggccacugggaagcaggaugcuggcuccucgaaagguguccuccuacagcuacccgagaagcccugcggcugccccgugaaacacaggccggggacugcauucucgcggacagggcugccugcagcgcggccugugugaggaucggcuugcagagccgaggcugggaguggccgucgcaggaacccagggcccacuccaaugcugaccuagcccucguacaagauguuuacccuaauuauggccccuggcaaggcagcagcgcuuccacuaauaugaauaaucaaaaugaaaucaaugacaacagcguguggcccaugcuuuggagagcaucuucugaugaacaauuuacccaagaggcggccaaccgcugggaaaagaguaauugagaucuagaagagagggcugggggaaggcgugggggcuucaccccacauggggcaggcugccagccgagagccucuuggguugcagcugcuccaucccaugcccuugggaagcggcggagagcuucagcuacacaggcuaagccugagccacgguagggccguccuauuuuccucugucaugaacugaauugugucccccaccaaauccauagguugaagcccuaaccaccaaugugacuguauuuggaaacagacuuuuaaggagguaauuacgguuaagugaggucacaugggugggacccuaucccagcaggacugguguccuuauaaguagaggaggagacaccaggagugccuaugccuagauagaugguuauaugaggaagcagugagaagguggcugucugcaacccaggaagagaggcccuaccagaaaccaaccccaauguccccuuaaucuuggacuuccagccugcagacugugagacgaucaauuucuguuguuuaagccgccagucuguggcacacugugagggcaguguuuuagucuucgucuuuuuugugcugcuacaacagaauaccacagacugggaaauucauaaagaacacaaguguauuggcuuauaguuuuggaggcugggaaguccaauaucaagcugccagugccuggugagggccuucuugcuaggucauugcaugguggaagggcgaagaaaaagaauccauucccagaaacccuaaguaaagcaguuuaaucccucccauggggccccaccuccagacacaguugcacugggaauucaauuucaacaugaguuucggaggaaaacauucaaaccacagcaggcuaaauaacacaccccgcaugggggcucaggccucccccauccucaggcucuguggcuaaagguccacaccaacccugcucuaugcacugcacacguguguguguacaggugcgcguguauagguguuuguacauauagguguguguauagguguggguguaucgguguauguguauauagauguguguauagguguguguguauagguguguaucagugugugugcauagguguguggguguguaguguguguauagguguguguauagguguguggguguguauagguguguguauagggguguuuguguguguagguggguguguuuguguguauaggugugcauaucaguguguauguguguggguguguacauagguguguguauguguguuguauagguguguguuuguauagguggguguguuuguguauagguauguguguauagguuguguauguggauagguguguguguauagguggguguauuugugugcauacguguguguguauagguggguguguuuguuuaaggguguguguauagguggguuuguguguauagguguguauaacgguguguguguauagguguguguguguauaacgguguguauaggugggucuguguguauagguguguguguauagguguguguguguauagauggguguguuuguguguauagggguguguguuuguguauagguguguguggguguguauagguguguguauagguggguuuguguguauagagguguguguauagguguguguauagguguguguguauagguggguguguguguauagguggguguguuuguauagguguguguauagguggguguguuuguguauauagggguguguguauagguguguguggguguguguauagguguguguguauagguggguguguuuguguguguauaggugugugcuuguguguguauagauggguguguuuguggguguauagauguauuuguguguauagauguguguguauagguggguauguguacagguggguguguucguguguauaggggugugugugguguguguggguguguguauagguguguggguauagguguguguuuagguggguguguuuguauauguguguguauagguguguggguguguguauagguggguguguuuguguguauagggguguuugugugcauggaguguguguauagguguguguguauaggugugugcuuguguguguauagauggguguguuuguguguauaggaguguguguguauagcuguguguauguauagguguguguguauaggugugugccgguguguguauagauggguguguuuguguguauaggaguguauguguguauagguguguguauguauagggguguguguguguacaguucaagggguucugacaucaggggcuuuccagaaugccucucuccucuaccacuuuauuuuuaauauauuuauuuauuuauuuuuugagacagggucucacucugucacccaggcuggagugcaguggugcaaucugagcucacugcaaccuccgacccuuggguucaagcaauucucaugccucagccuccugaguagcuggacuacaggugugcgccaccacgccuggcuaaguuuuguauuuuuaguagagacaggguuucagcaugguggucaggcuggucuugaacuccugaccucaagugauacacccaccucggccuccugaagugcagggauuacaggugugagccaccacgccuagcccuucuaccacuuuaaaugccacccuucuuuccagcacagcccagcucaagcccccgccucuggcucauucucaggcccuccccaaacccaccgaaucacagacucaggauggggcccagcaccuguguccuaaggggcccucgugggaauucaaaugcaugcuccaguuugagaacuauggguauagaaaucacaauagccuuccuggcugcucaugccugucccuaggagcuggaguuuggauccugagggcaggccuugccaagcuguucacugcucaucucccauccucagaacaaugccuggcacauaguagaugcuuaauaaaggcugguagagugaaugagugaauggccaauuucucaaucaugcccucccuagcacuuuuuuuuuuaauugguucaucauuucccucagugagcuauaagcagagcucaugucucaguaauaacaacaaaaacaaugauaguuauuggacauauccuccaugccaggcaguaugugagcaucuucauauguugacuccaaaaagaaaaaaagaacaaggccaggugugguggcucaugccagcacuuugggaggcuggggaggguggaucacuugagcccaggaguuugagaccagccuuggcaaaauggcgagacccagucucuacaaaaaauaaaaacauuagucuggugugguggugggcaccuguaaucccagcuacaugggaggcggaggcaggaggaucaccugagcccagggaggucgaggcuacagugagcugugaucgggccacugcacuccagccugggugacagagugaggcccugucucaaaaaaagaaggggaaaaaaauaauaacaauacuauguacuccacugagccucugcugugggcagggcacggggccagacacucuccuguggagcagugguucucaaaguguggcccccgcagcacuagaaucaccugacacuuguuagaaacgcacauucucaggccccgccccaaccugcagaauuagaaacgcugggguuuggggcccagcauccacguccuaauaggccuucgaggcacacucaaguuugagaagcucaggucuagagaugacaucuuuaaccucccagugaucccuugaggcagaauauauuaucccauuuuauuaaugccaaaaccgagacucagagaaguuauguaacuugcccaaggucacacagcaggugcguagggggugaggaggggcugcagauucaagcucuuuccacugggcgaccugccuggcuuucagcucugccaggaccagcuccuaggaggaggugaggaagacuggacagcagcucgguggugggcagaggagaaaagcgaccccaucuggagguagagggugcuggccgugagcagcaagacucacuucacuuccuggagggaagucugguuucccucggccccuucaccaggggcuggugacugugcaggaaacucaggguccuggugcuggaccacaugcugucaucccaagcugaugcccagcuucgucuccugcccucccugacuucgcagaugcugggcugucucagaggggccaggccuugcuggcuggggccuuagugggcagaagcucccgagucccuggcuccccacuugggauuuccucacuucggggucaggucagcugucacucaucuggccaagccacccagaccagggcagaagaaacucguccuugagccucccacgggaggaacugggaggcagggccugauggggacuugcucuuggaaaaucagagcaagcaggagaggaagggggaagaaaaccugggaggcugcugcaaggaggacaucucagcaacgcugcauccaagccugggagcuggggcuucccugaggcaugugcuggucuugucacggcagcaggcuuugugccugguuagaggugcauuuggggggaauuucuauaaaaacccaaagaagcuaagaaggguucauuccagacgguacaggaugugugggggcaaugcuuggcuccacgacagggccuccucauuugggguauggugggggugggaggggacccccugagggauggcagggggcugaggggcagcuucgucuuggcugucuuucauuccugacauggcugucccaugcagugguggggcuuucccaaagggcagggaaaaccuccaagugcgaugcccugugcuggcuaugugggaagaagaggcgagaauuuagaaacagugggagaccggguggcagcaccgugcuggccuggggucggggcccccauguggccgcagcuguuucccucaugcacugugugaucuuagaacaagaucuuuguuuccucuggaucuuaguuucuucaucuggaaagugguugccucuugccaguucaccugacuguaugccacugggcccuauccagguagguggccccaccccuggauucugaugugauggcauccacaggagaucugcccaggccaggguggaaagccucacaagaggggaagcucucugcuccgcaguccugccuggaagacuuuggaaaggaauuggacgaggagacagagagaacuccagaagucugccucagccccugguggcuccuggaacgggugagaaccagcuaccuguccccucugcucuguggggcaguaacucuuggaaggaugacagggcaaggccaccuggagcuuuggucaccaugguaacuguacaggcggcaccugcuggaaucgacgcuuggccuuccuuugcaugagaagagauuucugggugcugugaugagcagguggcaaggacgaggggcaguguccuuuucuggagggcuguggggggcccuguccuccuccuccaucugggcucguccaguccacccaccuagguacccugccacccaagaaagacccagaaagaggguggccauuuaacuagucaagccaggucaccuugggagccaacaaagggugcuguggucauuuguccaggugcugguauaggcuggguugcucuccagcaacccuggacguguggcugcucuccuuaugaaccacgugccggaggcggacgggagagggagcggccacgugccucuccuggagugaaugaggccccuucggaguccucgguguuguugacacuagaaggcugucuccauggcgacaaggucaaugggaaauggcagccggguugguuuaauuuucacuguauucuuguugacaggaauaaaggcccuguuucugauuucuugguucaacuggaugaaauuuucauuagauuuaacuucucauauccagacacccacauacuauucaauuucccgaucucaccacucaacucucauucgccuauugguccugaggacaaaauuuucagaaaucucauuucgaggagcgcagaggcugaggggggacgggauggagugugcgcccaccgugugcacaugcggggaccuaucugccguguccccagugagccugucauuucuggugcucgcuguuggggcaucacaguccucccucugccagggggcaugggcuucgucccaacaucacacguccucuggaaaaggcggggguggaggguccagcagacugccaggguguugagagcuugaccuucccguauucuuucuucuugcaagugggacagacauugucaaugagggguagggagaggcgccauuccagcccggccagugacuccaucaucaggaaauacagagcgugugggguggcauguccuuuaccccuguaacuggccucacaggaaaucuccaaggugcucagugacauacaaaguggcacuuuagagccauccugaggcucucggaaucuucuccugaugugcgaagcggcauuguuaccaggcugggaauucuuugcaccgugggugaagugugagugcgcuaggagugccggccgccuggcagcgucagagccucaggguuaucugccccuccaggccacuuggaaagaggggugggggaccaagugggauucuggaugcuuccaucuugcuccugguaagacugcucuagggccuccuggacucaggugccuccugguguguggggagguagcgccgcaggaagccaggcucgguccacagagcagccgccucugagcucccaacuaccuggccuggagccuuccauuuuuaaagagaggcugaaaaucuggagauuugaauguuggcaaugaauucuaacuuugacagaaccacucccuggcaccuagcagggcucagcaucagcucugcauagcagucagggcccaggacgucggugggguccuguauccccaacaccagcacaggggcgcacuccacaaaagggggaucuccugucacggaagcagcuaugcggccuugaagcggcccugggcagcaagacgccaggagagacaggaaaucaaaagcaguauuucucuuccaguccuccuugggggccggaucggcuccauaaaacuagcuggagugagaaaccaacauuugcaaaacaaaccuggauccuggagcaaaguaggaaggaagccccacacucaagucagccucuccgugcccacccucugcuguccuccaugccagguuggaagggggcugcaggcauucuggcaggagccaggaagagggcugggacccaccuggagauuccaggaaccugcccugccugcuccucauggcagcagcuccuucccaaagggaaggguaaaaggcagaggaaauccucuccaggaacccccagcgcuaucgcugccucccccaugacucccaggccccgcagaugcaggcagggagccgggccucugcucucagggaccgagcugcugucugggcugccguggggacacagaugugcuuccucuuaugcaacuccaggguuucucacaagugcaagucaacaagugucuggcaaggcuccaccaugugccggcaccaacaccucagcugcaaaacaaggaaacuucuagagucguauuucuuaacccagagucuacggaaaguccucacacaguccuggaacauccagaaaugguacacccaguacuuagugcaugcuggggacuggcuuccucugggaguguggcuacacuaagcuccguguggccuccaacgccugcccuccucgcaccuggaugugagaaaggaggccuguggcccaaagaggugcugguccugcucuuggcuggccucucgccagaggcugcuauaggccgggguuccuuaaaaaguaugguccuggggaccccagcacaagaaccuagcuucauaaaaaacucagugucuggagcccacuccagacccagggagucagaaugucuggggaagggccugccuuucagccccucccaggugguucugagggggaaccauugucucugcucaggcuuucugggaccuugguggauuccaggguaagacugcagccggcucggcucccucugagccccagaacuggguggccuggggggcccgagcucacuccugacauucagccauuugcuccuaucccagaagucucugcucagagguagugacccuggaacacgccucuaagugaacacugcuggccagaaagagucccucuaacaacacccccucucucucccacccggggcugauccccccacuccuuacugugcccacaccuguagcuccaugggggaaaaguuuuugcagcucucuucccuucucucucucuuuuuuuuuuuuuugagguggagucucacucuguugcccaggcuggagcacaauggcacgaucuuggcucacugcaaccuccaccuacuggguucaagugauucuccugccucagccuaccaaguaguugugauuacaggcaccugccaccaugcccagauaauuuuuguauuuuuaguagaaacagguuucaccacauggucaggcuggucucaaacuccugaccucaggugaucuaccugccucagccucccgaagugcugggauuaaaggugucagccaccauguccagcccucuucucuucucucucuucuuuucuuuagacaaggucuugcucugucacccaggcuggagugcaguggcgccaucucagcucacugcagcccugaacucccuagguucaagugauccuuccaccucagccucccaaguagcuggggcuacuggugugcaccaccacaucuggcuaauuuuucuauuuuuuguagagacagggucucgccauguugcccaggcugaucuugaacuccugggcucaaguaacccuccugccucggccacccagagugcugggauuacaggcguaagccacuacguccggacuuuuaggcuggcugcuguccuuccucgaugggcucuggcugagccuuagggauaccuguuccuagucaggcucggagcucccagcccgccguccccagccagccaggugauacuggaucaggaucgacugagcuggagaggaaaaaaggugggcacaggcaccucucccuagggucuccugcugcuaguuccagccccaccccaagccccaccacuccagaauuacagagcagguccccaaacagccuccuagcacaucucagacaccagguccagaggcgcgggugggacaggcccccgccugcaagcuccagguggccuggaccggggagucaggcuucccuggggcucccaucuccgagcggggccgcugccacuggccaccagguggcgcuggucgaccaggaacggcuccgcgagccccaggaaggaaggcuuuguugauuuuccuucuugauauucuauaaucaccaggauuacaaucuaagcaaaaaacaaaacaaauaaacacagccccccccccuucuggaucuuuggucuuugucugaaaaauuaugagaaaacaaaaggcgcacugaacauacaaccccaggcuuggguacuggcaacagcgagggccuccggaacagagggagggaggcugggggucuggggauccugggcucugcgaccucucccagccugagcugggucccuggagagcaggugcuggcuaagcagccgcucugagcagauuucucugccacugcagccacugcucagcaaugaggggcccguuugcagccaccccauccgaggcccgguacuggaaacgguguggugucucggcagcacugccuuacagaugcugaaggcuggcaggacugacacccuggccccuggaaaaccaacaggcugcaggugaggaccaguguguuaggggagauggacugugggggccaugacagcacaagcaagcccacacuugccagggccuccacccaacucaacagggccuccauucacacucacuagggccuccauuccaacucacuguggccuccaccccacucaccauggccuccacccucacagucaccauggccucuacccaacucaccaugacuuucacccucacagucaccauggccuccacccucagucaccagggccucuaccucaccagggccucugcucacacucaccaggaccuccucccaacccaccagagccuccacccaacucaccagggccuccacccaacucaccacagccuccaccuucacaguuaccauggccuccaaccacucaccagggcccucacccucacagucaccauggccuccacccucagucaccagggccuccauccgccucaacagggccuccagucacacucaccagggccuccacccaacucaccagggccuccaaccacacucacuauggccuccauccaacuuaccagggccuccacccaacucaccguggccuccacccaacucaccagggccuccacccaacucaccguggccuccaaccacacucacuauggccuccauccaacucaccagggcagggccuccacccaacucaccauagccuccaccuucacaaucaccauggccuccacccucacagucaccauggccuccaccugcagucaccagggccuccauccaccucaacggggccuccgcucacacuuaccagggccuccacccaacucaccauggccuccacccaauucaccagggcccccaccaaacucaccagggccuucaccugcacucacuauggccuccaccccacauucaggauggccuccaccuccacuuucaacauggccuuuguggccucacauuuacuauggccuccaccaccugccauggaggugagguugcuuuuggaggaaguguggggguggaggugcugaauccccacacacucgugccuguggauacgucgugugcccgugcagaagcauggaggugcacagagcacuuguguggugugggcguaggcccuggggcucugcugauuccacagccagcccuccugccgcccgcccagugcugcagaggacaccugccccagaggccugaguacucuggccugaugccagcggagcucuggggcuggcaggcaggguggagcuaaaccccgaggcggcugggggagcugccugcugauuuccgggccuucgaagccugcaggaaggccuaggacuugcucauggcugcagggccaucuggccagccagggcacuccaagaggagccuccaggugggagagcugggacaagaucaccacacgggaagggcugugaacacagcuuagaagucaugcccucgccacucacuccggauggaacaaccucaccaacagcuugcugggaaaugccuggcgugccauccccuccugggcugccaggaaaugggcagggaagaaagccacgggugcucagagggagaggaucuucuccgaggaaacgguuccaucuggcuuucuguagguuccaguggagccaagggugcaagguuuggggcauggcaguuuagaaccacuguggcucugagcagcccaagaucacugagcaaguuuccugccagcuuggcaggacagaagcacagagccugccuggcagagcagucgacuccacucaaagucaucucucaguggcuaaucugggaggagaggacucccccuucagcuccucacucacacuauggggguuuacugggugcaaaucuggugcucucucagaccagcugcauuggaacagacccuggaauuuccaggaugagacauacuaagcuuuagaucacuugcguacuguaaacuccaggccucagacggcgccucagacagucauugccaggccuuggacugagaugggcaauucugugcacuauaagccagaaagcugaagcccacaggggcaccccaggcuaagcacagcucuacucagcccugaaugauucacaugcagaaccucuuuccccaaaguacguuaggauggaacuacaaagcaaaaaacgacacuucccagacucucuugcaacuaggaguaaccauaugacaaaauucuguccaacgacaccagagaugaaaugauguaugcaaguugugggcuuaaagggaaggaacucacccuccaccuuauuuucuccucuuuccacugguuggaaugcaguugcaauggcaggagcuggaguagccauuuuggaccauguaaaagaaggcaaagcccuaggaauggggagcagccacccggagggagccaggguggccgaucccugacccuggggcugccacaucaacccugaacugugacaugaaagccaaaggagcuucccuuucauugaagccacuguuauuuuggucuuccucauagcagcaggacccauagucucaugauuacagaagggauuccaaaagacaggaaagaucucugggaauguccugggaauuccuaucagcuaucuucauuuauuucuguguguguuuuuuuucaucugaaggaagcauuccucagauugcagguggaagggaagcccccuucugaccaaagggcacagcugcaaggaccaggaugggauucucugaaucagccuggugagauucccagggcauaaggucacggagcccccaucucacagcaggugaggugaaggcugcagacccaucucccuucagcccuggggagcacgacauugugauuaaaccgcugacaacuccgcuggcgggcagggaaauuuggaaacaucaggaaaucaaacugugaagucuucgaaggcacgcgauuuaugugaaaaugggaugaagcuaauguguuuggcuccaguguugggugacccgccugauucuggaaucaaaucugaggucuucuuggcucucagcacaccucugcuguccccggacacacacacuuagcuggugcccucuguguguuccaagccugaucgucaucugcgccuucuccugcagccgcauuuccagggcuguuucucgggcuguguuucugucagagccgugcacacgcacgcccgagccaaggaauugugugcggcucugcuucccccagcccaagacaccagagagcugaguguuauuagauuuauggggaguuuguuguaguuuuacauaauuuucugaugcacugcagauuuuugagcaggcauucacaguucccuccaguucagcauuggaggcuggcuccggacugguuuccacccccuggaguucauaaagccuaauuccucccacccagccuggagguggcauuccugucugauggaugggcagcuccaggaaaaauggggagcauauggcugaaggagaagggcugucugugugugucgagaagaauuugggaaggcccaggcuagcagccucugacuguaggagccaccuugaaaggcaucuuuucccuugggagaaccuccuuggcuaaucucuggcucacacaaucucuuggaacuuuugcuggggcccaggggauuggggcugcuccccggccauauggauggggccucuguccagcaaaggggcccucauuuuccaguggaaucugacaagaggaauuccuucuagugaccuaagaagaagcagacagaaggcucagaaaggccaggaaggcaacuccuccuccugacugaagacuuguuuugagcaggaacuccccucuaaauguaaacacugaggggugggaggagcuucagaagcaccuggacccuggucacccuuucaaggcaagaguacuuaggacccuaauuuugaaagcacugacuaagccccagaaaggagguuccaggcuacuuccugcaggccuggagugcacucagccauggcagcuucugcaggaccaagcugagcccucuggagugacuccaccucccaagaaaugggacaggcuggcagccucagccccuuggacauggugugcagggguggaggagcugagccgggcccccugagauggcuggaagugcuggucuuagggcagaggcugcuagauucuugcuaccccuuuauagaagggguacuggggugcagagaggguggggcauuggucuggggcuguguagaggggcagccaugaagccaggaugagcaccugccuccugacuugccagcccugacucuuucuaccgcccuggccagggggcaccagcauuccuggucagcagucauagcgcuggcccagcugaggcucugcggcagagaaaguaucaguaggcccccuggggcggggucuaggcaggacccaguguccggugccagcccugcauagugaggugcccccuauguacugaguacgaaggcaggcaggcgggccugacagcagggcccgcagcaccggugccccagacuccuagccucuggccugcccuugggaaagugccacucagcagccccggcucccagagccaggacacugcagcuucuguccucugcucaggacccugggcaggucccuucccccccaccauuccagggcuauuuccagggccuugugcacacccagcacugugcagagagccggagggcuucccaagggcagcugugccauuuccccaugcuucccggugcucggcagcauuuugaagaggcucacgaggccccuccugaugaagcgcgggaagcugacaucucccccgugggggcucgaggaggccagggcacaggggugugaaggcccagcuggguggugggagggccuguggagaggcugagagcugagggaaagguggggugagcaggcagagccagggagaggggcagguggagaggcagcaggcucuggggaguggggacuacagcagguggaaagggcgcagaguccugcagaggccgggggcugcgggugggggggcugcaggcugugcucaggagcuugggcauugagcgugcauugaaugggcauugagugguuuuaagcagagagggauguggucagggcugcaguuaagaagguugccacuggguguggucugagcucaggaggucccugggcugccugccucgagguuccaggcagaagcacugaggcaagccugguccaaaccuccccacgggguacuuggcucaaaggacgacacgugaggaagcucagucuugugguccugcccuuggcgggcagggcugucacccacuggggggccucccuugccacacagaccccucugucccuccugacccucauccccaaccuugaggcugggagcagaucccuaaauccgagcacccaggggacucucaggauuagcaucaccgcaggugcccguagccucagccugggcccucccaggcacaggaccuucaccuuuccucccagccgcagaaagaauauuucaguccccccgcuguauauggugaccaacagcugcuuccucccuccagcccagcuccagggacaguucugcuucugagugagccacugacccacccccucaggcccugcugauggcagguccuugcccugagcccuggccaucaaugucccugaaccccgugggcuacguguccaccacuaaacagcccccaugcucuucuugggucaggaaagccccagacccauguuuguuuuucccgagccccgcugaacagggggcaggagaagccacugagagccgccagcggcugccgggagcuguggccacggcaacaaaguacggagcagccccagcuucccugccucacucgguguuuugcauucugugauuugcaccugacagaugcuucagaaagcaccacuuugcugacaaaaugaaauccagcucaauuaccaucaucuauuugccacccagccugggagccgaggcaggcccugaguccaggaggugguggcuaagcccagaucccacguggaugggcaaggcaggaggcaggguccgcucccgccaccccuccccuguuccauacuuucccuccccagccggccuccacuccugucuguggccccggagacccgguccuggcccacucuuggccugcuucuuccucuacaugcucugugucuccaaaccucacucuuuucaucugucacgugggccuggcauuuugugcccuggcuguuguauagggagcuuacaaggggccaagugaagguggggcaaaagcuaagcucacggugccacugucauuccagcaagauggggcuccggacccgcauccccaaggccacagaggaccuuccuggccccgccugguugaugccagccugguucccagcgugggggcgccaggccggccaaggccacucacacauggguuucagcugcccgaugagcucuucuuucguccauuucgcccacuccuucuugucgguguugauggagcagaggauggggccgcaaggcuugccgcaguccucgauggccggcacguucagguagugcaccaggacgaugucgggguucuguggggagagcagagacuggcagcaugaggguggcauggagcccaccagggucagggccgcccccaaccccgcaggugcaggcagagacugaggccccagacacccggcucucuugaccucacacugcugacgguugcagccagaugguucuguggugggggcuguccggcgcaugugggauauuagcagacucgcuggccucuacccacuagaugucauuaggccccucccccuccggcugugaccccuggagaagucuucagacauugcccaguguccccuagggggcaagaucaccccugguugagaaacucugaccuacacauaagcugauauguguguaacugggaaccacgggcaugaggucaaauucccuccagcccaacaucccugaccucgcaccacagccacugcccucucccuccuucacgcccaacacgcguugcccccucacagcuugcgggaugcccccaacacaggcauggucacccgcuucuccccaaggggaaaaggagcucccagggcuuaaggcuccuccugcugagggcuggagccccucugccuucagccguggucuucuccccugacaaacagcccugcaaugaagcacuuuuuuuuuuuuucuuuagacagagucucacuccaucguccagguuggagugcaguggugugaucucaguucacugcaaccucugcauccugagcucaagugauccucccacuucagccuccugaggcugggacuacaggcacacaccaccaugccuggcuaauuuuuguauuuuuuguagagauggggucucacuauauuggccaggcuggucuugaacuccuggguucaagcaauccgcccaccucagccucccaaacugcugcgaugacaggcgugagccaccgcacccagcuggcacuuuccaucuaagcaauacccagggggcaguuggugcccagaaucucuggaaacuccucccuggaagagcucuucugucaccccauccagcucguccacucuuucuuguugguuucuggggcggaguuucccaaacuucugggcaccagcugcccacagguauucugggaaagaucucucagucugaagaccuaaaaggaccaguuugggccgggcgugguggcuuaugccuguaaucccaggacuuugggaggcugaggcaggcggaucacgaggucagaagaucgagaccauccuggcuaacacggugaaaccccaucucuacuaaaaauacaaaaaaauuagccgggcaugguggcgggcgccuguagucccagcgacuugggaggcugaggcaggagaauggcgugaaucugggaggcagagcuugcagugagccgagaucgcaccccugcacuccagccugggcaacagagcgagacucugucucaaaaauaaaaaggcccaguuugucucaaaucaguuccauuuaacagucagcgccuucucaucacaucuuauuaagaauguccucugucgcuuucugccccccgagcucagauaggacaugcccaggggccuguguaaggcagcagugucccugggaugagcauggggccuucgguggcuuucucaugguccccccagaaggcagcgcugcuuaucuggccacgacaauacugacaaguuuguuaaagaaaaagcaauccugucacuuucuagaugcaucuggauaagccagaaaagccuagcuaaacccucccaucucaaucagaggguauuucuugaaccuuuuuuuuuuccuuuagacagggucuugcugugucaccuaggcuggagugcaguggccuaauaucggcucacugcaaccuccaccucccagguucaagcaauucucccgccucagccuccugaguagcugggauuacacgugcacgccaccacagcccggcuaauuuuuguauuuuuaguagagacgggguuucaccauauuggucaggcuggucucgaacucccgaccucaggugaucugccuuccucggccucccaaacugcugggauuaccggugugagccacugcgccuggccugaaccauuuuuuucuugcauucuccuaaggaaacauggcaggauaucagacgcugcagggaacaauggaaaaagccacgugggaggccucauccugugcuuuuccuccugauagaggaaagcugcuuuccccucugcuuuccccagcugauagacugagacucaaccaugaguccugggacaggcaggaccccaggcaggagagagcugggucugcaacugcuuuuuugaauguugucagggaaagagucauacaugaauauaugaaucaaucaauccaugaauaaauaaagacucaagaccacaccaugaccaauguaagaaaggagacuggcauaauuaaacagauuuuuuccugccaacgcucaguuaaccaggaaacucaaucaacacgaacaggagccuucuccuuaauggcggcuuuucuggauugcgguaaucaugcuccuuaauaaucacgauaaucccugacauaagcgcagcacuuuauucuuuucaaagcacuuuccagccauuaucuuauucggugccccugcuagccaaggaggcgggcugggcaggguagggcagggcagggugcccucugucuauagagaggugccuguagcacuaagaaguugugauugcccaaagcuaugugccagcagggcacagccugagcuggaagcuggggcucugacuccagguucggguccugccaggacaucugcuggccucucuuuuugcuuggccuaaguacugucucaucuccauuucacuucauucuugcaguaugcccaagaggugggucggguagaucugcuaugcccuuugcauggaggggguaacggcggagagacggggugauucacuguguccuugccccguguucuuccuacagaccaacauaguggccucccagggaccgcgucugggcugagggcuccugccugugccugggcacggccaggcagcaaugccagcugcugagcaagaugaguaaagaucaaaggacugcaggggccagcaggccgcccagggcugccucugauccuggcccuggagcagaagcccggcccugcaggagggagcggagaugccagacgccugggagaggaaaggacugccgcauccugccccacagucgugcugggcacagccugggccagccugggacccgugggaggccaagguggcgggcaggcagacagggucuuguggggcaaaggcccucucucaccaugaacccaaaccguggaguuccugcaugagagcaccccaaaagcugcuaucucaggaagcucugccugcaggccucagccuccaucugcauaaccagccuccaccuauucuuugaggucagaugccaggauccccuccucuuccaggaagccuucccugauucccucucugccucuaccauaguaggguggcauuuggcuuuguguuuuaauugucugaacaucaacuuuauuuccucaaccucagggacaaugcccugcagcuacgacaguccaacaaucaccggugcuuauuucagguuuguagaaucaaauuaggcugaauucugaccuccugcuugugcccucccuagaccuguguucuccugacaucuggcuucaguuuucuggguccacaaagggcagggaagccuuccuuuuuuuuuuuuugagauggaguuucacucuuguugcccaggcuggagugcaauggcaugaucucggcucacugcaaccucugccuccugaguucaagcaauucuccugccucagccucccgagcagcugggauuacaggcaucugccaccaugcccggcuaauuuuuaguagagaugggguuucaccacguuggccaggcuggucuugaacuccugaccucaggugauccacccaccuuggccuccuaaagugcugggauuacaggcgugagccacugcacccggccgggaagccuuucuaaacacagguuguugcuaggaagguaagauacaaugcaaggcugguucuucaucuuuucuggguaugagaucucuuugagagccugacgcaggcaguggauacccaccccauccuccaacauaccccaaggcauaucaacacuucaguucaagggcucacagauccaguggucaguggaucccacuucaguaacuacaaauguagggauuguagcauccagaucuaccccuuucaacucagggcaccugcccaacaccggggguggggggucccuucccgggagccuccaugcugggccuugccuuucucccuuguuuugauacaauuagcagagugucccagccccuggcaguuccaggagaccaaguggaggcucaggagaugcaggagcaggcagcuucccgguuuccaucccagggccuggagcucuugcaccuggaaugcccagaguugaguaguaacgauuuccuggcguggggcugguuuucagacaugggcugauggagguauuuuggaaauuuggggcacacaucgcuucuuggcaauguugcaauuuuauucauuaguuguacauuuuauuggguguuuuuggcagaaaaauauauuagcuuggaguccuaauguaucaguuucauggagugcucauaacggugucagaguccuugcugagcugcuuugcugguggcgagaugggcucagguggaccagcucagcagggcggccugcaggaaugcccggguugggccuggaucugagagucacggcaggggacagaccccgccagggcccuguauuuuuuuuuuuuuuuuuuugagacggagucuugcucugucccccaggcuggagugcaguggcgcgaucucggcucacugcaaccuccgccucccggguucacgccauucuccugccucagccucuggaguagcugggaguacaggcgcccgccacagugccccgcuaauuguuuuguauuuuuuaguagagacgggguuucaccguguuagccaggauagucucggugucccgaucucgugaucugccugccucggccuuccaaagugcugggauuacaggcgugagccaccacgcccggcccggauccuugauucuggacaguuguggagugaagcugccuuugucuugcccaggcugcccugauguuuccgugggguucaccacccugucaggcccuguggguucagggagggaagaagagcuugugcagaagccccucccugggcuauggaguuuucaugagagaugcuaggggucaccccccaaagugaucgugaccuuuggagaugagcccuugcuuuccuggaggccuggucagugccaaaggcuggggagagagagccccguggcauggucugugacugugguggugguagaggaagccaaggauaaguaaaagucucagagaaguuccacagccuucuggaagagccguggacgaggggaucccuccucccucuuggugccucaggcuccucacccauaagcauggaagcugcgccucuuucucacuggggcugcugcagggagcagggucaggccucggaacagcuggaaugucgucaggagagacagaggccccgcucuaccaccaccaaccaccaccaaaaccaaacccagacagaaaaaagcccugacgugcuuccugagagggugagcagaguuaagccuccagcgggcacuucugcugcuuagagcccccuuccuccuccggcagccccagccugucccagcucuccucuugcuguguacagaggcccuuccuccaccagcguccagccuggggcucuggccucccucucucucgcucucuuucucccucuuucccucucucccuccuuaguggccucauccaguguccugaccucacacccaccagauucccaggacacccagauuucccucuccagccuaccucuccucucuugccuaccugccuguugacggcaccccucgaaggccucaaaauccccaugacuucccauggccgaccucgccucccgaccuccugcucagcacccuuggccccuccaggcuucccacagcugcccaggucuggaacccaggagucauccucucauuuucccucccucucccucaacggccagucgaucacccaguucugccauuucucccaccccaggaagccuaauccucccauauacccccugccugcaaugaccaagucugauccuccaccugcucuccugcgcacgugggagugugcccuccucccggguguccucacgucugcuccucccuuccccaacccacccuucaaacagcagcaggcgugguugggcuguuccggacggcuccuuggcacugagaucaggcccacacuccugccacgguuccaggccgggccaccugugcuucuugcuggccgcugccugccucaugcaccuggcucccgccaccccauuccccagaucugccgcuucucucccugggcuguggucucuggcugccacgcuccaugccacauuggucccaggucacuuucuuguggaaaccucauucagcaaccccguugacaacagugcccaccuugccugguucccgccucgcugucuuugcagcacuaaucucucaguuuccgcucaauuacuacucggguuuggccuguuuuccuggccacaaugugagcuccggauggcugggacucugucugcggggcagccacauggcaggggcuccauccuacuuacugaaaaccgggggcauagcggggugccgccaagcugcuccagcacacgggccaacaagccugcuagggggcaccuggccuuggcugggggagcuggugcagggguggcugucuccucuccggagacucagugucucaggaccaauccuggagaacccccaggcaugucuucuagagggacagacagagacuagggugcggggaaggagucgguguccaucccaggcaugggcuggaagaggaggggguccacucccccagaaggggcccaggagggguggcaucuggggggguccacgagcucucugccccucugcagcucuuccucucugagggaaguucagcuugucccuuaacccagcugugccuccuggaaaugcauuuggagcugcugaccuccccaguuccagacucccagggcccugccaggcacaggacucucaggcugaaggugguggaagggcaucucccgggagccugagguagagucaaucucuuugagaaccuuuucuagauggcaccuuucacccaaacugcagggacaaagagaggacgggggacaagcugagggccuuuccuccaaaagcacaggagaggcuaagaacauucugcagagaaugccugcucuguguuaagcaggcccuuuagugcuagccugaaccuugccaggagggggugaggcaggcagagggcucaggacgggccuggcccccagcagcgcucauguguaaggucacuuacacuggcuaguaaaugggcaugaggcggaggugggggaggugcuccaggcugcagaggggagcugagcucugcaccucccgcaugcugagcccacgccugggcgugcgcaaucagcccuuggaguugguugaggaugcagcagugagcucuuccccagagacccacggaggggacucaagucacccacagcaagagccuuggggaucucacauccuuuuccuggccgcuuccagggguggauccugggccaaugggugucaggcagcagggucccaccgcccuggccucggcuccuccaucuccgcugaggaggaggaggccuggagccaggaccccuuucuguggaguaagcaggguggugaugcaagaagugguuaaaaaugcaaaaagcuguugguuuugauaaagaaaaaugcagcugcaacaucuguuugacucuuguuugcagcuucaucaacgcuaaguggucaauaaaucagaguggcauggcguuccguuucuucuggggcucagucauuaaucucgugccaguucucaugaaaaaugaaggagagaggccgugugauagugaaaauguauacauuacccagaaagucauaauagcauguaauagugccacacaccuccccacuugccgcugggggcgcggggggcgggccugccugccgccagccggauaggagggagacgggcgaggaagcagcauugccugcgucacaagcuccuucgaucuuugcauuugucauauuagcaccauuuauacauauuccgaaugucccauaagccucaucaucagaggcacagccuucccugcaccuggaugcuuaaugaacaacgaggguaggagccugugaaacgggugugcaaggcugggagggagaagggcaggguuuauuagggacgggauagagggcggcacugggcggcacugggcgacacugggcgacacuggguggcacagggcuguggugucacuaggcugcaggacugagcaaaauccucucacccaccuucuggcugccccagguagcugggccccuguccucucugcucuggguagcagugugaggugggacgaugguuccacuagaaaggaggcugaucaugaaggccuuggcaggcuuggguucuauccccacugucacccacugaggguagccaggaggcagggggaggaucagagaggccuggaggauggacggaagcacaagaaggaugcucccugagaagggccagggcacgcgggcgccugcugcucaggucucccaggaucugccggccccugcaggcugcugucuccuugggucucucuucccugccucugauggcuccaaugcauaguacuguggcauuccacggccacucaggggugggagcaugccuggacccacagcacauaccucccagugggcauuucuguuuucacaguuugcuuucugagugucagcugugucucgggcuccacauucaaguucuacaacccacaggugcaagugguauugcuaucccuguuuacagaaaggagagugccuuugagggcugagucucugggugccagcccugcuugaagucaugaucucacaccuccagaccacugccccagggcucuguggggcucacuggauguuucaugggagggcugugcacucagccucagugccccggguggcagcagcccaguucaugucuaugccagagcaaaaguagguccagggagcccgguugggucaugugagguguggggagcugggaggaccaaggauguggcuggaaggcuccuggcuggucuguaagcuccucagggcaggaccgaggcugcagaugucccugucuccacaucaagggcccacaguaguuagaacacccucuguggggugugcaggggaguggggaacagccuucagggacccuggagcugagcacccgguaacugggguacagaucuagguccccaaaguuggcagcuauuaaaggauaagcaaaaacagaagggagggaguaggaacugaaagaggggcccuggugccccaguaauaggcagggucaguagucaacugugcucuucugggggcuugguccugcaaucugugcugggcccagggaucucccacugcggccgaguguggcaggcacacagaacaccuccccacuuccuugucagugcucagcagggcuggaggauucugagcgauggcuggcaagggcuucagagggccuacaggcgagggcagagguaggcugcccuugggggcccugcagcaccuucccauggcugcccucauuacgcaagccugugcgccagcaggagucaggccggcagcccuucccugcuuuggagggaggcugggagacuuaauuaguuaauguggguaaaguggucugaagaugaaaaacccuggguaauugcugagugcugcugcuguuacacaauuaccagaauuuuccagucaugggaauauaguuaaacaauuuccaccuggugcgggguuccgggaaccaugccggcucaggggcuggcuugcccugccuccuuuagcccaaagguaguguaggaaaaacacauuuauggugggagaucaugccugacacaauccugggcacauccuagacacccagagaaugcuggaugaagggaguucuccacucucgcugagcagauaaagaugcauguaccucaagaggggacagagggucccgucugccugcacuuuccagaggccucugaaacagucccacccaaaggcugagaggggggucaagccauccuggaggggcgcugcccgggaggggaggacuuuucauugcgcagcaagaccuggcugcccaacagcacguaugcgugggggcccgggcuggccuuauuuaaaaucauuauaaaugacccgggggaagacauguccgauaaaaucuccacguuugcagaugacacuaaauuuuaaugaguaacgaaaaagagccagugucagaggguaugggagcuacagauguaucccagggcagugacgugcagggcgagaggcucaggaugaguaaagcaaauuggcaacggaggcuggcagcucgagcugccacugccaggccccccgagagaggaccucccaggauccacagaagccacugguccacaguuguugcagggaccagaaagggcccagccuggagaggagggcaggaccugggaacuggagacagaauggccgaggcguccuugcugcagagcugggucugaacuagggagugcaggggugagggagcaccaacugaggaggggcaggcagcuccaggaaaaugaagauaagggcuuuccgguccagaaagauaacaguggagaggaaaugugauucgagucuucagaaaggggagaagaggugaaaguugcuucuaacucuagauccaugaaagcuaagaauacggguucccccacucuggagcucagggagguaauuuuagcacaaucaaacuacacagcgggcagucaacguaugagacucauuauugcaaggcgacaugggcugaaaaauauaaagagcuuuuucuaaaaugggugacauuaguucccggauggcugauccauaaggaguugugcaagagaucgggaugcugggggccaucucucuuugggaccacaaaaucuaggagacaccaugauggccggugcccccaccaggguggaaucuggggcugcgagugucagcuggacuguucagcguccaaccauccuucucucucuugccagggaccugucagggaugcaggcugcuggcguccugcaguuggcagagccugagcuuggaugagauuguugguugguguccuguccuguuugucuccugcucucaccuugaacuaauuuuugauuuauuagcaaugcugcaagaguugcuccgaccaccccugggacaagaagccaugggccuuucgcaggggcacagggaacuccuguagggcaaagguccuccucagggcaugcagcccuggcccagcagagacagaggguggaacagcacagaugcugggcaaucaggucucagagggcugcagucaccauaccucuggccuccugucccucccaggagcuaaauccauaggcacauggccuccucaccagccucaaagaggucuugccugcagccuagacuggccauguccuccuggauggcuggaagccaggccugcugcccuccccugucucuuccauccucuccaagcacgugcgccccacuucugcucccagagcuggugugccugcucagaacugugccccauuaggcagugaaucaagcccaucagaugacaauggcagcaaacagucauugaggcaucucuagagugacugaugugcucuguagccuuuccugcccaucugcuccccuccauagcucugaaggaaguugggcaugugccaccaucccugcuggacugagaggugcuacaugaucugcucacggccacguggcucaugggaggcugagcuggacacaacucuggugcacuagcucuuuugauaagaguuuccaaguuuucuuuagcaauccagccaccucuccaacucaguccagggguggagcuugucacucaggcuggccaagccgcauucuuugggccacaucgacuggcucagagagagacccauggcuccaccagagccaaucagugcuaaucacuaggcuuugguuggagucacuuggaggcaggggugcucuuuccugcugaacucgaaccugggagaaugaaaucuagugcuccuggaagccaucucuugccagcacauggagaaggagaagggagcuggugcgaggagcagggcugaggggagaagacacaaagccucgaugcaacugauggaacacaggccagcacaucucaagacuuuucagcaacuccagcccccaaaucucuuccucccccaaagucaguucaagucgaguuuuuuguugcaucgcccaugagccuuaguuccuaaaaaaugaucacaucuucuuucggcuaagccggucacucuuuccaccacacaauucagaugacccucuggugucaauaacccccaccgcuaugauugcugagaacuagcauuucuucagaccuguaugcuccaggugcugagugcuaacuacuucccgggacuuagcuuguuuaauccucacuacaaccucacaagguagaacugguuauggccccaucugcuuuacacauaaagaaucuaaaacguaaggaauuaaguaguccaucaaagcccugcccauuaagcccaggucuaucugaugcugaggaagcagagugguagagagugugugcuccagagacaacugccuuagguucgagucuggguucugcuaccuccuagcugugagcuuugggcaaucacaucucugugccuuaguuuucucauccauacaauggagagaacaguagugccugcucccugagguaguugugaagacuaaacaagauacagcauuugaacagugcccgaggcaugggaaaccuucagaagggccagguauuauucugacugaccucucuaaccaguguuaugucaucucacacuauugcuaaggacaaaguuucccuaggaucguauggaacuuccauguggagcaacaucaaauuaauucagauauugcuuauuugggaagcgugauucuuugagauaggagcccaucuagguaaaguuaaauucuuuucaaacaucgaggaagcaucaugaucuccaacagacgaugagcuaaacaccagccauucuuguccaaacauaaaaacaggaucucugagacaauucuugguuaucuuccaaacucuggaagaaaacaaagcuccauuuucccgaaaaauaucccauaacucuccaugaauuaaagagacagacaccccauccacauccugccacauuggauagguaggagucccuugggccaaugggaucacuucuaguccucauccagaugauacaggcaucaagugaccugcaagcccuugaggagcuccagugccuccagccccuucucuaguaagcacuguccucuuccuggaugcuuuauguauuuuaauuugugcaugaaagauccuccaggguccugcaagucaggggucuccuaaacccuucuguuuacuccucuuggaacagagaguagugaaggugggaggaaacuuagggauuguccaggccaacuuaucaacccccuuccaucuccaauugggaaaacugaagcaagagagacucugaguugaacgucacgcagcagacagguagagagugaggacagggagcugcacccgacccccacccucugcugucucucagcuuugccucuuccugauguucagaaccuucugaagcaaaugauuacaccucccucgcuuugcagagagaauuugcagaaaagcagagcugguugcuguucaccacaaguggcauucagaacaaggcugcuucccggccagcaaacuucuucacaaccuugacuaugaguagggucccgagauguuuggugggcuuucuguuuagugucuuccuggugguagugauggcagggcaggugauccaagcagggaaaucugggagguugggauggggccacccuuccucugcucuggaggagcaccuggggagccccugcacucaauccuguuaaagaccuaaaccccaaagcucucccuugacugacaaaugggcuggccguggaggcagcagaggaugaauugugcccgguccaucaagcaucuacaggauuuuuaugcucuggcaucuguaauggugagauuccagcaauuguuuuagagggaaucaugauuaaauugggcuguauguuuuuuuaauguguuccccaguuccucuuuaauaccuugguaggacaagauaacguguaaucacugaaguaauuguggcucucaacaguuuaugucuugaaggagugacuggggguuaacaaagccacugcagggcaagguuuggauuagaaaauacaguuuuucuuuuuguuauuuucuuuuuaaauccuucuuuaucuucuuccuuucuccaguggcuccuggagcucgcugauaaccuguaagccuccucggguaauaacgggaccugcuauacuaaugacauaggcaagucuggggccggccccucugcagagcugcugcagcaggccaggcccuucccagagcacaugccuuugcaggaagcgccaacuggucccccagaccaguggggcucgacauccugaauaccaacgcccauccagaccccaucuucaucgccacauccugaagucgcuggcuggagccaagcagugaggcugcccuaugccagcccauugcgaauggcagaggagagcaagcucgugaaccccgacacugccucaaacugucccucuccuggcagaugcugaagacaacgguggggugggcaucugugcuagcagggagcuggcaaccccacucacuccucuucagaugaugcgacagaacggccuggcuucauccagcuuccucagggcaggggcaacucuaagcauccugcuuagaggccaagacccugucagcccgaugggggcagaaucaggccacagagcaguccugccacugugacuccauggccaccaagucugaggcgcugcuaaugccagcagagcugaaggaggggagagacgggcaggcauccugcuuuccucuuggcccuugaggccaccgccccagucuccccucacugccuuccccaugcuccuuggcaucagccuccugacuggucugccuuugagccaggcacucccauccaacucucagagccaucuucccaagucccagcucugaugacgucacccacugcuaaccuuuccuggcuccccauuuccugugaaugcaaccccacuccugaucccaauggccuccaugaucggcuggauccaccucccaugcacccuucucaccccucuuggcucagucaaccagaccauucagccugcucugccacuggcccugcccacgcuguucccaaggccuggaaucucuccacauuccaccuacuugucaagacccagauccaacgucacacuguccuuccagccucccuuuauccuuccaaccaaaauaauuucauucccuuugggacuccccugacaguccucugugucucuccugcagcaucagccagccucacucuuuccacugaucuucaggcuggcuggcaccuccauucccucucuggaccccagacuuccugagagcagagugugcaucagaaggaaauguauucccugauaggcagucagcaaguguugguugaaucagugguggguugacugcaucugaauggggacacucauccuggaucggucacuagagacagccccugugcugggggcugugccagucgguggccagcacacccaccacccacccaucacccucucccuucaucucuuccaccuucaccaaggcagagugaaggacauggcaagggccuuucuggguacuucugcaugcgaauuuacuggagucuucauuuuaacccaguuucucuguuuccaccugugggagcagugguauaccaggaugauuuguuccaaccaaccacucauacacaaaucccuacuccccaucuuggcccuuggaauucugcacuggaaccauggcggauggcacucuuucccacuaagcucagauggggucccagaaaucgcauaggcaggguucugcguugucaucaccaauugaucacagcuggugugggagacaaacugugguccucaucucugcacaggcgcaaggcaaccccuuagcggggagacccacagcacucgcucccuguuuguuuuuaggucuuaccacggcugccuugaagcugagaaaacagaagcugggcugagggccuuggcaccagcccaggguaacugggacacccauguuugcaaagaaagcauuugugaagugugaagaaaucagaacagcaccguucaaaaacuguguuuaaauuucacucaaaauguucuauuuugcgucgaggauagaguccccuuggaaaaaacacuuucuggcauuuggaaaccacuguugcuauggagcuguuaagagauguuagcuaccaggggacagcaauuaauugcgguggcugcagguaaaucaagccagcagcuccuuuggaggaagcugaugggaaaggggaucuaaaaggcaauguugaaaaagagcuucuguaaucccagcaccucgggaggccgaggcgggcggaacaccugaggucaggaguuugagaccagccuggccaacauggugaaaucccaucucuccugaaaauacagaauuagcugggugugguggcgcaugccuguagucccagcuacuuggggggcugaggcaggagaaucccuugaacccaggaggcagagguugcagucaaauuuccaacugaggguuucagaugcuugagggcgaggugccuucuuagugacuucuuuguguuuccuucauuucuaggagaaaggacucaguguguggagcugaugggaagucaggcuuucccuucaguuaaccugaaaugacuggggucccagcucacccacucuccugcagguagcucugaggugggauucucagccuuuuagaggaacagcugccucuucuauagaguagggguaacuguggcacuugcuuugcaggguguucauuaauucccucauucauucauucauucauucauucaacagauuagcucucaagaaccacaagauaccagggacuggccuacauuuggggucuacugugaccaagucuaagacucugcccucaaagagcauggaagagacgagcuauaaacauuggaauaaagaauaaggugguucuggauggcaugaagugguaugagcauaaaaaauggggguggguggagaauuuagccagcgagcuugagaaggccucugaggauggaaccuucagcuguaucugagaugauaaaaagaagccagcuguggggagcucugggagaggaaaggauucaggcacagggaauagggacgaagaccucaggacagacucgggcucacagggagcauucaggaaaacagccgugaaacaagaaagcacagagguucagucuggaaagccaaggacaauggccugugagggccgaguuccaugauggcggcuccacaucugucuggcuugcuaagccuugagccuggcaucuggcccagagcugggcuuggaaaauauuuguugaauaaaugaaaugguucaggaacgcuuuaauguugaauaagccuccacauggaacagaagauucaaucucuuaacagaagaaaaaccucagcauuuugagaucaccaggauaggcucaugcugguggccaagaucaaauacucacagggagaaacccauuagggagaaaguugucaaaguucaggugguggaaggcuuacuccgaaagaacgcucuguuuugcugguuauuuguuaaagaaaggagucaaugauggguuauaaugaagucagcuguuuucaauagcggauacuaacuuuggaauucaaauaagauagaaagaauacaccaaucuguuaucuugccugcagccagaugauggaaagaacuuggauguggaguggaaucacacauccaaguggaaguuagaucaaauuucaccuuggccacuucaaacgcugugugaucuugggcaaguuacuuaaccccucuuggccuuguaucccucccagguaaaauggggauccucccaucuaccugaggauaucaaaagccauugagaggauuaagggaaguguaauggagggcacccaacaaguucccagccaugaguagccgcucagucacugauaaugaguuaacgagcaaaaccaaucuccgcuuccuccuccuccccccauaccuccagggucaugaacagaaagaacaaggucacuguuuugguuuuugguuucugucuuuggaggugacuaacucccgaucugacaguuguuucugcagaaccaaagacuugacgggauugcaaggucacacgaggucacccagagaagacgccucacuaucuuuagcauauucguucucucuagaggcgccagggagccgagacguggccgagcugagcuggugccaggaauuuugcaacaaaccauggucaaguaaaaaccaaagugaccuucuuggaagcaauggucccagggccaggcuguguugcuggcacccccgaccugcucgggauugcacagacgucuccaucccucuuccaggaaacuuccagaagggcgagcacugcaccuggcaccucaccagcccccuuguuauaacuuuccuugcgauuuaaguacacucccaaugacacagaguguugggcugccacugcugggcagaggcaccugacaggaaauuaauuucuuaguuucuuauuaacuuugaggggaguaccucuaccgagcugcacugccaggacaaggugcaccagggcuuccaggaauuugaauaucagaggucagcaccgaggcacgaugcucagacucucccgucacugucuccaguuggcgccuggcuuagcaaaugucucaggagccaaggggaaauuccuggcaucccagaccacagccccuguugaaaauucugcugacauagccaggugacggugacaacguauucuggcuguggccugucacugugaaauaaaagggcucaggggcucuccagcacccaccaugggggguccucccagagcccuuggcucucuugggccaguggccccucuucuguggcagccucccucuaguugccccuaugagaggaccucuuuuccuggcuggaccccugccugcucccuccaguucaccagccccuaaucagggugcaaugccucucaagguccuggccuuuucuccacuguugggcccugcucuucccagcauuggacggaacauugauggauuacuccccugacccuacggccuuucccucgcacucucuuucucucuccugcuuccaccugcucuggccccaugcauccugcaccuguccucagggcugccuccuccaacaccuccucccugcuucucuugucaaaggaccuucuggcuuggucugaacugucagguucaauuucucgagcuaaaccuuugaaucuggcugacccacucuugaauggucuuuguuccccagcuaagaaccagcugaucucagccccggccaaaauuugccucaggggacuugccugccucuaaaucauagcuucucuacucagucccagaccucuccuccaacuccaucucuccucccuccuucuaacccacauuuaugagguaccugcucugugagugcugggcggauacagacaugguggaacugggcccugcucuccaaaugcugacagccucccaguaagauacucgugcagaacaaggcagcauagaauauauucucucucucucuuuuucuuuguuuugccagagguaaaggaaaguucugugagagaagggaaggaggggugaagaccaguucuguguucuccagcuuccagucacaucucauugguaagccaccuccucucucccuuucccagggggcaaagcaucaugggaguauccuggaugaaagccaggcuuccaugagguuucucagccucacaacuguagacacuuggggcuguauaacucuuuguuguggggcugugccgugcaauagaggaugcucagcagcacaucuggccuccacgacuaaauuacucgaagggugaugacaaaaaauugucuucagacauugccaaauguccuuggggaguaaaaucaccccuguuugagaaucacugggcuccacaguggccccacguuccacucacucuccugguaccacgauguucaacuuucaagacuccagcaaggauggagaagagugagccuguccuuagagggaacuucaaaggccugggucuaguucuggucuauucugggagggcccauuuucuuguuacuuuugcuuguguacauauacauugcuuugaaugugugcaacauuuaaugacagcaucacauacauugucugcacagcauuuauuccccaucaaaauucauuucucccgaggcaggcggaucacuugagcccaggaguucaagaccagccuggccaucauggugaaacuccgucucuacuaaaaauacaaaaauuaguugggugugguugcacuugccuauaaucccagcuacucaggaggcuggggcacgagaaucgcuugaacccaggaggcggagguugcagugagcugagaucaugccacugcacuccagccuuggugacagagugagacuccaucucaaaaaaaaaaaaaaaucaauuucuccucaauuuugucauuguguguguuuggcagggggcaguggcgagugaaucucauuggccaauuauucucccaucuuccucauaagggaauauuuaggaauggguaugugacccaauucuggcucaugagguaagagaagugugaagguuuccaggagaggguuuuucacugguaggagcugcagaacaucccacucuucuuccuugugacaccugcuaugugucaugugaaccuggacugcagucaccuggcucccaggaggcacacgaagccagcacucaagauggcagaguuggcuggugacauggcugaaccccugaauaggcugacccugcaguucgcacucucucuggcuuuccgcguaggugauagaauacauucugcauugcuuaggccaauuugaguugggguuugucucccuaggggcaggaauagcuugccauggcauggcuccguggugaugguagauggcagguggagagaaguuggacugugguuuuccuccuauggacugggucucauacuuuccucuucaugcuuucccucucucacauugggugaacugugaagccuguugacuagggggaagccacacagccucagcugccucccuggcccuggccuccuuaaaauuucuguuugagaugcaaauuuuuuggucaaaugugaauaaaucccuuauuucccuucccuaugucuaauuugggaucaggauaagagacaagaauaaagcauuucuggauuaaaaaaaaaaggauggcucuacauugaaauccaaaugacauaacagccuucaaacuggcauuugcaauugggcugaguuaaccuaauucaauaucaaaggaacagggaaguuuuuaauuaucucauucucauaaugggagaagaaacugguuccaugggagguaaacacccuaagccacaagguuuucauguaaauuacaaugcucaacuugagcugacaaggagaggggauguuucuuccuguuugauagccuucccugauguguggccuuuuacuauagucauaaaaagacaguaaauuaagaaggcacuguaaaauaucaucggaaccggcccaaggagccaaauuuccagccaaagccuugaaaacgagggagacgauaaacaguacagagucagucuuuggggcagaggccccaagccagggagaaagcugacgucuuuuccaaaggugcagaguugagagccuggagccgcacacaaagcaggauaaagaggagugggcauagaauugggaaaagagggccucccgauccuagaaagugguucuccuggguggggagcugcugaggcuuggcacaggguggaaucuggucuggcuugggaggugauauaggcugagaugccaucucuccacugaccacucagcuaacaccuucuugaguuacaggcacuagagauauggagauggaagaagagagagucaguguccucagggucgaggugaagaagacagaugaugugccagugugaugugaucaaggccagccaaaaugacaacaugggaugaagguaugaugauggcccccaaggaaccugcccaggcugcugugggagcaccacaucuuagaagcagacucaaguccaucuggguaauucaggagcucccacugugugcaugguacaggggugacuucuuguccagagcaugcuaagaacuaaugucgaucugugccaggccuugggcugcaggcuuugaguagcuuccuguguugaauucuccuaagaaccuuauugugaucagccccaccuuagagcugaggaaaugggcucuuggaaguuggggaccccgauucuccauucacuggacuauuucacaaucaagaagaucggggacccaagagcaaauuccucugaggaacaggaauccugguccucuggaaauaguaccuuagaccuuauguguaugcaugggggugggggggugggugugcaugaccaaaguccuucaggugacccuaccauugagacaucuggcaccccugcuguguccuuuccugggugucuaagugucugcuuagcagggaaaggggcugcucugagauugaggaccucaucagcuuugaggccuuauuugcuuugcugauaugcuggcccuagagccugaggguagaggacucaaauucuccugggaauuuccccaagcuccugaagucuuccaauccuucccuugguuccaggaagaauugccucgagccauuucaggcagaggguugucuauacuuucaaaguuuucgaaggaguggaugaacccugaaguccuccuccggucucagcugguucucugcugcuacacuuuugugcucugucaucucuucccccgcugagcuggagagagaauguggcagcagagcccuccugauauuuaaagacaggacugagagacuccucagccacgaccaugugugucagucaucuugauucugggacacugcacagccacagcagccgcuuggcuggaagugaaggucaaggccaccaggcaucccguggccgaaccuggcuccuucucuuggcucccagcagucucauuucccccgcgggaagggcuauuuauagaacagaaagagcaguugcagccacacuuuaccccacgagcucaacccucugugccuuagagggaaaacuucccugcgggugacaccugugcacuggcaagacuuacuugggagacagauuuauaauaaacagccuuauuuuauagagccccaaauauuugcacaaaaaugagcccuugguauaacuugcuccauuuaucucccugcugucauaggguauaucucucuguuuuauuacuuuauuugccaguuccuccagcuucugcgcucaccccuccucuucauuuccacugcaguugucacucuggugggggggccccgucucuccucccugucacgcuucucccucugccugcuaguguuccauucccuccagcucacacaggggacuuggccucccuagggucccccuccauucccccucaggauucuagggagcagcaggaaugugucccuggggaaggacccucuuccaaaugccccccagucacccccgaggcccggcuuccuuuucagcacucuggacagcgcuccuggaggcuguugcuuuaagagacuuggccuucgccuugcaguccugggcugaccgguucggaggcauuuaggaugccucccugccucaucucuuagcauuucuaacaguauaagguaaacccugagugguuucuuaaccuccacgacuacccaagacgugggcucaagaacagagugagcagcguaugaaaaaaagaagugauuuuaauuucaaaguucugcugacauucaucaagugcucucaagguuuacauaaacagaacgcccugcuugaaauaucacuuugaauuccguuugugcaauggcaccucuaauaggcugcuguuuugguuucucucagcaaugugagccuuuguguuuuaauauucagaggcacaaggaacaggaaaauuauagcuggggaagcccaggcuggguucuucaucauccaaguuaaauuuggcugaauggaggaaaaacauccuuuuaaaagggugguaaaugggaauaauaaucucuuacauuuacaaaacacugaguauuuucaaagcucucucauauucauuaucuuguuagguuuucacagaaauccuguauaaaacauuccacaaagagcuauuguaggugcuggaugugaauggcaggccugaggaggccuucucagcaaauggagaaacugaggcugggggagggugagugacuggcuuaaggucacuccaugguggccaagccagggagagcuggccaaagccaggagguggccaugccagccauccgucuugcaggcugccuccucccugguaccucccccauggccccaaagugaccuuugucucuucucucauggaacacacauccuccaaacgaaguggccacaaaacccccucaccuggacuucuacccuuguaggagaauuaaagcccaaagcaaaaagagagaaucuguacaaguggcaacagucuucaucugcugagcauuggcuuugcaucaagaagcgugcuguacccuugacaugcacuauuucauuugacccucuuaacagcuccgggaaugcuuuuagucccauuuuauggccaagaaaacugauguucagaagauucgagcuaaucagugucacagcugcagccacacucaagcagccugcuccaaagcccgagcugccugucacuaugccauauauauacuuccuguuugucuccaaggacaguuuuuagcaucaguuggagggagggacuggugggguaugaggccugcauugcccuucuugccagcggcuagguucuuugccuccuguaggcugcugcuaggauggggaccacagcacuguggguucugacaucgcagguccuaaggcugccccucugccuggcacugaccuugcccuuuaagauggaagucaccagacugcaacugaugcauggccagggcauucgugcaacauuccaaucacuucagcaaacacgucguauggaugaauacacacaugaacgaaugagugaaugaaugaaggaagggaagagaaaaagggucucuuuguagguguguggaguggggcucugcagcaggaagaagcagcgguugggaaauguaacaccugcuguggcucaaagcccugguucugaacaggagaccccuguacccuccccccagcaguaucugaugggcaagggcccugauggagguuaaguggaugcagauggagccagggcuuucaggggucaaggugagugaggaggacaggagccucgggaggugggagcagcggggcugggggcccaucagaugagccugauuugauguucacagucuagccugggccaggcaggcugaugguggauugucccgggcugucucuggggguggugucauuuauagguucucgaaauuuguuacuguugauaacagugacgagccauaaacauucccaagugaggaauguuaauaacgcgggaggcauuuuuuaagugguggcuuuggggagccuucagcgugucagcgccaauggggcgguuguugucacugucauauaucugggaaguuauuccgggaaggucgcacggugacuugauugucauuacguacaaaauauuucaauuuuccagaagagagucaguucuggcaucaaugaaucuucaucucuucuccuuuuuaugucucccuguuugucucuggaaucugguuuugugugagcaggagauggacauaaauagguggcugaggcuagaaugggaagcuccacgccagagcuccaacaagggaggggauggacacauaggccagcucaggcucugggaggagcccccucucagccgccuuugaccccaacucauccauugcagccaaaccugaccuggacucagccugagccuucaggccucgggccuuugcugacauccucauuucuccugccaaaaucuccucuccuccuacucaccccucugggucaggccugcccccaccaccaucccucuccucccaccccuaccucuggguuccaccuccccaaccacccaucgcuccccucagugcucuccucccacccaccccucugggucaggccugcccuccccacccauugcucuccucuccucaccccuccaggucugaccugcccccccaccaucucucuccucccaccugacacucuagguccggccugccccucuccaccaucgcucuccucccaucugccccuccagguccuacuugcucccccgacuccucuggguccagcuugccccaauacccaucgcucugcucccacccaccccuccaggucccgccugcucccccuacuccuccggguccggccugccccgcccccgccaucgcucuccucaggcugagagccaugcagugugugauucaucuggcacuucaucacgagcuuuccugugccccggcucccauucccugcuuggcaaugggacuuaaaucuuguucuauuuaacuuguccccaauuugucaccaccuccuugugggcaaggaccaugccauaaacacucccgcagguccuggagggggcugguugcugccucugcgccuccgugcaucuuuucccugcagccuggcucagcuccagggauuguccaaaacccagcucuggcuuuacggccugggggaccacccaggccaggcugggccucuccugugugcucugcaccaguccaugcccaccacucaggacccuccucccuacuugucuguccaucucacucagcacagugcugggcacacagcugggcuugaaaacguaagcagaugaaaggcaggugucgggagggggucagugaggacucuggcuuugcucuauguuccaguuccaaggcgacuugccaacuguguggccaaacacucaucuacaucccaucccgggguucccauggauuagacacaauuucuuccugcucuucucuccuggucccugcaauccuugggucauggguuuggugggcaccugcugaugccugggguacggauauaaaacugcuaaggugagcuaccugucuuugggaaacacacucccgguuaagacuggugcacauggaaagguucaugaagaacacaggcccuucugguggcgaggaccaacccacagggugauggggacuccuggggagcaggcccuccaagaggagggaauugaggcccagaaucuguuucugcagaaucacucccaccgccuuccucucacccaaaccuuuuucuuugaaaugcccucuuaaccugcaaagggugguuuuggccccaagagccccagugggauggccucagccaucugugugcuggccuugcuuagagcccugucucugagugguccacagucuccugaaaugucagaauggcugugccuggcagccaucacuccaugcacacugugaccccugcccuuccggcccagugagcucggaguggugauacggacaggaggcaaggaaauacuggguagaagagggcaguuccccagcaaaggccccgcccucaagccuggaaaccugcagcccuaaaugggaacaggcaauccuguuucugcgcccaaauguugccuuuuagcccaccgugcccuccuauccuguacucauauaaaccccaagcuccaggauccacagacagaugagcagaggggcagaagaguggcacaguggcacggcagagaaagagaaaagagaaggagugucuaaacgucgagaggaguuuggcuggggauaguuggagaggagaucagcuucaggaugaccaaacuccaggggaaaaucaucuucccacuccaucccuuguccagcuccccauccauccugcugagagccaccuccaccacucaaucaaauccccacauucaccauccuucaaguccgugugaccugauucuucugggauaccggacaagaagcuggguaccaagagggcaggguguaaaaggcugucauccugacucuccacugagcugguuuaacacuuagcuguccguggauggcaacugccaaaacagcauuaauuguaacacaccucuagaugcuaccauggggccagagcccaaaagcacuugcccaggcuccugccccugcccaucucugugcacccccucccagugggcgcauggcagcugccaagaaaaugagccauaccccguugcaagucucuugacggggucagggaacucucccauuucagugggucaggucagcaccucucaggucaagacagggggcuuggcaaggcacagagaagcuccaggcggucccccagcacuggccccugggcagaggugggagugaggggcagccugaagcagcagcugcccccaccuuacccuggcagcgagugcaggugggaaaggccggcugagccugggagguacaguaagggucugauaguaaggcuggagagagccuccugcugcacacagcucuugucagacucuuguuggcaagcuuggccccccagcagcccagguggcauguuccaacaucaggcaccacuuggcuccugcucucucacacccacccgggucaggcucaggcccucgggcuagagggaauccucuccuuccugguccucgcucaaaccuguucccagcauccugcuccucuaaccuggccuccuccuggacucagauacuuugguccaagcccuuuggccagaggccuaggcugugcagggaaggcaagggaggcacuugucuuggccacaaaauuuaagggggugccagaaaacucaguaacggagauaauguuuagugcaauauucuaaaaaguuggaacuguugugaaaaaaauccacaaugaacaaaauaucaacgugauaaauaaacacagacucagcagccccccaggcugugggcccuggucucuuauccccaacucugcaccgagagcauggacuaggcccgcaccauggcccagcucucuucugcauggccccgcgccuuccucuccacagucccggagguggguacuuucacucugccugcuuuacagaggagaaaauggacacuucgagaggcaaggugauuuguccaggacugcacagguugcaaagggcagagcuaggggucucaggccugggccugcgucuuggccacuuagcuuccccucugccugggggccugggaccuggccucccguaguuaccaggacugggaagcccuggccuuugccccucaugcugcuuucuugagguucaucuggugcucugaggcgcuauuugaccuccacucugugcugcugcugggccuggcugcaccaucagggcaaggacccauccuugccuuaggggcucccaggccauuuagggaagaaagaaaaagccauaggccuucccagcuggggcugcaucuuguuucuagggaggggcagaggccacuucuggucuuguggcuccacucccucccuucccuggggucaggguuauggaugggcaccccccugcaacuguugcugacaggccuauaggaggggccacggagucugcccccagucacuuuugaauggcagaaccaggcuagaacauuuguggcauuagggauuuaaccugcuaggccacagaggagaaacugaggcuggggggagggucacggggcugauugacuguggcuggucuuguuugggauugcauuccuagugcucaacacuaggaauucccuucauuugacccauguuuauuaagugcaaguucagugccaagcacaaugugcaggagccaggcagguccuggugauggagcagacuuggccuuucccucagggagccaccgguuuggggacacagggacagaacaggacccagauaucccagcucuucucgcugagccuugccuuuaaugucucuaugugcugaacaggcuguguauguauuuaugaggucauguuuggcugcugccacugccaugugagcacaugugagcacguguguguguguguuuuugcacaaccccuggcugggcugugcccuccaugcuucuccguugcagaaucuggcagagaaacgucccugagaagcagcucccccuuugcaggcugcacagcucccuccugugagugcacacacaguguggacagacccggcaggugcuguauuucagguaaagagacuuggagaccccacaguuuacccucucauuucacaaauaagagaaugaagaccaggagaggugaaguaagagcaguacauaauaauccgagcuuccauguuuggacucuacccggaugccaggaaccucaguuccuggcacucacacguguucacaggugcccugcgggagggcaguucccaccuggcuuugcagacaggaaagagaggcucagagaagcaaagugaccugcucaaggucacaccaccuguggguggaagagaucugggguccaggggaucugacuugaggcuggagcuccaauguccucagcaaggucaccaggacaugggugacagccaggacccugcuccccuccccuuuugugccauggccuggcugaggcuggcucacuccugcagggcuggacuggagccugagagagggguggcaggcccugagcaucccugggggccuggaggcuggggccagggcuugccuucuggcugcugcucugcugcccucacugaggggcuuugauuugcuguuaacacccaaaguugagcagagccucaugaaucauucaugaaggugcuccagcgagaucauuauuuugaguguugagugucaggaaaacagcgucugauggguaaacaugaugucugaugacagaacagccgauggggugacccagcagccgggcaccugccaugcuguggggaauuuuuaaacauuaaaaaaaaauccaacccaggcucaaggaugagcaagccggcucaucauaaaccccugucuguggcuaggaggccaggaggcaaggcacaggcggcagggcuaggccgguagugggaaggggccagaauguccugggaguucagacccuguccucuggcaggaagugacucagcacugcccccaccccugcggggggcccagccugcaucaggagacuccuuuccaauccacaacgcaggccuccuagccagacagcuccugcccucacuucugcuuagaauuuccccauagaauguccuucuagaaaaggccagguagggcucaagcucccauccauucaucuuggaccaugccaagggccuggcccuucuugaagagccccuguucagccagagacuggaccuguggccggcugaggccccuggggcccucccacgcuucuggcucugucgaagccacuuucaagcagaugacagauugucaauaacuucacuaccugcauuauuuaagcagaacaaggugagccucugcugcacccuugagcucagaucaaacugauggccaguguggaagcuacaagcaaucagauuuucuaaggagaaagagaugccaaggggacagacacaagccaaauggggcuccugcauggcuccuucccugccaucagccucucauggagccccaaucccuuucccugggcuggggacagugaaacaggcacugguguuaugcaguccugggccccagcuucuuucucaggccuuuuuugucuccuuucaggcccuggcucuuaguagggaaggugagugcuaaggacaugugccugcuccagaggaggguucccuggcccugagcauuccccaggaacuaggccugggaggcucugcccuggcucuguccaauuugucucuguaggggcuuccuggcagcaccuccuugccucucccaucuaccaccugcaugaccuuggucaggucugggccugcuugacugucacaugcuuccuguccucucugcagaucagcuuccucaggucaccugggcagcaucugagagcucagucagaggagcgggcaggagagccaaggucugaagccaggagagugcaccccugccaugggucagcagcugcacuagcagagcaugggucuccugcaggggccagaaaaauuggcuccuugacccaguugaggacaggggcucaggaggaacuauggaggccagagauggaaagaccucuggggucucccugcaacuagcacaaggacaccuucuacuacaccugacagcuuccuuuuccugacacuuccagggaccaugacuugcucccuuuccacacagucuacuccaacaaaagccaacuggggucaguagaaaguucuuucuuagccugaguccaaaucugcuucucuauagaaucuacuaugauuuuguuuucuggauccacagaagauacgacuccacucuuuaagaugugacagucuuucaaagauuugaggaaagauucaugccacuuuuccauucacacauucauucacucaacaguccaucugucaacccaccuacucaccuauccauucacccaucugccuacccacccaccuauccauccaaauauuuaucuaucauccuccaaagaauccaccuauccacacaucuauccacucauucucccaccccuccauauaugcacuacccauccacucaucuuccauccaucaaccccuccacuuacucaucuauugacuaucuauccaucuauccauccauccauccauccacccauccauccauccacccaccuaucauuccaucuacacauccauccauccauccauccauccaccaguccaccuauucacccauccauccaucuacccauccaccuaucuuccaucuauccauugacccauccauccauccacccaccuaccauuccauccaaccauccacacacccauccauccauccauccauccagcuacccacccauucacccauccauccagcugcccauccaccuaucuuccauccauccaccuacccauccauccauccacucaucauuccauccaaccacccaucuaaccauccauccauccauccauccauccauccauccauccuuccaucuacccaccuacuccuccauccauccacccauccaaccauccaugcauccguccucccuucuauuuaacauguauugagcaccuguuguuaaaugcugauaccacucugaguauuaaaagaagcaguuccuggcuucaaggagcuaacucuccuggugcugaggcagacaugugacuagggucacacaaugacuugagugcucaacuagaggaauguagacagcaucuaaggauccugcagcuccacacuccccauuuccuccccagccaucccaggggcuccaaaccccuccucacccugaugauccuuuggauggcuccugggcuggcgcuguccucucucaucagugggacaggccucuccuaggguuugagguuggaggugggaaccauccuccauguucccauccccuggagaggaggacacgcuugugcugugaacaugcaacauuuuccucccagcucuuucacagaucaugucuggugcuuuucgaugcagcaaagaacauuucaaacgagucccuggcaggcucaguugggaaguucuuuuggccacuuaaaaucucagccucugaauguaaggcaugcuggcgguaauuguucaagaaaauaaaaugaaaacagauacagcaaguuucugguuauuuaucagcuguagauauaggccacuuuucaucaugcugagccucaagaaaagauaaaagcacgagaauugaucugagccucuagagggagugucacacauugcugcccaacaagugccaucuuaaaugaaccacuucccagccugcaucauggccggcagcugcugggucucaggcccugccccagccacuccuuggaccgcuggcauccucuggcuguuuccuaagcacccacagaggcaucugucagccccugccugggaagaaggugcugagagucuggaccuggggaggauuuugcuucaggaccagggcugggggcuugaccaaugccuccaccgacuacacuggucagucuccucccagacuugccagagugaccucuuuauucucugcucaggggccuugauuggaucacaugacucaggggcagugggcucugagaugaagccuucuacaagcucccccgagggcaggagggcagggauggagccacagauccaagggaggacagugucaccugagagcacuuuguugucccucucugugaugugucagcuugacuaggccacagaacccagcccuucuggcggucacagugaugguccuuuuuagaugagauuaauauuuaaauugggggguggagccaagaugaccaaauaggaacagcuccagucuacagcuccccgcaugagcgacgcagaagacaggugauuucugcauuuccaacugagguaccggguucaucucacuagggagugucggaaagugggugcaggacagugggcgcagcacaccaagcaugagcugaagcagggcgaggcaucaccucaccugggaagcacaaagggucagggaauucccuuuccuagucaaagaaaggggugacagauggcaccuggaaaaucaggucacucccacccuaauacugcacuuuuccaacagucuuagcaaacggcacaccaggagauuauaucccacacauggcucagaggguccuacgcccacagagccucgcucauugcuagcacagcagucugagaucaaacugcaaggcagcagcgaggcuuggggaggggcgccugccauugccgaggcuugaguagguaaauaaagcggcugggaagcucgaacucaguggagccuacugcagcucaaggaggccugccugccucuguagacuccaccucugggggcagggcauagccaaacaaaagaaagcaauaaccucugcagacuuaaaugucccugucugacagcuuugaagagaguagugguucccccaucaugcagcuggagaucggagaauggacagacugcguccucaagugggucccugacccccgaguagccuaacugggaggcacccccuaguagggguagacugacaccucacacagccggccggguacuccucugagacaaaacuuccagaggaaugaucaggcagcaacauuugcuguucaccaauauccgcuguucuguggccuccacugcugauauccaggcaaacagggucuggaguggaccuccagcaaacuccaacagaccugcagcugaggguccugacuguuagaaggaaaacuaacaaacagaaacgacauccacaccaaaaccccaucuguacgucaccaugaucaaagaccaaagguagauaaaaccacaaagauggguaaaaaacagagcagaaaaacuggaaacucuaaaaaucagagcaccucuccuccuccaaaggaaaccagcuccucaccagcaacggaacaaagcuggacagacaaugacuuugacgaguugagagaagaagucuucagacgaucaaacuacucugagcuaaaggaggaaguucgaacccauggcaaagaaguuaaaaaccuugaaaaaaaauuagaugaauggcuagcuagaauaaccaauacagagaaagccuuaaaggaccugauggagcugaaaaccacggccucagaacuaugugaugaaugcacaagccucaguagcugauucgaucaacuggaagaaaggguaucagugauggaagaucaaaugaaugaaaugaagcgagaaaagaaguuuagagaaaaaagaauaaaaagaaacaaacaagccuccaagaaacaugggacuaugugaaaagaccaacucuacgucugauuuguguaccugaaagugauggggagaauggaaccaaguuggaaaacacugcaggauauuauccaggagaacuuccccaaucuagcaaggcaggccaauauucaaauucaggaaauacagagaacgccacaaagauacuccuugagaagagcaacuccaacacacauaauugucagauucaucaaacuugaaaugaaggaaaaaauguuaagggcagccagagagaaaggucggguuacccacaaagggaagcccaucagaguaacaguggaucucucagcagaaacucuacaagccagaagagagugggggccaauauucaacauucuugaagaaaagaauuuucaacccagaauuucauauccagccaaacuaagcuucauaagugaaggagaaauaaaauacuuuacagacaagcaaacgcugagagauuuuguuaccaccaggccugcccuaaaagagcuccugaaggaagcacuaaacauggaaaggaacaacugguaccagccacugcaaaaacaugccaaauuguaaagaccaucgaggcuaggaagaaacugcaucaacuaacaagcaaaaugaccagcuaacaucauaaugacaggaucaaauucacacauaauaauauuaaccuuaaguguaaaugggcuaaaugguccaauuaaaagacacagacuggcaaauuggauaaagagucaagacccaucagugugcuguauucaggaaacccaucucacgugcagagacacacauaggcucaaaagaaagggauggaggaagaucuaccaagcaaauggaaaacaaaaaaaggcagggguugcaauccuagucucugauaaaacagacuuuaaaccaacaaagaucaaaagagacaaagaagaccauuacauaaugguaaagggaucaauucaacaagaagagcuaacuauccuaaauaauaugcacccaauacaggagcacccagauucauaaagcaaguccuuagagaucuacaaagagacuuagacucccacacaauaauaaugggagacuuuaacaccccacugucaacauuagaaagaucaaugagacagaaaguuaacaaggauauccaggaacugaacucagcucugcaccaaacagaccuaauagacaucuacagaacucuccaccccaaaucaacagaauauacauucuuuucagcaccacaccacaccuauuccaaaauugaccacauaguuggaaguaaagcacuccucagcaaauguaaaagaacagaaauuauaacaagcugucucucagaccacagugcaaucaaacuagaacucagaccacagugcaaucaaacuagaacucaggauucagaaacucacucaaaaccacucaacuacauggaaacugaacaaccugcuccugaaugacuacuggguacauaaugaaagaaggcagaaauaaagaugcucuuugaaaccaaugagaacaaagacacaacauaccagaaucucugggacauauucaaagcaguguguagagggaaauuuauagcacuaaaugcccacaagagaaagcaggaaagaucuaaaauugacacccuaacaucacaauuaaaagaacuagaaaagcaagagcaaacacauucaaaagcuagcagaaggcaagaaauaauuaagaucagagcagaacugaaggaaauagagacacaaaaaacccuucaaaaaaucaauaaauccaggagcugguuuuuugaaaagaucaacaaaauugauagaccgcuagcaagacuaauacagaagaaaagagagaagaaucaaauagacgcaauaaaaaaugauaaaggggauaucaccaccaaucccacagaaauacaaacuaccaucagagaauacuguaaagaccucuaugcaaauaaaguagaaaaucuagaagaaauggauaaauuccucgacacauacacucucccaagacuaaaccaggaagaaguugaaucucugaauagaccaauaacaggcucugaaauugaggcaauaauuaauagcuuaccaaccaaaaaaaguccaggaccagauggauucacagccgaauucuaccagagguacaaggaggagcugguaccauuccuucugaaacuacuccaaucaauagaaaaagagggaaucgaggggaggggaagggaagggaggagggagggagggagggaggaaggaaggaaggaaggaaggaaggaaggaaggaaggaaggaaggaaggaaggaaggaaggaaagaaaauuggaaaggcuccuccucucccucucccuccucucccucucccuccucucccuccucucccucucccucucccucucccucuccccacggucucccucuccccacagucucccucuccccacggucucccucucccucucuuuccacggucuccuccugaugccgagccaaagcuggacuguacugcugccaucucagcucacugcaaccucccugccugauucuccugccucagccugccgagugccugcgauugcaggcgcgcgccgccaugccugacugguuuucguauuuuuuugguggagacgggguuucgcuguguuggccaggcuggucuccagcuccuaaccgcgagggauccgccagccucggccucccgaggugccgggauugcagacggagucgcguucacucagugcucaauggugcccaggcuggagugcaguggcgugaucucggcucgcuacaaccuccaccucccagcugccugccuuggccucccaaagugccgagauugcagccucugcccggccgccacccugucugggaagugaggagcaucucugccuggccgcccaucgucugggaugugaggagccucucugccuggcugcccagucuggaaagugaggagcgucucugcccggccgccaucccaucuaggaagugaggagcgucucugccaggccgcccaucgucugagauguggggagcgccucugcccugccgccccgucugggaugugaggagcgucucugcccggccgcaccgucugagaagugaggagacccucugccuggcaaccgccccgucugagaagugaggagccccuccgcccggcagccaccccgucugggaagugaggagcgucuccgcccagcagccaccccguccgggagggaggugggggucagcccccugcccggccagccgccccguccgggagggaggugggggggucagcccccggcccggccagccgccccuuccgggaggugaggggcaccucugcccggccgccccuaccgggaagugaggagccccucugcccagccaccaccccaucugggagguguacucaacagcucauugagaacgggccaugaugacaauggugguuuuguggaauagaaaggggggaaagguggggaaaagacugagaaaucuaaugguugccaugucuguguagaaagagguagacaugggagacuuuucauuuuguucuguauuaagaaaaauucuucugccuugggauccuguugaucugugaccuuacccccaacccugugcucucugaaacaugugcuguguccacucaggguugaauggauuaaggguggugcaagaugugcuuuguuaaacagaugcuugaaggcagcaugcuuguuaagagucaucaccacucccuaaucucaaguacccagggacacaaacacuuuggaaggccgcaggguccucugccuaggaaaaccagagaccuuuguucacuuaucugcugaccuucccuccacuauuguccugugacccugccaaaucccccucugcgagaaacacccaagaaugaucaauuaaaaaaaaaaaaagaaaaagaaaaagagggaauccucccuaacucauuuuaugaggccagcguuauccugauaccaaagccuggcagagacacaacaaaaaaagagaauuuuagaccaaugucccugaugaaccucgaugcaaaaauccucaauaaaauacuggcaaacugaauccagcagcacaucaaaagcuuauccaccaugaucaacugggcuucaucccugggaugcaaggcugguucaacauacgcaaaucaacaaacauaauccagcacauaaacagaaccaacgacaaaaaccacaugauuaucucaauagaugcagaaaaggccuuugacaaaauucaacaacccuucaugcugaaaacucucaauaaauuagguauugaugggacguaucucaaaaucauaagagcuaucuaugacaaacccacagccaauaacauacugaaugggcaaaaacuggaagcauucccuuugagaacuggcacaagacagggaugcacucucucaccacuccuauucaacacagcguuggaaguucuggccagggcaaucaggcaggagaaggaaauaaaggguauucaauuaggaaaagaggaagucaaaucgucccuguuugcagaugacaugauuguauaucuagaaaaccccauugucucagcccaaaaucuccuuaagcugauaggcaacuucagcaaagucucaggauacaaaaucaaugugcaaaaaucacaagcauucuuauacaccaauaacagacaaacagagagcuaaaucaugaaugaacuccuauucacaacugcuucaaagagaauaaaauaccuaggaauccaacuuacaagggacaugaaggaccuuuucaaggagaacuacaaaccacugcucaaugaaauaaaagaggguacaaacaaauggaagaacauuccaugcucauggguaggaagaaucaauaucaugaaaauggccauacuccccaagguaauuuauagauucaaugccauccccaucaagcuaccaaugacuuucuucacagaauuggaaaacacuacuuugaaguucauauggaacaagaaaagagcccgcaucgccaaaucaauccuaagccaaaagaacauagcuggaggcaucacgcuaccugacuuuaaacuauacuacaaggcuacaguaaccaaaacagcaugguacugguaccaaaacagagaugucgaccaauggaacagaacagagcccucagaaauaaugcugcaugucuacaccuaucugaccuuugacaaaccugacaaaaacaagaaauggggaaaggauucccuauuuaauaaauggugcugggaaaacuggcuagccauauguagaaagcugaaacuggauccccuccuuacaccuuacacaaaaauuaauucaggauggauuaaagauuuaaauguuagaccaaaaaccauaaaagcccuagaagaaaaccuaggcaauaccauucaggacauaggcaugggcaaggacuucaugucuaaaacaccaaaagcaauggcaacaaaagccaaaauugacaaaugggaucucauuaaacuaaagagcuucugcacagcgaaagaaacuaccaucagagugaacaggcaaccuacagaaugggagaaaauuuuugcaaucuacucaucugacaaagggcuaauauccagaaucuacaaugaacugaaacaaauuuacaagaaaaaaacaaacaaccccaucaaaaagugggcaaaggacaugaacagacacuucucaaaagaagacauuuaugcagccaaaagacacaugaaaaaaaugcucaucaucacuggccaucagagaaggaagcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguagaagucaguguggcgauuccucagggaucuagaacuagaaauaccauuugacccaaccaucccauuacuggguauauacccaaaggauuauaaaacauacugcuauaaagacacaugcacacauauguuuauuguggcacuauucacaauaggaaagacuuggaaccaacccaaauguccaaaaaugauagacuggauuaagaaaauguggcacauauacaccauggaauacuaugcagccauaaaaaaugaugaguucguguccuuuguaggaacacggaugaagcuggaaaccauuauucucagcaaacuaucacaaggauaaaaaaccaaacaccacauguucucacucauaggugggaauugaacaaugagaacacauggacacaggaaggggaacaucacacaccggggccuguugugggguugggggaggggggagggauagcauuaggagauauaccuaauguuaaaugaagaguuaaugggugcagcacaccaacauggcacauguauacauauguaacaaaccugcacauugugcacauguacccuaaaacuuaaaguauaaaaaaaaaaaaaguagaugacggguugauagucgcagcaaaccaccacggcauauguauaccuguguaacaaaccugcacauucugcacauguaucccaacacuuaaaguaaaauuuaaaaaaauuuaaaaaauauauuuaaaucacuagacuuuggguaagcagaugacccuccauaaugucagugggccucaaucaaucauugaaggucuuaugcaaaaaagacugagguccccaagaaagaagcaauuccaccagcagauggcuuucagacucgaccuacaacaucauuucuuuccuggucuccagcccguugaccuacucuguagaauuuggagccccacaaucaugcuccucucucucucucucuccauauauauacacauccuauuaguucuguuacauggagaacccugacuaauacaguucccacccaggaaacacaucuucugcugcagcaacccuauggaauacucagggguugcgaaguucagggccaagcucucuuuuccuuccuguggaggccucggggccagagucaacaaucaaucagccagucaauaagaagaaaaacucgcagugcucccgcuacuuaucaaggcuucacucugugcaaaacacugagugaacaucacaggcgucagcucaucuuguccucgcaccaguucuaggaggcauugcucccauuuggaagcaggggaaaugaaaacucaaagaggucaagcaccuugcccaaggucaugugcagcuaguagcugguagggucaagacuugcacccagcuuuguccaagacccuugccuacucagugggcucguguccacuggguaagugggcucguguuugcugggugccuggggagagcagguugguggacgucagcaaggggcaauagaaaggaugaagaugccaacaauguccaaggccuggggccacaaggggauuacagguggagacacugguacccuggaccaguccucagucuccugggcugccagggggcuccgccugucucaagggcaucaguucugcucaugcuaggaguuacugcaugucugucaucuugucacucucuccugcagauagagacauggguggggguggggggaugaaaucuacaaagccaugucaaguugagugauugugcaguggcucacugccccucacugcuccaggaaaggcaauaaagcuaggagaaccaauaaaagcaagugccguggggcuugacggauuuggcuguccccagcgggugauggccaauucaaccacagaggaaaauggaagucagagcaaaccaguccagggagcgagugacccugagaagccuggcacccaucguucaucugaggagcaggcaccugucagccugggugggagcaggccuugugcauggcccugaguggagggaaggccacagcacagggcugugaguggccauggggagugcuucacggccccuuggacagggaagugggcaccugcggccagcacaggacacacagaagaguaggagcaggcaugggggugggagaaaugcugggcagauucggggccaagaagccugagucaaacuauaucuucugagcugaucccuuguucccaagauccagcugcaccuggcauggagcugcccucuccauuucuauccaggccugggucacccagccagcaugcuggauugcaguggguggggcagacaggccccagcuuugucaccucagagagccuccugcuuccccugaagcuggcuccugggcacugaugccccacuugcaccagccacucggcucugcuuccucccacccucaucugcaggcagccaagccuugucacuuauugcagcggccccucccugacuuuccacccaucuucaaggacagagggagcaagacggauggggacagugaagcuaaauugcccagcuugcuguugcugaagccgggguccccaggaagccaagaggaggcagaggcugaggcuggucaagugucaggccccuaaucucauccuggaagcuugggaggcugcacguuccuugggaugucauccuuuuggcuagauugggaggugugguuguggaaaguggccacaaguaacugugaugcccagguggggugggggguuccgccagggccaugaaaacacaacagucagaccucaacacucagaucucuugagcucuguaaccucaggcaagccuuuugcauuuccucaucucugaaacaaggcuaacuccauguagcuucuuauuaaccagccugggccucaguuuccccaucucuaaaaugggggcaaucucacuggugucaccucagaggguuguugugaagauccaguggcuucucagccuccagggucuggagcugugccuggccugugcagggcauccccggcgguguccgggcuccguggugcugaagcagaaucagccuccagauucagcagagccgcgggaggaaacagcuucccaccuucuucguuuaaagaagaaccaaauuaaggcacuaaguuuauacauuaauuuugcuacagacgggagaacugaaauagcuuucuaaaagguauuuuuaaaaacugcuucucaaugcuccauuaaagggcucucugccuugccucggagucucugcagcugccaaaaauacgaugaaaauuacucaaaugcagacuuuguuggcucugaguuugccaacuugcuucagauaaucugaaagcugaucacauuugaucugagacacaggcgcucuuuuggaucaauaugaugauccagggcugccucgaagugcgcaccgcaccccuuuguuuagagauccacccaggaccccuauccugaaagaccccucuucuuaguuuauggaguccccaucaucagcuccauccaagcacccuccgcuuccugucucaugaccuaagauguugggguaucccagcucagucuuaggccucuccucuuuuauugggugaucccccaucgccugacccuugacuccuucauuccugaaucacauuccaacuucaccaauuccgaacccauagugcucacugccugcuggaucugucuacccagaucuccgacaagcaccucgacugcaauaugacccgaggggagcucuucaucccgccuguuccccgcugggccucccuuucugaggacaagaaccuuccaugcagcucuucaagcucugaauccauguguugcucugaaguccucucuucgucuuaacuucacauccaaaccaucagcauauuugucaaccuugccucaaaauaggucccagaccucuguccuccucuccccacccugcucugcccuggugcagucaccacccucucuugucuggacccugagagggccuuccaguagcucugcaggccgccagcccagacuuugcaaacaaccauguugcccaaagcagccagagggagcuuuuaaaacacaucaaucagaucaugucacugcccugcuugaaaugccccaaggcauccccugcgauuugaauaaaacccacacacucugcccugugcccagggcuugcgggucccuuugcucaccagcucugccccuguuuccuuucuuuuuccuuccucccagccuuggugccuuuaccccggcuggucccccugucuggaacauucuuccccuagguccuuaaaaggcugcuucugugccgcagcucaaauaccaccuccucugacaguccuucuuuucuuucuuccuuccuuccuuccuuccuuccuuccuuccuuccuuccccucccuccuuucuugucuuuucuuucuuuccuuucuccuuccuucuuuccuuccuuccuucuuucuuucuuucuuucuuucucucuuucuuucuuucuucuuuccucucucucucucucugucccucccucccucccucucucuuucucuuuuuuguuuuaacagaaucucacucuguugcccaggcuggaguguagugguacgaucuuggcucacugcaaccuccaccucccagguucaagcaauucuccugccucagccuccugaguagcugagauuacaggcacaugccaccaugccagguuaauuuuugcauuuuuaguagagacgggguuucaccauguuggccaggcugcucucgaacuccugaccacaggugauccaccugccuuggccuccuaguguuaggggccagguacagugguucacgccuguaaucucaacaguuugggaggccaaggcggguggaucacuggaggucaggaguucgagacuagccuggccaacauggugaaaccccugucuuuacuaaaaauacaacaguuagccaggcgugauagugcaugcucguagucccagcuacucaggaggcugaggcaggagaaucgcuugaacccuggaggcagagguuguagugagccaagaucacgccacugcacuccagccugggugacagagugggacucugucucaaaaaaaaaaaaaaaaaagugcuaggauuauaggcaugagccaccucaccuggccagaguccuuccucgacccuugaucaggaaagcccacaggccuuauguguaucuagauacgcaucuagauagcauuuucuuguuuauuugcuuaucaucuacuucuucccacugggucaccaacucuaugagagcagagacuccaggacuccaaaugcccaagacccagaaucaugccuggcacacacucuccaauaaaucuugaggaaugcauaagugagaccuaggaccugucccaggugauucacugugcaagauaugcuguuucucccccuggaaugucuugacuggcaaaacccggaccuuuaccgagccaucucuggcugcuuucaggccuggaugagaaaucacugccccagaguggaguggcaugaaggagcuuuaacaggcucagauggcaggauggcauaauggcuuuugggauguaggcaccugaagcccaaucccaccaucuagaugcugugggacuuggacacauuccuuaauaagccucugagcaucaguuuccuccuuggaacagcaguucugccucucggcccugcugagguuuaaugcaauauugcauuucaugaggucaugaugccugaucccgcccuaauguuuaacacauggccauagcuauuacuguuguuacuguuauagaggcugaggugugugaggguggggaggagcucucggagaauccucauuuuccaagguagaggaugcaggagaugcugguugacuccaugaggacacuguguguccuauguucagggcacagacaagcuuccgaccugacccaaagccucccagaggcaacucaugcagcaacgccuggacacuccccacucauuccgcacugguagguggcuugcaggacagcaggucuuucccacggcccugugucccuaagagucccugcccuggucaucagaggacccccagagggugcuggcccauuccaauaggacccuaccuaugucucaugcuuggaaucaucaccaauucaaucacuccaugaauaucuguccuguuccuguuaggaagcgggcaacacuacugcaaggugccaggauccaacagacccccagccuaccgaaugugccgcaggggaggcgcacuggcgagagagaugugaccagaugcugucugcugccaguccggugagcuagcacaaaggggaaggacagugauggcaaggacagugaugggcgugguuggggaaggggccuucaaagagggccacugagcugagaucuaaacugugaaaaguggcugggugcgguggcucaugccuguaauccuagcacuuugggagguugaggcgggcagaucaucugaggucaggaguucgagaccagccuggccaacaugaugaaaccccaucucuacuaaaaauauaaaaauuagcuagguaugguggcaugcaccuguaaucccagcuacuuaggaggcugaggcaggagaaucacuugaacccacaaggcggagguugcagugagcugagaucccgccauugcacucuagccugggugacaagagcgaaacuccaucucaaaauaauaaauaaauacauaaauaaacaaacaaacugugaaauccaggcagccacacaagucuagggaggcguggcgggcagagggagcugccagggaaaagcugugagcuuggcuuguuugcaggaaggaaaggagccagcguggccugagcacgguggaccaugggcagagagauccaaacugagacccgcggggcaggugggaaccaaacagugcagggcgcauucuggccagagugguaacuuggauuucacccugagaacaggagucacgggagggauucuaguggccacugacccuccaaaugggaggguuucccucuuguuaucacaagcccuuucuugccauuugauuugcuuaaacaaugaagaacugauuagaaguuuuaauuauuccuggaaacuuugaggccuuggagcagugugcaaaggccuaguuucaauguuuuacaguaacagucuguuaacaaauuccagacuuaauuuauccaagaacuuguuaaaauucccucugugcaaccacaaaggaaugggcuuuugaagucauuuacuuaccaauaaauuacaauggucugaaaucauuagcagcaaaguaaauuguuuuaauugaucugaacuucguuaugacccagggccuccgauuuugugcaacugcacuuucuaaaggucuaaaauaacaaauuaaucucuuuugaauccugucaucuuuggaucgguccuuucucagagaccaggaaggaacaagaaucaaugguggguuaggguuugcugcagcgcccgggaacugcacagaaauacuucaguuucggagugagggucuagucccagguuacucuucccauuaugggggaaauggcagaccgcagagaacccagugucaguuucugguccuggguuguggucacacacuugauaaucacggaaucaccaguccuaucuguuccgugcacuuuucuguagguacaguauauaugacgauaaaaacaagagcaaaugugaaaguaaaaauauacuuaaaaauaauuagagagguuuugucuggugauccugauucucagacggccuccuggaaaagcccugccgucagcucuggggaaacuccccucucucucugggcucuucucugaugcugccagagucugacacccacugcccagucucucugagggugggcaaaggugccgguccuuuugaaagcaggaccauaaagugaccagggcugugcuuugggacaccucuaagguucuccccaaaauuagcgcugucugguggaggggagggaguuggaaugcuggcuggcugucagccaaccgcccaccccaaguaugcuagugggugggggcaccuccagcuguagcccucaugaaccacccuccaaggugcaggcagcaaagccagacugucucaaaucagagaugccagcccaaggggccacugcagguucccuggcccuuaauccugaagagccagcggggccugguuauauugugguggguagaugaguacagggucccaguacucauccaaacugcccccaccagggcccacaccugcucugacccuguggaaugugcugcucuaucugccugaaauuuuccuucccuuuaucucacugcuuccacguaagaggcucaggaucagcccuggccagggacucauagcagcagcagggccuugaugacucggagcugugcaugaauccuccuagagcugccuugauugugagggccguguugggggcuuauguccucaccccugccuuagggagaugcuagcccugggacacccuguacgggcaaauaggcaauguugaaguucagggcggagacuuccaggaaaaggauccaaacucagggccuggcccucaaguucuucuuucaggggcaagcuccaugcgaucguaccaagccagggugugcaaagggcuuuaaaaucccaucugcacacaaccccgccuugugcagccagcaagagggaggcugaucaaacaagaggaggccagggcugaagccacacagccagaagggcagccgggguuugaggcuaucacaacaguuuaucuuggcagcauugauggaggggccucgggagguaacugugaaauuuacaaguggaggaugauuugcaucugagaaaacccuccucuuauuauuccugggauaaaaggaacaucgaggcaagggcuuugggggucuguccagaggccucauccagccucccugucaauaucacuagaguagagaauuucuuuccuagaacguggagcaaaccuugcaggauuuaccccgcagaugcugagcgacagaggucgagggaaggauaucuggagccagcggagacaaccacugcuggucagaacugcaggccugcacagaaugacggacaccaugcgucaagccgucaagccacaagcgcugacugcucucaccaagaggauuugccuccccuggguccccaagcaucccacagucaagcuguccuccuucacuuggaaaugacacgaaaaugucacaggaaaauugacuugaggacaucugcuccucaacaccugaacaaaugcaggggacauguggggaacccugccacagcggccgggguguguagagcccccaggaagagggcaacacccaccccuacuugggcacccucuccuugguagaccugaggacaggcacaaugcccagcccagugcccaguaaaggccuggcucugccaggaggaaggggagggaccacaacacccugacccugucggcccucaagaaagaggagccuggggcaagcgucuuucuccagaagggggaaaugugauggcacuacaauucccuucccagcuaagcccucuucucacggaggaaacgaaugcuaauggaagcaguuaaaauggaaagggagucgguuuucuggcugcgcaaaauucugagaagcgauugaagguaaauugcuugguuuucaauuuuaagcugcacuuauccaagcacgaucagucuucccugaucguggcagaaaauaauaagcaccugaugcgggguugcccuggugcccaauaacauggugggacugcauccccauuucauuacagaagacagagugcacucuaagcaaguuuauugauaugauaaauugccccgucacuucccuuugggugaaucuccugccuggagcuguuggucccgcuccaggggcagguaccucacuggcagagagcagagguccaucuggccgugcugccaggagcccagucguggcccugggguugcccugcaagggagggaacaacaugggccacuguggcuggggcugcucagaucgcccuggccuggagcugcaugggacccgagaguccaaggucuggagucugcaagaccugggcuccacuucguggccuugggcacaccaagcucuucagcucagcugucaaauggagguggugauggcaauggugaggguuuugauaaaacgaugcuugcagaggcguuaguguagugugauuacgaagcccagggccuccugagccccuggggccaucccccgcccggaccaucccgacuguguguggcagagcaaagggcuccagacugcagagccaccucucaccagaccugacagacccgggguccccagcagggccacaccagcgugggugucagaggcagugagaacuggggcggggguugucuggccacaggagcuuguccugggguagggauuuuccuggcugagaggcagagagagaccuugccaaugggcagggccugugacuuucugugggaucccagcccuggggucuagucccauagccccagugacccagaacagcacccugggccacugccaggccagcccagugcccaccugcacgguggaggcugccacacgcacuugaacgaggaaugaauggccagggccaggcaccgauaggggaucaaggaccuguucucccagaagcuacagcugccaucugggccgagggaggcggguucuggggagguacccggugcuuuacguuuccuuccaggaaaagccauuucaucucugagccugaccucucaggucugcucucucugggggcuucucuguuccccaugacccucccauggggaaggggugccuccagguuccugccagccugagacaugacacugcagacccugguugcaggaggagagguuccugcagaagcugggcgcucgggggagcccaggugucugcaacccaucugagguucucaucucuaaacacuucagaugaagauaaauggaucugaaaggagcauaucccccucaaccauguaaacacaaggcagcagacgaguaaguaacauuaggccugacauggggaagcugcgagguauuacucacccugauaaguuuaauguauaauuuagaaacauaucaucaaaaugggaaaaaagggaagaaccucuuaaauaacucugaaagauauucagcgcugaaaucacgggcgguuagaguggagggcgugcugccgacucaccgcagacgcaggccccacacucccgguaauuggguuuagauggaucugugagcaaagcccuuuaggaaggaaagauucacccuuuccagaaguggggaaagggugggggucuaggguggggguaucugucuggccagggcucugccaggcacagcagggccgccugcaggggcggcggguggaugggcucaacuccaauaggcuaugaauucuucguggcggcugugugggccccccaccuccugccacagaggccucuucccucucaccuggucugggaugggaguggggaagggaaggcgugcagacagacagauagaaugacuggggaauaggaacaauucuaggcauugaaaccccuccccuucugggggagcugguggugggugcagguggucaugggggcgggggugguuggggacaucacagaccccugcccugguguaucugggcuacuuugaguccaccaaccccucuugaguggcacaaccccuccccuagccacaagguggggacguccccauccacacugcuauugugcuucucugcccgccccacagcaaggggcaccucaguuccaccgcagccaccgugggagccacaugaccccugcacagcauggggccccucugagccccuccuaucuuccuggucacaucucagggcugucgacagucccccaccccugaucccugauguggugaggacccagugggaccaggaggagaccgugucggcuggugugcccaggcggggguaugcuucuacccuuuccagguauuguugcccagcuggugagcugagggcagaggagugcuggggcaggagggaggcugcaggcccauggggacgggguggugccaguuaggccugggcccuggagcagggcuucacagccuggccugggcgcccaagucacgccuaggugucaguauuguuuggaagcugccaggagguucgguguggcugcaggguuuagaacuccaggcuggaggcugaagagugcccuuggcuugcagcaugggcuuuaucucgggccucuggggagcgcagauaaggcgccuucugcgauaacggggaggacuccgacauuugagccaaggacauuucccuaauuucuggacuuucgucuucagagugcguccacagccagcccucgaggcuuaaacucaagugcggauccccaccgcugggcccugagaugcagcugcagggaggggccgcccacacuggagggugcccggggcccugagggauggaugcagccaggugccuggcugggaguggagccuggcugggagugggcgccuuccuccuccuccaggcuccucugguucucauuccagcuuguucucaccaccuugucuguuugggaacugcccuggcuaccccagccuuuucccacaaucuuggggauuucuaccgcaaacuugucccugcccugugagugcaugugaggagcuggacccaggguccugggggacacagagaggaaggcucagcccagcugggaaccagacagguuuacauaaugaaagccgcaucgagaggggaggugggaggcaggggaggugggggcugagucuacuaaggccccgcagcaggaagcuggagguggaugagggacagaugagccgugucucuggccugucuguccacaagagagccccccucuaggauguaugaacugggcaccccgcauccuggccauuccccuccugccccuugaggcuaccuauucuuguccucccauggcccauuguccuccugcagccuccugcccuugcccucugcaccaguagccagcgugaucccauguucacguucuuucacuggcuccccuccacacucacggugaaaccccaaguccuuacaaugcccaugggcuggacccaucugguccuggucaccucuguagccucgucacuccuaugggaacccacuggaguaggcugggcuccuggcuguuuuucagagacuucaagcuuauguccaccccagggccuuugcacauacucuucccucuguuaggacugccauucccuagaucugcucccagcccaucccaccgcucucagggcucugccaggugccccuccgcagaggccucuucuuggcuacucuauccgcaacccucccguaccccuuccuuuacucugccuggcugucguuacugcauuuaucacuaucuuaaauuauauuacaggcccacaauccaauuccaaaauccauaaagcucuaaaagccacagcuuguucauaacucauuugguggcaaaacgugaccugaacugaugugaggcuacuuauagucucaguucaucccucuuugugugaauauucauaaauuuugcugcagaaauauuaaugcaucugauuauggggugcuacuccacaucccgccggggacauuacauaauauauggucuauguaccauauucuguuucuaaaaugcaaagucugaagucucaagccacguuucuaagccucggcacgaguacuggcgucguaggccggauaacuccaccgugggggcuguccggugcauugcaggauguuuacaguguccccggccuccacccaccagaugccacuagcagccccacccucagcugugacaaccgauagcaucuccagacacugccagauugccccaugugaggaccucuggucuagcuaaguacaccuggccuuagggguuucagaugaggggcugugcaccucucuccaguuauuuaucugcuuacaugaaauauaaaccccaugggggcagaaccccuguucuucuguucucugcugcauacccagcauccaguggugucuaccccagagcggguacuuaauucugacaaagauuccuuccuuugacuaaaacuuuaguuagggucuacugaguccucugcuugacucggcccaaacucgggcuucccucucugucgugggagaauccagugugagccacaauccugccgucagcuuagcagaaacccccaccuuaguaucugaccacccuccacaucaucuccuccuggccugccugcaggccuaauccgagcgagacaguucagccggaagcccccgacccuuggccauccucucagucagcuuccguccccugaugcccccugcuccuugcugauaaauccccacuucuccuugcuggagucagaguucagccugaucucucuccccuacuguaagaccccaugguggucccugaaccuacagucauggcgccccuggaauaacgucugccuuaucaucuuuaacaagcaucaugaauaaaguuuuucuuuaacaauacagaauuguggcacaaagaaagaaaguguuauaugauuccucuagcagaguccccacccuaaggguuuaucagaauguccgugacacccccucucugagcagaaugccauggacgccccauucuccaucccagcucaucuuuggggaugcaagagcacccgucagagcucagggucccaggggagcuucccagagcccagaucugaugccacucucacguggccaaccucagacuauugaucccuagggugaggacagugaucugggucuaccucccgggagacggcaccuucuaaguggcuggacacccacucaccguguggaguugaaccccccugugucuuccugugcaccugugcaggucugggcaccagggcagaccuuguggaucagaguggacuugggacgggacagagccuccagacgacccucagagucuggucacugccccccagaggcggcagagagugucagggauaagcucugggauguggcuuuuguccuggcagaaaugcucagagcagguuccacacaggggaagacugcuggguccuaccccacaccucguuccaugcagggccagccucugccugcucacaucuagcucucuucuggugcagcccgguccaccagaggacagccccagcaguuagucacaccuuccuuucauugagccaaaauccugcagcccccaccugcuggccccagcucugcuuccuagagcucagaguacccugcagcccacaguguguccggcauccucaggcugccuuacuucccaucguguagggggcugaucuucucggcuucccaggacaggccugguucagucucugcaccccuuccacacaccugggccucugcuuggcuccucccuccuuccacacacccccaugcaauguggaacugagucuucucuuccccaggaugaugggcagguuggggaagggauccccuuuaggcccccugcuaacgcccccugcucccugcugauaaagacagggcgcugccucaccacugggaugugcccaguccucagccucaccuucugguccuucuuagcugauggccacuggaagguucuggagcgugugcacuccaggccaaggagaccacacuuggagaagagggcucuuuuacacccagcagcuaggggcagacagacaggugauacugugcugagagaggacgggccaggguaaggucuggguuacagccaugaaacccaccgagaggcugcuauugugcccagggcccauuuccuucugguuccucaguccccagucuccugggugcacagcugccuggacagcugugugacacuucccagcucccucugcagcuagccaugugacucugcuuggccagugguuugugagcgaaaguaguaugugugaguuccaggaaguguucuuaaaaggaggggcugugccucucuccuuuguaguggcugggaugaagacacgauggcuggaguuagagcagccacacuggaccagaagcugcuggaguggauguuacagcaacaagcuagaaggagccugggucccuuggaaauugugcagucaccacacuagcccuugacugugucuguuuacagagaaaagagaaccuuuauccauugagccucuguuggcuuagauuuucugccacucacagcugaacccaaccccagagaauccagagcccaggcagaucuuccugcuggagacucguucauggacacacccaaggaugcaggguagggggugggugaaucagggcacugaggcccucaggagugggggaaggagaggauuuaggaaaucaggucaguaacgcauugcauuaucagaaggacagagagcucucugcaaacugacaggagagagcuccuuucucugagcaaccgccacgugggcuaucauuuauggcuguugcuguuuccuagcuaaagaggacccugccguugcuggggacagccuccuggagcacagacuccagcucagggaucagagccagcuccuccugcugcuggccuacgcgugaugugaaaguuacggaagcaacaaaugcugccuucuguccuccaggggaacguauccccagaaagccaacaagagcagagagacaagaagacggagagagcuucgccggcacacgaauaucaucacaccauccuugugggcugugcagcuuuguguaaacccuacaacagccaugcaaggaacacagacacauuccugcccucuggugacugaugaggagacugagacauggcuuaaaggaggagcucaaagccccucaguacagaguuagaaacuagaacugagcuguuugaacuccagaaacagugcuccuuccauuccagaaaauucccagcaagaggaugcuagcagccucccagugccagaaccgcaaaagcuccggugaggagcagaaaccuaggccacacguggcaggugugaacacuugccccuaauggccucaaggaccgcaaggcccacucuuggccggucccaccuccaaagagcuuguccacggcccaguggagggagggugcucuugucuagggccccugggucacaggucagcuuugccuccugauuucuggcacccagccccaccauuguuucuguacuuucuccaaauuaaaaacccauuguggcuguuccuagguaaaaagaguuaauuuucaauucgagugugugggaggguguccccagggaacagaguaaugaagccgcuagugcuaguugcaaaacaaauagaugaaucaauguuucaauuuucuccaugugagagaacggacacuguugcuuagcaauucagagaacguugcugcaggcccuucggaggcagccaugauugccaggaaaaaguuucugggguuccagccauauuggaaugacaaccaaacuuccuaucuuggggcugcagcugguuggugccagggaaaggggaugauuccaagagauaccccucaaacuuguccucucgcaacacggugcccagcagaugugggaggaggggcgggggcccucaggcccugcuuuucugaucugacgcuucccauggcuccccagugccccuggcaccgaguuaucaaaaaccacguaugugugguggcacuuuacuaagcucugcagucguuccauuuucucaacaaccuuuuaggguauuuucuauuauuaucccauuuacagaugaggaaacugaggcccagcgaggucaugugaccuucucgaggucacacagucaggacaggguguuucacaccauaugacucugaacccucuaaggaugggcuugugaugggcacggguuggaggagaucuugguuggggaggagauaaccaaacccuccaaagccagagucaaaugccaaguucccuccgaccggcagcccauccaggaagaccagcacaggagggauuuugcacagugcugggcacagccagccucggggccaggugcccagggaccuuuggugccaccgagaaugagcaguauuaucagucucugacacggcuguccccaaacgugggagggcuuggcacuuguuagugguuccuccaugugcggguguccugucugccaccuggcucaugggaagagggcugugugucucugaggucuccaugaugucuuccaugcccaaaguggggcacacuaccccugggaccucaucauggcucccaucagcccccucaccugucuuccuuccucucccccagaccugcuucaucugagccccuuccucccuggguuccccucauucacagggcuuccuuccagaaagcuccuccucuucuccaccugcccccauuccccccaacagcucccacgguccagauguggacaaccccccaggagccucagccuccacagccccagggggagggagcccuccuuccucuucuggucugaacacaaagaccuuggccaggagcucuucccgcugccucaguucacauaccaguguccucucggacugugagcccgcugugggcagggaugcucccugugguccgcaaggcccagcuccuagcugugugccuggcacaggccagaggccagaaugcaugugugaguugugaguugaccggagagaggguggauucagcugagcugccccaaguuuauggagcccccacuucucacagugaaugucacuugggugccacgacccagaucucagaacugucccagugacgcaggagaaggacauauuuuucuagaguucuguccagaaacuuaagaaaguggacuuuaaggcugggcgcgguggcucacgcuucuaaucccagcacuuggggaagccgaggcugguggauugcuugaggucaggaguucgagaccagccugaccaacauggugaaaccccgucucuacugaaaauacaaaaauuagccgggcaugguggugggcgccuguagugccagcuacucaggagguugaggugagggaaucacuugaaccugugaggcggagguugcagugagccgagauugugccacugcacuucagucugggugacagagugagacucuaucucaaaaaaaaaaaaaaaaaaaaaaaaagaaaagaaaagaaaagaaaguggaccuuagagcaaaaccaaauggaccucuuggcuugccaccuccaggugccgagaccuugggacauuccugaacucucugagcuuuuccugucuacacaacggcagguaauaacagcaccugagggcugucaugagguuccccaagcccacgcugccaugcccagggcccuccauccaugccaccaucgugacgguuguugcuguggcacagaucugcuuggaagccucgccaggcuggcaagacuucuccaggccaggccagggacggcaaccaugcaauggucaaaguguccaaaggcuugggcaugagggcuaggaggacugugaggguggaggggcagccuuggugccaccagaaagugcccaaucucccccaggcacgucccucuccauguggccucagccacugcccgucuguugccccaggucucaauguggccucuugauguagaggacagaccuuuccaccugucaaucccuccauaagccugaggcuucugcacucaguaaagcggggaggcugugcucccuggagcagggguaguggugggagagccucccacggggaugguaugaaugccuuugccacagcuguggguugaauguguccccuaaagcucauguguuagaaauuuaauucccaaugcaacaguuuugggggacuuaauaggaagugacugggucacaagggcugugcccccauacacgcauucgugccacuauugagagagugggccucuugcucucucucuugccacguagugccuccuuccaugggaugaugaagcaagaagcccucacagauggggccaucuguccaucuuggacuucccacccucuagaucagugggauucauacauuucugcucauuguaaguuacccagccugcgguuuucuguuagagcagcacaaaacagacuaagacagcuccauauccacagggcacggccauccauugccacggauaugggagccgcuuggaugcacguguccuuuccggcgacccugucgguaggggcggagggcaggugagccagcccuuccccaguggcaucugugggacccagccuccacaccgcuuggcccuugcccugggaacaaggggucuucccgagcaagcugcugugagagccuggcggggagggacacguggcuuuguccuuggugcucccggcucccuggaggacccagggccucggcuuucucuuuguggagaagccacuggauuguugaugugcaugacccuggagcaggccacggccccuguccuccccuccaacaggauccacagagggcaccugggugugaccaccuagauucuuuuagugaacuuuccuaaacuguguuucaagagagacaugaacagggguguguagggagaaaaaaaaguucccagguccucucggaaaucagggcucacagucaaaugcguuaggaacaugugcacaguaacucccaucauggggacucacaaugugagauuaacauauuaaacagucugggaaaacccaucaaccuuuguuguacccaguguucccugaacucaucugacggcagaauccuguuuuuguggggcagcaaauaacggugaccuucaacuauaguuuugaaaaugaugaucuaggccagggguuggcaaacuauaguccauaggcccaaaucuggcccgccaucuauuuuuguaaauaaaguuuuauuggaacacagccagugcauucaucgauauauugccucugguggcuuuucugcuacaauggcaguguuggguaguuucaacagagaccacaaagcagaauauacuaucugaccauuuaagaaaaaauuggcugaccauugcuuuaaauaaaaccuuaugagaccacuguaaagacaugcaggacggugugagugugaagaacaucaacccauuuuacaccaccgggagcguuugcaguuaggaaggaaauucaaugcuuaaaaaaaaaaaggguuguaggggcaucuccaaaacaaagucccugggcacgugucuagaugggacuuccuuccaggccggcuggugagugagaauggucagagccugugaaauucccgaccagucacaggcaaccguuagagggagccauggucugugacggugagaaggagugcugacacagguggccuugcuucccuccugaggggcugggagagguuggggcuacuccuuaaaguuuguuaaucugcaaaaaauaagcacaagggggggcccuuuucagugauggcacaccucguucuacacaccagaugaguuucuggagcacauagggaggccacaguccuagccaaacagaggugacagggaucugaggaacgucuccuccaggccucugaucucacagccaagcacacugggccuccgggggaggacgaugcuggcuuguugaucccucacaccaaucagucccaucuccccagugcagaggcacagcccaggcuacugagucccuuggguuugacucucggcuugaggaguuguggcguucagcaaagaauaaccacaaaggcauuagcuggcaucuauugaguaccuauucuuggcaccccaugcauucagccccuuucuccacuuucagagccauaagacagaucuucauuaacaaauucccuguaucugugauggccaaucccccguccuccuaccucucugcucugguggauccugcacaccccugccaggcaaucuuuccuacaauccgaccuuccuggggccaugcacucucucaaggaugguugcuggcucccuaguacugcuccccucagcugcagcacccgcucccaucacucuccaccguguggcaucucaauccauucugcaccucacaugucuuaguccauuugggcugugauagcagaauaucauagucugggugguuuauaaagaacagaaauggauuuccaguucuggaggcuggaaaguccaagaucaaggcaccaucaauucagugucuggugaggccccuuccugguuccuagacagugccuucuugcuugcguccucacacgguggaaggucugaggugucucucuugggccucuuuuauaagguuuuauaagggcacuaauuguauucacucauaaccuaaacaacgcuccaaauccccacuuccuaauaccaucacugugggggcuaggauuuuaauguaugaauuuuggggagacaacacaaacauuuggucuguaacaggaaggcccuuaauuggccuggcacggugguucacgccuguaaucccagcacuuuggguggccgaggcggauggaucaccugaggucaggaguuggagaccagccuggccaacauggaggaaccccgucucuacuaaaaauacaaaaaauuagccaggcgugguggugggcaccuguaaucccagcuacuugggaggcugaggcaggagaauugcuugaaccugggagguggagguugcagugagccgagauugcaccauugcacuccagccugggugacagagcaagacucugucucaaaaacaaaacaaaacaaaacaaaacugagccccagugcugagccuccugcagucaggcccgccuccuugcuccauuuccuugaucgccccucugccaccucccucccugacgucuccagggaagcaggaacuggagggcccucagaaaucacugagaauggccuugccuggcagugcaaauuccuucuccgaguggauuucccucagcuuuccucuuccccagggucucauccaauaagguguuaccacuuagcucuaugacaaguaaguaacaagugugccucaucuuucccugccuacaccugggccagacauuacuaaucaaucacugcacucuuucccucugagccagaacucagacuccuccuugauacauguuauuuaaagugaugaacccuuuuggccaugguuuugcuggggcagaaacugaggcccugggcagggaggugacuagcccaaagucacaugggcauuugaggcagaggcaggcuuagaucucauuuccuuucuccugccucagggcuguacacaugacaggccaucugcaaacucugguuccauguucuguaaacuggauucugccccuaagaaacaggaggaacuuagcuugauauggggccuguguucugggaggacgucugacccaccucccugccucucuguuuggugggagugauuuugaugcacuaaaaaacaaggaggccucuauccagagagacagagucggggcagugugggguagaggaauucagugcagaggcacagcucaggcuacugagucccuugggcuugacucucagcuugagguguuguggcauucagcaaagaauaaccacaaaggcaucagcugacaucuauugaguacuuaucauuggccagaaacagagcugagcacccaacaugaguuauuucaugugauccucaccacuauccaaggcaacaauauuagcccauucuacagaugagaccacagaggcacagacagaagcagaauccugcugcgucagaggcagggaaugugcaugaagcagcagcccagagcucaacaugcggcugccacuaggcuuagcacuauugcuggucgacauguccguccuucccugguggagcucugggacugggcugggguuggggcacggaccucucaguaagccaagagcuugugggucuggggccugcaaaaugaaacuggcagguggaagccaaguuggcuggaggugggaagccuggaacuuuucuuccaucucagccagccugacaccuggccucucucuaccugaccccugaaagucuaaagacuguccccaggaaggcacagacggcugagguuagccgguuggcuuggcacgggacagagcuggccaggcggaccucucugcaucgcgucgagaggaagcuaaauaaacagcccguguucucuggaaaaugacccugcugauccuggaguuaaaaauagaggcauauugaucguggcccgugcccagugagcguuagcagagcuucacuggcaaaaugaccggccugagucagccccucagguaauuuauuuuuccacucagcuggccagggagcaucccugcacauccugggcugugcaaacgaggugccacguguuccccaacaccacagcucacuugccagggcucccugaugggggcaaggggagugggcugcccuuccuuccuggguggguucaggcaccgccccauuuccacagucauguauaacgccuggcagugucugcuuggaaggucuguuuggcaggugcacaggaccagcucgcagcucccagcucccagcccuuggcucagagcucggcacaugguguugugucuuucuccuguuacucccugcacggcccacaugcugccgccugucggguggacaccugcagggaagcccugagagcccucuccuggcucagguaaauugagccuuuauggaaguaauuuguuaagaugaggucaugcaugccuguaaucuucacaccuugggaggcugaggcagauggaucaccugaggucaggaguuugagaacagcauggccaacagggugaaaccccaucucuacuaaaaauacaaaaauuagccgggcaugguggugcacgccuguaaucccagcuacacgggaggcugaggcaggagaaucgcuugaacccaggagacagagcuuguacugagccaagauggcgccacugcacuccagcccgggcaacagagcgagacucugucucaaaacaacaagaacaaacccaaaaaaacccaaaaaacgaugaugucaugcugcgguagagugguccuagaugcaauagcuggagagacacacuagaggcacccagggagaaggcccugcaaagacacaggccgagaucagagugacauagcugcaagccaagggguaccaaugcuugccaggagccagcggaggcggggaggccgggcauaggcucuccuggaaggaacuggcccugcuggcgcugugguuuuggacaucucuggacuccugcaccgugagagcauaaaugucugcuguuuuaagccacccggucagugguaauuuauuagggcagccagggaccacuguucccuucauagaaacaccauuaucuggauggcacggaagcagcuguggccccgcugagcacaggcaaaccucaggcugaccagcaguucacucuccaaagccucaguuucuuugacccuaaaaugggaaccauagucccacugcccaagaggguuugucaaucuguguaaacuccauggugugcccagcugcaaaggugcaagggguucuggggagcagggcccuggcacucugaggguuaaguagggugcuuugccagguuuuucuuuccccaguuuccaucgauccuuagcaugcuaacccuguuccugcaugccacuccauuagguuugcccagugcaagaacuugagucuuguccaggaguaaacccuucugaaccagaaaaacaaauauggcuuaaaauaagacauugcuuccugguagaacacaggccaggcauaaggcuuuggugaguucaggcgccggcugccuguuucuggaagagcuggggcugggcuggggcugagagggaugggcaaggggguggcuguccauacagauagcuggaucacaggugcgguuucuuaucagacugggcccuuggccagcccuggcagccuuuuaucuucgucuuccauuucccuucugucuuuagcaagcuuccuuucugcucuggucugaacaugugugucuucccccaaauuccuauguugaaauccuaaacccccaggugaugguauuaggagguggggguuugggagaugauugagucacggggauggagcucacaugaaugggaaugccucacaccuacaaccaucuaaucucugacgaagcugacaaaaacaagcaauggggaaagaacucuuuauucaauaaauggugcugggacaacugguuagccauauauagaagacugaaacuggacuccuuccuuauaucauauaaaaaaaucaacucaagauggauuaaagacuuaaauguaagaccuaaaaccauaaaaacccuggaagauaagcuagaaaauaccauucuggauauaggaacuggcaaaacuuucaugaugaagacaccaaaaacaagugcaacaaaagccaaaauugacaaaugggaucuaauuaaacuaaagagcuucugcgcagcaaaggaaacugucaacagaguaaacagacaacccacagaauuggagaaaauauuuacaaacuaugcuucugacaaaggucuaauauccagaaucuauaaggaacauaaacagauuuacaagcuaaaaacaaacaaccccguuaaaacauaggcaaaaggacaugaacaaacacuuuucaaaagaagacauacaugcggccaauaggcauaugaaaaaugcucaacaucacuaaucauuagagaaaugcaaaucaaaaccacaaugagauaccaucucacaggaaucagaaugccuauuauuaaaaaaucaaaagguaacagaugcuggugagguugcagagaaaaggggacacuuauacacugaugaugggaguguaaauuaguucagcuauuguggagagcaguauggugauuccucaaagaacuaauaacagaacucccauucgaccuagcaaucucauuacuggauauauacccaaaggaauauaaauuguuccaccauaaagacacacgcaugcauauguucacugcagcacuauucacaauagcaaagacauagaaucaaucuaaauguccacuaacuauagacuggauaaagaaaaugugauacauaugcaccguggaauacuaugcagccauaaaaaaagagcaagaucauguccuuugcagcaacauggauagagcuggaggccauuuccuaagcagacuaacacaggaacagaaaaccaacuacugcauguucucacuuauaauugggagcuaaaauaacaagaacacaugggcacaaagaggggaacaacagacauuggggccuaccugaaggcagaaggugggaggagggaaaggaucagaaaaaaauaguuauuggguacuauguuuaguaccugagugaugaaauaaucuguaggccaaaccccugugacacaaguuuaccaacauaacaaaccugcacagguaccccgaaccuaaaauaaaccauaaaaaguguaaagaaaaagaauccucauaaacuggauuaauggccuuagaaaaaaggccugagagauaucccuugccccuuccacccugugaggacgcagugagaagaugguuauccaugaaccagaaagcccucagcagacacuaagucuacugggaccuugaucuuggacucgcugcuuccauaacugugggaaauaaaguuugguuugaaagcugccuaguuuaugucauuuugcuauagcagcccaauggacuaagacacuuuguuuuccaugaaggugaaggcaguugggcacagauuguugcagagcaugcacaggccuggcucugggagggacaccuuacaccuuacagauacaccaccuuuaauccucacaaccuccggcgacacagaaaggcugcccaucuugaggcaacugaggcucagagugguuaaggagccuccugacaucacccagcugguucaugggggaggccaggcuuggauucugacucccaggcucucuccagucuccguacccuauccccauccucgcaugauaacacugauuuucccucugcgguggggggugauggagagcagaggugaggcccuucaaacccaccuggggaagcaggggucccaggcagggucugugcugacacagcaggaggcugacaggaccuuggccuuggugaacagggcagugccaggcucagagaacaaacuggaugaaccaaccagcaaggcaccccugccuuccacuuucaggacaaaguucaauggcacuagaggacuuuccuuaauuaaaaguugauagcagaacagccuccaggucucuggcuggggcccaugugcagccaaacuccugcuggugacugccgacauccugggccagcccuuggcacaugcacgggcugguccggguuugccccuggcuuccuccuccccgugcuuccucccuccacccuuccagcuuaagcaauaaguucuccggcccucucugaaagggccccaauucagguuacaguguaauugaccuacaguggaauguaggaacuuuuaaaggaaggguugcaucuccucagggaucaaaagcagaagccagggaaaagaacucuccuggaugaauuucaggauuggaucacaggaaggagguggcgugaggggcaaccaguccugcagggaguuuuggauccccccagugcccagcaagggaucccugaucucccacccaaggucucgguagaauuaagcaagacggccccaaggccucccaggaccccuaaugaucaaagcaaaagccauuuuaaauugauacagucuuuaauaaggcagggaaauggacacaugauuuuagaaccuuuuccacuaagaguccaaaggauuaggcagggcaguuagcuuaugggaaaacucacuuccuggguguuuccugacuaaggggaccugacgauggcagcuaggauggaggcugcaggggcugggauccaggacacacugucugcaccugggugguacaguaauaauaaugauggugauuggugaugguggcggugaugauggugauggugguagugaugaugaugaugguggugaugaugauggugaugcugcugcugaugguuauguugaugacaaugguggugaugaugauggugauguuggagaaugaugguagugaugguaauaguaauaauaugaugauggugauagugaucaugaugaugaugaugaagauggugaugguggugaugacacugaugaugauggugaugugaugaugaagauggugauguugauguggugguggugaugaugauguuggagaaugaugaagguaaugguaaucauaugaugauggugauagugaucaugaugaugauggagauacugauagugguggugaugauaauggagauggugauggugguagugaugaugaugaugauggugauguggugaugauggugauguugaugaugguuggugguggugauggugguagugaugaugaugaugauggugauguggugaugaugauggugauguugaugaugguuggugguggugauggugaugugaugaugaugauggugauuuggugaugaugaugaugauggugaugaugauggaugauggugguaauggugaugauaaggaugaugauggugauagugaccacgaugaugauaguggagauggugaugaucguggugaugaugauggagauggugaugguggugaugaugacacugaugaugauggugauguugaugaugguggugguaaugaugaugauggagaaugaugguggugaugaugguaaugguaauaauaugaugauggugauagggaucaugaugauggagauagugauagugguggugaugaugauaauggagauggugauggugguagugagaugaugaugauggugauguugaugauggauggugguggugauggugaugcggugaugauggugauguugaugaugaugauguggugaugaugaugauggugauuuggugaugacgaugauggugauguugaugauggauggugguggugauggugaugugauggugaugaugauggugauguggugaugaggauggugauguugauguuggauggugguggugauggugauguggugaugauuuugauggugauuuggugacaaugaugauggcgauguugauggauggugguggugauggugaugugauggugaugaugauggugauguggugaugaugauggugauguugaugaugguugucgguggugauggugauguggugaugaugauggugaugcugaugaugguuguugguggugauggugauguggugaugaugauggugauguugaugaugguuguugguggugauggugauguggugaugauguugauggugauguggugaugaugauggugauguugaugauggauggugguggugauggugauguggugaugacagugaugucgaugauggugauguggugaugaugcuggugauccugaugagggauggugguggugauggugauguggugaugaugaugaugaugauggugauuuggugaugaugacgacggugauguugaugauggauggugguggugauggugauguggugaugaugauggugauguugaugauggauggugguagugauggugaugauaaggaugaugauggugauagugaucaugaugaugauaauggagauggugguggugaugaugaugaugauggagaugguggugguagugaugacggugguaaugguaaacauuuauugaucaccuuauaucugucaggcaauauucuaugagcaugcuauuuauuaacucacuuaauucuggcaacaacccaguuagguaggugauaguauuauccucacuuuacuauguggaaacaggcaaugaaaguuuagguuauauaccugaggacaaaugguuaacaguggcagagcccagcugugaucucaguuuguuugggaccggaguuuucucucuucaccuuucaauggguggugauugagcccaggauaaaauacauggcacagacuugaaguccauagacugacugcccaucugaaucaccccagcaucuugugaaaauacauauuccacagccacuauaggcucucuguggcccaggccugaggaugugcauuuucauaagguccuugggugauucacauguggauaauccaggaccaaggugggacccaccagugcaaacaacccaccaggaagcugggcuggcacagggguugggccuauuggccugucuccaaagcacgucucccauccauccacugcuuucccugucaucggccaccaccuguguugacgccaccauuucccugucccacugcuacagcuuggcugagagcuuucaaauacucagacuugucccuuaccucugcuucugccugccauucagguguaugucugcaauugcaugucgaguguggaggcucuccugcagcuggcccuccccuguccuucagggucccugugagcaguccugccugcccugguccucaucaccacacuucgccugugguucagaccucagggccugcccuccaugcuuccauggugaguggccuuccuccgcugccaccaugggccccuucuacucugccagguugccagccaagcugccuccucagagugccuuccagaaccacauuccgggaacggaccccugcucuggaguuauuauccacacuugagguccccguccccaaggucacucagcuggccucacuuauuucccuaacagcugucugcucugagccuccuccaucccagacccugacccagggugggacacacaaaaguccccauuuucauggaucugcuacgcucacuuguuuuagcuccuuccuacuagcaggcaagguccaugaagacuggcccaugaagacuguguccgugugggcacagagggggugcucgggagucuggcagcaugugaaaugcuccuagugccaaucuggggcuugggcuggucucauugcccuccccgcacgaugaagcccacugggcauagaagggaaagacuggacaucucguugucuucccuccugaugugcagggaugaggcugagagagccuucuaagugugacacagcccagagggacucaggccucugggugccuguggagggcucuguggcccagccaggcugaggucugggugucacaucgguuuugagaucugcaaagccauggucaugugauuuucuuggagcuggggcugccugccugcuuaggccagguucucucugcucaucaacaaccacgggagggagggaagaaaggaagcgaggcaggggcuggugggaaguuugaggggcugggcuggguucucuuugguauucugugcagugccugccugcaacucggugggugcuuaauaaauguuuauuacgaguaacaaaaccagccuuauuuacacuaggccuaucuccaaaggcugcuuuccauacuuaaaaauaaccuuaaucaucucucccaacauccuccagagacagggucgauggcucuuugccauuuauaaauggaaagaaaggucuagagagggacagugagugccugggggucacccaggggcccagcccggcucgcaccagaucccuugucuccagucucuagagagcacaggcaggauccaggaaaaccuccaucuuuuuuuccaaagugauuucaaggugcuauggcugaauuguauccugccacauccauauguugaagcucaaagccccagugugaccguaaucagagauacagcuuuagaagguaauuaagguucaaugaagccauggggccaggguccuaauccaauaggauuggaagacuucuaagaagaguaagauucucucucucucucucucucucucccuacuaugugaggacacagcgagaaggcggcugucugcaagccaggaagggaguccucaccagcccccaaccacgcuagcauccugaucuuggcccuccagcuuccagaacugugagaguguaaaugucuacuguuuaagccacccggucuaugguauuuugucauggcagccugaguagacuaagacacgaggacaaaacaaacaacauaaaacagcccccagaaaauacccaggaauuccuuuccccaaggagccccacaguauggcugaggcccccaggcagccuccccaaaggagcaggaccuggcucuccuggggucucagucagguaggcccaauggaguucgagggucccaagcucugccagccccguccugcuguuccggacagccuagagccaggcucucugcggaaagcccagccccugauguggacacucagccaagcccucuguuccuggccucuucacucuaccacguggucagggaccuggguugucccuggggccuagaagccugggucagcugucccaguaggcuccccugggcccucaccagccuucugccccugcucagagacucaccccacugccccacagccugccucacucccauccccauaggcccgugggccccaaaggcagcgcccacuucuccagcccuuuauggcagcuacaucucucugggugcuucuccggggaaugaggagggacagauggagaucccaccuucugccccagugaucggcuggcaaguggagggugggggugugagggguauauccagguagcacaggugacuggcaggagucuccccagggagcccccuggcacccacagccccucugcuuugggucccucaccucccugaggggccuugcccuucugcucccaccccccauccaccuugaucucgugguugucacccugucuuccucaucccucucauacucucccaccuugcuuccuuugcuucucucucuccuucuccauuucucugucccccacccuccuucuccuugacuauuuuuuuccaccccacuguuuuuguucauugucucuuuguucucaucccucucaacucuccuuuuuucugccucagucuccaucuccuucuaauccucacagccuuuugcuuguccuccucugcuucacgugccucccaggaccccucuacuccuuccagucccugagcccucacuccacuggacacugggagggcagagggccugcagagcuuccuggacgacaaccaugucugggggucacacgcacacacacacacacgccugcaaacguacauacccgcacaugaacaugcacacucacacaagcuugcagacacacacgcaggcaugcacaggcaaccaagacucauauuugcugugucucauuuuuggugcaugggccaucccaggaaacagagggcagaggagcccguuuucccacggcaugggagcuuacagagcuucugaagaagcaaggucuuagccacuugcccugugaaggcgccgcccucucuaauuaauuuucaggguucacuauaaccgcugucccucccacggcccuuacaaaucacaucaguagcgauaauccagacagcacgccgucuccgggaaggggaagauuagagcugaguuggcgucuccuccucagggagagacucuugccuuagaagccagccuggcagguggagugacaaaggccagcccuacccaauagccggaaauagagggucugggaggaccacaggccaggaggggugcaccccaggaggggacauggggucggaacauccggagagccccaaugggccuagcaccuagaacgauguuucuggagaauaggauucaacuucuauuugauucuccucauuugaauucuaaaaaccuaaaaccaaaaggacccuucuagaucagucaugacacccaaggccugggucugaaugucuaccccccacccagccccuccucgcuuuacccucccucugcagcgcuuacccccauggaauauucugcagguucugcuuagcucuccuguucuuaugucuccuucuccagaaugcaguuccaugggcaggcauuuggucugcuuuguuugcagggcacacaauaauauuugcuggguaaaugcaggagccucuacuuugcagagccauauagcauucaacaagucgcuguaucucuccaggacucaguuuccccaaugggcauaaaaagauguguggucccagaaugcuguguucuuugcagaagcacugauaccacucagaucacaaggccgugagcaaacgcacuggcugccauccagucucaagguggccaucagagccaccccaagccaaggguugcuaacacccugauguggaaggcugaagacaaaacuugcuacagcugggcccacuccacaugaggaggccagccuugggccuggacagcaggcucuaguggggcccgagugggaacagaaggcacgggagcugcuagcaggucccaccgagccucgcugaccucccagguccugcugugcugcaggucucaguccugaccaucuccccaaaccaggcuucuugaggugcggcugguuccacagacccacccccaucccugccucuccguaaggaguugggccaguccaaaagcagguucgcuucuagcagcugcgcggaagacucuggcagguacuuaguguccugucucuguggccgcuugcccccaugugugaggaaaaguccaggacagaaaggagcagggggcauggggcugccccgaugccugggggcuacagcccgaugaccagggacccuggacacuggacacaauagcuuggggcuggggaggggcuggugggcguccaaaggccacaaaagucccagcaggggcuggcuguugagagucgucucuagaaugugggaagcaguguacccagaaagcaccucugugaugggccucacagcccccaaccaaauccagauucaaggaccagcuggggugggugggccccaagcucuggcuaaacagcccauggggcccugggagagucccggagcuggcuguugacaggcugcaggugagugggcggugggguuagagggccugucaucccguccgccuugcuuggggguccuggggaccaugagaacaagaaguggggugggcuacugcuggccuggcgaggguuaacggcagaugcgggaaauaucagacccuucucccagcaucuccgugccagcugcggggucagauaaaccaucugagcaguggcguacaauuuggguaucucuucggacgguugugggugacaucuccgaaaaagaggagauaacauuucugggacaugcaggcagcgugacagcggguacugcugccugucaggggccagguagcugucaaggggagcagcaggacaggugucgcaggcgggcgggagugggcagagccgucugccagccugggggaagaaugcggagagccaggcagaaguuccagcaucgcagcaaacaaagcuuaaauuagcugagcugccgcggccugcccugcugcugccaccagcccugauacccaacugaguuacacugcccaacgaugcaggaagcaccgaauuaaacagcuuagugccuuuacauauucaaaccaaggcaaaacaccaucaaauaugcugagugacaguugucuaacacacauucuuuaaaguuuuguguagugcuuacaauagcagauuugggaggggccggagcuggggugccgggccucaggacugggcagcugcaacccgugaauccuggugcggguagugaggcuggcaggagauaggcacgccuggccuggcuuuuccuggggcacaaaggcuucccugaacaccaucucccaaucaccaucuuggccacgacccuucgauggggacaaagucugcagaaagccucaugaucucucuggagacugcguuugcucuucugaccuggaacacaggacugggcaggucaggggaaaaauggagcccaggaaauggagugccuggugacacaugcuggugaaggcugccucgaggauggcuuccuccuccaggccggcgugcaggcagggaugaggguucguucucauccauccccgagucauuucugcuugugggagguagcguggagaggcuaacaccauggccuguugggcuggggagggguggccucugacaggcgucgugaagaaucuaacacaguggccuagggggcuggggagggguggccucugacgggcaucauggagccuugccugcugauccugugccacugcugcauguaaccagcucugccugcagagggugcugcgcaagccgcccacagucuccccuccucccugaaccagcccaucccugcgccugcaacgaguuuacaggcaagaggcuuucucucaccucugcuugggcucauccuagaggaugaggagugugcuggugccgcuggggugugcccagcagggagagucccaugcccucaggggccaugugacucccaagaggaggcuccugccccaccugccuggcccauuggccugcugcccgccggccucucugccugucccucugucccuccaucaccccagcugggcuccuggaggcuccuccaggagcaccaaccucagccuugguagcugagcagaugguagaggggcugggaugaucaauaucagauccaggugcuccugcugaaccuguugggcucuuccugccuggaucggcugugguuugcugggagcccuucauucaccacccaccggccccccucggccagccccuggccaugccuggauucuugggcguuguucagaaaggacagcaaugaggauccugccucaugggaagcgcccagcccagcgucacccccugagccugagcgcagagggccagggcuucuaggucccagccuguccuucacagucauacgagucacccccacugagggacuccuguucuuccaggcucccagcuggcacugcuggauaaaucugggcucuagugaggcccauaccccagcguuccuuccugucaccuccagcccugccugucccugcccuuccaggccccagcucccagccuuuguguguucucucuuccccaccugagugccugccccgagucccauguucucaugaugcucuuugcugauggcaccaaagcaguccuaggcagucgcaugagccagccaguggguuaccgugcucagugacacagggucuuacaccagcugagaugcacaccggccgcggugaccucaaaacacaauccaucacagcauacuccccuggcccgugugguacagccagcccugccugucugcacgucugaggaccuaauggcuggcuuuggaugcauaggccuuacucauggcccagauggccaaguauccuuggggccugauggagacauuggccaucccaucuucuacauggcucauuucacagaggagaaaacugaggcccagaggacagaaacaucucauguucccggcuccagcucccagcccaugcugccgcagagaccuguuagacucugcucagccucucaccccuggggcucagugccuggagccugggcugcagggugagccucagcaccugccucaggggacacaagcgaccccaggggaccugaagggcaguggggccugcagaaaggagagugugcaggggcaccuuagagggccacaagaagugguggcagaaucccacacaggugccagggggcccugcugcccucauucccccuucgggaccagggacaaggauaggaacaaucaccccacaguugggggagaggagaagaaucccccuccugagcuggaggucaaauccccauuuagauccauccucagccugggccuuggggucccagagucacaugugauuuggaggaagugcccauuuauuuuacacagaauucccaaacaacagaaacaucaugguuuccuaagaacagcagagaaccaagcucucauccaagaacccagacagguuccggaaacucgcugcgagucugacuuguguuuccuucuagaauucuccugcagucaggcccugaggccccccuccccuggccucccagaagcuggaaguucagcccagaucuagggaggaggaugcucagaggacaucggggugcaaucaguugcauccuggggugcauccugauucagugaggaugccaagcuccuggggcucagcucuggaccccaaggagccguguguccuccggcccacccugugacaggcgcaggcucagagccugccugaugucucaggaauccuccagugcagaccccuccaacaccuccccaaaccguggcauuagcagguccuucugcagggcuccgagcugugcucggcgugaaaacaccaagucggcaggcaggcuccccgcuucccucugcucucugauccuuuaaucugagacuauuaaaauuucauuccacuccuauugguaaaccaucaaucacuguugccaagcagccccuggcugagacagccuggaggggaagguggcagggagggcaagaggugcuguggccguccagggccaggaggcaggagggucagcuugagaaccuccccuccccugggcagagcugggugcaggagggccgugugcccuugagaaggacggggcuucuggguggagggacaggaggcacaaggcccaugucuggggugcgugggaggcucuggggguggagaauggcuaccacucgggccccucuuggcggguggcggcaaugccuacagccggccuccgugccagacagcaccaccggugccagcugccgccuccuuccugagcggcugccaugugggggagccuuggccuuucucuccugguggcuccuugcuuccuucucaguucagacaccuggcccuuugucccuccucucccaaagugacccuggccuucaggcaggggggacggggguccgagacccagcccuuuaaggguaacuugugaaaaggcugcaccagcucagugcuugcaggauuaugggucuuuuucuuaauuaaaaaaauccaauuaaauuaagauaucagaacuaaauaacgcuggagucauuagugcaacuuuuaucuuaaugacuacagcugcugaaauccuucuuuaauucugacagccucggcaggcgaguggguuuucacuguauagaggccuggggcugcagacacaggggguggcggaagccccugcuucuccucugcaccccagacccgcagagcgggugaguuccguguguuucggggcuggggggacagggauguacauggcugagguauuccuucccaucuucaggaccaugcccacugcccaucagcccuaguggacuuaauccgagcaggcaacuuuggaaggaacaacagugggucccuaaauacauuuuaagacuuuucccuggagaagggagccgaguuccucccugucugcucaggagugagggaagcagcugucugggcccugcuggggcacccuguccuggauggcuggaggggcacggcguguuggcuccugggucccauccagaggggcuccaugcuccccgccuucaacccuggcggccuugaccccccucuuccugccaugccugggggacgccgcagcauguugguauugaauccagucccacaggagcagaggcagcgggcgggggcccuggcgccaugagcaggagagcaggcacagcacaggccccaugcggccccgaggcggagcuggacugggaagaacggggcucugggaagcaggagauaagaggcugccggagcgaggggccuggaggggauuugggucacaggaggguggcugggggaguggcagagagccaggcgaggaggaggccugguuaucacuuuaccucaggaugccgggaauggcagaggcgagaggcacagagcccagagccggaagccccacggacaccacaccgcgagguaaagaugcucacggggcugguggcacagaccagacuugcccccaccccgcuguccacugcagccccagacaguccucccucacuuuucuuccuccacucagaugcucccagagaagacccuugcggucaccccagaucccgagaugccuccugccagccccuccagaaacaucacaaggaucuauggcugcaggucuuggaggucagggacuguguccagcuaacucacccggugucugugucugggccagagccuggcacacgguaggugcccaguaaauaugcagcaauugacugacgggcaaaagggagcugggggagaaaugggccaaauccgcccacugaguucuggcaucuugccaugaauguguauuacuucaccaauaacuuuuagaagcaaugaaaauuauguuuuucauuugcuuuucugcaagaaaauaaagaccucuaaagaaaguggcuaugaaacauaccggauccuagaaugucacagcuggggaacagcuggaaaagcauccagcccaaauccucacuguucagccuaggaagugaaggcucaggguggggagagagcuggucuguccgcuuggccgggcucuggacacuccugcuguuagaugugaugggaucuguugcacaucuuuuuuuuuuuuuuucugaacggagucuuguucugucgcccaggcuggagugcaguggcgugaucucagcucacuacaaccuccacgucccugguucaagcaauucuccugccucagccucccgaguagcugggauuacaggcacacacugccacgccccgcuaauuuuuuguauuuuaguagaggccggguuucgccauguugcccaggcuggucucgaacuccugaggucuggcaauccucccgccucggucuccccaagugcugggauuacaggugugagccaccgcgccuggcuguugaacauguuaacaauggguuaagaugcuccaucuccucaucuaaagaauggggauaaacaagaacaccugccucaaagggucaccaugaagauuugagaaacucuucuauagcuauuucuggagugcccgccaugagcugugcccugucaucggugcccagcaugccccacugaaugcucacucugagugggguggcccuuuuggauccaaaauucccaccacagaggcccaagcagugagggaggggagcugguucuucgaggauccuuaggcaggggucacagggcugagugggugugagcagaggaggggagguggauggcccaggcagacgaauugagugcauuccacaccugcaagaggccagugugucuggagcgugggguggggcacaagguuugagaugggguuugagagcaggaauggccacaguggccacccuuagaacagugguguugaauuggcgaggugaugugcgugugcauggcuguaaugaccacaugaggaucauuauugcuagccacugugcaaggaagaguuugcaagggugagagcaugcucagaaaaccuuggccaggguccggaagaaggcacagucgucaugccauuuuauuuucuguauuucugaugcuuugaccucuggggccuugcugaaccuggagggacugccccccuagggcuggucaauuccuagagauagcaaaggacuggccugggaacccaccuuucagaccaacccacccagagcccauaccccacaaccuccucuaucaggguuucccccaagggccaccaucuagcugcccuagucaccccaggccagggacaacuuaggggcagccucuccgcccagagcccgcaggaauuaccccaggaauuucuccaaagccugcucaccccgucuuacuuguuccuuccugcaaaaaccacaauagaggcucugcccacauugcccccggcucccucugccucuugauggacucccugcuuccccaagugguccugugugacguggccugcccccuccucaugggaucuaugaguaacaaaccaucuuaaacaggcagccgccugcugaucugcuagccucaccauggcugcauauuaauacaacccgcauuuggaaaaaagggcccuagcggcuuagauuggagcuggugugagaugcaggacgugguuggguuuggggcauuuaggagaacagguggacagaccuaguggugaccuggggguggaaugugacagaggaggugaaugaaugacuccugggcuugagcuugguuugggggaccacgugcuaggugcuugccuuggugcugggggagacagggacaccaggcugcaaaugugaccagagccacccaugggcccuggagcuccgugggagccaggggcuuuucuccugccuguuccaggagcaggaccucauucggcuccuugggugagaguuccaagcuugugauucuugggauauccaggcccuggcucugucugcccuggggaaugaugagagaguggcuuuggggagggcacagcucugggucucaggagagaaagaggagaaggaggagcagggcugugggguggccacagguggguggagggcagcagacccacaggacccauggagggagcaugaauggaggggcugcuugcuuuggcucugagaaauucuggucccagcugcccuccuggguccuacccacaugcacccccaaauaagcuugagcacuuuaaaaauggaaacaaaugcucccuuccuuuucgcggagcuuucugucaaucgaagcugucaguuuccucuaguucuaaaaaagggcgagcucugugugucccauaaauagauuuccaaagccacaggccaauccggcucccagaacacacccaucucgcugcaggcuuugaaggggcagcuggggagcaauccccucuccuggagggcaagcaggcugaaaggcacuuggggauacccuugagguucacaguuuacugggaggugccagcauucacacaucauuacccacuguugacagaggcagcugauaacucccugagucuuguucucgccuccauuagcagauugcuugaaaaaaaaagucagaaaaauucaguucucagauuugggcccccaccaucuggcuugggaagucugcuggguuuuguuucugcccuacagaaaucuggcuucuuuuuuuggcaugggguugggggggaugaagcaagccaagauaagggguuccaggaacugggacaaccucagaaggucauugaaacucaaguccugggggaggaggaagaacccagcuuguggucaaaggcagacgcuaaggagagggugggagggacaucgucaguguuugugugaggcugaaaauggcagaaagagccaacaggucagagaugaucaggguggaggcagugacaggagggggcaagagcagggauagcaaauuacuuuucucuuauucaugggcuucuacugacagcugacagcuguagggccaggcugggcaggauucugagacugcauuuggaaaaugugcugugauccauuaguaaugucugcccugggcacgggaggggaagguggcagcuggugauuuguuaucgcagcauguaaggcaagugguuuagaacuaagacgaggaagagcaaccucacaccuagaacagcauuuggcacauacuaggucucuacagauaucugccaagcaaccagcugaaagagugaaggagugcaggguagagaaauggaggaagaugaccacuucuggggaauuccuaagcccugggccagcaagggagcuugaagggagguaccuggcaggaaaacacccuucuucuuccauguaaugaaacgaacccgggaaugacuccugccuuccuuuauguggaggaaauuuucagcuaccaccacccaggccaucuucuacauuuauuucccucuucucucaugcuuccagacacuucccugcagugugcacuagaacagagcccacauccaggaauuuuagaguccagaacccaucacuuuguggcccacugaaagaaccugaguacaaauugcuaggaccugaguacagacuccccagagacagagcaggggggcagucauguuggucucaucuuagcacagggugacaaucacuucugauuucacgccccugcaucauguggcuguucaggccuggacucagagucacuguugagauagcccugcagagcacgaccucccuucucuuugaauccaagcucuugauugcaggugagaauucuuguuagagcuacaggacccaggguuccugacacuuugccuggagaugucugggaagcugcccuuuccuuuccugaggcuuaaaccagggaaguuucucucagcaccuuucagcacccccaucugggccuccaggaaaucugugcagucaccucugagccagguucugugcacagaugggggacaccaaagagggucagggacagaacccugagcuucgcuuaucccucuugcuuucaaucuuucaguccacuaggcugugagcucccuccaggggagcccugugggauggguccugcaucucagccccuacacguggcagcacucaauacacagcugauggcucugggaauggaugacuacacuuucucuaaagcacagauuucugcacagcucucccucacugccagugugcccucuucaucauagcugagcccugaauucacucacucauucacucauucauucacucacucaauuauucacucauucauucauucccucauucauucauucccucauucauucacucacuuauucacucauucaugcauucacucauucauucauucacucauucauucaugcauucacucauucauucauucacucauucauuuacucacucacucauucguucauucacucaagguacuucaugugugccaggcccuguucucacuaccaaucuuagcacagucuuuagcuucucugaaagccaguuagacugcggcuguuccuauugcagcucccagaggucccucuguccucaccggcuguugggggaagguuugccacaaugacauccccacucagcuacugcuuaacauggacagggcaggagagaaacaggguaagaggcucuccgugcggcuccgugcuccuuggacuguaaccuccugguucacugugacucuggaggucaacucugagcacgccaucccgggagcuguggcaggggccuccaccagcucuuccccuaacccagccucccugcuuugcugcagugcaccauugcggaacugggcgggcugcuccagagcccugaguguuuggacaggaagcaggagagccaguccuccccugcuuucaguuuaaugagcaaccuccuggauaugcgugggcagugacccgggauggacagggcucacaguggcugcggccugaagcccaggcgagccagcuucuggacuuccuccuuccuucccuccugucggccagugcucugcuccugucccaccccugugugucaggcgcacacacaggagagucugcugaaugcuguuucacaagcagagucuggccgagacaggcacauccacuguucccagugaacacaacugggaauggcuccuggguggauggagaaauggggccaugguuugccugacccugugcagcaagcucugcaucacacuuuacggcaccuugcaggggcugagugagguccgggcucagagguccuguucugggacuuggcgguccagagaugcagccucuuguggcagaagcaucguucccuugccuccagagcuaggcuggguggcacugggggggugugguggccuucagaaggcuacuucaucagucccucuggccaucagccuugcucugucaaaggaggaggcuggugccccuuggggucagacugggguuugaauccaaguucuaccgucucccacugugugaccuauggcaagucacugguccucucugagcuucucuuuccucaccuacaggcccacuucuaggauucuggugaggauuaaaugagaggauuuuaaaaagugcauauccuggaaccuggcugaggucuacacuggagucccaguccuacuuaacucucccucccuggggguuuuucugugcuugguucugugcugaggccaucaggaauggagagaagccuaagagguguccuucuaccccugggaaccagccagcugguaagaccagagagaaccucuuagggagcagucccagcagcagagacccagugccagggacaggcuccaagggccacagauacuggacaccagggacaggcucugagggccacggggacccaggccugaucaggcccuauucaggcaaagccacaggggagucggguugcauuaaauucucuggagugucaggaagcuucagcagccacaguguccccaguaggggagggggcugcugggagccugcggugaggacgugacccgauggacacaggaaguugccuggaagacacacgguucucuggagcucaaggccacuucaggcaugcucuguuacgaauggagagaaggaacaagcgucugggaacuagcugggugccuuccuccucugugcccugcguuuucuuccucauaaacaccugugugugugcacacacaugcacauacacacucaugcacagauacauacaugugcacacacacacaugcacauacacucagugcaccugcgcacacauguccuuuggcccugcagcucuuguccgaccuccggagcccagcugggcacaggaugugauaagcacccuccucccuuccuugcuucuccccucugggcagggaagccccaggguggcuaggguggagacugggguggagaccaggagggacuagugaguaaccucguggugcuucccucccugugagggugaaggucacacuggcucucccaggccaauccugcgccuucccagaccuuucaaugagguugucucugcaucuguuccagucaguaauuagacaaaaauccauuaaaaugaagcggggguacuuugccuuccugugaaggaggccaagggagauuccucguggggagggggcagagagagcuggggugucuaugggcugcugcugggccugggagagagaggcccaggugagagagggucagcuggguggguguggucaggugagggggccgggugguaggggccagguaggagaggaccaugugaaagacggucagguaggagagggccgggugggaggggcaggugucaggguucaguggggaggagucagggggaggggccagguaggagaggacugugugagacagagucagguaggggagggccagcugcgaggaggccagguaggugugguuaggugaggggccaggugggagggggccagguaggaaaagaucacguuaaagagggucagguaggagagggccagguaggaggggcccaggugggagggauuauggggaggggacagagggcgaggccccuaccauaugggaggggcccagguggccagggccagggaggggagguccaggugggagaaagccgggugggaguggcuggguggcacaggcagugggaggcccugggcuuccccauucaggacucuggaucagggccacacucuugaggcaaaaaggaauggugaguggcccagguuaaacuugcucacuggacuccggaaccaucaucuuguucuuccccucccagaccagggucuccaaagaaagaucugcauuuaacacuccauuaacccucuguaucagcuucucuuccuaccacucugggagcuguggauucacagauuuuuaaauccaaaguuacuaggucagcucagcugucuucugccucugggcacccuuagccucacuccagccccucccagaaacucacccucuccuccacucccugcacccucuccuccacuccccugcaaugacuccuugggauucuccuccuuugcacacccuccuccuccuuccuucccucuuucagauuccuuugagacuccuccuccgagcaccagagccccuaaccucugucucuuauguuccucucucuauagaugcuguggucucugagauggggccagccucuucucugagcccccagggccaagccugggcgcuuggcacacaggaggcucuccuaaguucuugaagaaugaaacccucccgcccucacccucccauucuuacucugagcucuuucuucuuccuacaacacauaucacuuucugacaugcuugaguuacucauuuuuuucuuuucuguuugucucucccggcccacaggugucuuuguuuuaaucacucaugaaccucacauaucacuugaggacauugucugauugauaguggguccuuaaaaauauuugugagaugaaaagauuuaaacuaaagcugggccaguccacaacugcauuuuaucuaaagcacuuuuuccacaaguagacuuucugaaugccccagggcauuggagaggaaaugagucaucccauuucugacgccuuugcugacagccaagcacagguucugugggcaccaaucgggggaauaaggaugagggagguggccaagggguucugugguggcaggagaaggucaaauacggucagcuuccugcugccaacaaggucaacccggaagaaaaugagaagggaccuggugagucccgaguagaagucaaaacacccuccacgggcaucuccaccccuaagagggacccuccaugggcaccuccaccccuaagagggacccugcaugggugccuccaccccuaagggggcacccuccacgggcaccuccacccauaaggggugcccuccaccagcaccuccgccccuaagggacaccuccaugggcaucuccaccucuaagagggacccugcaagggcaccuccaccccuaaggaggcacccuccaugggcaccuccaccccuaagggggcaccuuccaugggcaucuccaccccuaagggggcacccuccaccagcaccucuaccccuaaggggguaccuuccaugggcaucuccaccccuaaggggacacccuacaccagcacuuccacuccuaaggggcacccugcaugggcacuuccaccccuaagggggcacccuccaccagcaccuccaccccuaagggggcacccuccacgggcaccuccaccccuaaggggugcccuccaccagcaccuccgccccuaagggacaccuccaugggcaucuccaccucuaagaggaacccugcaagggcaccuccaccccuaaggaggcacccuccaugggcaccuccaccccuaagggggcaccuuccaugggcaucuccaccccuaagggggcacccuccaccagcaccuccaccccuaaggggauaccuuccaugggcaucuccaccccuaaggggacacccuacaccagcaccuccaccccuaaggggcacccugcacgggcaccuccaccccuaagggggcacccuccaccagcaccuccaccccuaaaggggcacccuccaccagcaccuccacuccuaagggggcacccuccaccagcaccuccacuccuaaggggcacccugcacgggcaccuccacccuuaaggggugcccuccaugggcaccuccauuccuaaggcgcacccugcaugggaaucuuccuccuuaaggaggcuugccagacccucccacagucuacagaagagggcaaggaguugggggagguggcaaaggagcugcuggaaacuguagacaugugcccaacacagagggucgaaaaccacagagcagacccagaacugugcuuccucaguacccauacagggcaugaccagugaccugguuaaugccuguugcccagcauaacugucaacuuuuauuguuugcaauuguuaauucuuauuucucucucaaaacgauauggucaccugaucaauauaaaugcucacacugaccaucuuaagucggggccagcauauguguggcaggaacccuuccugucccucuguucauggcagacauuacuaaucaaucacgucacuguuuccccugagccuggagauggcuucagaauccuccuuacaacagcauaagggcauauugacgggugagugggggguccacacaguggagugcccuugcaaggggugucagagucuggguuuggagggggcccacaugggguggcagagaugugagacugguuguguacagggagauuauguuggaagaauaauucucuuaggccacacauaaauauacuaacacuaacgguagcugaugagcuaaaaaaaaaaaaaauugcaaaaaagucucauaauguuuuaggaaaguuuaugaauuuguguugggccacauucaaagcuguccugggccacaggcagcccacaagccauggguuggacaagcuugauuuaaaucaucuuuagauuacuuauaauaccuaguaacaauguaaaugcuauguaaauauuucuuauacuguuuuauuuagggaauaaucauaagaaaaaaauauguuugguacaaaugcaauuuuuuuccuggauauuuuuggcccguuguugguugaauccacggaugcgaaacucaugaauguggaaggccaacucugugugugugugugugugugugugugugugugugugugugugcauaugauacauauauuccccagcucuaucuacugagagaggccugggagcagugagcauacucaggcccagaucuuggcuucuaaacaccacuuuccacuaaaagaaaccagguuucuuuggagaaaugguugauuucaggaaaguacaagauaugccuggaacaucuuguucagaaagcaaggaagugcucaaagaaugauugggcuuauaucaaaugacccagaaaccagcuugaauggagguccaccaaccaaaucugagacaacaugaacacugaaauaaauaacaaugguaauagauuauaauccauugaauaaaauaagguuauacauaaacaaaugaauaaaaacugaaagucugauggggaauacuugcauauacuaugaaaguacuuucucacaaaauauuuauuaacuacaaacagaaaaugaguaagcuuacaguggagaagccuugcagacaccaccugaauuaaguggucaaggugaacaucaccagucaugaguaaaauggaaauccugcaucaacagacacuuuucaaaauaagacguucguccagccaacaagcauaugaaaaagugcucaacgucacugaucauuagggaaaugcaaaucaaaaccacaaugagauaccaucucaugccagucggaauggugaucauuaaaaaguuaaaaaacaacagaugcuggcgauguugcagacaagaagaaacgcuguuacacuguuggugggaauguaaauuaguucggcuauuuuggaagacaguggggcaauucuucaaagaucuagaaguggaaauaccauuugacccagcaaucccauuacugguuauauacccaaaggaauagaaaucauuuuguuauaaagauacaugcauguguauguucauugcagcacuauucacaauagcaaagacacagaauuaacccaaaugcccaucaaugauaaacuggauuuuaaaaaugugguacauauacaccauugaauacuauacagccauaaaaaggaaugagaacauguacuuugcagggacauggauagaacuggaagcuguuauccucagcaaacuaauccaggaauagaaaaccaggccgggcgcaguggcucacgccuguaaucccagcacuuugggaggcugagguggguggaucacgaggucaggagaucgagacuauccuggcuaacacggugaaacccugucucuacuaaaaaauacaaaaauuuagccaggcgugguggcaggugccuguagucccagcuacucgggagacugaggcaggagacuggugugaacccgggagguggagcuugcagugagcugagauugagccacugcacuccagccugggcgacagagcgagacuccgucucaaaaaaaaaaaaaaaagaaaagaaaagaaaaccaaacaccacauguuuucacuuguaagugggagcugaacaaugagaacacauggacauguccggggggacaacacacacuggggccuggugguggggguggggagggagagcaucagaaagaauagcuaauggaugcugggcuuaauagcuaaaugauggguugaucuguguagcaagccaccauggcacaugucuaccuauguaacaaaccugcacauccaggguacauccuaacauguauccuggaacuuaaaaguugaagagaaaaaaaaaauuggaaauccugggccaccagacagagcucaguaucccuuaugugaggcucuugcucaagaugcaccaccugagucuaaucacaagaaaacaucagacaaaaccaaacugaggggcagccuuauaaaguaacuggucuguaaucuucaaaaaugucaaggucacaaaagucaaugacaaaaugaagaacugcucgagacugaaggacgcaacuauuaaaugugacccgugaugcugacaucauuggaacaaucgguaaaaugucauugaagacaggauuaguugauagacauguaucaauguuuguuuccugauuugagaguucugaugugguuuugucagagaaaauguuuuguugcauagaugcuaaaauacuuggggggugaugggacaucaggcuggcaaauuucaaaugguucagaaaaaaguuucuuugaauuguacucccaacuuuuuaguaugucugauuguuucaagauuuaagaaaaagugaaagggagaauuggaaauucaaagaagaaacaaaaauaacggcauaagcaaguuaugguucaaauaaaaagcaauauaaaugaggcaugaaugaccacgauaauauauaaguuuugguguuugcuaugguuuggauaugguuugucacugccgaaacccaugcugaaauuugauuuccaguguggcaguguuggggguggggccaugugggagaugucuggguuaugagggcagaucccucaugaacagauuaguucucucccgaagggguaauuucuuccuccugagggaaugaaauagcuccggagaaagcgaguuguuaaagagucuggcuucuucgguuucucucucuugcuuccucucuugccacguguuaucuuggcacaggcuggcucuccucccaccuuccaccaugaguggaagcugcgugagacccucaccagaugcagcugcacagucuugaaccuuccagcugccagaauccugugccaaguaaaccccuuuucuuucuacauuacccagccucagguguuauguuauagcaacacuaaauggacucaguguuugaaggguaaacuucagcugcauagaaaguucucuuuguacgacaauucucaggcucagugcagcagggcacagaggagaucaugcucugagcuuugauuuucauggggaugaagggugagaccuggcacaaagacccucaaugguuagagauggccugacuccucaacaccggugggaaagagucuuccccaacugaugugguuuggcuguguccccacccaaaucucaucuugaauuguacucucauaauucccacauguugugggagggaccuggcgggagauaauuugaaucauggggcgguugcccccauacuguucucgugguagugaaaaagucucaugaaaucugauagguuuaucagggguuucugcuuuugcaucuucuucauuuuucucuugccaccgccauguaagaagugccuuuugcuucccaccaugauucugaggccuccccagccauguggaacuguaaguccaauuaagccucuuuuucuucccagucucagguaugucuuuaucagcagcaugaaaacagacuaauacaccaaccaagaugggcuacaugauuugugggaccuggugcaaaaugaaaaugugggaucccuuuuuuaagaacuauuaagaauuuugagaauacggcagcaaggcauuaaacuaagcuugguuuaacacaacggcacagguugcacacccagaaucugucccuuuccaugacaucugccaagagcuguugcuuuaacccuuuuccuguucagaaaaaaaaaaaaaaguucugcucgcugccagcacucauuuaauuuuacauaaacacacucuuugaggaugaagcaaaucucacugauuuucaaugugaaaauaaaauauaaaaacuguucuuggaguuauuucuaaacagaacuaacaucagaaucaucugaaucaucagaauugucuauuucagaaaacucggauucaucaaaugagucuuuagccaacaacuguuugagaacaauguuaacaucacauguagaaaugcugcguuuuccaggauuugacauuuucagcguucgggaacugcuauauuuuguaaauggaaauaccacuacuaaacacagaaugcuaaaaauagaaugaggucuuuuguuuccaaagucgauauacuagagccaugugaaaauaauaauaaaagcgagauauuucaugucaaagcuaucucgggguaaaugcugcagccacaagugcugcuggggauuauucucagugcaaaugggaaaagggcuaagaacuuguccuuuuauaauacccagggaugagaugaaaaauuuauuuauaaggauguucaucagaguauuauuuauagugcugaacaccggaagcaucacagauguccaacaggaaaugacuaaauuacagcauauccagaagaugggauauuacgcagccauuaaaaacuguguuuuaggcugggugugguguuucacaccuguaaucccagcacuuugggaggccgaggugggcggauuacgaggucaggaguucgagaccauccuggcuaacacggugaaacccugucuccacuaauaaauacaaaaauaauuagccggguguaguggagggcgccuguagucccagcuacucgggaggcugaggcaggagaauggcgugaaugcgggaaguggagcuugcagugagccgagaucgcgccacugcacuccagccugugugacagagcaagacuccggcucaaacacacacacacacacacacacacacacacacacacacacacuguguuuuaggccaggcgugguggcuuacaccuguaauccuagcacuuugaggggucaaggcgggcagauucacuugaggccaggaguucaagaucagucuggccaacauggcgaaaucccgucucuacuaaaaauacaaacauuagccagguaugguggcacacaccuguaaucccagcuacucaggaggcacacaccuguaaucccagcuacucaggaggcacacaccuguaaucccagcuacucaggaggcacacaccuguaaucccagcuacucaggaggcugaggcaggagaauugcuugaacccaggaggcagagguugcagugagccgagaucacgccacugcacugcagccuaggcaacaaagugagacucugucucaaaaaaacaaacaaacaaaaaaaacaaaaaaauauguuuugagaaacagugaaugacgggggaaaugcuuuuauacaaugguaagugaaaaaaaagcaaaacacuaaaccucaucuuauauuaucaacuuugugaaaagaaaaaauacccauaggcaugaguauagcaaaaaacaacaacaacaacaacaacaaacuggcaggaaauauaacaaaauguaaacagagguuauuuuugggugaugggauuauaggugguuuuuauuauccuuuuaguacuuucccaugucuuauaaauguucuacuaugaguacgccuaauuuuucuaauuagaaaaauauuuuaaaauuguauucauuuguuauaaugagccuguuugccuuuguaauuaaaaauuuuuaauuaagaaaaaagugaaguuaaaaaaaaauagccauucaugcaaccaguauuuauggcacacauccuguguugggguguaacgcuugguucuggaggaacgccgaggaagcagugagaaacauggacggugcuggugacuucauggacuuaucuuguuggccaggcagagcaguaaacaaaaaaacacgucaguguggucagcgcauucugagcccuuccaugcaccucucccaggguucuggcaggaucuugaguucaccagaaccccugugggugaccacccuggugccugcaagcugagccuggaaaguuaaucacgugaccacagaacaaccaaaggcugcaguggggguuugggggaacgcgcccguguaacuucuguguguuucaauggugcaugccggggaaaauguuuguuaaacacauuacccuuuaauaaacuauaacuuaaaaggcaauggcagguucuaaguaaucaauacgacauuguaauaauuucaagcaaacagagauuuauauuccgugcaccuugggcagcaauuacuuuauucuucuaacauacuugugagcgcugcuuuauuuucacuuaaaccaauuugcuuuauugaccaaaucaaguccuguggccauaauaucaacccuucucccaaccucuaacucagcaaauccaguucccaucaauaauuaugacaaggguggugauuucuuuccucaaagccaaggcagcauggacgagaucugucuagagguaucauuuucccauucucccuucuccaggcaggagagaaacaggcagggggcuugcccaugcagugaggccaagggucagaaaacaaaucccaaagcgucaaaacgugaggacauggagggagggaaccagaaaggaagggagggaggagugcaggagaaagaaaggaggcuggaggaagggcauaaaaucugggccauguacagcuggagccucgaggaaggucacucuguccugcccagcacagcccccacaucccuuuuuuggcaacagccagugugcggagggacccugcaaccuccaguucuccaggucgacgugcccagggcagguuguaagcaacuugcugggacgugccauuagcuaaagaccaaugaccucuucccuccuccuguuggugcagcaacuuugugcaacuaaucaacuaauucauucaacuucagagagguaggccaaagccucuaugauugagucaauuaaucaaggaccagaguuucagguuuuggcaauaguuuucuugaccuuuuuuuuugacuauguaacuaucucucagaagccuuuaacuuacugcauuuuuuacccucaacuggcccacguguuuccacuuguacucuggaagggccagcaauuaggcccauacguccagguuggugucccugagacacagaggugggcgguuuuggggggugaauccagcugucgugcaaagaggaaugugcacaacauuuccugcaccaguuacccauguccuuggaaaguguagacaucuauugaacucacagccauggagcugagcuggggccuggaugccggacugcuacccuuccagcuucuauucuccccagcaggagcugcuuuccugggugggggguggcaggauuucagaaacucagccaggagcucauggagagacuccagguuaggguucucuccugguaaaaucugguccccaaaggagcucacccugacuaaacccugcccguacuccaguucuaaugcugggccccagccuggguccccagggcuggaauuccuacgugucuuccauccacccauccauccauccauuucuccauucauucaugcauuuaauuaauuauucauugagucgcacuuaugcaccagcacuguccccauuaccagguacacaaucaugaaccaggcacuguucuuggaguggggccagaucauggcaacagaaucacagcacacagagaaggauguacaacguuggguguguacaggguucagaggaagcccagggcagggcacgacuaacguccuagaagguaaggcuuccuggaggagucagcauccuagcugggcucugaaggaggaacagaagucugcaaggugauccaugcaaaaguaagggacagcccagcagagggcgcugcuugauccccugccugaaucucaacucaggccaaccuucuaccuggcccgcuaguucucugacucaugagaugccuaucaggcaguucucaugcugucucugcaggcaccuuccacguuggcccugccgucuggcccugccuuccuaugucugcccucaucauuccuggcuggaauuucugugagaucuuggaggugggcagacuccaccaugcaugugugauguagccaauucuguaugagaacgauagcauccuaaguggaguuauuuugacacuguuccaguuugcauaggaaacagaggaaucaggcugcaugugcugugcaaugcacaacucuaggaggcgccauucccacaaacuucggagugauauauccccuggaaugguucagcgcaauagccccaagaggaacauucuucacucauacaaagaaauaugcuacgugcuuucucuugaaacacauggcccacuuguacuaucuuucauuucccacuuuuggaagaaaccuggguagagggaaauauuucuuuaagaaaaaccacugugcagacaccauaagaaaaggccacugcucuucagccugagcacuggggagauagccugagaggguguggccugggaagccagauggcccacguccugucccccaaggcuguggcuguccaucaguccugccuguugcagccauguggggauuuagggccaggaggucaggucuucugauucuucaagaaaagucauacaucuggguuugcaugugaaacucccagauuucuauauguggguucaaauauguauaaaacacuggaaggcccgagggcucugugcuugcaacccuggcccugaggguggcaggcuguuugcaucuggaggcugugaucuccgaggggaacucugaaccauggggaggaugaaagggaaggaaagcaggcugggaccccucuggccaggacaugcuagaaggugcuaguaguucagcgcuuggguacauuuucaggaaguucaaaugaccggaagccaggaaacuccaugcuccuccagugucaaaguagaaagguggguucacccacacugauagcucuaugcugccuggucuaagcauagccuggggcagggccaccaauggagaggcagcuggucagcuggucacacgcccuaccucuuuaagaacccccaccccuacaucguaaugaggcagacucaguuuguuggggucugaggucuauauaguuuguucauuuuuuuuuguugagagacagggucuuggucuugaucugucauccaggcuggagugcagcagugugaucauggcucacugccgccucagcguccugagcccaagaauuuuccugccucagucucccuaguagcugggacuacaagcacuugccaucacaccugguuaauuuuauuucuuuuuaguagagacgaagucuccuauguuacccaggcuggucucaaaacuccugggcucaagugauccccccgcuguggccccccaaagugcugggauuacacugcacccagccuggguauuuuuuuuuuaaugaaaagaauacauaacuccuuguguauucaguugcaggggccuggagacagccugugaccuggccugcugaugucugcuugcacugacucaucacagccaauuauacaucuuuccucucaacuuugcacucaaugacaucaugcugguagccugagaauuggccguggugggaguacucgcacuauggagauuggcaaaugccacagaucaggcuuuucccccuagagagcugguuguucaacagcuaccagcacaacacugcacgugcaaaugagggcuccaagcuugagcaucauuagcuccgugguaaacuugccucugaucguaacacauuuauuaggcaggggcccaugaagaacagagcagagaaaaaccuagagccacgacgucagacaggaggaaagacuguuuucugaaguagaagaaaauaggaaaagaccccuuugagaggaacagguuuucccuucucaguuugagcugggaaugaaaaagauuuuaaaaagucuuuuuuucuauccccaaaaggcgagacugaaccuggaguuucccuuugaaaagugcaugguuugggggcauuugcugaauaaaaucaucccaaauuaaaaucucauuuccuuccaggggcuagagagugugucuauuugucuggggcuaaaggaccuaaauucauuuuaagggaagagauucaucagugaggacgggcugagaagcuucuagggaagauccugccccagcuccuguaucccgaugcccuucagcagagaggccuugaggaccagcguccccagggucuggcagccucgugggcucagccccaccccauuccagcugguggcagccugagagucagccccgcugugcacagacgccuuuuggagaaggguuguuaggaccuuggcagccagggcuguguugcugcuguugcucgggcaggggccucucuguccugcccacucugaagcugguggggcugcaccuggcugcuggcugcucccaggggcucaaagcguccuucauggugugggggaggccacuuugccgacugccuggagcaggggcuguguuugcuuggacuggcugccgacgggcaaaggaucacaggaaagguguccuuuccaaagacagcccugaugccccauccacucaaucaugcuucgccccauaaaccguggggcaaugcgucccuccugcuuaggccacaugccugcgagcuccgaaugcugcauuucucagcugugggggaggaggcgcccgcuguagcccacagcugcagaugaaugucaccugcugccugcucagaggcugcuaccugacuggacagggagccccugccuaagccgagggcuuccugaccaugcuugguccaggacgcucucuggagcaggugaugucuugagauggcagagggacgaggaagaugugggcagggagggggacgagagaucaaugggggcaggagccaccagaguugaugccuggggucagugagaccuuggccagcugggaucccugggaguagcucaggggacucuuuagaggguuagggcuucaggcugcaggcagcggggcagcacuccgcggguggagcagagggaaggccuuggucggaucugcuauuuaaaugagcgucgcgccugccgugcagaaagcccugcguccacaccucagcccagugcaccauggaggcagcccuucacacacucgcuggacccaggggccggugucccagccccgucccugcccccagcagcccugcccgguccuaguuuuguuccagaauagggaacccugggcuagagccccugucaaggccugcccagcuccaguaaaaucaugauccaaauucugggaucuccagcugccuguuuaaggacacccaauggucacagacuugggacuaggaugcagagaaaccgaacccacagcaaagggcaggcugcagcggcagggacgcagagugaacccaggggcaggcaccuccuccccguccuuugauuuugccacaaagccccucccugccgcucacccugaaagugcugagucaguugcaguuacuuuuuaaugaaagugcagagcaauuuauuuugcaugagaaucuccaacuaucugccccucugggagccagacugcaagggguggggaaaggagcugugggguuuuaugagcccugucacuuaauacacacgaugacgggggcuggaaugucaccucugggggcugccaugucaccucugggggcugccagggaugcuuggcccacucuaccuuugucagcguuuaguuuaaugccacgaggagguuguuauagcccaagucuauacauaaaggauuuacaauuaagguuauuagcaucagguggaaccuaaacuuggcaaccuugcauuucaugcacagaaauaaucguguagugcauuuuguucugauucaaacaacaacagcaaaaagaccggagcucacccacugugggcuucccuugcuaaaacauuuucacaccuguggcagcgccccagguuccugugggguagaagccucuuugaaaggugccugugggucucaaaguacagggacuggcugagguaucaccuccuggggucauagguugugucccagggugguggccacagagaggugacaauacuagguggcugucuauuaaaccugccaggugagguucaggagguguggucuucagccaagucuccuguguuugcaucagugacauauuccaaggucuucuccagcuugcaaguggccacucgucuccaguccugcacccaagaaagugcugagguuucccggguacagaagcugcacugagaaagcgcagcuuugcccaucucuagcgggugacugggccaugcucgcagcccagacgucccagagccccuccaaguuuuacuuuaggaccaugucacagggcagguccugagcccacauacucugucugacguaaagauugagccugccccugcacaccagcaggcuuucuucaggaaaagaccuggggguggaggcgggcggcacucccugggcacugcagcuuccccagcccaaggaagagcucccagcccucagcaggcaucgccccagaggaccgggggcccugccaggggugccugacuucagaagacacaugcuggccaaucagagccccuugucaccagagucauucguucauucauucacugaaacucacugaguuccuccuuuggacucagcucucaccccuggcauggaccugccggccuugcugccucaacggccuguggguggcuggcccgggguggggcgggcggccugugguguccacaucccagccaucucccuugacuccccuuuuuuggaugggaucuuccuagcccuccccuccccuccucucuccuucacucccuuccccuccucuucccuucccucugcccuccacuuucuuuccuucuuucugcaucuuuuucaaaaucgagacagagucaucuguaccaggcaaaaggcaaacccacuuccucuggccccaaggcagccucagggacaagccauaaaccucacuuucgcuggccuuucucuaaaguugaggacugcuaguggaaccccaaacugacccagcagcagccccccaggccccaacucugcccccuguggucuuaggaaggaggagugaggaguccccgccguggccucagcuccccucggcccgaacguccacugcugugacccuggacagcugcuggccuucugcggccacagcccgugccgccgaggacaugccagacaaagacagagggugugggcuggccggggagguggggagcagguagugccaccccacagggcugggccucagcugccuaggagggugaggacugccacuuguuuacagggaagcagauuuuuugugaaacgugacacaaauucauuuggacaaauaacacuccauccacaguggcuucuccuccccgggucugcagcaagcucuccccguguggccccggggugucaggaagauuuaauuccucccuuucuagaauggaugcuuggagggggauguugacgcaaacuaaaaauagccccgcggcccccagccucggccuccagccagccugggcucugcugaacguuaugauguuucucacggaaaggaaagacuaauggauuucuuccuucaggcaauuaaaaagugauuugucacacaccaagauguauggcuuuguauuggcagauaugaggcugccaggggccuggcgggcggggugaccggugaugggaggggccucaggagucccaugagcccccaggagagccaggcugggcaagggcaggguucagggucaggagaaggcuccagguacaguagaugaggcuugaccaugcggcauccagaagggcccugcuccuggcuucaagggaagaagccuggacguuuucuuuuuuucuuuucauuuuuuuuuggggggacaaggucucgcucugucauccaggcuagagugcaguggugugacugcggcuuacugcaaccucugccucccaggguucaagagauucuccugccucagccucccgaguagcugggauuacaggugcacaccaccaugcccggcuaauuuuuauauuuuuaguagagacaggguuucaccauguuggccaggcuggucucaaacuccugaccucaagugaucugcccacuucgaccucccaaagugcugggauuacaggcgugagccaccgugcccggccgacguuuucuaaugucuaguccagcuggagaaguccaggagccccagaccccaacuguccacacccccagccucucugacacacucaguagggagaggaugugacuccgugcuuccugcugcagggacaccccaccucuaccucccuucggaguagcccuuggucccucuuggcaguuccuucuuuggggauaaagcuaucagaggucaagaguaaggacccagcccuucuucagccccagcugcuuggugccaggagggucucucuugauuccuuaguuugagggcagggcagguaacccuggcccaccucccucucuucugucagcugccugcagagggcacagccggccugugcccuaccucaguggagccuggaguggagcccggcagggaagggccugccccuggagggaggcucgggacccauccggcacgugcagcaggggaggggugccccccgacugacuggggacgcuggagggagacuccugggcacauccccacugcugcccagcacccgggcaccacagcgcuggaggaauuaacccaggaguguaccuccaacugccuuacucuuguuucucucaguagguucagaacucaggcagggaaaacaacguacuaauuauugggacccucaacucccaccugggccucccaucucuuguuccagaugaaaucccacccuucccaaaaagccgccaccugcacugguccaauaagagucuucuguccugaacucuuuggggccccaggguccauuccacccuuugacauucagcacguggggcccugcuggccuguuucucuuucuguguuccuucccuuucuuucuucuucuccagcauggauuaaaucucccuugauccauccacucauucauucuucuaucagcgauugggcacccaucguaaacagucacuaccaggcugauggggaggcagguacugccuucaacuccagggagaagagggagguugccaagcccuaugcuuuuuguaaguuucaauaccugacugguaaauaucuguggccuaagugauggauuaaagaaagaagcugaacucggggggccgaaaugggaggauugauugagcccaggaguucaagaccaaccugggcaacaugguaagagccccgucccuaaaacaaacauaaaauaaaaauuagcugggcacaggggugugugccuguagucccagauacuugggaggcugaggugggaggaucacuugagcccaggaggcugcggugugcugugacuauaccacugcacuccagucugggcaacagagugaaaucugucucuaaaaaaaaaauagaaagaaaugaaagaagcugagaagauggccaccucggagggugaguggcaguccugacuugagggcacuagugugcaagaauguccccuccaccaagaauccgaaggccacacaggaaggacuggcucaauggagacgucccaagggcugcagcuuagggcucgggugggcccgggagccuccagguaccgcuggagucaccugccuccuuuucugucacucauucgccgccccugccccuuccucucugccuuucuuccacugcuuucauuuccuucaugguauugaacaucuaaaggacuagcauggugugaagccucaagaacgccagcaguuuggggcauuuuguaggugcguuagaaaaaaauuacuaucuguucaaaagccaacauucagcccaaagguucuguggccgccccagauggacacccagagaaguggaacaggaccaccugaccagcucacagggcaaccugccccgucauaguccucugaagucucagccgcucuguggaccacaggcacggcauggaaggacuguuuauucagugaugcuguucucagaagcucugcgcuucuggaggcagcucaacuucaagacuuuaaggaacaaagagguagagggaggggcugggaguggaccuggcgagagggaggcuccucuccucugggucccccagccuaggggauccgggcacacuucucucaggccugcuucuggucugagacccguagugggccagaauugaucuccuuccuggagaucuccuuccuggacuugggguuccucucccggagucuggggaacgaggugcucaggaguccccucugcagguuuuucgaguaaggauggugguugacacugaggcccaccuugccuggcaaagcacucagcaggucugcaugcauuugcucauggaacccccagcgagucugugagguggcacugugaugacucagcccauuuuacaggugaagagcgugaggcauggagagguaagaacaucacagacucugagacuucgguggaggcacagugacaacaaggcaggaaaagugacucuuaggucacucuuugcucucaccgggacuuuacuauucccaccuucccuccuucccucccucccucccucccauccaugcuuccaucccuucaucuuaacauuuauugagcauauuaagagguuacuggccaggcgcgguggcucaugccuguaaucucagcauuuugggaggccgaggcauacagaucaccugaggucaggaguuugagaccagccuggccaacauggugaaaccccgucucuucuaaaaauacaaaaauuagccgggcaugguggcagaugccuauaaucccagcuacuugggggaggcugaggcaggagaauugcuugaacccgggaggcagagguugcagugagcugagauugcacauugcacucuagccugggcgacaagagcaagacucagucucaaaaaaaaaaaaaaaaaaaacaagagcucacagugcuggacauacuuuaguaaauuaaaaaaaaaaauccacauucugaucuauggcuauggagcugacguuugggagggaaagaugauaauaauaauaaugcacaugugaugagucccuacugugugcuccauaugcagcuucaaaguggcagagacuugacucagauagauccaaguuugaauccugguuuuuucaccuagcugcugugcagccucgggcagcuuccuuaacuucucagacccucccucaucuauaacccacccccgggacugcugggaggauaccuggguuacaguggacagcgacauuugugaggcucccuggaguggcuugauuuccauaaaucaccgaaacaaaugcauguccccagcugcuagggaccgaccagagugccgcucugccucgaaucaacagacuuaauauuuaauaauaaucugcugaaaggcacuucggucagcucagugcaucagugccacacuaauaacaaauuacuucuuaaauuauuagccucgguuccuuucaugaagcucugguuaaguuuguaucaaggagggaggaggacgagcuggggccagcuguagccugaggccaagguggcugugcacgggcugugcccacacacaucugcaucuuucuguguggguggcagccacaggugggcagaggggucugggcagggugccgaggugccagagaagggaggguagcaagggcuguggguggagcugacgagcccuccccagguacagggaagucaaccucugcugggccccagagagaccccacucagcuccuggucgguggcaggggagcaugcugggcacgggcagcagaugccccuccaagaaugcccaccugugcaggaagcuucuuauccagccuuuucuggauauguugccagcauguggccucccaggacagccucacuucuggguuacacuuuauccuggucauggucgccauuuaucaaacaccuacuaugugaugggcuuuacauuacaccauuuccauuaaaaacccaaccacaucuuuauaagggagugacugcuuugccccauuuuacagauagagauguuaagguuccuugucugaggucaagagcuuguagccagcagaucugggagcuacauccagccaguggggcccauaagugaauguuuuuaacccauagacagcagaaguaucacagaggagcagggaacguggacucggggccugccugcacggugcaaauccuagauccuucacuuccauguggugugagcucagguuaaguuacuuaagcucucugugccucaaguuccuugucugugacaacaauguuuucuaccucgaaggguucugugggggcucagcgagcggguacugucgcacggggucagugcaaggccaggagguaugcgucauuacuggggccagauucccacaugguaugcaccgagaggacagagagccccagcucacacaagaggagagaugcagacccagcccaugccaugcagagaagcagguggaggaauguccaaggucacagggaccuugagcaagccugccccaugcccaucucugccccacuccuccccgccaugagguccucuugacuccaagagcuauccuggacuucuguaggcuguccugaccuuucuaugaguuuuauggaggcccccuucauuccauauccacaacagacccgugggaugggcagggcuuggcagaaacuccugguuaguugcuaggaagcagaugcugcaagcagugagcugacuucccugggugucacuaguuacuggcaugacuaguuacuggcaugacuaguuacuggcaugacuaguuacuggcaccaacccugugcaggaguuucuacccuacacaggggaacagaaggcauggaacacauucucacagacauugucagcugcuucaggauggaguacagcauaauuauucuucauucacucacuucauucauucauucauucauucauucauucauucauccauccuuucauuccuuuacauuugaucuuagccaaaaggccaagaaacaguucauucauucaauagcuaugugguuuucuaauuccaauucugccuuucucacugacuuggugcaaguuuccuggccucgguauucccaucugucaauagggcacgccaccaucuuucccaggaccagccacugugagggcacaucccaggccucaugcaaaagcuccuccccgagaccaaugcagacgcugacagcaaaagucagauaccagccugacucagagcugaggaacccaggcuccuggaaaggaggccagaucuccggggcccucuaggagaucccuaguuguauuuaucuuuagaaagauuuuuuuuuuuuaaaaaaccaaaauauuagcugugguuaacuuugagugucaggccuugaagcuauuuuaauuuaaaauuauuccugucuguucugaagguucuaaguuuucaucaaugaacauggauugcuagugucauaacaaagcuaaggaaggcagugaaacacuaacucccccaggccuuuuuccuugagggcuaagcccugagucgacuuuuguuguuuuuuuucauuaccaacaaggaaaaagaaaugcguggaaaagcucaggaacaagaucagucugcucucgucaaucuaaagagagcaagcuuuuucuucccaaggcagcgaugguguggggagacaggcagagccacaggcaccuuugucugggcugugggauucuuggucccacuggugcagcaguggucacgggcuuccuaaccccagggcuccgucucuaguggcuucagagucccuuucuaggcucuugccgcugcgcccuccaaaccuuccccagcuucuuggagcgaucucuagagcauuggugcugcuguuugucccaaccucuggcagguuccagaaagggcagggauugggguggaggcugggagagaacagauagguacaggcugaauuugugaggucggagaaccgcagccacuuguggggcucccaagugaggcacccuuuccccuuagcugguugggggcaugaaacuagaccugggcuuucagcucccuaucuccgggucgaggcagcuucuagugacuuccaagaggaagagccugggcugugcccgaugagcauucuggccucuuaggcucaagauacaaggccccaggucagcugugcuguguuucccugcuaccucccuggcccugccccauccagccccucugcagggccaggacccaggcucugugcuauacucuugccucuggucucagcuccuuuucagacuuccugucuuaggagcgaguuuagaugucucaaagucccaagcugccuggagaagcugcucuguauuuugaggccagagguugaccuggcgcugcuugucuuccagcuuucucuuucuagcccagggaugacucuccagggguggaucgucugggagaugauggcuguaggcugggaccaacaugaugucauggugaagagcuucuguggauucagauccucaucugucacucaguggcaguuuaggucaccuuccggagccuuaguuuccuucucuggaaacagucacuccuucaugggguuaggguaugagucaaacgagaucaucagauauaaagcugaucaugguggcuacagucagugguggcuuugaguuucucaggaugcacagucaggcaggccuggguaccccaauccucacaggggagaggagcagccgcuggccuggggcaggaagagucaggucugcaugccccggugauagccguggggguggagagaccuucucagcagucaaagucccuguuggaaaggcugcuuucuuggaaacacaggccccagcagcugggcaaggaauaacguagcuuaaugcccagagacacaaauagagugaacucuucagacacugcuccuggggguggccagcccuggcuggagggguggucacccagccccaucugcuaacagagagccagggccuccucaugucagccuggucaucugggcaggcccuggccuggccuuggaugcccugaggguauccagaaggcucacugcuagaacgcaggcugguguucuccaagugaguggcuggccucgccccucagccaggccuggaggaacaugcccuucucugccaugaaucaccacacacucaugcuuugucccaccuuugucccucacccuuggauuucuguccaggacuccuccgccuuccaauggcucuugcugcuuuguucugaaccccgacgaggccagcucacagcuguggucugugugcaguauccacggccuggacagaccucagggcuccaggccucagccucuuccacugcaggggaggcccauggccagccucuguccaguccgugcagacugugggguggggggcaggggugugcaguagccacgggcuuaggaaggagaagcagaggugggccuggggcuuuggugcaguggugggcggugggggagcucggggagaugcauagguucagacuggaacuccagccuccagagccccuggagccccuggggugggaaagugccaucucucuuucuucucaccccuggaaaccucuuccccgugcuucuguccugcuuauccuucuccuucugcuugcagugacaaugucuccucccugggaagccuucccguagguguccugccuuucuuuaaaauguugauuuuguguuuaucauggauuuuuugcauuaaucuugauuaucaaaaauauucuauuaaaauauuauuuggcuucacaauuuuuuuuuguaccaccuuaaauuuguaccccaugccagugccucacccugguccuggcccugccaggcuucccaggucugggugggggcucccacaggccgugggucugugggaucaggggacccacacugucuugccugccucccucuucagaccgugagcagcugcccgccuggcccugggcgcuaagugacaugcgggcagugggugcucaguagaugcucguggaaggagugcccacuggucagggcugcccacccuuggcugugaccugagauggaggagcagggugcaggggugguuucacagauauucagaugaggaugaaaucaccccguaucucuugauaccugcaaucaucuuuccagcugggauuguucuggggaaaaugagccucgcuguccucccaggagcuggccugaugaugcucagagucgcuaugaaaaaaaccaucaacucggcaacucuccaauucugugagccucugccugaggccacacugauaauaauaauauuauugaagagauuugcauauaaagaaauuguucccuugauuaaaaaaaacacacacaagaacaucaauagcguaccauccugcggauguggagauggggggagccugagccucugcagaagguuccagagucagggcuggagcugggaugggugagggggcuuguccucugccugcugugggccagaggcucuagugguauguguguguaggggggugagaugggggccugaggaccaccacacugcucccacccugcugcagggcggcccggagaagagugggugcugggggcugucugggauacacauuuccuggaaaaggaaaaugguagagcagagcaacuccuggagccucagccagcccuggccagcccccuggagaggggaugcaagucucaugcagcgcgacgggggccgacgcgggggcggguggaguuuggguguuagacugcauuucucaagggcaggucugcagcccuugauuucuguaccacagggugcaggccuugcugaaugaaugaaugaaugaguggauaugugaaugugugaaugguccacacugguuugucaggguuccuuuuccugaggggccgggaacauggcacaggacagaaggcucagccaaggggagagggaucggugggguagaggacaggauugcgagucaaaaaccugagcgggaggcuguggaccccuuacccaccgggcccuccaggauccugugaggggcaggaugugaaugaaaagcaguccuggguaugguacaaacuggugggucccaaaguuucugauuucaggggcagcaaaguuuaacaaaugagggaacugcucucagcaagucaggaauagcaggaaauuaucucagcuugauaaaaagcaucuacaaaaucccucuggcucacaucaauuuaaugguggaagacugagugcucuuccacagaugaggaauggggcaaggaugucugcuugcaccgcccucacccaacacaguacaggaaguucugaggcaguaaagcaggagaaagacguaaaagccacacugaugggacaggaagaaauacaacugucuguacagaugacaugauugccuaaauagaaaauuccaagaaaucuacaaaaaaaaucuagaacuaauuagugaauccaguaaagcuggaggauacaagaucaacacagaaaaauugauugcauuucuauauguucaucauaaauauguggccaccacaaucacaaacacaauaccauugauaauagcuccaaagaaaaugaaauucuuuuuuguguguguggagacagagucuccugggcacucugucgcccaggcuggagugcaguggugcgaucucggcucacugcaaucucugccucccagguucaagcaguucuucugccucagccucccaaguagcugggacuacaggcacgcaucaccaugcccagcuaauuuuuguauuauuaguagagacagguguuuuaccauauuggccaggcuggucucaaacuccugaccuugugauccacccgccucagcuucccaaagugcugggauuacaggcaugagccacugcacccggccaagaaaaugaaauuauuauuauuauuauuuuuuuuuucgagauagagucucacucugucguccaggcuggagugcaguggugcgaucuuggcucacggcaagcucugccucccagguucacgccauuuuccugccucagccuccugaguagcugggacuacaggugcccacuaccacgcccggcuaauuuuuuuuuuuguauauuuaguagagacgggguuucaccguguuagccaggauggucuugaucuccugagcuugugauccgccugucucagccucccaaagugcugggauuauaggcgugagccaccgcacccggccaaaaaugaaauucuuaagccuacacuucacagaauguguacagaauuuguauacugaaaaugacaacaugccaauggaggaaaaucaaagaccuaguacaugaagagacacauaccuuuuucauggauuggaagacccaaccuagugaagaugucaauucucuuccgauuuaucuauagguuuaauacaauuccuaucaaaacugcagcaauauuucggauagucauggacaauguauccuauaauuuauauggaaaggcacagggcuuagaauagauaccaauauuagaauagaauagcuaaaacaggcuugacagagaagaauaaauaagaacccacucuaccugauacugaggauuaauacagaguuauagcaaucaagucagugugaugucagaggagagacagucauauauuaauagaucaacagggccagacacgguggcucacgccuguaaucccagaacuuugggaggccaaggcgggcagauuaccugaggucaggaguuugagaccagccuggccaacauggugaaaccccaucucuacuaaaaauacaaaaauuagcugggcgugguggcgcaugcuuguaauucuagcuacucagaaggcugaggcaggagaaucacuugaauccaggacgcagagguugcagugagcugagacugcaccacugcacuccagccugggcaacaagagcgaagcuccugucucaaaaaaccaaaaaaagagaucaacagaacagaauacagaacccagaaauagccccaacaaacacacucaacuuauuuuugacaaaggcacaaaagcaauuaaauggaggaaggauaaacuuuucaacaaaugguauuggagcaauuggauauccacaggccaaaaccaaaacaaaacacaaaaaaccaaaccccagaaacaaaaggaaccucgaccuaaaccuuaugcuuuaaacaaaagugaacuaagaaugaauuacggacuuaaauguaaaauuauaauacuuguagaaaaacacaagagaaaguauuugggaucuaggacugggcaacuuaguccuaaaagcaugguccauaaauggaaaaugcuaaaacuggaccucaucaacauuaaaaacuuuuguucuacaaaagcucauuuggagaagaugaaaaagcaagcuacagacugggagaaaauauuugcaaaucacauagucagcaaaggacucguacugagaauauaauaacaaacucucaaaauucaacaguaaaaacaagcaauuccauuagaaaacgggcaaaagacacauagagauaucucggcaaagaugauauacagauggcauguaagcaccugaaagaugcuuaacaucacuagccuuaaagaaauguaagucaaagccauaaugagacauuacuacauaccuaucaaaaugucucaaauaaaaaauagugacaacaucaaaugcuggugaggccgugaaaaaaccggauccgucauaccccguuaguggggaugugagaugguacaguuguucuggcacacgguuuggcaggcuaaaucugcagcuaccacaggacccagcaauugcacucuugggcauuuaucccagaaguucacauaacaacgcacaugugauguucacagcagcuucauuugucauugucaaaaaauggaaacauccggacguccuucaaugaguaaaugguucaaacaauagugguucauccauaacauggaauaacuccucagaaauaaaaaggaaggaacuguggagugagcgcaguggcucacgccuguaaucccagcacuuugggaggcagaggugggcggaucaugaggucaggaguucaagaccagccuggccaacauggugaaacuccgucucuacuaaaaauacaaaaauuagcugggcaugguggcgugugccuauaaucccagcuacacaggaggcugaggcaggagaauugcuugaacugggacccaggaggcagagguugcagugagcugagauugugccacugcacuccagccugggcuacagagcaagccuccaucugaaaaaaaaaaggaacuguggacaugcaacggugguggauacacaaaccuacauguauaauaaauuguagagaaugaaacacacacacacacacacacacaaaugcaaguaaaaauggggaaaacggaaugagacugguggcuuguaucaacauucuggcugugauauuuaugccgacauuuugcaaaauguuaccacugggggaaacuggguaaggaguacuugggagcucucuguguuauuucuuacaacugcauaugagccuacaauuaucucacuaaaaauuucaauuaaaaaugggggcgcugaugggguaucaucuuuuaauuuugccaaauaagucauuaagaaacaaucacccugucuaccaucaccaugcuuucauaaaagagaggacauuuuaaaguguaauaaaagcgggaagaucagucucagaauagaggacaguccuuugaaaaugaacauuuagcuuaugaaaagcccaccacauuuuuuuuauuuuucuuauuuccccauggacugauaagaguuucaucacaagcaauacaggauugaagacaaguauuugggaaccacuaauaucaagugcuggcuaguuauauauuauuauggggaaggugaggugugugggugcauguguguguuugugugacugucugucuggaggggauuuugcagugucuggccaugcugaggaaggcuggucuggaagguucuauggauaccuggggaaugaggugccagggccuuucuuggacuggaagaagccaauaccaacauccuucucacacauuccacagcaagaugcacgaggcuguguggcucuuuagguccuuggcguaggagccugggguagcugggacugcugagagaagguuccccaccgcccaacucugcagccagugcuccccagcugggugcccagaaggggccccugcuccccucuggggcagccacccuagcaaggugggcagaugacgggugcccaugugcucuucccucucugugggagagacacucccacucagccagaccccuccuguggggauccaugucugccuguggcacucaugauggaugggcgccugagacuggaacccaaggcuguauccugcuggccccaccucccugccaagacacuuguacucagcacuucggagaggggccguaacccagcgccuguccacacaucgaauaacucucagccccaaguuguggugguccauagaccccacaggacccugggagaggugggcuccagagccucaccagagcagacucucauuugguuuuuaggcaggaggaggagggaagaggaggggagaggaggagggaggaggaggaggaggaggaggaggaggucggcaguccagccagggcagcugaggccugagaggcggccaggugcugaaagcaacaggguggguucuucaagugcaaagcccuggaaaugaguuggggggcugguggacugguggggaguccacaaagagagcucugcuaggggaguugcuuuuugugcugaagacuuuuggguaggggaacaacauggagugauguguuuuagaagcucccguucugauggugcuguggacugugggccagcacgggacaacugaugugcccgagaugaacagggagacgaaggcaguagucaaagagagaggugaggaagccccaggagggugguggcugugcagauagaggggcagggaccacugcggaacauguaggaguagaacugaccagguuugagucauccagaugugggggugaccagauagaugguggcaccugucagggagagaaggagccccugaggaggaguaaggggacaaaggauuagcccagcaucaccucuacugagggagggggcaugucuguacacagcuguguaugcggccugaagcucaggguuggcucuaggcuagauuucaggauuuggcaucauuggcccgggcaaugagaguggcagagguggcucagggaggagaaauucagugagacggggccaaggaaggucccuggcugaggaacacuggaggaagaaccacaaagccuggcagaagcccugccugcaucuccaaggcuccuugaaugccuccaaagggauccugggcuucccccuccacaccaggcuccaggcgugcagagcuccuucugccaagacagccugagcaguggccaugcuggggagccaccuguggagcugccgugagcaggagcugcccuccuccaggucuggcuaagacuuccccugugcccccaccucuccuggccccugcccaccugccgaagccucaaggagacaggugagggcuguccccaaacuccuccucaguggcagaaagcucugugccagccggcaucagggcaccucuggcaucucaccuuguaaaugagcuuuugaugauuugagaagacuucuaauuagagcaccuguuuaugaucucaacuuuaauugcauauuaacauuuuuucuuccuuuucccuuuccaucuggagugggcugucuggugauggauggggcagggaggaaggccagaagauuuccuugagaacugccuugcucuccccaggagggcucugcuccuggcacagggccgggggcccccuccccuggggacccaagccaucccaaguacuggggcuggcaggccuggagccaucacaggccauuuuuucgggagcacucaaugaggguauggccaaguuugaccucagaagggagaugaguaugcaccaggcucccucugcccaugggauggauguguggcuccuccugacuuuuuguucugacauuggcuucuggagagauggaggcagugagugaggggcaccuuccuuuccaggagucagcuaaguggagcuguaagacaugccauccucccugcaccaggccagcccggcccuucuccuggaaccagcgcugggugggcacagguccauuucuccugagggcagugugggcggcccaggcuccuggaccccaaggcggcccgacaacacgcucuguucaucggcugucuucagggagggauggugcuucucccacaggcaacugccccguggggggacuucaggggcucugcaaucagccuucaccuaaaugggcccuucuaaauggguggagacacugaccuugggggugucacugggcuccuggugaaguugauguggauaggggucaggcccaggauggagaggccgguggagggaacagaagagccauauuagggauggaagccauagggcagcucagccucuggagagaucccgccacaccuccgggaggggcuucuagaagucugggaauccaacugccagcuucguuuuaccagguaguuuuucaaauuguguaagacacagucuccaagcagccugagaguugcugauaggagccauaucccugacacgugcuugcuaaauauaaccugacucugggaucacggucccauccacuucucacauccagcucuggcagacaccacuuagcuacucauauguccucuugucccccagugggagaagcuucucugagcccuuggcccucuuaucuaggcuggaaaaucaagaguuucugaugguucagucaauugcccaggcucaguaagcaaagggcuuaacccugggcucucagagccaggugcaggagggguccuccaggccuccuggggggaucaucgucccucauggcaggacuucucuuuaagggaccuuggcucaaaccucugccuggacauccuccagggguguacuccgaaaguacaucgccaggacugaauggauaucguguucucucccugaugggggaugcccagacaugguagacagaggauguguugguugcucuaagugucucugacccugaagauuugagaauaagccccagccgucagccccugcucaauugcagucacccacccaggaauuuccccaacccuucuugagacuucauaucuguuuuacuuuuuccuuccuuuggaaucauaacauuaaagagaugauauauaccaaagcacuuugugaaaggagaguuagcagcaacuacucagaaaaggagcuaacauuuaguagaaccuacuaaaugccagguucugugccagguccugcaauccuugccauuaucagaacaggauucguguacccauuucacagguuggggaacagcuuuagggaaauuaaaguccuuggccaagguugcagguagaaguggaacucuccugugagguuccccugugacccagcaaucccaucucuagggauuuaucccaaggguauaaccagaccaacaugaaaaggauaauuagaaggauccugguuauuaaugaugaguaauuaggaauaauccaaacaucccacgcucacggacuggcuagauaagugauggaguauuuggagaauggaauauaacguggccacgagaaaggauuaugcagaucuauguccaucagcuugaaaagaugcucaugucagcaaaaaaaguagauuacaagauagcaguggcuaauaucugcccagaaagagcucagaaguucagacacuaaaaucugaagaguuacuaucuuuggaaggugggauuucacacgauuuuuauuaccauucuaccuuuuuuuaaugauuagauuuuuaaacaugggcauggauuauuuucauaaugagaaauaacaauagagcuaugcccauuuuacaaacaagagcccucucagggucuccugugugacucccuuugcuggcagacagggcuuccuuccauuugucuaaaaauaugcaacauuucuucccagugagccccuucuucuggccuguggggaguggaaaacaggucugugacauucugcuggccuucuguggucucuugugggugugaccaccucagucccuuccucuuuucuguguggguuuugcaggacaguucccuagcauuccucuugucuugggguggagaaaugaagaacaugaaauccugaaaugucuaagcaggaaggaaccucaaggagccaucuggucuacccugugccucuuucuuagcuguucccacugucagcccagccauccaaagcauccagcucugaagaggcuucucccagccagcagaggggcgugugugcacuggcucuggccggugagcucccuggcugccccagcugcccuccacggccccuccuccucccagcccccaauuccacagugugacuccaacaggaggcuucgggacagcagaacaauuuaauuccuauuacaguauaaaaauuaauaacauuaaaaugucaugaucaucccacacuaauuaagcaucuaaugaauaauuagcuguggacacaucugacauuuuggucauuaauuugagcaaguguuuuaaguuccaaacaaaaccccucugugguggagcccacgacucuguguuaagcgguggagacuuacaaagucagcgcacguuccccagccggcugggaggcuugcugauggaggcgggagugggguagguucuccugcccuggugggggccgguccaggaaggcugaugcagagcccaccuucucuagcuugggaggaugugacacagggcaagggcauaugcaaagacucaggggacaucagucccugagaccugggguaagagccaccaggcuccacaaucccuuugcaucggcuguucccacucagaggcugaaaucagacaaaccgugccuauuugggacccaugucccacgaccugcugcgcccaugggucugugaaaucacucaaggaaggaaaagagucguggagucuuagcagaccagcagauccugggaaaaagugaaaccaggucuguccagggcucgcgagagguuagcuuagcaggggacgaaggaggggaacuugggagccugguggagccuggacucuggauuugcucacuggugccucucgcuccgagaugagcugcccgggggguggaauaggguguagggagaagucauccuggcuaagaggcagccccaaauccugucaagagcccuggcccggguuuaaacucagcugugcccaucccuggcugugcagccaccccugacugggccauguggugggcauugggcugugagcuaaguacuuacauacauaagcccaugaggaaauugggcacccagagguugaaugacucaccugaagucacauacagaggcagagcccggacaggaaucagguguuuuggugccacaguccgagacuuaggcaaugcuccuuaaggccucuuucuuccugaugucucaggaacccuuccaaggccacaagagcaggaagcugccagggccagauaagcucugccggugagugacaugagcaaggggacaccugggaugaucccagguggaggcagccggggaggaccagccugaugaucccagguggagggagccggggaggaccagccugaugaucccagguggagggagccggggaggaccagccugaugaucccagguggagggagccggggaggaccagccugaugaucccagguggagggagccgggaaggaccagccugaugaucccaggugaagggagcaggggagggccggccugaugauccuggguggagggagcccaggaggaccaccuggcucucaaaggggaguaggaggaacagacauuugcucuuuagguuuuuccucugggacuguuuugaaucucagucugcaucccaagcaggugcucugcagcgaauaauggggugguggggggcgggccucuugggccccgaauggaacauucucaggcacuccaggccccacagcuccagguggaugucugcaccaggaccaggcugcccagugggaagaggauuccucucuucccacugucugcucaugccccuuggcugguuggccagaagcacccugccacaggucucugccccuuggggccuuacccugcagucugggcacagggcucucccugcuugcauuucccaaaugaguuguuucuaugcaaaaggaucucucuuuucuccuuaggacaaaucucauauguccuucaaagucuuuccaggaggccaccuccagccccuucccagccccuggugcucccucugacacaucugcaagugcuccgugaugccaugccacaucauaggugcucaaggaauguuaacucaaugcagaacaagucaaugcccuuccccacucaugcccuucccuucuggagcaccuggcuccugagcagagagacucuggcccaggcacugccugucugcccuguguuugggcaacugcucuuugcuuguuuccucuugggguggggucuggcuaggaagggcuggaggucuaaggagaauccuccucuuuccuccuugugcuagggagcuggaagaggcuccgaggcauggagaucugagccagaugugagggacuguucccucucuggggagaaguccuucuuccuuggauguugucauagguugauucacaucccccaaauucauuugcugaaguccccagugccccagaaugugaucugacuugaaaaaggcucauugcugauacaauuaguuaagauaaggucauuggaguagggugggcccugauccaguguaacugguguuuguguguguauguguguguguguguauguguguguguguguauguguuuuugagacggaguuucacucuugucgcccaggcuggagugcaauggugcaaucuuggcucacugcaaccucugccucccagguucaagugauucucccgccucggccuccaggguagcuggaauuacaggcaugcgccaccacgccuggcuaauuuuguauuuuuaguagagaugagguuucuccauguuggucaggcuggucucaauaucccgaccucaggugauacucccaucucggccucccaaagugcugggauuacaggugugagccaccacgcccagccuguaaccgguguuuugguaagaaaaagccauggacacaggaagaagaucaugugaacaugaaggcaggggucagagugaucuuucuacagccaaggaauugcagcaaacacuggaagccaggggagagggccgggacagacccucucuuccagccucggaaggaaccgaccccuugaucuuggacucuggccuccagagcuaagaggcgguagauucuguuguuuaagcugcccagucuacgcugcuuugcauggcugcccugggaaacucacacugauguccccacaggccucuccaagcugaaauuccaagguggcucuccugaccccacccagcugccauuacgauggcaagaccacgagucagccuggaaguuucucuuucucucccacauccuagcaucuggcaggccgguggcuugaccucugaaucugcccagaaucggccgcuucuccccaccccacagcucuacccuggagguccgcaucaccucccaccugggucgucacaagcaccucccuggucuccccuuuuccccuauggugucccugcagugaagggggcacggggugguguugggaugggagucagugccugucacucaaaacccaccagauucucaccuugcucagugggaggccaagccuuuccagcaacucaagggaccccugccaucuucccuucuggcacuuucuaguaccuuuucuucugccauuuugcagccucugcucacuuccacaaagaggucucugcccucucugacuguccccuugcccugaugcccuguccuaccuagucuucuccuggcucccucccucccagccuccaaggcauggcucacaggagacaccuucucaggggcuuguccugcuggcuuugggaggaugcacuucuguucagcagcuaguauugcuuccuuccccacucucuauguuacggaugcuggguuuugcuauguaacuugcucuggccagcgugauaggaguggauaugacuucccugugucugagcagcagcuugcauggccaacggcccucccgccuucugcucucagaaaaccaagccccaguccagguccagggcgagaccccuggaauagacuugaagccaccccucagccuggacacagccacugaaucugccuacaaucaaauaacuaugcgguccugucagccgcugagauucccagacuguuuguuaccgagcaguguugccgcaaaccugacuaauuugcuacccuugccccaccauuugaaauugcaucuugucaucccuccaggaccaccccaaucucccccuuacaggccuugucuggcuuuauuguuucuuucccauaacacugauaccuuccacauguuacauaacugaugauucugcccaucguuuggggccaucuccuugccccugaugcaagguucucugcuuuaucuuuggcauauuccagacacccagaacagugauugguacagagcaggugcucaguaaacauuucugaauaaaugaaugaaagaaugaaugaaugaaagcacuuucaugagcugacagcuugugcucucccaaggaaaggccucaguuccuuccaggcagcugaguggcucccagucccugaguggcagcugagcgcagagccaggcaacccaucuauccagauaagccugugguuccugaaucuggauuagaaauucuaggaaccucagaagaaacugagaaaacaaagagagcucccugcagacugcgauuucuucuggccuguguucuugucucccaggggaugguguauuagguguuuccucuacaaaguggaguuuggggaccaggaaagccgccagcuccacagucucugcccaggucccaagugcccaggagccccagccacgggaaacaccuggccagauucuagggaaaggggagguccaggaaaccucaccagccuuuugagaucuggcagcaagaaucuggugagaaacugccucugguggggucagaauacacuggucagaacuccagaacuccagauggcuuccuucccuucugcuggaccccgggauguggggaaugccuagcagcagcuggaaaaguucccagauguuccaugugauggagagacagccacagacauaucucaggaacaccugggcaccccaggauccugugccuuugggcuauucucccagaacaggagcuuguguccauggugauaaugauaauuaucauccugcacaugcuuaaaugccacaaagaugccaagugauuuacauucauuauuucuuuuucucauaacacuuaauauaugggugaugauccccacauuacaggaaagaaaguggacacucaaggucacggagcuacuagggugucccuccaggaugugaacucaaggcuuucugauucgaagucugaaguguccccuggugcuauccugcauuauccuggcuuaacugaaaguugauaaaccuacuaugcaaggugcccugcuaauugggaaggggguuggaaaugcucguaggcacaguuccugccuuccaggaggcucggcugacacccaguagcaggugcugaguuucuggcuguggaaagaaugccucgggcaaucgggcgagugccgaaggaguaacacacacggagaguuuaaagaggggaggcucgaagcucccaggagccucccuggaaaagguggcuuuagaguggggcgauggaggguguaggauguggacaggcagauggggcagggucacgcuggcaaagguacagugacucccaaaccaccgggaccccaagcaaugcucucaaacaaaaguaggaauuacaguguguguuuaugaacugggaugccuggaagguagagagccauccuggagcaggaggacaaagguccugcuguccccaguaggguaaacacaauggaggaaacucauuuuaugugaguuucuggaaaggcuggagguaaaggcugcuuguauaaaccacacauucucgccccaagaauuucaucacuugaaagauucuugacgucauuucugauggauuguugauggacucuggaaccucugugugaaauccucuuccuucuccagugccuguggcagacugggcucugcccaucgcagucauaguacgagcuacagcugugaccuaugugucacuauugggagggcacugccccugauccucuuaacaagugggaagguggcacuaccuuccuucccaugggacaggugagcccccaggggcgaagcaaggugcaucaaugccagcaggugucagaggugggauggacccuccaaugccagccugggaaucgcugaacaaaacagccauucugggcucuaccccagaguggggcacccagaauucccggggguggggcccaggcauuugcauauuuuuuacaaacuccuuagaccuaagaacuguuggccuuuaccccuucaauaucccaaacaggugacccuugguagcuugcccuuuaaugaaaacggggaguguuaucucgagugccgucguaccaagcguggaaucuccuccugaugugaaaaucagucugaaauguaucuguugggucacugggucaggagcuuguacaaagggggccuggauggccucggaggacaguguuuuuuuuuuuuguuguuuguuuguuuguuuuugcaggaugacucgggagugacagagguuguggucacugagagucaggguagcuuuucccccuuggucgcugggcugcuaaaaagcuucauggccuugugaacucauggaaaauccuuuaugagcagacuuuggaccacauagcucgccuggcuggcaaggggaggccccauguccacauccccucacaccaggaggcaaagcccaggucuccuagccucuuguucucuguuguaggccgacuggauguccccaccugggggcauggaagggacccagcagcugugcaccguagggucccagccucaggccucaguacguuuuuacggccaaguuauaaaccucugagaaaugggguuuauaauggaaacucugacaccaccuaaaauacagcagcacuacugggugcucccagaauacagcccuaauuuauaaaccacucagggauccugggccauucugaaacuuacagacaauaauccagaaauagaguaaaccaggaggggaaagaaugguacaagugucuguggacuauaaagccugcuggguccgacaguuuagaaaucaaacccgugucacgguguuuucucucuguucugaauccuggcucccccgacccccaaguguugccuggcucuggggaaggcagcucugucaucuggccagcgcugcucuguuuaucuuccagcuguauuuuuagcgugaggaugggauaaagugaaagagagaaaaggcgcccaggcuuugguuugauguaacagaugcauuuguaagacgguuccaacacacucuccuuuaaauugaaaaaaguggugacagaagcaaccugcuuauucuuuagggacaugagguucccaguagauggugcuuccauuugcugccuccagcucucugcucagccaucccaguggggugaguaucuugccuggggggacccacagcagccagggagcccaggacagacccgggaagggaggcccaggcuuguccugcccauagccuguagcgccuggucucaggccaugggcauuuuuuuugcacguuuuccagcccuguaugggaaggggccuucccuuucuuccucauuagcugagugaguugcagaaaucaagagggggagaagguuugcagggagcuagaaugcauuaauuuuggcagacaggcuaaguggguguggaugccccucuccuccagggccagggcugggaggccuugucuuccugcucccucuccuauucuaggacugucccucccucccuucccucccuccacccuuccaaccuuccuaaccuccuuccauucuucaucucuugccccacuuuccuccucccuucucucuucccucccuccuucccucauucacugacucaacaaauauucucugagccuuugcccugagccaggcacagugcugggugcugggggcacagaggugacucagagaacucagggugagcagggaggucauaccugucaacacgcagaugcaugaaagcagcauuucccgcccacuuuaguccgcccccugcuuugcuagucuucuuuagugcugcaaggaauuucaaaauaaucgucaggacuagcgacaaaucaaaguagcaggauuuuugaggaggcuuuuucaagccucaccagccccacgucccagcuuccaggggccucugaagcgccucuuccgacgggugugggaugcaggagucaggcccucugcccaccacuggugcuccccauggcugugacaggggucuguggaggguccaccggaggcccgggcccggcacugcccugcuucaagcccaagcucagagucagggccccaggcaaagcccagcuccaccucucugggcuccagguuccccaucuauaaugugacaacagcaccacuuccuaccuucucaggguacggaaccgauuugaugagaucauaagcgagggcuucgcucccuguuuggaacacagccaagugccccauaaaccccacugguaucgucaugacuuggugaaggaacaagugggcauuacagagugggagccacguggcaaagcccuggggcuuggaccagcauucggucaacagacacacgcuggagagcugcggugugccaggcagggaggccaccgagugcccagcugggaagacccggaggugggguggaggcuuguuaggaggcuggcgcagguggcagaggcugcccgcucagagcuuggacucccuuugcaggugggguccaggucugcucuuaucuggacguggcccgugggccccaaaguugccagcagacuggagaggccccuggggccugggccccuaccuguugccugcucgggggcuggcgcuugcagcuucccuccacccugccucccuccuuccugcacuuccaucuugcagggcuccucggaaaaugcaauuugagucaagccacuuucaauuacuaagaugcuguguucugagcccacgagguaauaaagggccuguuugcccuccugggaauguugggguuuuucaggugccaaagaugagagagaaaggaagugaggccaagagcugcuugggggaguaaacagcuccgauagacccccgugccaggcgugugcccccuccccagccugcagccugcaggcaccugugcagagacggcuccucacaucagagcagccaggaggcagggagagccggagagcuggagcugguaggggugugugcagccgugugcaaaaggcagggugugugcgagugugcaaauaugugagcgugaguuuugugugagcaaguguguaucggugagugugccacugugaggguguuauguaugugagugugagcguguguguugugugagugugggagugagugugagugugugaaugugagaggguuagagggugagcauguaagugugggugugaauuuugagugucaauaugagagcaagugugaauuuugagugugauaaugugagcaugaguuuugagugugagcaugagauguuagugugaauuuugagugucaguaucagagcaagugcaaauuuugagugugugugaauuuugauugugaguacauaagugugagugaauuuugagugugagcaagagauagugugaauuuugaguguuaguaugaaagcgagugugaauucugugugauuuuugaguguaagcauggguguaguucugugugagcauguuaaugugaauuuugaguguaagcaugugaguuugcauugagugugagcaugugagauuuugugugagcaugaugcuagugugaauuuugagugugagcgugugagugugcauuucgagugugagcaugagauguuagagugaauuuuacguuucagcaugagguguuagugugaauguugaacauuaguaugagagugugacuuuugagugugagcgugugagugugcgugugaauuuugagugagcuugugagcauguguacauuauaagggugaguaugagauguuagugugaauuuugaguuucaguaugaaguguuagugugaauuuugaguguuaguaugagagugugaauuuugagugugaauuuugagugugagcaugagacugugugugacugagugcacagguguccggugguggguugaggaagcccaaaccuccaaccuucccccugggaguggggccggggcuccagggcagggcugggcugggcucacuucccuccucugggaaccgggcucagggcccuggggcaccugggacucagucccaccccugcucuccuuugccacaccuggaagauuuuccugguucugguguguuccuuucauucccaguuccugcucccaaguccucaugcugaagcccagugccacagcgagguuauagaggguggggguggucuguuccccaggcagccucuggccggcuuccuccucugcgauucuccacccuccgcuucccucuggucugggccguucugucaucacugaugugaagagcucugccuccccuuccacuggcuucugcuuuccacacugcugcagccugcccccaccaaaccugcccgccugagaaccugggugaggaggccucucggacugggagggccaggugaggucgugcaggugaagcgcccacaggucagcugugcccgcugggaccucagcagcccucgcuccuguaccccaggugaccaugagcacuggggccggacacccaagaccgucccagacugagaagaccagguacaguggacccugcucagcggacuguggugucccccugugccacccgaggacauuccaagguuaucugucaacacuucugccagacccaaaugugcugccucauguggccucugggugggcugucuccuggccugguccccccaccugaccaugggaggaacacccugccccuggggcaccgccaggucccugaaacugcagcccuggguggguggccucaucugaaguccagguccccucccggccccaucugggccugcacaagcuccuuuucccgcugucuccagcaggcagcucuggggccguggagagggugggcuggagcugggggaggguggcacgcucugucuguccugggccgcccaggacuguuuuucuuuugcacuagacgcccacgucccagcacaccccucagguaggcccuaaacucagugaccgcagugcuugcagcagcccucagaagccagagggagccucgacuuggcugccggggauguggugggagcagcugcagccaguccugcuguggcccaugggcaaagguccuggaggccacucagggccuccuuuccugccacuggccagcuagcugugcaacaaacaugugugcacuuggccuccaggugaauauuaugcaugugcccaugaggcaucugugugcuugugccacuuccgcccgugaaggaggcugugcgcuacacugaacuccuccugcccagcugugcccaugaggcaucugugugcuugugccauguccgcccgugaaggaggcugugcgcuacacugaacuccuccugcccagcugugcccaugaggcaucugugugcuugugccauguccgcccgugaaggaggcugugcgcuacacugaacuccuccugcccagugauucugcccagugagguggugggcauggcauucugagaaaggccagcugugucacuguaagaggcacuugugagauguccaugcccucuaggaaaggcuggucugcugcccuaacgguccagagccgcuauucccagugggccuagacauuuuuacugcuaggguaggaaaaacauggaggaccacugcucuagaauguucuggaccucaccucuccccucuaguacauggcugugggcaucuuuggugcauccccaaccucuucccucuugcagguggagcaggcagguggggucaaccccacaccaagcuggaagccccaaaagcuugaucuuggagucaguuggcagaaagaccaggcagcucugagggcccuggaagcagguggccugugaggcccacacucccugcccgaggcugagaaggccucccugacggacaggggucugucuagcaggguccucagauaccaaagggaagcagagcccugugcccaggccaagcccaggcagcaagggggcaggacagcuggacacauucuccaagccuggguaccaggagccacaccuggggguuccacggggccaugagacugugagagacaguagaggaaggugagcguggcugcauggccugguugucaccugagaccuccugggcagcagagccuggcaggacccgggaggcugauugcagacccuuggccuggguccaaagucaguccccacccguuccccgcagugaggacacagagucccccggccaugguauccuaagaacccaccacugcccacagaggcccuugggauggcaggcauggccagucucggcugaggcugccacccucuccugcccgggaggccccucuggcugcccuuuggggucagacuguucaccugguucucccguucugaggcccccagcuccugacuccccucccccagcccuuccucuggcuccucuccagccuccaugcuucuguccccugggacacaagugcggggcagcggagguggcucagagccggccagaugcgucacacuugcagggaacuccgucagcagguguggugggcacagcauccgagugggcaucacugugggugggcaggcuacacacaaacaggaggcuccccccaccucccgagggccacacaucuaagaaucgagcugagcugaaccugacggaaaugggaaacuacccugagagagccuucaggugcccuagacuugggguuuuacucaccaccaggcgucuuaugaagcagccuggccacugucaggccuggcuaagugcuucccaaaugcccugcaaaggcagaugaggcccaggucuggcaccugacccuggaaauggugggggagggcagcgaccauucccuccccuucggcgaagguggccagccagggccaggccagagggagacccaggccaacuccaugguccucuaccugggcuggcuguauuaccccaggacccaaggcugcucacugcgaggaaguucucugcauugugacccgaaagccccuucguaagcacaccuucugaagcacacccucuggcuuaauaaucccacuucuccaucuguaagcaaaaacccaggcgggagggcccuccaugcccuggacccuugcucucggcccccagcccugacucuccaagggcagcagagcccggggcacuuuucugaucgucuggcccuguugguaaaagccaaggcuucuagggcuugugccuggauuuaccucacaagccagagggguggccagcaggcucccccauuccacagagcccaugacacgcccaccccauuguccugacgcugacugaccccacucugugugccaggccccggcuaagaggggagaguagagagccaaauggacauggccguugcccacaggaagcuucuaguguguguuucccuccaagcacaucugugcccagggugagccauggggugcggggcagggggugcggggcaggggccacagggcagggcugccugccucgcuucagcccuuguaggggagcucuugugugcugagcgaaugaaguacaggggugaucucuggaaacguacuacacaucccccacuaagcccagcgaggccauuucuauucuugcgcugacuucacaucuccgucggcauugaaucccccuccagugcucaguguccucaucucauuuaugagggcccgauuccagagcccuggggcuucgcuucuccuuggggucaaaggccagaggcccccccacuccucgaccuggugaagcaauccugcuccuucuugggaaagccgggggcugaaggcgacuuuccagauguggagggaguccuuccuccaagggcucccucacuaaagaggccacuugcagaacguggcugagcuccugcccaagccagggaccaaacaaacacuuggaauucguaaggagauucugcugagcugccggagcccaucaaauuuuuauugaaugcauuuccucuggagaacucguguacuacauccugccuaggcuguauuagaggaauaaaaauuccacacacagcccugacugcaaauguuccuuccuagagcaaaggacacacuuccuccaaagccgcuucucugcaugaagacuggguuuaggcuugccguuggccagggucuggagggguguggagaacuggaccuccagaggggagagugggguggagaccacccuguaagcccuaaccagcugccuuccggggcugucguugaccuuggacccauccuagcaaccugcaaucugcucaccgcugcaccacaugugcuaacccugagcagaaaaccagcaggcgccuugcugcuuccuccuccggggggcuugagauugcagccaaggcagaggauccccuagcuuccuccccagccccucugcagucucagagacucaggcuugcugcaaacaccaggggucccaaagcccucagcuggaggccucaggggcucagggagaacccacugcacaugugagcccccacugagcugccggcagcugaggaauuuggaucccagugggugucuaugcauccuagaacccccagacucuauugcuuuaguaggaguggaugaaaucggugugaaagcaggagguggcacaaagaggaaaacccacagcagaagagcccacaguggagggugccgaugacaugucaauuucagauaaacaauaaaucaauuguggaaguauaucccaaauacugugugggacauaccuagacuaaaauaaaaaaaaaacuguuguuuauccgaauuucaaaaguaaccaggcaucuacaauuuucauuugcuaaauuugguaagccugcaccccagccuccagggccuccaggguugacagcacaaaccaucccucucuccucuucccaccaaaacccacaccccgccaagcccaaggccaucccuaaugagaugucuuuggcgagcauucucccuccagcgggcucuggagcacagaaaccugaagcagcagcugugagggcacaucugguccggagaucccgggaacaaaggccguucucaggccucccuuccucuugccugccaggaccuguggccugcacuucccauucaucucagcaaucugccucccgcccuucuguuggacuuuucucagcuugaugccuugcucugcugacuggaagggcagggacugaggcagccuuccagggagagccucccuggagggucuggggagaaugcccuagaaccugcuuacucagcauacucucucggcugccucgccagcaguggugucaaggacgagggguggcgcguggcacaggugggugguaaccgcuuccgaggaucugugcuugcuuuccugaaaggucugugugaggcagcuuugguccugcagacccuaccucaguccccuggggauggcucucggccugggcuacgguucccagaguuucugccugggaccccucuugccaguugggugugaccaguugagcaugaagcccugaugucuccugggcuugacagcggccacaagcucugcccuggaacugccugaugucaccgagacuugcugcuuuaaggcagcaaaggaaagagguucugcucccuucucucugaagccacccgcagacucugaggcaagggaacaccggcccucccuccaucuggacggagccagcccacgccucugacuuugagccgugguaauugaagcugggcgaccacaggcaggaacacggccugagcaacagagggcccuugagaggaggcugcugcugcuacagaagcgggcaggacccacgggcccacccaggggagcagggccgcguccucaagaccagcgugcacagagugggcgcaguagccugagcuuugcucaagaaggucuccagaccugcagagagaacuagaugccaaacaccagaggcucacacacacucacucaugcacacacacacacaacaggcucacaccauccucucuacacacucacucacggacacacaugcacacacacacucauauacauacacacgcacaccaggcucacaccauccucucuacacacucgcucacggacacacaugcacacacacacucauauacauaugcacgcacaccaggcucacacaauccucucuacacacucacucaugaacacacauacacucauauacauacacacgcacaccaggcucacaccauccucucuacacacucacucauguacacacaugcacacacacacccauauacauacacacgcacaccaggcucacacaaucuucuacacacucauggacacacaugcacacacacacucauauacguacacacgcacaccaggcucacacaauccucucuacacaguaaaugugcacauaugcacacacacacucauauaccuaugcacgcacaccaggcucacacaguccucuccacacacucauccucucugcacacucacucaugcacacacacacucauauacauaagcaugcacaccaggcucacacaauccucuauauacacucauguacacacaugcacacacacauacauaugcaugcacaccaggcucacacaauccucuccacacacacucauggacacacacacucacaacaggcucacacaauccucucuacacacucacucauggacacacaugcacacacacacucauauacauaugcacgcacaccagguucacacacacucaugcacacacucacauacacaugcacucacaccaggcucacacucacucaugcacacacacacucauauacauacgcacucacgccaggcucacaccauccucucuacacacucauggacacacaugcacacacacacacucauauacauacacaugcacaccaggcucacacaauccucucuacacacucauguacacacaugcacacacacacacucauauacauaugcacaccaggcucacacaauccucucuacacacucauguacacacaugcacacacacacucauauacauacacacgcacaccaggcucacacaauccucucuacacacauguacacacaugcacacacacucauauacauacacacgcacaccaggcucacaccauccucucuacacacucacucauguacacacaugcacacacacacucauauacauacacaugcacaccaggaucacaccauccucucugcacacucauggacacacaugcacacacacacucauauacguacacacgcacaccaggaucacaccauccucucuacacacucacucauggacacacaugcacacacacacucauauacauacacacgcacaccaggcucacacaauccucucuacacacucacucauggacacacaugcacacacacucauauacauacacacgcacaccagacucacacaauccucucuacacacucauggacacacaugcacacacacacucauauacauacgcacucacaccaggcucacaccauccucucuacacacucacucaugcacacacacacucauacauacacacgcacaccaggcucacaccauccucucuacacacauguacacacaugcacacacauacauacacaugcacaccaggcucacacaauccucugcacacucauccucucugcacaugcacucauguacacccaugugcacacacauauacacacauacauaugcaugcacucaauguagucauacauccacauacauucacaugcaugcacacucauacacacacugcacacagauguucacacucacacguacacacacaugcacaugcauauacaugcauauacagguagauuaacaugcacacaugcaacacaacauuccuaugcauauacacccacacccacacucacucucauacaugcucacacauccacacacacugucaugcacauucacacacacucauacacacgcacauccacacacucauacacacucauacacauucacucacacacauccacucauacacacacauccacacucacucuacacacacucauacacauccacacucacucuuacacacacauccacacucacugucacgcucauacacgcucacacucacacacgcucucucauacacucucccacacauccacacucacucucauacacacacauccacacugucacacacacacacacucacucucauacacacacaugcacacacacucacaaaucuccaguauccuguugcucauacuagugagcaggggacguuuccucccucccccucuccucaggaugcuccccgcaccccuuccccacucucacccccucuuuccauaaggacucuccaggaaggacuggacucaucccaacaugccaaggagagacucccacagggagcacugagggccucgagugaggcccagcagacaaggccugucuuccgagcagccccgucaucucuccugccuggguugugggugggcugcuugcaucugucucugccucaguguuuugacuuugcacaguagaauccacauuagcacaacucuccagaaugaaaauggccucccaggugucuagcgcugccccccuuacuaaggcgcacuccaguccgucugcucucuccugccgucauggcugagcucugucauauucucuucugggcccugaguuuguguggcugucucuccagucagggaagucccuuaagagaaggugcagugaaaaaugaaagugguagcauucaugagaguacaagaagcacaaauggaaggcaccacgcaaugugacgugagagauuuccauucuagaaucucaccaggaacgugugggugaagcaacaaaggcugauuugugguuguggcaccgugcaccaaaagagauugccagcaugcagggcuggggaugucauuccuguucucuagaugggccgugccuuguccaagguugcccagagugaggagcagagccaggguggauuucagccaggguauaggcuuucugccugcccagacaccaagagguuuggaggaugggauggggccugggcuuggcccccugcgugagcuguugacaugggggagguggcuggcuucuagcuccaggccuccucagggacagcgcagugucugugaccagccaucgugucugauggguggggauuggggccucacaggggcuccaucuccaggggaggugugagacgggcagcuucucccgucugacagaagccauucagcgaguggccucaggagaagcggcagccacuuuucuuucugcuuaucuugggugaugaguuuaauguucagugaaacugaaaagaccguggccuugguggccucagcuauuuuucucgagcccuagguccccugggguggaccguggcuuggcuuuuaugccucccuucccgggcugugccacuuuugcauggccuaggaagggagagugucucgguggcugcucaggauggaggcucuugggcugugucuggccugagguugcgcuugcugaccgugcagugacuagcagcccugggaggugguguuggggccugggaggccuccuucccuggccgugccuggggccagggugcucuuaggagacgcuggaccccugccuacugggaggcagagggaucaacaacacgaccuuccaagcaccuuccucuccaaggaccacaggacagggguaggggaugcuguccucucucccugccuuuauuuuaugaaguaaccacuuuuuaauuauagccaacaccagauaagcaaagcccaauggagaugcuggggauuaaucccaggggaacauugcugcaucugaggcguugcagccaccuggguacagggcagacacugcagccagcagagcccauguccgcccugucugcugcaggaggaccugggcacgcaugugcacacgcaggcugugacagguugggggacacagacagugcacacgggacuugccccuccccacagucucaugcucuuuggggcuucauguccucacccacaugcuuacccuuguucaaaucccugucugcaggccacgcccauacccggaaagucacgagcucacgugccccacauagagccaucuuacagagagcccacaacagccacacacuucuuucccucuccagcaccuccucccgcacauggacuauuuuucaaguacaaaggagcccccagccuauucagacugccugugugaggcugaccucaggcaaaggcagcccggggagaggauggccacacagcucugagccggcccucuggguccuggcggcugggucugcacaggccgcuccccuccggcucccuggggcagcccagagagcuggcccugggccaggauagagagaggaaaugguuccccaguucagagggccaagcaaggagcuuucaucgaccugaaaugaaacgauggccaggaggugcucugggcaagaccaagacaggacccugggaacaggcagugcccgucaccucccaggacucgcaggcuuuccugggcggguuuagccuggaggagcccugagaggaacucuguuccaacaagaucuagggaacucuggcuuaaaugacacagucucuugguuaacaaaguccuuaugagcagaaaucucccugauaaacacuuaaaucuggggguaggaauuuucauuccgcaccuggccagggccuauggagacuccaggguggauccuucuuugccuggaagaaggcaaaguguguaggguguuucuuccagcccugggaugcuaacaggcuuugccaguccaggaaugagaggccaggcaucaagaguccugacaacccgacucaggcucugccuggcugugccaggagauguggggcccugccaugcccaagccggguagaugccagcugguggucaaggcaaaucacuucuggggauggaacauggggccccaaagacaaaugaucuuagaucgggcucugaugucacaaggaauucaucgccuccucucccuacgcucacccacaucccaaacuugauccuccucacaaagcccccagaacacagcugcgggaaucaaaugaacucuaaucaugaucguugaagaucaaggcaugacaaagcccagugggaaaacuugcuaaauaaugguuuguaguuuaccccccgaaacucuccagaucuuccgucucucacgaggaugcaggcuugcugucugguuggagauaauuauuagguuucuuaauuauuuauaaguuugcaucucuuauuucucugcagcuaccaaacaagagccugaguuugagaggauuuaaacgacgggggcagccacugaggggcaacugcauggagcccaacagagaccuaggauccuuuucucaggacaagaagcaggagagggcuuggccccacucacccacagucucgggaucccagccccagucugagggcguagagaacaggagggaagggucagcguccucuuccucaggacacugccggcuugcuggucaaggcugccuguucccuacuuguuccuccccuggcuucuaucuggaccagaccucuuggccuuuuauuuuuuauuauuuuuuuugagacagggucucaaucugucacccacgcuggagugcaguggcgccaucucugcucacugcaaucucuacuucuggaguucaagugauucucaugccucagccuccugaguagcugggauuacaggugugcgccaccacaccuggcuaauuuuuguauuuuuaguagagaugggguuuuaccacauugaccaggcuggucuugagcuccugaccucaagugauccgccugccuuggccucccauggugcugggauuacagguguaagccaccgcacccggccccucuugguccuuugaccucugcaucccccagaccccagcagcugcucuuggcuucccgcucaugguuucaacuccccggagacggccagagccccuccaugccucagcccuccuggcagaugccugcagcucaggagauugaauuuauucauauuuccaggugcuguacauucugaugagguucuucuccggaucuccugcccagaaaaggauaaauauuucugaucuauagcaaauguguuuuccuuuagcuaacaucuuggcaggcaaguacacuaaucucucaggaaaaucuagggccugaauagcaagcagauuuuucccccucugaacaaauagaaauucugaguuacauuuuuuuuuuuuuuugaacagcagaucuggagaagaaucgcaguccaugaaaucugcaucucuugaaagaaaaacccagaaggccaccucccuaucaaaggcagaaugaacccaguuuggaaacguguuuaaaaugcacgggggaguggcaaccauccuaaauuaccccgcuagcccucccgagaugggcaggagaggccggcggguggccugcugagccugggaggcagagacggggagugaagccacauggccccauggggccauccagcacugcagaggucucagcagcaucccgcccccgacaggugccacgugacccccaagcugaacacagagcacacacccacaagacuacaaaaucucccaacagccucauuucauagaacugcauuucgcugacuucuguaggaugcguggccagggaacccuuugagggaauccucgagaaggugcccugaguuuacagagugggcaauguccccucaaggacaaacucuuccgcugacccccccccccccccaguucccugggggauggaugcugugcuuuugaggaauaaaagaaaggucagagaaggaucuaaaguguguggauccgucguugcgugccugguacugugcuuggcacuuucuuaugugugccccugcgcguguguguguuuguaugguuaugugugugcacgccuguuuauauguuuuuguguguuugcacguguguuuguauguuugugugugcauguguguauguagguuuguguuuuugugugugugcacguguuuguuugugugugcgcacguguguuuguauguuuguguuugugugugcauguguguguacguagguuuguuugugugcgcauuuguauguuuguguuugugcgcguguauguuugugugcguguguacguagguuugugugugcgugauuguacguuugugugugcguguguauguagguuuguguuugugugugugcguguuuguauuugugugcgcguguauguagguuuguguugugugcucacguuuguaugucugugugugcgcguguguguauguagguuuguguugugugcucacguuuguaugucugugugugugcgcgcguguguauguagguuuguguuugugugugcgugcauguguguuuguagguuuguguuugugugcgcguuuguauguuuguguuugagcgcauguguauguaagucuguguuuaugugugcgugcguguguguuugcagguuugugugugugcacguguguauguagguuuguguuugugcaugugcgcguguguuuguagguuuguguuugugcgugugcguguuuguauguuugugugucugugcgcgcauguguauacguagguuuguguuugugugugcacuuguguauguagguuugugugugugugcgcgcguguguguauguagguuuguguuugugugugugccugcguguguguuuguagguuuguguuuguguguguguguucguauguuuguguuugugugauuguauguguuugugugcgcguguauguacauuugugugugugugugcacgcguguguguauguagguuugcguuuguaugugcgugcguguguguguucaagcccucacagugcuaugcaggagcggaugagcucucucucuuucauggccauggaaacccuuuccauccuucacugcugccuccugagcagcccgggggcugguggcaggggcauagagcacccuugcucaugugcacaccccagcugaggaucccagacugcaaaaggccggagccagcucuucugagccucuaugcaugucacgcccguaagcccugcccagcccuaagcagggcagagcagguccugggcccccguagugccuuccuuuuauccucuucacugagaaguugugcuuucugccgacuucacucuauaagcugaguguaucgcccuggccuuccucgcagaggaugaugggaaagacgcucuaccaaggaggacuugcuuagcaacuucccagcuggggugaccaucaugcucuuggacgggagggcacccugagccuagugggagcgugucccauccuagacagguuuccucgacuccacccuagagccagggaguggccuugagccuccuguuuagaagcucuaaccaagcaggugacauucugacauccacaauguggcaaucaagacuuccagggugagcuggccagagcuguggacacagauucggcagcagcaugggucuuuguuucgucggaacaccaaagccucggcagaagggagcccauuaaguuugcauuuuccaucauggagcaaguaaacaaacccagaggaagcucugcccaucacugagcuggcuucgcgacaggaaaugguaugagugacuucguuuuuaaacauuauuauccucuugaaagcaaaagauaaaggaugccuugaagcagccaaauugcuuuggcucaaaaaucauuuuaaauaccauuuccuuuaacaagccugcugccugggcaacggaucaacacuauucauuuuaaccuuagucaguagaaaaaaaaaucaccgaagugcuuguaauuauuuaacgcucugccuuuuuccccgcccagauugguuaacuaaugaccaaaacaaugcacgccaagcccuguuuuaagcaauuggacaaucggcaguacacgcagaacauuccggaaccaucuucccucugugucuacucuaaacaugggcggggggauucaggguuaguuuuggccuuuuccagaaagugagagaaauagccuuccccucuaugguuuguguuugugaaaucaccaggugggggugagaguucacccgugcccguccuuaaguaaacaagcaucaagaggcuccuugagaaaccuuaugaacaggaaagaggguggguggaguccucccggcucugccuuggugagugcggcucaggugauggcaggggguacauggaggccggggguggucucucagggugcuguacagcccaaacaccaucagaaaagcuuggaggaguucagauguggagguagaccaugcuagagccuccuuuuuguuuuggaagggaacagaaggaguuucauuagguuauuugcaaacaacaaaacucacacaaauucaaagaaaaugacauucacagaacaaaagcugagucaauggaucggagcuggaguggggaagagacaagcacagaaggaaauaucuuugcuaccgaagccagaaguccuaaacugcuuugggguuauguccucagccuggaggcccaaagucuucccaggaaagagcauccugccugagagaggaaagcaccucccacuuucugcaucaaggagaggaucucggccugacaacccagucagaggacuccugcggcagcagcaccuucuagcacagaccucaaaagguaacgcacgguggcugggugccaaggccucaggucacacuggccacucccuggcagaggggcugcuuugucacuuuuuuuuuuugagauggaguuucgcucucgucacccaggcuggagugcaguggcacaaucucggcucaccgcaaccuccgccuccuggguucaagcgauucuccggccucagccucccgaguagcuaggauugcaggcacgugccacuacgcccggcuaauuuuuguauuuuuaguagagacgggguuuugccauguuggccaggcuggucucgaacuccugaccucaggugaaccgccugccucggccucccaaagugcugggauuacaggcaugagccaucgcgcccggccaaucacugcuuuugauaaugacaguuccgacuuuauggagggcucacuguuguguucugggcaaucgaugcccgcggcagugaccgcacauuccuaacugcaucucuuauggaaagcacaucuccacauugugcacggugcaaucccaugcgaggaggcauagcaagggaagcucagcaccagauucacccagaggacaggcugguccuggauguggggagaagagcuauuugcuccuaucguacucugcaacauuaacuaggaugcccgagucacuccuguagcagaaagcagucacccugaagcagaggcugccgcggagggcuucaccuucaggacgucaccacagagcaggccugugagauccaauaucccggcguggaacauuuccucggggauccaagugcccucccguaaccgcugaaagucaccccaucugcugagcagccagaagcaagcugaugaugccaguagccagucaccccgucugcucggggccagacauggaggaguggggacggacaugucccacccucgucuaggucaugggaugcuggccgaaggccccuggcaugggaacugcuccgggccagggguuguggagggcuggacaggaaaggaaugaggaucgccuccaccacuacagccucaggaggguggggaggcuggaugcgugccacuuuaacgaguguguauuuaccaaauggauaaauucugcgcaaugcuuugcauuccaaauaacuugccaccaggucccuugugagucuccaccugccuagacugugagcuuccuaagggcuggaucaccccugcaacccuagcaccuggcauacuaccugaccccuaacacgcauggaugccuaaggagugaguuccuccgacaccuggagaacgagaugcagaggcucgccgggagccccagugcccugcaugccaauggcacacaucuucuccaaacacagccucucucuaaagagcugccucaaaucagccaugccuugcccugacagcuguuuccuuccccugcaaagacccucgaaagaucucuuggcugugauuugauuugagcucuucuggaagguccuauagagggccuuaucuagguuguugaaucuuuuucagcaucuggaaacgggggacagaaacaaaugggagugugucuagggggcggcaggcaucauggccccccuucccaggccagggcccaccuguggcaaaggaggccccaaauaauagccauccugguuuucuugcaugugaggccacggagugugguagcuguugccgaaggugacugagguggggagagcucagauuuacccagaggcucugugucccucuuugcagaaaugucagagcccauguggcgcuggggguggcagcgugugugugugugugcuuguauguauauguguaugugugaauguguauugugugugacgugugcauggguaugcauguguguauaaauguacauauguacacgucugcaauguguauuguguguauauauguauguguauaucaugugcauaugugugugauguuaagguacauauuuguauuacauguguguauuuauauugcaaauuacaagcaugugcauauguacauguauguguauauauguguacauuuauguguacuauggguauguaugcauauguauauauuuauguguauauguguguguaugcaaguguuuauaugugugcacauaugugcuuauauguauauguauauuguauguguauguguuacauguaucaugcauguauguguacacauguguacagauguaugugcaugcauguguacagauguaugugugugcauguguauuguguguacauguguguguaugugcguguguguguauugugugugugugaugggaugggcagaaauaggcugaguuguugucccugaucccagccccucucagggucccuuugcuccuuggggcuccaggagcgaagcuggggguaaugaggacuccuuggagccaguggggugccagacaccagggucuggagccaucccuggccacuccaggccuccaucccacauccuaccaggagcacccacacuuggcccagccucacagcugcuccagcccccuguccaggcgcugcugcuggaaaggcucuggucaccugagagcuccugggaucaagcaccuagagagauucuagagagauugcagagagauucuagagggagauuccagaaaggcuccagagagauuuuagagagauucuagagagguucuagagagacccagagagacucuagcaagauuccagagagacugcagagaguagaugggaggagucucagagaaagggaagggagagccuggcuccaaaggcaggcaggcuuuuccugagaggcugugugggagguggcggcaaacgacaccacuccggggaauggcuaagaugcucccagcagggccugggguccugaggcagagcugugacgugagcaaccgaggggcucagcagaaacagcaaagaaccuggacagaggggaaggggauggaggagaucagggugaaggacagacaagggccugggaucccuuccucuggggggcgauaagaaugcucuggaaagugcagccuuuggggacacucaguuucuugcagucuugucccucugcucuucagucaagaacugagcaccugcuguaagccaggcccugugcgggaccagagagcugagaagacaccgcauccucagccucagccucaccugcaggcugcagcagguccagcaucugaaugggaugcuagagagcacgggcagguccuccauggacguccagacagagcuggcacuaggguggaaaucucaagaggugcccaaacacucagccaucaagacaaaugccacugcagugcaauacuuuaaaauaucaaaauuaauccaagaauccuugaugaacaaaauaucaacauuuuaaauaaagacagggucagucugacugauuuuucccuuugccuuaaagcuuugguguagcugggcauggccccagagcugggguggggcuugacccugaguaaagguuucuuaccccaaagugcugccuucuuaguucccucuugguggccacaacucuuugcuccaugguuaacugaggagcuugaagaguagccgauaaccguggaggggccuucaugcacuugcuacaggagggaggaacacgagacgcauagaugggagacagaccagcugcgggucagaaaggagccccuccuaucaggagcaucugugcucauugagcaucuacuaugugccguguaucacgcuaagugcuucacauuuguuagggauuuuuccccucccaacaacccuugagucaggugcuauucucauuucuguuguacaggugaggaagcugaggcccagagaggcugagguuaagccacuucccuagagaagucagggguagagcuugggugugcugggagggcagacuggggaagccgccgcuucuguauccaggggguugcucacagggcuuucagaggcaggaccuucccucagauccugccuuggggagauggagcuccagggaggaaagacaagguucacccagagugucauuuugaccaucaaaguggaacccaacagcggcacugccaugacccugaugaaagaugcacuugggucaucccggacacaggacagacagggagccugagauuagcuaagccuuaggucuggaggagcugagcuguagcaacaggggacagagaccacccuggaagucaggucucagaggccuaaagcaggcccccgucagccuuggaagucuccauggcgacagaugacuugccccaggggaggcucaagagggagacccugccuuucauuccuuaaggcaugagcauuaucagucuuggccagaaguagagaggcccaaacagguccuaggagguuggaugugcagaggcaauacaagacuggguuguuggagcuggccuguacuggcucaugaaagcagccugguacauuuuugagaauuuugcaauggauaucaugauaucauguugguagcuugaagacagcuacaguggugguauuuacaccauagaaauuggcaaacguuaccaaucagaaauuuuuucuuucuccuggagagccaacuguuaggcauuuccagcauaccacugcuuugcaggacaaaaucugaacaccuacgaaaaucuggccauucugcaaacugucacaccgaauugaggagcaguugcaugucucuuccugaaagaggcaaucaucaucucaaacagcaguuauaugcaaacgucacuucuggagcugggaaagcauggucuguuucuggcaguagaaugaucuuuuaucuaauuaagcucaacuugggcuaauguugugagcgugcacucucugaucagacaccaacagcuggcggcugaggugcaugccgggguggccugagaagcuggucuggaguguuaaaagugcuguggguugcccaccaucucuauugagagggaagucucagaaagagcccagccaugcagucaggaaguugggguucaagcccagcucuucugcuaagucacugggugucccuggauaagucauuggccugcccuaggugacagcuuucccaugcaaagcaaggcacugggccggaugguuucugaaguccugccucgccugguggggaaggggcagagucauugugacucagugggaggggcucuccuggacucacccaggggcccagagccuggcagggucccagcagcagaagauccugccagugacucuggcaaggaacgucagccccaaaccccaagcaugcugcacucucucugcuguggcucucagcccggcacugcccauacuacuccaaguucagaauuauggcuuuggcagaagaggcuccaugaccaaacccuuucaccuuccccagcugcccccaaaggcagcugaucccagggagcugagagcagcauguggcagggagcacgaguggcugucaggaggguggugggauggggcuuccuucuugucuccccuaaggcagugggagugacugcucugacacacccugagagacgaggcacgauggagacaugggugacaacuggcaacugcagcuauguaaugcgcgcacaagggccguggcuuucaggcucagacaucaggggacacagggaggccauuggccaggaaagggugggggacuggggaugggcagccagagaagauccuccuguggaauucugaauccaagccuuuuggaggcaacagaaggggcuggauccagguccgggcagcucuggggacauucccagagucaccagggcaggcauggcccauggugagcgugggccggugcuuggccaaggucuuuggcugugaaugcuggaagcaguggccuggugggucacaguguacaacucaacugauggccagagaggggagagagccuaggacggggucuuugugggcccagcucagcacgggcggcucuaucagggguuaucacgugguuuuguaacaacacaacggucaugacaacagccacgauuuuuuuuuuuucugagacauagucucgcucugucgcccagguuggagugcaguggugcgaucucagcucacugcaagcuccgccucccagguucaugccauucuccugccucagccuccugaguaguugggacuacagguguccaccaccaugccuggcuaauuuuuuauauuuuuaguagagacgggauuucaccguguuagccaggauggucuugaucuccugaccuugugauccaccugccuuggccucccaaagugcugggauuacaggcgugagccaccgugcccggccacgauuguuaucugaaugcuggucuauguccgacccugugcaaagugcuuuaaaaauucugcggaugaggaaacugagccccugguuuuggguuaauuagcccgaggugacacagcuccacgugguugaagaagggggauuagaacccaggucagugugaacacccagggccugaccuugcggcugcaucaggacaacccuuuccaggccuccuggggagaggcucagucuccugggacugggggccagccugagucaggcuggugagccccccgagggaaggcggaccugaggugggccccccucugugccagguacucacccaccuacccacaccgggucugcccugggaugagcuggugauggcccugcggccccaggccacggucugcaaguggcuguguuuuaugucucuugcuuggugaggcucagagugaaugcugggucuacaauauuuuagcccauaaugaagugagcacuuccuaccuacgaggguaguaagugcagggccaagguggggcucccccagucucccuggccaagggucaaagugggaauaaaaaugauagaaagguccucugccccaggagggaacaggcccaggagguguguggagcucaggcugcucacgggagccaggucaggggcuggccgacuccaggagccaccccugggguccugccacggccugugggcugcguucuccagcucccugugcaccugaggaguccuccagucagcaggaggcugcaggaaggugagguuucccuccccagggugggacgagacucuguucugcaacccccugcuccccgcccugggcuacugcccuguccuggggucagcaagaugccagcucucagccucccucaggacgcugggccccggcagccugaggucaagggggaauccuccagccccugcucugguuccuggcugaucucccugcccagaggcuuuuacaguucuccccaggaaaggaagggaacuugcuucuucccaguggcuuuggcugcgaucugagggggcugcauuccuugucucugcccuuccucaggguggggagaagagcuccccgagcugagggucucccuccggcccaggcucccagacugcagucucuggccgugguggcuucuugucgcugccacgggcugcucugcaccagauuuuagauugaacucaacaucccuucuuaaugcagaauuugcaucuuaaacuucucguggcugaagcaggacuccugauuuccucccugagcucucuuccuccggucugacugcaaugacaaaucuccauccaugcaacccuccuucaugccucucuuucccucacugccucuuuccugcucucaaauauguccugagccugcagggggcugaaggauucccccuugaccucgggcugcuggggcccagcuuccugagagaggcugagacauauugaaugcagagggguuggcucagccuccugucuggaguucugcagcccucucaggcuguagagguggccccaguuggcuggcacuggcuccaggcucacccugggaugacaugggguggggccugggcacauuuacagcucacaucacucugacugagaggagguguugacagagccccugcaucagggaccugagcuggggacuuuccacaggagacgccugcaccccaaugccaccuccucugcugcagagaaacugagggcacagauagggcaaaaugagaccccaugggagcucauuucuuuggaaccgacaguguuuuucugagaacuuggucuccaaacuaagaaaccuuuuagcaauucaggaucaacaaacguuucugccccgaauuuccuucucaauccuccaagcuaagcucacagagaauucucaugccuggugucaccagggucacccuuucugggcauuccaaaggcucucugaugcuuuaguucugcccaagcuaaggccaguuuaaacuguaucucuaaagagcaugucuucucccucuucaggaggauggagggagguggggacacacugcguggagagcgcauccauucuggugucuuuaccgagugcugacgcuugugcucguggggcacagcuggaccuaggggcagcugugggagagccuaggagaaaccccaggaaguagugaccuggcccugcccucaggaagcccggugcuggauggauggacaccauucacaccuauccaauaaacaaguacuuaugugcuaggcauggcuccaggcacuccaaauguagcagugaacaaaacagaucaugccccugacccuguggagcuuaugcuugaaggauggggcugggcuuggggggauagacaaggcauaaauaacacaguaggcaguagcaacaugaugaauggcaaaauacgauguggagugaaagaagccaaguauauaccugagugcauauacugcaggauuccaguucuacgaaguucuagaacagaaaaaaugaaccuauaguggagaaaucagaacagugguggccucugggggugaaguggguauugacugcaaagggacacauggguacuuucuggggugauggcgauguuccaaaucuugaugugggcuuaggguaugacugacgcacgcaucgaucaaaacucaucaacuagugcacuuaacauguaugcauucaauuguuucacaguguauaaacuuuacuucaaaagcaaaaaaaaaaaagaacuguaugcaaauauugaacuuugguuaaugcuaugcaccuugaaagacuugggggaggugugcuguggcuguugcuuacuuugaaauccucgaaaaauugcuggauagguggaacacguaagugaucaaaugauauggucaaauguuaacggcagaaucuggguggcagcuguacggguguguguacaauucucucaacuuuucuguauaucauaaacauuucaucauaaaaugcuggggagggaggaacagaagggcuugccagagagugagggaacaguagauggagugucaagagggcuuugauguggaguugaaaguugaaaggagaccugaaucuuagugugaaccauggaagguccagggcagccuccagucagagggaggagcaugugcaaaggcccugaggcacgaaaggaccugacucuuugaggagagaaagaagccaguauggcuggagagugagcagggagaggaagaccaaggucaaggguacaggucuucagaggucacgguaagguuuuggacauuaagugccguggagacuucuugaacugccugaagcauaagggugaugugaucugauuugggauuuaaguggcugcccccaccgcuuuguggagagugcagcacaggcuaagaaggagggacuccagcucuggguaggagggagccguggcuuaggguugggaagcagaagagagggagagaaggagguggguucaggacauauuucugagcaggaaagaggcagugagggaaagaggggcauaauggaggguuggcuugagccucugcaugacggcgagccaucgaugcucuaaggcaggaggaagagcaguucagggaggaaaucaucaugaguccugcucuagccgugagaaguuggagaugcagauucugcauuaagagaggauguugagucggguaaaaaucuggugcagagcagugaggcaggacauagauaugaacgugggagucacuagcauacaguuggcacuggggccguggggcuggaugagaugaucccaggagaaaguguagacagagaagagaaggccucagcagcucagggauaguccagcaucgggggguugagcaagagggauugccaagaacagaaaggagggagauagccgggaagucucggcagcagggagcguucauaaggagggaauggccgccugaagaggugcugcugggaggccaggaaacaugacgauggcacagugaccuucugguauagcaaggcagaggucauuagugaccucuccaagagccucaucggggccuggaggagaaggaaagcuggaaggagcagggggagaagaggaggagaggggaacuaggggcgaggauaucucucucugucucucucucucacacacacacacacacacacucucauauacgcacaugcaggcacucacacacaugcacaaacacacacaugcacauauacaugcacucauacacacacacacuuacaaaugcacucauacacacacgcacucauacacagaugcacucacacacauacacacaugcacacacacggacacaugcacucacacacacguacacacaugcacucacacacaugcacacacaugcacugagacacaagcacacacacaugcacccacacggacacaggcgcucacacacacauacucacacacacacacacgcucucacacacaggcacacacacggacacaugcacucacacaaacacacucauacggacucacacauggacauacacaugcacucagagucauacacaagcauucacacacaugcacauacauucacauauauacacacuuguguacucacacacugacauacacucauacacacauauacacauucacacacaugcacacacacauauaucuucuaggggugcagaacacugagcugaagggaagcugaacccacaggagcacuuggcuauguggguucgguggcugccagccaguggggcugcucuggcagaagcagauaagggacuagguagagaggcagaauugcaggaacagcaaagaaagacaugaggcaggauggcucugcaugcugggagguggccuagguuccagaggcuucaggcuugggaugcugcugagcugagcuaggcugagcugggcugggcaggaggcucgccagcaccagcgcaucucacaugacagcccaaugaggccuggggaagacacacccugggcucauggcugccuucucccagcagccagguggagugagaggacagcucuguuaauauuccccaucaccuacagggacccuggcaugucuggaaaaagagcauaaaaucccccaggacguccugcccauuuugggguggugauggggauggcaagaagccuccuucagguaccacccccaccccagauccuuacuccagcaugaaggcaggagaacugagaggggaggcuuguggcgcagugacgccuguguacagcugugugcaccuguggguaccugggcgcaccugucuucaccugucuaggcaaaaccauuugccaggaguccgaagcagguggugugucucccgugggaauauacaaccugcaucccgagagccacugaaauauuaauggugcuaaaagcagugaugacaccaugucaugggacuuccuuguugagcuagagucucugacacgcccacacagaccaacaucaccagcugggugcagcuggaggcccagcaagcugcugacguccacacgcagagugggucacccaccgcccacgucuuccacugcauucugucccacuacgucuggauuucacucuuugcccuuugaaucacgucagaggcaaaagagaaaguguuuccuugaggcaaaguuuugucuuuugcuuuggaaacuacagucuccccuuugcuccaaaggagauuagaauauuaaggacacaaugucagcugaagauuacaugaaaaggauaauuaaacaaaagccccauauuauaagccaucuagaagggaaauuaagcagcuucugcauucuccacaucuuugaaggauguucuuagagggggcaggaauuguuuggcuugauaaagauaguaaccaaacuguauugcccauuguucuggcuguauaugaaaagcgauuguuuagccaagcugacagcacacgcuguggaggcauaaaccccucugccgacggaaggauuaagagacugacaaguucuggauaauaagacuaauuaauaauuuccaucucuaaggaacugcggcuccggaagcuucauccuuccucucucccagucaagccugggcagcccagucccuaagggcugagggacagaggagcgucggcaggccaggccaggagagguccugguggcagucacaggggaugguguggagcagagaggcucggggaggguggcacacaggagacaagugccagaaggcagagcuuccaucucacucagccagacaccagauucccgccugaggcugcggaacaagugaguuuuguuccuaaucacaguugcaucucacaagccuagcauuuugccauuugcaaacuggguuggauaggaccuucucaggggacccccuuccccgaccacugcuauuccacccguccaauccccuagaguaaaagcugcuggaaaggguccugguggggugaaaacagccaccacuucccagggggcugccgaguccaaaagaccucugugugucuuagcucaauucaucuucccauucagcucaggagggagguauuuuauuuuauuuuaccaaaaaggaaauaagguucaaagaaguugauucaguuggccagagucacuuggcucauaaggguggugaugaauucaaaaccuuuggcucugguggucccacauagguggccaggaggaagacuuuccugaugccccgaggucuccccuguacucaguacccacucguccacacggcgggagcagagggugccccuccccagagggcucuggccacauagcagacguuggccgccgcagucugcaaggugaagggugagcaauggggccugcaaggggacccucugagaaagccgacuggauguccuccugucgcccaguccccagaggcggggaggggugaaggaaggaaucgggaagagggaaucuucuagaaaaugcccagugacuuuucucagagaggauaauggccguuuugggagcucugccauauuuucuggaggcuuuagguggguacagcaguggccuuggcaucguaaacugcaaucaggcaaagaugucugagcgggaaauacuguccgcucugccgugcagccuuggcaaggguccugaaaucuuaauggaauugagcaauuuuuugcacagcaccguaaauucccagugucuaccuuaucuccucgucacguuauucaagggacauuaaauggagaaagauguggaagcugccagcuagaaugaagccagacccaggaggcagcuuaggaacccucuggcugacacaaccuuucauccucaacucucuuuuccaaaacccgccccuccccagcugcaggagggcuuugccguuuacuaguccagaugaagcuuucgaggcggcuucuaagaccagggcuggguuucuaucccuggcccgcagcuucuggacugagugaguuucucagugucaccauggucacuccugccaggguuuccuccuaccuggggcaccgcuggagcccuggccucccucacacccccuugcccuucuccuaauuaucuaauggcgcaagcgucugcuggggucuugucuuuccugcaaggucugugaagcgagccagugucugggucuucagccagccuucccucugcauggcgggggcugcggaggccugaccugaagcacagacccagccuccuuuccacauggugacagugacuaaaugcuggccucacaggcaggcugagugcuugcccgcagccuucgaugacuguuguuauugcuacuggugacaggaugaggaugaggauggccacugcugucacugucagcuguggggagcuugcauggccauguugaagcugcaugcacuggucuggugaggcucuuccuguccugcucucuucugagcccagcagagagucaggaggauuccaggcccuuccccaugcuccccuccagaucaccuggcuggcaccggugcugggacaccuguccugagggccucuucccagacagcccugugccgggugagguguguggaacuggcucaugggaacugggaccccucaaguggccuuguuagucucacugagcacuuagcacugugacccaugcuugccccaugucagagggcauggaaacacccccuccccauuucuuccauccuucaacuuugggcucaccuccuccaggaagccuccccugaccgccccgcccauucugugucuccuucucuggauccaccgucuugaccagcuuuagggaccaccaacuaggcuagggucagaaauggcuuugacaccacaggguccuccaucugcuguccaugcaaggauccaagggcccaaaugucagggccuggccacuccugucucugcugccaaguuccagcuaccccuuggaguacagcgggcuggcucaguguccccugccgagguccaagugcucuggagugugcccauggucagcucagcuguggcggccaaagguguggaagaaaggucccaucagaccccagccucacagggacgccaagggccagggcaggggaaacuugggguuuaugucagggucggucaaccuuucucuugcccuucuuggcaucaggacuggucccugugaggccagcacauccaggcucuggaagcugcucuuccuucucaucucugcucacugcacaugugugcaccuugggccuggccgcuguggccugugggcucccccaggacagggaccacgucuguuuaaagggccuggaccagggcccugccuacccuaugucuuuuggagccccuuauucucuuccugacccucaguuucuucuucuaugaaacacugggacgaacucaccccugcccuguuuccuucccaggguagcugugagaaccaaaagccaggccuugaaguuucugaucaagcgcucaguggccgucacgcacggccagggcuguggucuccugagccaugcacgguggugagcguguauaggggcaccucggcaucagccacguccccacucuugguggcugaagguaacacagggugcuuauaacaccaaagauaccagggcugggcugcgggauggugcgcagagggucuggcaggccugggacaccuuccccucccugcugagcccagauguggaggccaggaccccucagggagcgacuugcuuccuuuccuugaagcacauggguccaaauguccucuuuggggcagagugucagccugacagcaaggccuccuguugcucuaaucccccccgccaagccucauuuggugggagccguggagcccugccccagcgauagauggcaguagaaggcccagguacagagccagugccgucaggcuuuauuuccaagccauuucuauuucacccugaugaaacauaaaaaugguugcugagcaaaaagcucagguauuuuuuaugaagcuauaauauucuccauuuuaagaaagauuuuuaaaaaagaagaaagaaaaagaaagaaagaaaugauauccuguuaagcuagcuugugcuuccuagagauggccugccagggaagagcccagcucauccggguggagagguccccaccaccaggaggaggccacgggcugaggggcgagcgcggccauacucuucagggugucccacuuggccugcagucccuuccaugaccgagcucacagcucaccgccagggcaguccuuccugagggcugcagggcaugguccuggaguggggugcggggagaggcugcacuucuggggagacacuuggguugccaaagagcugcucauucuccaaauagacaucaagucucuuggguggcuaagggacauuuauugcaaugacagcaccacccugguguagccucugcucccuucucuguccgggcugcagaagagggugguaugaaggguagagaggcugccuguaccagcggggcuccugccuggcucaggcuuugggaggggcuggcucagccuagcucaacgccucugggagagagaaugcagaggugggaugcuagggaugggguggggaugucacagacgcuuucuccgggauucaggauguccacuuacaggucuaccuggugcuggcagcaucaagcuaucauucguggaugcuugcccugugccagggacugggugacauuuuaugcacggcaucaaugcagacuuccacuccuccaacagccucuguauuccaugcugcuguuggcuccauuuuauggaugagcaaacugagacucagagaaaauagacagacugcccagauucacacagccaauagcugcuucuuugcuguuggcuccauuuuauggaugagcuaacugagacucagagacauuagacaaacugcccagagucacacagcuaauagcugcuucuuugcuguuggcuccauuuuauggaugagcuaacugagacucggagaaauuagacaaacugcccagugucacacagcuaauaggugcuucuuugggugauccuaaccccacuauuugacgggucuaaaccccaccccacacagagggcugauggugcccauccacucacccaguguccagggggguggccccggaagggcagccuccugugugguugcagcaggcaggggcugggguucagggacccugcaggaugccuagaccugacacagcagcacgcuuuggugcucccagaagagacacauccugaggacccuuccuggggagccagaggcagucggcucagagaggccaucgcguuccacagccagguuccggcgucaguggagaaaaacuacacuaaugccccaguguggagcugggcucaucucagacccaccaugaggugccacggucccuggagcugggccaggagggcucacggccuacucucuucucuguuggcugggggugccugggacucaguugcccucagggaccugcagggccugucccucugaaaagauucuucagcagugagggggccccacggccccucuugagggcugcagcaugaagggaggacucccugggggcaugccugggcugaggccuauagggccugugucuggggcagaggcugaaaaggcuguuggcugcaaggucuccugaacaaggagcagaaguggcuucucuagggccugaguauggaacuccagaggcuguagcagccuggagaggccacuuguccuccuccuccuccuugggggagccccgagccugggcucuaggacugccggucccucugccauggagcugccccagccccagcuguuccuccuaugggccaaaaggccaaguaugccaaugggaccugcucuggcuggagagauccauguucuggcuaacucugcagggcucccauggagggcagauggccuggggcaggaguggaaccggggcaucuccccuagggccucucccugcagccuugcccuucuccccucucugggaacuacccuaggaaacccugcucucagccccaggguggacaagcagcugaccacucuggggauggaaggcccacugauuuggggaucuggagcuucaucucuccccugugaaccugguuucagagccccaggccuuguggggaagccuggauccugcccagaggcagccccauggagaaggcaucuucuuccucuccugggggguggugagucccagguaaaggcaacuucgcuccuggacaugggggcccuuuggggccaggaccgccuggagugaaccccauggugaacuggcauuguccccgccccgaguccccacucagcagcaccagccacagaggcugcuguggcugggcucuguucuggccacaaugccuguggugcuuagucucacggugccugcucuagggggugauggcaccccugugcccugcacccacuacuucuagggggacccagggcuggcaaaggcucaugugggggcagcaagcagacagcauccaggcugagggcccagcagcugucccacuuucuggccacuuccgugaucugcuacaaggugcccaaucucucugauucucaaaugccucaucuauaaacaggggugaugguggugcccccaggggaggcagcggagggcagcgaugguugcccccuauugacugagcaacuguggagcuucucggaggcuguuuucucccaggugaaguguggugcgugguggaggcucacugcccagccaggagucagcaccagagguguccaguggcauggucaccgcuccuggugcucagguagguccaggcagagcuggaauccagcuccucagacucugaauccagagucccccaaggagcucaacuccuagaacucaggcucaaagaucugccuguuccagugaugugggagccccgaccugcacugccacccuguccuguggucuccuaaggccccaggguccucgucuccccgcagccgugcucuugcccccacaggcuuggucugugcugccagcgugggccaggaaggaccccccgcugccuccacccaagcaagccgggcuuggcagccaaacagcuccggccuggcaauggcagccaugcggggacacacccccgcuucacucgagcacggaaagcagucauuaagcauuuuagaggacaagggcacaaaggaaaacacucauuagaagcagaaauaguuuccaaaugagccauacagaaucugcagggaagucuggccuggaaugggggccugguccccugcgggggcaggcggagaaugcagagaaggacggaagguggaggaccaggagaaaggggcacaugaggaggucagggggcccugaaccucugcugccuaccccucgaaaccaucagaaaaucccaaacaggagggaccgcucuguccagcucaccccuucaugccuccucuaccucacgaggcucaggguccugcggcugcagugacacccacaucaggcgguaggggcagaggccaaggcaucgggagaacggagcacugccugcuccuccccugacccacugggugaccugggccuggcccugcucucgcugggucucagaaauccuucuagaaaaugcacuggguaggcucaggggagccugaaggcccugucagcugugacacagagcccccagcaaugcugaggaugggugccaccagcagaggggaagagguggccucuuccaggucauggcucuggcccugcccagcuggagugggcugagcucaggucaucuggucccuccccagcuguccuggugaccucacauggugguuacuggucaugccaauggcuuuaugagccuaugggccacaugggcucuagugcccugccugugagaggcucccugcccgucuccucgcucauagccuaauagaauauuugucagcaauggagagauggggagggagaacaugacagagagagacgcagagagagacagagagccugaaagacagacagacagacacagacagagagguagcacccuccccugaaagcccgaugacucagaagcuuacgugccacgucaacucaggcccuucucuguaaaucuuggcaccaauccugagcuccaggccccgagucugcgaggccugcucauucccgccccgggguggauacgucaccacagcagaacauggcucucccaaaugcuggcuccugcccugugguggcuguggcucugggcugggcacucaggggagacaggaauucaugucucucccuugggagcugacuaguuggagaggaaaaucgaggccaacauaggcagacgugcccacuaagugcuaaguggccuugggugacaucagcuggagcaucucagagggcaggagcgaguucacagugggccggcaggaggcggccacugaacugaggcuacaaagguggggcagugggugcuauuccuuggagaaagucuccuuuuuccagaagcacuucuuccuuuccuuccucccucuuuccuccaaugcccuuaccuuucuagaaggcucacccccugcagggggcugagagagcauggccagcccaucacucccuuuccuagugccuccugcauucagaggaccaggcuggcucggggcuggcaucugagcagccuccuuccucagcucccaacaugggcacugcccugacaccuuggaccccaccuaauccuuuuucuugguaauuggugucagagacacacuugagccaauuuccaucugagccaguaacucauggcuucuuuccuauuuaacaucagagaaauuaaaccuggccacagcaucauuauccugguguuguaauuagcaccagaacaaauugcccugagcggcaccggcugccacauaggcucugggcuccgagcagggcgugcauugugcuaauugcuuuggccuuagcuccuuaaccugcuguugccccgcacagaccugggggagcaggaacccccuacaccugugugcgcucccucuuugugaucugaucacagaaacaagucugaugcuggaggacacagaggagagggauggggagggauggcucccccaggcuugggcagagaagaugaagaggccccagcucggccaugaagaagccugguccugccauccuggccuucggggagacuccaacuuccccgccagcugggagguaacgaaccagacacacaugaaucaguccagguaugccuccagcauacggaggcuggaaaacaggagcgccagugagggagggcuggggcagagagcaggaccccucuccucgcuuggcccgaguugaggaacaggagcagcugaaucuaggagggacccggaaugagcagaaugcagcuugggaagucaucagcucagaccucguggcugcccaauggugucugauuccaggaaaguaaauuuaguggaauuaaaaagccacaagggcaugauggaaugaggggaggcaggcggaggcgugggugcaggagaaaaggccuggaggagcagaccagccuggaggagcggguggcugggcugcuggcaggaugccagcuuccaggugcugccccgacaggagggcaauggccaaagagguguucugaccagggggcaugaaaccgaaaaggaaaagggcagaaaccagacccauggggcuggaggcccaggaaggaguguacagggcugcaggcugcuuuggauaaaugguguuucuugggaagccagaguuugucccuggggacucaaggacaugcucugacucugacucagccgccagaacucuggccucggguggaaccccacccuucaucggguagaggagaaaacccucugccaagggguggaacaccuugggaccaauuccuaguaacaagaccccaaaagccucaucccaugaccaugugacaacuccccuccucaagcacacaggucugagcaauuagaaaagcaggugcuagcacgucagccuccaggggaggcagagccagggaaacugaugacagggugagguauugggaagcagccucugcaaaucagcacguccccggauggucucgggcaucauuugaacuugcugaacaacagacggcuauuucugggaacugagggagaauggaaaggguuuggaggcuggggcugggcagagccgauggauagagggcccugucuaggcugagcccggccuccacaucgacauggcuccggcccugugggcaccuuccagaccagcucuccuguggccaucagccucucugcacuccguggcaugugugacucuuuucucccugagcuugugucauagcacugggggacuugcuuccccagcugccaggccccuccaacuacacccccgccaggucagagagaucccuaaaccaucaagguccagggguuugcugccuugaacaacagaaaguagaaccauggugggaaaggccucaggcagcaacuccuggguagaggcaacaguaagaacuuggggugacagaggcaggccauggggaauggguucuaccaagaacagcugcaaaucagaggaugcauuuugaaaaggaccuaugucuaguccgacugcauggaucccucagaccuucccgcccacacggcaggcaagacagcuggcagacgauccccagagggcaagaggccaggugggccucccguaccuacccaccccugguucagcaacgcugugcacaaacaccauggacagagaucugggcaccaggccacucucccacaggaauggcuagcaugcccagccacaaccuguuccaucccugccacagcagacaucacaaaucgauuacggagcuccuuccuccuuuccccacagcuaucccaaucaauccagcugugccuggcaaccuccgggagccuguuuuccacaugugccuuguaacuaacccaugagagaaaaugaauguacagcuuucagccaacaggcauuucagggcaggauacucggccuucuuucuuguccucaucaaaagaaaacugaggcgccuuggaagcuggaagcaccuagguuuauuucccaucagugggugacagcuaccccugccaccaggccuucuccccuuccugacacaugacaacaccagcccagccacugagcuggccucagugccgcaacagccgaagucucccuaggcaagcucaccagggcucucagcccgaagccgugucgcaugcggagccccgcgcccucagugcccuccacagacccuucccgagcaccagagacagaagaagaauccagucccagccaccuaccugaaggagccaguagcaccuccgguggaagguggggaugauggaggaauggacauagcagccguacaagcacuagggagagaggaaaaacgagaauucaguuggaaagagggaaggaaggaaggaaggaagacggcgcaacagagaaggagcaagaaggggccacagccgccuggcagcggcccagggagaccgagggcaccucugcgucuggcuccagcuccaagacuaaggcucugggacagcaccuacgaagccccguggggacacaccagccggcagacucgaugggcagcuggggccuuacccuccgggagccauagaggcgucgagaacccaggacagccaaggaccagggaaauguaccuacguaugcauuuuccuauaauuuuaggggcuuggaguuacucuguaguucauuccuagagccuagguuaagacccuuugggguacagggaauggcugaugguuacagaauucauuaaacacaugaaacauacaugcuacagaccuuuccuggccagggggcccuggccgguacgagcccaaccaggggggacaggguggggcggcacuucccaggaugggcuucuagagcuuguggggccucuugugcaucccugcuuguugacuuugccuacuguuuauucauauauuuguuaaguaauccugcaucuuuugcagauggauuugguuuuggaaaacagccagagccagguuggagaagguggguggaaagucaaggucaggaaggguggacugugggucgggauggcucucaggggcccaucaccuagacccaggugagcagaguugaccaguggguggggucauuggggcuggcauguuggugaggaaggccgcccugcucugauucucuggugcugccugcguguguagagcugggcaccgugggccaggcuugcuggugagauggagaaaggggccuaaggagaaccauugaucaggucccucuugcaauccagcuggaaggucugagugggagggaggggcccagccuugagcaggucaucaauuuggagagggaagucucaaggcacccagugaugggggcccccaccaaagccaggggcaaagcuuuucuuuuggugccucugauuccagacuggaaugaucucccuuccaucagcuucagaguuccccuggcuucccacugcauccgcucuagaagggguggggcauagaggggaggaaaguuccucagagccacacaggacaucugccaggugggaaaaggccucccccaccucuccuugcucauuuuaaucucacuguuguccccauacccuugaaccagcucuccagagagaaaugccaccagcucugcuuuaaagcuuucaucagcuauuauuuacacccccaaaagagcgggugcaauuugguugaacuaggaguccaucggagcccugccugucugauuagcagaguugacagagaaaucauuuuggacuaugcgauucuggcugcaagaaaaucagauuucaauauguuagaacuuuuacagaucacugucagcugggacuuaagcccuguauaaaccaaacauacaaagcggaaauuaauuuaaacaauucccuugcaauucuugcccaugaaauguauuuauuauuaagaaagcaauauucuuucuugacuuuucugguuuucaagacacgguguuuuguuuucguuguuuuggugguuugauaacucacuccuugccgaaggagacgcaugucuagacauuuuugucuaagcguuugguugcaaugaacaagcaacccaccugugacauucaccaucuccuuuccuuuggaauuugcauguucucacaggcagguucauuacuuugacucaugugaugagccaaauggagggagauaucaacggcugagggguguuucucucgucccuuugaaauaagagguuuccaucugcuguuuccccacucuauuccucucuagacuuugcaaugacuuucccucuucaccugucuuauucucuguccacuacuuucucuuggacuugaaaagaccgugguugguuuucaccaucacuucucccucgauugccugccugucugccuggacugggcuucagcaucucugaaccccacacucagaggugagaauuucccaaacaccaacuguguuuccucugugaaccuacaaaagaagaggaaggcccaggcccgcuuuccccugaagccuccuaacaccucucuggccuacccacaacugccccagaaccauccgauaaacaaaaugaaguuaagaugaaagaaacacugccauuucuacaucaaggcucacucauuugaaucagaggaacccucgggcccucacuccagaacccgguuacuccauuuuuagauacuccucuaaccacuguggcaaucccaugccccuggucuccuuggaugagaagcguggucccuggauggugggagggaugggaagugcggcugaaggcagauccccaauaggcaaggaucacaucaaacaguaccagaggaggaaagaaaaaagcuacacaaagagccccagggacucaggaagcccacagggaaugggaccccuuccaugcugccuggcucagcacacugggcuaccccaaugguugguuauuugguuaauuuacccaucugccuucucagaaugggggcuccugagggcacagggccuuaggcuuuuugaauaaagauaucccaguucuccccacuggcagcuccaggacacaggucccaggaaaggacuccagagacggucaauguuuaaguuuugcccguggcacccugaacgcuaaggacuucuaauacacacuagaaaacaaccuugaaaaauggcucuacauuuagggcuuaaaggguugagcuucaguuucaaggaaagcagacuuguguggagucgcgcuuugcuguccaaguggggaaagcagcucacggcaauccccugcugaugagccgggguggcugugagggccucggcgagagguggagccugccuggggugggagaugugugacuugggcucagagaguccuuguccugccaggcugcaccauggguacgauucuaauccuuucucucggguggcugugugggcugagagcuuaugcagcaauggaacccucgggaugcuccuuggaccccccgugagugugcacccucaucagugauugucaccggaaggggacaucagaggaggcugcaaaagcuuuaaggaugagcaggguuugccgagggaagcacagcagcaggaaaagcagccagugaaggacaggagauucccucuccccuuccauucaccccuuggcccaaaccacccuacagcccagcccugaccccaggcucuagcugcuaccaccgcccucacucugcagucuuuucaccagauuccaggccauaugacaaggucauuaccaagccaauuggggauuaauugcacaauauuccaugaggccguguggcgaauccauucccuuuauccacuaaucaaaaaagcaaucaaguuugucuguagugauuuguguuguacaaacuccuggcgcuuuuugaucaggcucucaggguccucugggguuuccccaguugagcuuuucacugcagggagccacauuccggggcucguggauaaauccgcgugugaggugcacacgcgugugggagugugagggaguacaugccguggguucccuuauuuuuguguauacacaaaaagagagagaaaggaagcaacuagguauuuauaggaaaccugggaggacaucaccuuucagaugaaagcaaccuuugaaucaguuguauuggggaauuaaggccuggcagcuuccccuuaacauggcaguugagcaaggaaaaauuuuuugguaaauauucaaaauugcuuuuaugacacuauagggcuuauuuauuuauuuauuuuuauaaaaaaguaaagaugaaauuacaggggaaaccaacagcaaacaagagcucccuucagcucaaaguaaaugccucaaaaaagaaaguggcguuucugaagggagcauggccgcagagcccccucaaacgcagugggggucccacaccaaagagggcuccugaaggcugggcagugauggcuuaguggcccaagaaggaagcacaucacuuauagguugguauguugugggcaccucccuucccggccagcucucuacggccucaucugacgcagcagauuucugcccccaccuacucccaccaucuguuucucucuuccuaucucuguaucugucucucucuccuugccucucugugucucugucccuuggucucucuucuuccgucucuaucuuucucuaucucuguaucugucucaucuucuuucucucucugucucucccugucucucaaucucuuucucagucucuuucuuucucucucucuccaucucugcagcugucuuguccucucucugucucucucccauuucccccaucugucucuccccgucugucuuuauuucucucuccguuucuguaucugucucugucucuccugcuaucucucuccaucuuucucugucucucugucucucccugucucuguuucccuugccugucccugucucugugucugacacacacacacccuccaucccuuuccuuccaccucccaugcccugccugggggaagccgcagaggauucagcaacuuacccaaggcguccugagcagagcaugcuuagggcauggagccccggggagcagauggggccugaaggucacagcgggccacagggcagcccuccccgugucccugcucacaugaacccccggccccaggaggccuuaugugcccaccuauaggcucugccgcacacagugccauucaccaggacaaccucccugugcugccuccgaagaccccgcucagcuggaguccagcucaggucccccuccaggagcccccgacccaguggccuaggagcagacgcugggaacacucaucagagcgagacagugggcacacggguggagggaggauguggacucugccucgggucauuucacucuucaccucugcagccucaccucacccauccugugggcuggcagacuuccugcuaagagucagagagcagauguguccagcuuugagagccggguggccucggggguuacuaggucccugccagggcaggggaggagcggcaggaggaaugggguggggaugcaucccaaucaaacuaccacggacacagaaaucugaauucagaugauuuucaagugucaugaguauucuucuuuuggcuauuuuucaacaauuaaaaaaaauguaaaagcuauucuuaccucacagcuguucaaaaauagguaguuaggccggguguggugguuccugccuguaaucccagcacuuugggaggccaaucaccugaggucaggaguuccagaccagccuggccaacauggcgaaaccccaucucuacuaaaaauacaaaaauuagccggcgugauggcaugcaccuguagucucagcuacgcaggaggcugaggcagaagaauugcuugaaccugggagguggagguugcaguaaggcaagauuaugccacugcacuccagccugggcaacagagugagacuccaucucaaaaaauaaaaaauaaaaauaccagcuccuugggaggcugaggcaggagaauugcuugaacccaggaggcggagguuguggugagccgagaucacaccauugcacuccagccugggcaacaagagugaaacucugucucaaaaauaaaauaaaaauagguagugggccggauuuggccuauggagcauugcuugcugaccugugaccugucagguugggacaaguguggauuauaucguccuucaaaaaauucccaauuuuaaaucacugcuagugacauucgcauagcaggugcucaauaugugugauuuccugugcgcccuuaggcagggcagggaaggggagcauggcccaggcguaugggagaucauggacugcauaugauacagacacaaaggaaacuggaaaugucuuuccaauuguacuucguuugggauguuuguuuucugguccugaguaugagcaugcauggcccuuuuccccuggaggaacaaaaugacccuagaacuucuaguuggucugccaugaagaccuuuucuagggaagccccuuuuaugcuguuuccuuggguccaccucccacaaggaggcagggaacccccagaagccagggcuugcuguugaccucccauucugggaaaaugugaggccagcaucuaauuucauggaucacuggaaaagacauccuuggcauugcucaacaggugucuuuaaagcugggcuaucuaacuuggcagccacuagucacugcggcuguucgaauucaaauuuaaaugaaguaaaauuaaauccaaucaaagcuucaguuccucaguugcagcagccacauuucaagugcucaacagccacauguggccgagggcuaccacauuggacagcacagcaauggcagaaaguuauaccgaugcucccacgcuagagaacauggguuaggguccaguucagagauguuuggcaaagacacugggagcuugggaccccaggggccacgaucugggggagucagggcuucaagggaugaggacuuggggaguccguaugcuugaagguuggcaccuguuguucuaccugggcaggccugaaucaaccagggaagauuccccagagccuucugugccugugauggcaaagcucauuccugagcuccccuccccucucuucccuaaaaccuucucuaaugcaaggauaauacccgcgggggcggcagacagggguguuuaccagcaaaucuccaucuauaauccucuuuuaugagggucccucugcuaccuccucugcaaacagcccugccccaguccuagcagccaggccaccgguaggggucagagagcaccacguuaggcuggcugugguggccuccacaccaccacagccccuguggcuggccccagagacuccacugggcccaucucucugccgcuagggaaguggcugucuacacaaaggcaaucagagagaacauagauuuuguuggugcuugguuuaucacucuugcuuguaucugauguacccacgacaaagaugaacaguuuuuaaaauguguccaggguauaaagcugauggaagaaaagagcucauagaagggaagggaaaauccaccuagaagaugaggguuuaaugcuauccucaagcaaugaggggacaggagcaggugagaggcagaacugggggcaggcugggguuggggggggcagucacagccuccagaacggggcauccuggaccagcugggccguagcuuggacauccaaggaacgugugggaccagaucccaugugaguaacuuuucacugcugucugcucugugccugccuugagcucuuguccuccagccucccccagucucguagaggagagagauagagagcguguacaugccgggcaaacacacgagaccaaaucaaagagcccuguugcuaagggcagaguaccgagggggcaggaucagcccggaggaugaaguguccccuuuucauucaaggucagcaaagucaccuaagaggaagugacauuugugcugagccaaaaaaggugagagggaauuggccagguggacaaaagggaugcaaagcagaggggccgccacgggagaggacggcgggccccuccccagcucucucauccgcgucccgcaugcggggugaagcugcaggggccgagugcaugacuccacacacaguucugcagaaucuccccuaagggacccacagugagcggcuggcagauggccuugccuuugaagcaaaggcccugugauuuuauggcgcugcccuucuccacugguccagacucuguguauugaagcagauuuccaggaaggacucaggauugcucugagaacugauggcucaagugcaggcucaggacuagaacuuuggcucugacccgcucaccaucccaugucuccauuucuccucucuguaugccuucccugcgcuguuucucucccacuacaguugggcugacuucauguggcacguagccagaguccccuucuuccggcugugacccaagaggcaggaaagucucucucuuccagauuuggggugacagcaccagggagggacuuugacuuaccuggacugcaagcccaggacugucagugggguagggcagcaccugagcaggggccugcagccuggagggcagaucugucagcagaagcagggccugagugugcuacgcugauguccaagggcagggcuguggggcucacagaaggggguaaaaaugugguuccuuuccugucaaagccuagacgucaggaagaaguaggugcuccucaaagagcaggugggagugaaaaccuuccagcacuuuccagagcucccuaaccagcagcagguacagcaaggcacaggaggaggaccaagcagcccuauugcuccccaggguacccugaacgcagacgcagauccugggaggccuuggcaagauccuguguggggcaaggagaggaugacauggauuccucuuacccuaguucucuaguugcacaagugucuugcacagaggcaucuguggggaagaccagagccuagacaggcucagcaguuugucuaaggucacccggcuaggaacaggcagaaggauucaaacaagcgucaucugaccgcaaagcccuugcuccuuccuccccagcaggccacccccugguccucgcucagacacccgugccauuggcugagagucaggucuucuuugggacccgccuucaucaaagacaaugagaugaaguccuggagcugcucccaagacuguccucgcugaaggauuugguuuguauuaaucuaagauuagaccaaaugauucaauucacauauugccugcaaaagcauggcgccucagaacuuguuaaauagugaauugcuuuaaaacgaguuugagcuaaauggauugcagucugauucagccuccaggguugggucacagcagagauuuggaauauuagaucgucauugaccagggcucuagccuggccucuuuccuaagacaaucugcaauggugucucccaaagcagcuuguggcccugccacgccaggggacugaggccagacagcaagagggcuggccuggauccccaaacccugaugccuucagguuaugaagucaggugccggccacagcucaggcccaggcuccccaagugggacuagaggcucuccugaaaacagccccuuaacacugcacuuucuugggggacuccucugggcaggggcgggaaggcuccccaaaauucauucuccagggcucccugggagaguagccgucccuuggcuuggcauucuggcugguccuguccuuccacaauguuaaaucacucuuucugccauaguggacacaggaggaugaggaaggguagcccuuccagggaccucaccacccuccuggaaggaagaguaguaugaaucccucucugcagaugugggaacugcagcucagaggcaucaauuccuuccuuggcagaggucacaggggcaugauaaagcuagaaucugaacuccaguccccuggccggcaaagccugcaggaguuaaccccgucucccucaucagaagcccuggugcacacccuggagggacacaggggaccagguggcccagucuggccaugaagguugguuccuuugagauggaggcgauugaagagcagauagaaaccaggaacggcagcaaacgucaaaaagcuggccacccgccacccccuaguccccacccccagacaggaagcuggugagggaaacagccagaagaaccaggcagcgccaggcaggcgcaggacacgugggcgccccaccccaucaugaggcagaaagugccugcgggccucuggccgugggggacaggacagacuccuccccuggguaucugggucggccggagcuccgcggaagggggauccuugggcaggcagagagcaccaagaagacccgccagguggggacccuggagaccccagagcucugcucaggagggaggacaggugugccgucgaauggggaacaggaaggagggccccucggucuggaugaagaccagugagaaacucugcaggggggucauggagagagggacacugggucuucaagcuggaggcucccccagccucucugaggaauguucuagauugcuuuugcagcauaggcccuuuugcaagcuggaaggcaaaaugggagcagagguaagagucgcggagaacagugugugcuccagaaaggaaccagggaggugugcagccuggcccggggacacugaggggcaugggacacagccuggcccggggacacugaggggcaggggaccuaaccuaguaguccccuaggaggcuggcacccgugccucugcccccacccaccuccccucaccugagcuccuuccuguuggggcccccaaguaucugcaggggaaacaucuaaauaaagcggccgccggccuaacgacgacaugagugaggagggcaauaaaaauucaaugaauuuuuagauaaaaagccauaaaaaucauguugaaagauauaaauaaaauaucuggagcuucagcuuuauuguuuuuggggguuccaagauuaauaaauuagugggcauaaaauggaauaauagcuaaaaauugauaauaagguaaauuuagauuuagagaaagaguugauccaagucaugaaucucaagucagagaaggccaggggugggugaggggcacguuggcgcagggggcgggugaggggcacggcggcgcagggggcggggcgggugaggggaaauggaagggagggaggaagaaugggagggaggaggaacgggagggcggcgccgaacucugcugggccucgcuccacucuccacaugggcugcucccaucugggccuugcugcacgcuccacaugggcuguucucgucagcucuagcgccugcugcuuagggucacguccaggaaccuggccacucucaccugccuguuuucccacccucugaggacguucagccaggcccacaugggccccugcugugucccagcaccugccaaaccgcuuuggggaaggcagcccagcuccucacccugcacaggcccagccaagcgggagcuggagaccugcaccuuucgugucucagaaaucuguccugauaccuggcucccugcgggccccagcaaagaacaggcuuucucugagcugggugugccaggcugcugggaucugcgguccugucaucagcaggagcucugcucaguguacguguauauucuugcucaguuaucucccacccacuggcucuuguucuuuuagccuauuucaauguaucagugcuguugcuaucucaaauacuuccuaaaaguacugggcauaaauaauauauaaauaaagugaaauucccucucuuucaucaaaauguaccgcugagaccuauuucuuggagcccugccaaguggcuagagcuggucuccagagugguguauacuggugauggccugccuuccuccuucccgcucccuguccuuccucccucccauucuucuugccucccugccccccuuccucccuuccucccucccuccuucucucccucccucucucccauucuuccucccucccucccauuuuuccucccucccuuccaucucccucccucccuuccuccaucccucuguuauggguacccccucacccuucaccaggucugccugcauuaagcacaagggaucucugacgaaugccugcaaguagcucugggucugauguguuccuuaucaacagccuguuaggccagcagggguguuguguauuucagccucagggaugaccaacggugggacccugagccuugguaaggaggcucaggcuguacccucuggcgcugggagcuucggcuacacagccccagguggccggccuuucucucuacucaucugccauucccagaggagagcagaugcagaugccaggagcccacuccccgaggccauucuggacggcacggagggccaagugcugcccagaaaucaguggcucucuucuccugugggcaggcgucugcggggcuggcacugccgggauuccuggcugugguuacuacucagcuccagagccugcuggcauccagcuccccagcgccgcccgcucuaggcaccugugacgccacguagguauccacggcacacuccaacaugugcggcugcauguggccagggagucugggcagggauucuugcuuaaaacggacaacaggguuuugcuuaugaagcagguggagggaaacgccgggccggucuguggcuauguuaaugcaaggcugagcugucugccaggacauuaagaggaguuggauuccugaaaccagcuuucaucagcagauuuuuaagguuagaauuacucucuccucuugaaggcuugccaagguuaauucggccugagcaugcagaauuaaugggcugggcagagggaaucggccuuuucccgauuuuuucucaaguucacgaaaacaucucuacaaaagagagcagacagcagggcggcaucaggccuuccaccugggagccagugucggaaacacacacgcagaaccaugccgagccgcggcuccugcacuagagaagcaggagggaugggcagcaugucuuguccuggaacagacuuagcagggucugcacagcagcgccccuuccccugaaaacaaaugugccucaaacaccugcagaugcgcugccccagccaggccggcccuggaugcccccagggcccugagugcaucggaaccuccgaggcucuggcacggagcagggggaugaaccccagcugaaucacucagucucacugagcccugacuucaucaucugcagaaugaaaauaauaguaauggugagacuucaauaauaacugcugauaaaauaagucugcaguuuagcagaaagaagggcugcacugugagcgcucugggaucucgggcagaggagaagccaaccuuccuuuaacacagggacugaggaacuuugccccuugcaggaagagguaauguccccagggagcucugcacccucagacccaggcugacugaggccucccgcccagcacugcuguccaggccucagacccucaggaggagagagcugaguaggacgaagcggggguagaggccccuuccuauccucccugaucaggcagagaaacucacucgguccuccuggauggaggucggggugccuggccuugggccuggggugccugguggaaguuugggcacuaagccagacuuggguuugaaacucgccugcacaucuuagcagcacugaugacugugggccaguggccgcgacacugaaucacaauguccucauuaguagggaggggaugaaggaugacccugaucuugcagguuuguuggauuaaaugacaauacguuugcagugacuggcacauaaaaggucuucgauaaacacaaaccuccucaguuuccccagacacggggcacucuguccccugccugcccaucucuugauuacagcaggauccuccuaauagcuccccauggcucaggcggccaccuaguggggacucccgcccaggaagugugaggcgaggucgccucugccauuuccucucuccucagcuuccucaaggaguccgggcuguuuuaaaauaaacggcagcuuccaaggacucgagagcccugcccaagugcaaacagaaagggggacagagucagagcuccccucggggacauaagcucugggauccccuccccacuggaugagcacagggaccuccuuuuauaaaaaugucagauccucccugguuccgcucaggucuccccugaaauucccagcucucuucagaaccaaccacauaggucuuaacccaacacgccugcugcagcucaccacaguggaugcaccuccagguccccgggcugcugcggggggccgggucccagcaugagugagcaaagacuccacagcagcuccaaggaaagugggaaccccaccgucccuuuccuucccucccucaggggggucuuuugucugccacagccaccccuucuucugccuaagggucagcucucuaggccuugccuccuacugaggagagagcagggaaggccaaugggaccagccuguugccugcaacauggcuuuuauggccaguaccaccuuugugccaucugcccacaugucccccuccagggacaggugcagggcagccuucccccaggacuuggggggaccagggaaggccuguuuggcucagagcuggggguuccagcauagugccuagaacuauuucauccggacauaaaaugcuaaaagggcugccuucucuguggaaaggccuggaaggauugguggaggaauuuccuuccugauuagugguuccuagauuugggguccaggaguauagagaucuaggcaccuggacagacugcuggaagcugucaggcccaccccugacucugcagauaaugacaguggggagggaggugcagggagagggggaccugcccaaagccacagucaccccguguggcucauucugggccaugugcuuucugggccagccuccucccgugaaccucccaggcuggggaacccaggcugccgcuggacacgauuccacauuuaugcuucagggacgaagccaaaagaagguucugccaccagaugcugcugggagcucggacucuccaaagcuuccccuaggguccuccugucccagcagcagcuuugcugccucacaugggcugagagcaggccaggagguccugggggcugggauggggucuuauuucaucuguguuuccuuggagucuaguuagucaacuggaagccgauucaagaaccucguuugaacuucauagagaaacuguggcccauuccucaaaaaguuaaacauaggauuagcauacaacccagccauuccacuccuagguaacugcccaaaagaacugaaaacagacucaaacagguaccugcacacacauaucuacaguggcacacuucacacaaggcaggaacagccuacaugcccaucggcagaggaagagguaagcaaaugugggcucgccauacaauggaacguuauccaccccgagaggggaaccaagagcugacaugcgccacaacauggaugaaccuugaaaacagacucacugaaagaagccaggcacagaaggccacacauuguaugauuccauuccuaggaaacauucugaagaggucaaccuauagggucagaaugcagauugguggucgcuagaggcagagggagggaagaagggggaacggcugcuaaugcauugggaguuucccuuuggggugaugaaaguguuuuggaacaagauaguggugaugacgguacaacacuguaaauguacuaaugcuucugaauugcugacuuuaaaaaguuaauuuugcauuaugugaaucugaccaaaaugaaaacaaacaaaaagaaaccguggcccaggcacagacaagggccagggauuccacucuguccagucccuggggaagcugccucagcacacacacccuccuggcagggcggaggggggccuggagaggaaccaggggggaugcaggagacacagaccccccgugagucuaucuguucaacugacaaguuugccgagcaccuauuauauuccaggccccauucgaggugcugaaauuugauggggaaccaggcaaaguuuguccugcccuugaggccuccaguuuagagggggguuagccccccggccugguguucuguguagccuagcccagugagccugagguccaaaccucagcacugcggcugggagcugccugccucuuguguccccuccauauuagcuucuaaggggcccaccugcccaaugaggcugcugacuccuugugggcaugaacuugaccuuucauguauuucugcaucccugggucugcacacgcggcccagcagagcuacuggacaaugguguguugcugggacccagcucagaggaaaccaggggagcugagggcagggagccaauagcccuucugguugggugagaacccucuggagcucugagggcugagguucugcccaaacucagcuguggacuccaggccucacagggagcagccacagagaacgugcucagugaugguucauugacaggaggaagggaggccucccuguccauucuaaggguucucagggagaggcuaggcuucaaguuccccaccaccuccccaaccugacacagcacuuggcacacagugcguauucugguaaagcucagggggcuaaggacucaagguggaaagguggcucaggagggaccuggggcuucggagagcagggauggggcgagcugacucaucccucaucccccaggcagagcugugacccuccguaggcagugccgcaguggcgagggcggccaccuggccacaguaggagggagaucccugcaccagguaaagccugggggcugagcugccuggggccauccaggcagcugcagagcucagugcacugaucuggagcccuggaaauccgcuuuccaaaaccccucccgguagguucugagcagcuccccagcaagaagugcaaucugcagaugagaacaucaugcaaauggcugucaacuggagucagggacggggagagauggggcuggcucagugcuuuaaugggaccaggcaggagguuugcucucuggaccuggagccucagcagggucuggggccucagcaacauguacauaagucucuagcugaagagccuacaucuauuaaugcagugcccugccugggccucuguaauuacaccugcuucucccgagcuaacaccuucgccgaccuccccggggaaauaacagauuguccugcagccucuaggaugauccuccuggggguggaagggaggaaucaguucuuaacaguaagaugagaugcccugcauuuagcugcucucucugccccaauagaggggcucucacccucgguccugcauuuuaucugccuugugauggguccgcgggcuccagaaagagagaaugcaguauuuuaaaguguguaaugacaugcaggcugcaugugguacaaauuuccuggauguauaaaaugggaaagaaacagguuuucugucaccugcaacuauccagcaguguuaaaauaugacucguuggaauccaaugugcugcuaaccugcacggggcgguauugaaucuugcaggcagagcgggcaggcgguggggccugcagccccgggcaccugugguuaauucaaucccaccugucucuacuucugcaucuggucugcuuacaaggugugaaagcugcagaggccccuuccauccccuccccuccagcagagguggguggagguggcagggcgccugcuuuccuucuuguggcugcucauaauggaaauccuuugccugaugccacacuuucuguguucuggauuuuuagggaagucuccccagguugucucacugagcuguuguaucucugggccacuguugccuaagguagugucuucacuggcuggcugaugggcacccauccucacuuuugguccuuacaacaaccuucaaggaggagggaauuagcacauccucuuucaggauggaguaucaagccuuggagaggcucaggacuuguacacauuccacagggauucagacccauggcuugcgggaugguggccuccaaguuggugccugcaguccccaagggggccgcaucccugcugggcuggcugguggggcuucauccugggccucaucucuccaagcaggacaccaggcccuaaggguaacaugauggcagugccagaauucaaacccugccccucuccucccuccuacccccaagccaccugguggucuuguugcgaagugugguaucaaacgccuuucuccccugggggcugcauggagcaaggagucaggcucauacuccucgggggcugcucugagucccugccguuccacugaguacugggccccaguacuuucuuuucuuuuuucuuucuuucuuuuuuuuuuuuuuuuuuugagaccgagucuugcucuguugcccagacuggaguguaguggcacuauuucggcucacugcaaccuccaccucccagguucaagugauucuccugccccagccucccaaguagcugggauuacagacaugcaccaugacgcccagcuaauuuuuguauuuucaguagagaugggguuucaccauguuggccaggcugguguugaacuccuguccucaauugauccgcccgccuuggccuuccaaagugcugggauuauagggcugggccacugcccuggcccucauuccuaucuucuaggugagauaacugaggcccuuggaaaagacgaggucagagggcucugacuccuggaucccacacgcugccagcauccuugccuacccuggugggagcugcucugccuggcccgguggucuuagacugcuucugacuucucugaugagaguuagagaccucgugucagaaaaauguugcuuggcccacgcacaccacguugggugcagcuucgcuggguuaagaagcccuagccccauccugacaaaugucuaggccuacaucuccucgcuuuaucagccuugugguuugucuagaauccagacacagcccaugcucccagggucagcuucuucuuucuuugcuguuuuccuuaagaaugugcaaaccgccagccacccuuccugcucggcaguggcccccagcagcugcccaggccuccagcccauggcgccccacagaccauguugguaucaauguucacgacagguuauuguuuguuuugggaaacauuuugcuucuguaccuuggagccauuuccaccugugugugcaaaacagccuggaucgcugccucagagcaagcaggcagugcugcugggcgcccacagaggggccugcaaugucugaauguuuuuguguccccaaauucauaugcugaaauccugaccccgaggagaugggauuaggagguggggccuuugggaagugaugaagucauggggacagagcccuugugcaugggauuaguguccuuauaaaaagaggcuggagggagaccccugccucuucuaccacguaaggacgcagcaagaaggcacggucuaugaaccaggaagaaggcccucaccagauaccgaaccugcugguaccuugaucuuggacuuccagccuccugaacucugggaaauaaaucucuguuuuuuauacgccaccuagucuauagauuguguuauagcagcccagacagacugggacaggcucugucccccacccacaaggagggcuggcgccugcccagcucccagcuuggacacagcacagagagccucggccuccacagaggccucagcugagcacccaccuggagaccaguucuccccaggcagaggguccuuccuccaggacauggagguucgcacacauuccagacccaaggaaacgucagguuucacaccuuccugucacccaggagccugagaggguggcacuggcagcaggugucaugcaucagaauucuggaggggagagcccccccacuccauguccaugccugcugccagugaggggagcccaucaaucuuugugcccuccuccucaccccagaauuugcccagggaaggagaggagggaggugcggggacugggcuugggcaccaagacucccucucugcucugcaaacacaugcguuuggaaugaggaggaucaagacagcggccgcagaggagcacccgcugaccugcuccgaggacucagugacaugggcagucuguguggugugcauggacagccugcuucagagcaugggcucugaggucagaccaaccuggguguaaaccuggauugauugccaugugaccuugggcaaauagcuuugcuucucugcacccaggugccugcacuauaaaaagcagugaagagcuucuaccuuguucagcagcgagcccaccuggaaugcucaugggaguuccucacacucagcacaggaaggcaggagaggacaguguccccacccuccaagggcugcauucaggcuggggaggcuuccagggccagugaaagcacucggguggacgagagaacccccacacagggcugggaggcccguggcacuggcagggcugcucugagucccugccguuccacugaguccugagccccagggaggguuaggggcugcagcauaugccuagcgagugccagguggaggugagcagagccagggaccccuuagccuggcacgauccccugaggccuuugagaagaagcccaugugggaacugaaagcuggcaccguggcugcugaaauccagcacucagcagcucccccacccccucaccccccaccccgcccccacucaaagcccuucaggccaaaggcaggcccaacacuaucaaccugacuucacuccgcuucccuccccuacucucccuccagacggugucaugccauccaugcgugccacguguuuaccaagugcccuucuuguagagucacucugcuucccuccccuacucucucccuccagauggugcuacaccauccacgcgcaccacguguuuacaaagugcccuucugguaaagcaauguucucagccaggggcaguauggcucccugggggcauaggaagugucugggcauuucaggugggcaugagggguuggggcacacuggcaucuacuaggugcaggcccagugggagccgcauccuccagugcacgggacggucuccaccuugacuccuccaucuggcccaaaccccgacagcuccagguuugagacccuccugcagaccccagcaccauaccugggagguaagaaagacgguggaggcgaggguggcugccacauguccugcccacugaaagcuguuuauacuccacuuugggagaccaggugcccuuacaaggaacaaccgggcugugaauccaguuccacagaaccccaggggagcaccccuccccuccacagccccggggaagggaugucaaggguuuccagcccagcugcuggucugauagaaggucccuuucacaauguccccugcacguggccaguguugggauggccuaagccagcgggcagccccuacugugggagagccuucuucaucgcccacagagggguccggccaacauggguucggcucccagcugcaccacuacaagccacaugagcuccguuugccguaucaccuuucugaggcucauucgcccaguaggcaaguccguggccacccgggcccuccugguggccaggcguguguuccccucccggucucucagccucccucucguaagcaggauucccuguacccgugggaccagagccccagacagaguaucacccuuccugagccucagucaggccaagcagcuuuugugaucaaauauuguuauauuuaccuaaggaucuguuaggaagcaauuuuugagaugaugaauauuuaaugaaauauuuaaauauuuaauaggaacuuuucaaaccugacuuaauaauccaugucauagggagaggaaaaugggggucguguuuuuacauuuucacuuccucuaggucucucaguguuugcuaggcuuuuuuuuuuuuuucacagcagaguuuuaauuauacucaauauuccagagagaaauucuuuucucaguaaaacuuaacucuugccgacagcaaggugagcggcgggcggaggaugcaccgggauggaaaauguguggagcagagagggauuguccacccaccagcccaacuccccuguuuaucaggugaggagggaggccuggagcagccacagcuguguccaaggucacgccaggcaucuguggccacacccagaugggacccaggucuuuggacucgcaggcucugggagcuccauucaugacaccauccugaccccugaauguucgcucaagucaaggcugacauccggugacaucuccuagccucagugaugcuaccccuggcccucuguagcagcagcaaauugagauguucaucgcuuaggaagaggaggcaaccuccccuuucaugaaagacuugaaaaauuuaaacugaguuccagacucuucuaccaugaggguggaugugagugaacguccagccaugucuuuguucuguccuguguccccucuucucucuggcuccuccggcgucagguggccuugggcccaggucuuuccaccugggaggggacacaggccagcuccgccucccccuccaggcugagccccucccccguccagggucaccuugggugguucugcucuggcugggcauucguucccugugggccacacuggcaccagccucacuguaccaucugugggcaguggggcaucccccggcugaccagcccuucagacccagcucagaccacagcucccaugggcuuccccuuccucaccagcuccgucuccacccuugucucuguggggcagucuuuccucauagcagcggcuucuccaucccucucugcuuggaucauuccagaaggcucuggauaucucuuucccaugccuuucccuuguacucuggggcccuuucucuggucucauucaucaguacuucccucucuccccaucuguccaggccacaccaagcuacugcacauuccuaguggauucaggguauccucaaaaccugcuuagacaucaccuccccuugaggcaccccucccaccucccaccugaggcacagagguaacccccaccccaucccccaccuccuaccccgugcuagggaggcagcugcaaccgcuuuuauuacagcacauuugauuccacaucaugggcuguuuuuagucuauuuccccagcuaggcgggcaaauuuuacgggaagcaggaacaugucacacucaguucuauauucucagggccuggcaugguuccuggcauacaguaggugcucaauugcuuguugaacaagucuuugaaccuguaugucuuuguguugucugguuuucuuuguuuuuagaggguugggggaaacccccauuucuauguccagugaacugguauucaccuuuuaggugcugcucaaagaccuaauucucauccuaauccuacaacagcuucuccucuaaucuggcucuaauuccuccaggcagaaguggaugcuucuugcucggugcccccaugacccucugcuugcccaacaucaucagcagggccaagaccuugccguggcucagggcuucacuuccugcuuccucacucccuaggcugggcuguccuuagcuucucugccuccagcccagccuggugcccagggaggagggaagcagcaaacagaaccuugggcugggcagagugcacuauggccacguacugcagcccaagcugccuccucaccauauucccugagaccugcucaggcuggugccagcccaucacguggcagaagcuacuguggcuggagaggcagaugcucgggcagccacagugcuggguacagaguggguccucagaaaccacuugaaaugauccuggggcccagggcaaagaggguuucuguuucuggggugcuuggauacagcccugaggccacacuccagaggaaggacaugacagaugaagaucugacauuuuuaagaugguaacucuuuuaauaaggggucuuuaaauauuuagcaaaacaguagaagaggccaauucagccaggagugauaguuuuaaucucacugagcaccagcggguuuccucugagcgagggaaucugacuuuucccugcucccagccccagcucccacccuccgcaaacuccuccagcuuccucugggggccugaaggaggggcucgauggcucaccgacggaucacaaugucugagcccaacaagacuggggauggcauuuccugguccuguguccaggcagaggcaugggugagaggcugugccuccucccucuggccugcucagcugggacccccuguagaggcugucuugggacccuggacaggauaucaggagguacaaauaaauggaaaagagggugcagagaccugagggacccucucuggagccccacuucucccuucuuaccaaaccuccacaucuacaaaacccaccucuggcaucagcucacccagaaugccccaggcucugggccucccucuaccccaacggugcacuauagggcacugcaaucaucucugcuugcgagccuccucugugccacucaauauggcuggaaggugagacuggguucccagugcccuagcagggccauaugccaagcagaagcucaaucagugguagguauugugcugaggugguccaggcgccagucuccagaaaaugcugauucggaugcccagggcugggugacuuuccacucucccugcugucgucugacauggcuaucaucaucuccacgugcucccaaggccaccuugaugcagcaucuacuaacucaacaaguacuagcuaggcuugccaugggccaggcccgaugcuggggcugagcaugcgauggggaccagaacagaccuggucccugccucaaggggacuguaccccacgaaaguggggaaauggacuucaugcagaucaucauacacgucuaggguaugaagcuuaugugugacugagcugggaacccgaagccuuaugcuuugcagccgucauccagggcuuugacuuggguagagacacaguauacuugagcugggagggacaguucuguuggagugaaugaggccaagaagucaggaggaggaucugcgcaggggcaaggagagaccacaggcaggaagaaguguucaaagacagggauggaaaggacauccugaguccaggaggucaacagagaauguggcaucugggaaggccagggcaguagcacugugucauagcccuugagucucagugucugccuucuccauaagaacaccagcucugggggcagggaccaugcuugcuuuauuccuugccaaucucuaaauaccagcacaguacugacauacaguaggugcucaauaaauguuuguaaacuagauaaaaagugccucauagauauugucucauuuacucuuaacaacaacccaguggaaucaggauuaucagcauccgcauuuugccagugagggaauggaggcucugggagauugagaaccucagccaagucacgcguugaguaaaccauggaggcaggauuugcacccagggcugcucugacccucaaacccauauucucaacccgugugccacuuugcuuuggccucuuuuucuagcagauucuuuaucucuuggagcugcugcuaccaccuccaugaauacaaccgggccauugguaugcgaaccuacgugcucccuguaccggcugccugcucaucuaugcauauuucguuauuaaaauggggauacuucaaucuccgaauaauuuugucuuuagggaagcuccguccccagcugcccacagcgaaagcccccaggaagcaggcaccuacuugugauucaggccaccguguccaucugucaacacgguugucuccuguaucugccaucucuuauuuauaaucccgcucagauuaaugaaugacaguaguucucaucacaggaaauuugauuaaucaauuuaagugcuuaaucaccacagccuugcugagcgcugagcauaagggaucucacuuugaugcagaugaauuucaggaagaacugggagaguagaaacaaaauugucagcacuucuccauggaaaccccauggagguuucagggcugaggacagcgcuggggaaguccuggggcccccagaagccagaggugggguaacaagaggauggguggaugacuuacgcagggagcagcccucugaaaccgccggaaucgaggccuccuuugcaccuugauuccacccagagucugcgccuacgcuuugggcaggggaggcagaacccacguuggucuaagagcagggagaagugggcaugauccuaccaugcugcagggccucgggauggggaugggauuugcugcucuuugugcccaauuaaugagcgagacgaacaagcacacugaguagcuuccugccagccguccccuuuggcagcaaacucauccccaccucugggccuuggcucgaguuguuagccaacucaaccuugaagccgucccuuccuaucagcccaugcaaauucugccaucagccaaggaccgccucuuccucuuccgggaagcugacuucaagccaugcccuucccuuuugcaagcucccguggcucgcgacccgcagcccaccccugcaccaguggacacugcgggauggccuggccucggcucugcauuuucacuucucuuagcucucaucuccuccaccacagagacagcucugucugaguaucuuucugauacuguucuuuaucccccaggacuggcccagcccagggcggugcguacagcagacacuuaauguaacacaguagcagcuuuuaauuucucaggccaaugagauacagacagucacugguaugguaguuuuucagucaagcaucaagggugugugccccugggggacauugcaaaaugcuggguguggggagcaguuugaacagcaacauucaauauuacaccauguuuucauuuuucaaaugcaggaagaacuuauuaguuugaauuacaaacaacagaaguagaaaacuccacaaggaaaaaucucagcuggugaagaagcucaggagcucacagaaggugagcacuuggggguaagugggcugggcaccucaggaguuuugugauguccaaaaggagaugugggugacguaggguuuaaaacccgcaccuguaggaccagucaaauggagacagaguuggcuucccagagcuaccgcaagggcacgagguaggaggaccaagcuaccaguuacugaaugggcacugagcagcuauaaugugugcacuaagcuuguccugucuuaaucccaaaacagugugaugaaguaaucaaaccaucgccaucggcuaaggaaaccgaggggugcagagcugaugucgcuuggcccgcaagccacggagagugggagcaagaggagguuuggucaggcugccucugccccugucuuucucggcccacaggcuccaagcaggcaggaccagaccgcagcuuccaggugcugggauccggggaccacaccuucaccugcugcucucuugaaggaaaaacaaauaucugccucuggcagguaaaaaaaaaauaaaaggagugcgucucaugcuguuugugauagcugcuacacagagaaagacuaauuuuggaaaccgauuauuaaaaaauauauucacucugaacgacgcaaucaaucaaaccuucaagaugcagguucagccggugccguggaacucccaggcaacacacggcuccuucccaggcugcugucuggcccggccaggccuccuucccacugggacugucccagcucugcccuggggacauuggccuccggccugcccaggcugcagugaggauggagagggaagaggucggggcucccgauugcugacuggucaggaggcagcugcggagucaggauugaagccgcaucggcucccaugccaugaaguggacaaaguggacaccucuccccaccagguagugggcacagagcccaagacacacugguaggagcagucccuagccugcccucucgccuaugccacggggccagugccaccugagccaugggcuaaugugccagagauguggggcacaugggaugcccagugcggguacccgcccagugcugccugcguuccaggagccaccugccucccuugccacugagacaggccugcugggccucaacaaagccucacggaauucuagcgaugauucugugaagggaucuccgagcucacuggggccucuucauuuugcaaaugaggaagccaagguuggagaugcagcucacgugacuccgacacuccgcaccuuggacagccucagauacccaggcuuugccuccugggaggcugggcucggcacucucccucccuucaccccuucaucugcaccuggggagcucagagaccugcacccuagaggccugcacacuuccguuccuccccaucaucacaguggggcaguccugaaugagaagcugcccagguggugucuggccuaugggccugcacucuggaggcuggaucccaggaccuauguaggacgguggccguaccaugcgcaggcuugagccuguuaaccaguagcucagaggguccucaguggggagcccugguccugcauggguggugggucccacacagacucaggcaggugaaucgacccuccauggaggcaucagguggcagagucgcagugaggcaggagugggggcuggaccgggagacgugcuucaggguaguguccacucggccugaccuggguggugcaggggcagggggcucauucacugcacagucucagggaggggcucgauuccagacaacgaagaacaucagagucgcagccaacgauggcucagugugguccaggggacacagaucccccaccuaggaggggucaguggcagcauggacccaggcagaaagcaguaugacagaaauggggagccugucccaccuguguccagucagcaagggcgggcccgacccaggaccgcagaccccaccugggagcagcagggccuggaggggcccucggcccugggaggacgcagcucugggccugcagccccccaccgaccaccugccugcagccagaagcugccccucuuugugguggccuucccucucagagccagcacgagcccugcucacucuggcccuggugugaugagaggcggcuccgugacaccucucugugcaggcaccgcacccaggacucucagagauggucauuccauccucacugucucacuaugauauggagguggacacuggguuuuacagaugaggaagcugaggcugagaguggccaggacuuuucuuccuguccaacccugcucaguaacagcaggucaggccuuccgggcuccacaggccaugcucuuucugcuccaccaggacccucgaggcccuuugaguucuaaaaccugucugauuccugugugcgggacccccucugccugcuuccaccugcccuugccccucggaggagacagauguuggggccacagcugcauugcagccacaggaaggagggaaacuggaagccaggggccucccacggcucuggguacaguugaccccuccugccuggacacaggggccagugguggaugauggggacccugggaugcccucagggugaggauagagauuccuggcugagcccaggcccuugggggaucccagucucuccagccaugguugccccgagugaccgagaccagcucaaagucacaacuuccccuuguucccggccacccuggcucacucaucacuuuggcuucuucucaaaggauuuaaaagacuccaaagaaagcuguaucuggguuuucccuagaacagaguccuucuccaccaugcuccacccccgcaaaccugccgcucggacagugcgucuugccccucaccccagucucaagaccucugaccuacccaggcccugcccagcugccuggagguggcagcccuaugggccgcagcuggggugagagcuggcaucucugauucccccaacaccacccagcccugccuucugccucugccuccgccucuacaccccuacuccugagguguucuucuuggguuccucaaagccccucuccuucagauucugcucaaacgucccacucucagcaaggcccucugugauuucccgucacgugacuucauucuuagcucucauccccacuugagaugauuuuuuauauuuguugaccuguuuguccucuggcuucuucccagaaagcaagacccaggugguaaaaccuuggcugucgugcggccugcuucacccaugugcuggacacaccgcccgaccguguaggagccggucguacucgcugaaugagugaaugcgccugcuggcccgggacuuaccccacagggccagcuggggaggcagcacccugugucaggcccuccaacccaccaagcugcaggcuucuacagacccagaaucugagguuucccaggggaggggucucuucccuuaaaagucagaggcccccgguuauggauugaauguugucucccaaaauucauacguugaaguccuagcccccaggaccucagaauguggccuaauuuggaaagucucugcagauguaaggaguucagaugagucggugggcccugauucagcaugacugguguccuuacacggcagggagugugggcacagacacgaacacagguagaaugccaaguaaacaugagggcagagcucagaugaggcuucucccagcccagggacaccaagcaaagcauuagaaggcaagagaggccccgaacaggguuuuccucaccgcccucaggaggaauggacgugcagccuccaggguggcaggauggaucccuguggcuuaagcccccaggcuguggugcuuuuaggcucaucuguccccuuaggaggaugauccgcuuuccaggccuggaggcuaaagaggggccaggcugcugguuggacaccggagaccugccuccggcauccaggcauccggggaggauagggcugggaagggccucugcugggccucccuccucuuccucugcggccuccucugcuugccugcggcugucaguuuccccuuucugcuccugucccaccuggccaagccugccagcugugccccagaggggcugagacaugggggacuuagauccuccugcaaugccgcugugcccugccauuccccccaacgugcaggcuuugcccacagcucagaaugugccccacuuugguacccggcacccacaaccuccagccucaguuaccucuuuacaucccacacccagauugcagggcccucagcucccagccacagccugcauucuaccucugcauccgccccgcugggaccccagccccacugccguucccaggguacagaggcgagggacuacaaguuaauaagagacagaaacuaaacaaaaugacccuggaaguaauaacccuuucagaugccacaggcccgggaagggcaaguccaggaaccagccuucaacugcucuaguaccucuagagcuggggagcugggaggagggaccaggcccuggcaaggagggaccccuuaccgaccucacccugcuccucccaccucagguucccuggggcccuguggucugcaggcagagggcggcccagaggcucugccgggcccacaagacagagcuuuagaugcugcaggaagcugggagcaccccuccaggugcuuagugcuaggacagaagcaccccuccaagccuagcauuaagucugcugccuggaacuggggcgucacucuuccccuuuucccucccaggcccccucccugaacaauccugaacaaucccaugcuggaaccagcccggaagccagggcuucaucugcuccugaggacaggggccugcggcacgcagggcaucucccagcuucaaacacacucucuucccaugagccucuucuccccaugcccggcucccucucgccucccagacugcuuggagagcucccuggcagccccgggccugggggacgaggggagagacauuuuuuccaaucaauauucauaucaggcuguggcucgagcugccaugaggcugagagucuaccugauaaauaauguucuaagaaagcccagagccucccgcuccugcuugcaaauugggcugguucucugcugcaagcucagggugguggcauggggagcuucccagcucccuccucugcuccugaggugccucuuguaccuaagacaguaucuuccccagggugcagcacagccaggccccugggucaugcugugagcucggaggcaugcaagcccugccagaaggcaagggugcaggaaugggaggguggcucccugagccgggccaugaggagggcucucugcguggauugcccugacuucagauaggcgggccccugugccaccgugacaaugccaugaucgggcuauaggaacugaguacccuucagccaugagaacggcggccagcccuugccuggucagaaggaggcugccugguucuuucugaggcgcugauuccgccaaagcugggggacuuuccccaagcauggggacugcgcuccacugccaccacagugaaccaggcugagaacccugaagagcccacugccgguugcucucuucaggguaacagaggggaugaugacccaacccucaacaaaccggaagguucuguuucaaaacaggaauagcagcagagcaagaacccagccuagggcagggaucccacagggagagguacaggagucccaaacuuggaauucuggaguucugggauucugggcuuuagaaugaugggauucuggccugaguucaugccugagacagugagaauaaaggcagccuggggccugaucuccccacuggacugugagcucagcaggucuaggcaaacugcugugguuugaaugcacccccuccaaaaugcagcuguugccaaugugauuguuuuaagagguggggucuguaagaggugagaaagccaugagagcuccuccugccaaaaugggauucaggcccuuauaaaaaaggcuucaggcagcauucagcuagcaugcccucugccuucuuuuuuuucuuuuuucuuguuuugagacaggguuuugcugucacccaggcuggagugcaguggugggaucucagcucacugcagccucaaccuccugggcucaggugauccuuuuaccucagccuacccaguagguaggacuauaggcaugugccaccaugcuuggcuaauuucuguauuuuuuuuuuuuuuuuuguagagacaggauuuugccauguugcccagguuggucucaaacuccugagcuuaagcgaucagccugccucggucucccagagugcugagauuacaggcgugagccaccaugcccggcuccccuccccacuacuguccaccacucggggacagagcaagaaggcccucacuagguaagaugcuggcaccuuggcuuuggacuucccagccuccagaaccauugaugggaaauaaauuucuguucuaaguuacccaaucucagacacucuguuacaggagcacaaacagacuaaggcucaagccaaugucugaugaugucagacucauuuuagagaacccaguaccuagggcagguccuagaagguagcgggggacucaguggggauuugcugaaucugaaugaaugaaugaaugaaugaaugaauggugcuuuccuccuaagccccagggguggccaacccaucacugccuagccacccuauggggaguaugucacacagacagugucugcccuggcgagauggagaaggccagcgucugugcaguguucggggcugagggagcuguccuuacugccaugcuccccguggcuccuguauccugcaauuuuuugcacagggugaggauaugguugccuucaugagcugaucccuugggaaagagcagagaguucugcaaaugcucagagcagcagagggccagccuccuccuuucugagagcaaguuuggaaaguaaaagagagagagcugggaggcauggaugcuuggggagggacucuccaggaggaggaagggaugugggggagggacucuccaggagguggaagggaugugggggagggacaggggacagggcgaagcaggcagcagugaagcccaagguccaggcaauaggcuuaaugcuuccccguccaccagggcccccuccccuugcauugaaugaggagggcugauccugugcugcuggcuuguggggcugaggcuggggcuacugcuguccuggccccaugagucucccuuuccuguacaucccagauguugauaccaggacagucaggaaacggaaucuuccaucacaagggcccuuccuucuacccuuuucagccacacccacuucccucccagcccaacuccuucuuaaccacuggcggccacuaaucugcucucuauuucuauaauucugucauuucaaugauauuaucuaaauggaaccgugcaguauguggccuucugggauuggcuuguuuugcucagcaguguucucuggggguuccuccaggugcucacguacaucaauuggcucguccuuuuuucuccguuggugagguaguaguggcuucaccuugccauuggaccuggccccucccugagaaguggguaccuggaggggcccugcagcaagaaacugcuaggugguccuugggagccucaaaggcaaaggcugggccuggccaggagugggaaucacacaggccguggcuuucagaagcucccagcugccacagucccaucugaagggcugcagaggaauggaaaggagggagucacacagcuguggccaccaaggagguugcucagguugcuggaggcuuagauagagaugcccagguggaggaugcaggcagcacagcccuuccuucugcccugccuccuucucugacacccaacaccagccugcuagggcagccacaagccuuaggcuggccuauuuccugggcaauuccucccucagggaccuccaugagcaggaggcaggcaaccuggcucuauugaauaaggccacagggaccaaguacccuucagccauggggacugggggccggcauacccgguggucagagggaggcugccugcuuccuucugaggaggugauuucaccaaggcugggggucugucgggucuggagaucccucuggggcuggccccggugcagaaccuaugcacgaagaaaggcaggugcuggcugggcccuggcugcaggcugcccacugcuacuugucuccucagccugggcauugccugcagagagcgaaauaaacaaggccguaaauaauccucuccuggugaagcugaaaggcagaagggcccugaauagagauaacaggagaugcagggccacaagggggacggcaaauuuuguucaacugaguggagcucagacaacagaaaggcagcugcuguguggggagcagccagauucccuucccaaggcuugcucaggacggaccaccccagcaccagaggugggcugaggcccggacggaggcagagcacuggcccuggccccucagcauccuggccccguggugaccccaccaggaugcuuccucucccagacagcccugacuucucaugccacgcagccaccucucacuugucuucugcugcauagaauggucucugugccucaauucccuggccgcuaccggaacaugcuccucccauucccucagauccucuaaauuauguuaaacacccacagaaaggccuccuggauugaacucccugggacaccaauuuauaguuagaccugaauucaaaaccugacuucaguacuuuccggcugugugaccuuggggaggucacuuucccucucugggccuguuucugggucuguggaauagggauguuauguuuagcucacaaggcugggugaggcuuaaaagagaauacggaugcuccuggcaccuagcauacccacagccaacagcgguucucacagcuccggcucuucccagggccccugggcucugcgcuggucagccuuguuucuaguccacuuugucagcguuguucgaucaucuucccagguuuaugucuuguucuccagaacugacugcaggcuucuuggggaccaggguugccucugccuggcucagggcccagguuguuccccuggcaccagcauuacagucgcugccuucggggguccuagagucugguaggaugaguggcucccaugcugcaugugcaaagggccucugcacagaugacauaggacuuugggagcuuggggauggggcaggaggagguaaggguggucuccaggggcuuaggcaucagaaaagccuuagagaguuggucucaaagaucugcagggaagaggcaguuugaaggaagggcuuacugggagugggagacacuuggcaagggagcaggggcaggaauucaccuaaggggaccugaucugcagaugggcugggguaugcuugagcggcgccacggcaggaggaaguagaggccaccagcaggcuuaacugccuggcgcccaccccaaaguggccguccauucgggagggcaguugggaaugcugccuucuucgaucugccaaguggggcugcccaguguggagcugagucuauggcaggacgcucuucccagcgaucagggaccuggggcagccacaagccuggggcugaaggcacaguaggaccuguacucccggguggaaaugagaaaucuggaugcccuuugacuggguccucugggguagggucagucgugacugccaccuggagcagccaggcuuacucagaggcuguggacaaggguuuccacuuuugcccuuucaaaccaagcuuccuggccaggcuccuugaggacccagcugcugaucgaucucaaaggagacaucucugaguucuuagaaauggcccaagggaaagagacuuugggacuguuggaacaguuuauucucaaaaggcugagaaggcaucucugagucggcagaaagccgcucucccugaguccucauaaaguguccugcacuuccacuaacucauugauccacauguuuuccccagccugaagauuucuuaacugucaucacaagguuagaagaauugugaguuggaaaacuaugcagcauauuaaagucaggcugaaauaucuccacaauacagagaaauauuuuauauuuauucucuuuuagaaauuguuauaaagggaauauaaugagaauguugcaaaugaguggaauauuuucuucuaaccugacaauaaaaauaugucaaagggaugcaugagacucuaauaggaaacagauggcgagccuuggaagugcagggauuuagcaaagauuuuacuuggugccuuuacuggcccacagggcagaaauagaggccucuccagcaggcuucccugugggugaacaugcagagaaugagagggaaggggcagguuauucuaugucccggcccuggucagguaacagagaggcuugccaagaccugaagccauggauccucauggagccucaaaaugguagaaacauaucaagaucccugucaccaucaccuccaccaucauccccaucaucgucauccucauacccaucaucaucaucggcagcagguucaccaccaucaucaucaccaccaccaaaaucaccaucauccauguuaucgcugucaucaccaucaccaucguuauuaucacugucaccuccaccaucaucaucauccuccugaugagcagcagcagcagauucaccaccauggucaccaucaccaucauaaucaccaucauccaugugauugcugucaucaccacugccaucagcagcagcagcaccucuaccaacaucuccaucauccucgucaucaucauccccaucaucaucagcagcagauucaccaccaucaucaucaucaccaccauaaucaccaucauccauguuaucaccgucaucaccacugccaucgucaucaucaccaucaccuccaccaucauccccaucauugccaucauugucaucaacauccccaucagcagcagcaguagcagcagauuugccaccuuuggaucuaugucccuacccaaauuucauguugaaauguaauccccaaugcuggagguagggccuggugggaggugaucggaucauaggggugguuucucaugauuaacaccauuccccuuggugcugucguggugacagugaauucuuacuagaucugguuguuuaaaaguguguagcaccucccccacucucuuuuccuccugcuccagccauguaagaugugccugcuuccccuuugccuucugccaugauugaaaguuuccugaggccuccccagaagccacuaugcuuccuguacagcaugcagaaaugugagccaauuaaaccucuuuucuuuauaaauuacccagucucaaguaucucuuuacagcaaugugagaacuaacauaccaucaucacuuucaucaucauccauauuaucagcacugucaucaccaucaucaucauuaucaccaucaccaccaucagcaucaccauucaccacugccaccagcaucaccaucaucaucauccauauuaucacugucaucaucaucaccaucaucaccaucaccuucaguaccaccauuaccaccaucaucaccaucaucaucacccguauuaucacugucaucaucaccaucaccaccauaaucaccaucauugauauaaucaucaccaccaucaugaucaccauaguuaucaccaucaucaucaccaccauuaugcccaucauuaucuccauccucaucaccaucaucaccaugcgaauaguuuccauguguugaacacuuaaaauaugccgugcacuaugcuaagggcuugacauaaaucauuacauuucaaccucgcaaccaccauaugagguacguguauccaauuguguauccaguauggaaacggaugcucagagagguuaggaacucacucaaggacauacacccuguaggugguggggcucuaaucgcaacccaggucauuauggcucccaaauucugacaacacucucaaauggaagagcauuucguggaagcagaaagcacuccaagaaaucucaagauggggaggaaacuucuccauuagaggcguccauuagaggugcuggguauuucguucagccuguggcuuguaugcaauaaccaucugcuaagaugacuucugccaucgcugccagcagaccagagaaaauaacauuuaauaauaaacacccacugagcccuuacaguggugccaggcaccggugcuagcugcaggaaucagacgcacacagacaaccagcuccgaaaccaauaugcaaaggccacgcaauacaagacguggcacucagggaaucacucugauuaggcacagggguggugggguggggcagucauggcuuugaaggagugauggaugagggagaggggaugucauccuaguggagaggacaguguggggggucagaggaagagccaggugcucuggaugacuuuagaauaggacucaggggaggaugugguagggacgcugcugggaggcagugcugggccuccacugcagagcccugaccuaucaccuaugcgggaaggcaucuggacuugacucuaugugcuccgggaagccaccagaggcaacugagcagggcagggucaugagagccacacaaucccugauguggugaucggcccucgguaaaauccuagaggcagcaaggugugccuccaucuccucccuuccuucagagcccccaccccaaagaucccauucauacaacagauacucagugagcgccuccuacacccugggcacuggucuaggugcuggcaauggaacagugcauucgcccgacgaggucuuccccucuagaaauucgccuuccagugugcaagagacaacuuucccugccccaggcugugcuucccaacaguaccaacgucuccauagcucuccagagucugaugguugcccguggacuuccugcccccacccucccuccagauagcacuucugcgugcuggccagaaccuuucagacacacagugcuucccagagacacaguguuucccacggacgccgacuccagugcugccugcuuccugcuucccucccguggcagcagcacguccuggagccucccuugccaggucugcucuguaguuuggagcucauuucuguaauccccaaagaggguacccuagaaaggaaaggaugagucgcaaggggcccugagaauauucuggaacccagagcucccuguaccucaaggcucacccuagaggaccugcaaugucugaggggcugagugcucagggguaacccacucucccccagaggaccagcugggauugcgccucgucccugggcggcagaaugugugcagagggagaggacagcccaucccaggggagagcuuucucaaauugacauuuaauuucccauugcuaaaaauauuucugaagccaagccacucaggauuauaaaagagacuagagauugaaaauuaaauacguaugcacucacugcugggaaggauuugaccuucgacacuuccuuucaaugaauucccaaauaaaauacuauuuauacagcuuauagcaaauuauuguguagccccguacuaaaucuucacauuccaauuuagacucugcagagcuuccugcagcuuggauaugcuggcaggagugacaaucaguggugucugaggaggucuuuuugaacccauugccguagaaauacugaguuuggaucacucgcaaucuacuuauaaauauuacauuugugcuccugcagcccaaauagcuaagcauuaaucucuuaagauuagugacuaaaugugcuggaauucacaauguacaaauaggaacggagcuuuucugacauuugugggccacuuaggaagcggucaaaagguugaugucaucgcagcauuaauuuuuuaucaaagauggccaagcucauuuucaggguuguaauaaacagcucuucucggcucagacaccuccugucccccaccugcuggaggccucgcuuguccuugaggauggaugccaccucuucaggccucuaagucggcugcccugcuucuggaagauucaucuaggacagcuuaagaggggacgacaccugggaauguugaguaaggaaaacacgauucugaacgccaccgcugagcaaaaaggccuugcugguggccugauaaauuacuaaaaacacaggccagauuuaaggaccaaauuucaucucaaccugacucccaggaggacagccguucaggucuuuuuaacucuaauuuugcaauucuacgaaagccauuauuuuuaagucacgugcaagcuaauaugcugcaaccaggcacaaaaaugaucucauucggaacucccacgucucugaaucucagauuucuccugcccaaaugcggugagcgaaguuuucuccaccuuucccccgccccaaccccugcuuuuuugcacagucgccaucagcccccaaucacagaagcucugagccaggcugauuaauuauggauuugccaaaccucgaagcuuucacuaaaguuaaucuuuuaaacgaucuccauguaaaucaggccuugcucagcccuggccagggcccuccgcuugaucuaacaaguaguaucaaucgaaucgaugcaguuauuuaguauuaauagauaaugggcugcaaguuggaaacccagguaggcaguuuuuugggggagaucacuaccgcugguccuauauccgaugccaggaugggaguugacaccaccugcccuugcuggccccaugcacccaccaggcagggcacccuaggacucugaggggcuacagaaaugcuagugaggaugcucugagcuucggaccgugcagcucucucuggcccugggcaccuggauauaguuaaagagcaaggucugggggaggugcccucaccuuuuuaaacuguuaaagucaggcuggaaagguaaucugcucagaaguguuuagagaugggguggcugaugggacuagcagaaggagggaggagcccugcagaugccaggaggccccuacccugccaccuuuuccaggaccgcagcucaccugugaucucaagcauguguagugccagucacugcagccucuuuucucagcaccuggccccaugccuggcacagggcagguacaugaaucaaugaaaucacaaacauuggccuucaguggcuggcccaguggcuaugggggcagggagaagauggggaagcuggagucacaacugggccccucuggcuacagagugagaccagggcccaaagugaaagggagacugggaguccccucgucuaggaagcgagcaagugggaaggggugcucccuguuugcuggucucagcaacagagugagguggauggacccugccagucccagaagggcucucgguggguagcagccaugccugacgucuuugagucauagagaaggggcaguaugguggaggggggauugcuccugcccccucugacucuccucugacagcaagaagugccuggcucuuuagacaccccgacccauagcuucccaccuggcagccucauucacacucucccuuuaucugccauggaggcugcucugaaggacccuggccuugcagcguccaccccagacaaacuccuagaggacuguccuuccugcccccaucgccauucacagaggaugacugacaugggcuaggggacugccagggccucuuucccagggucuaggugccaccugagcacccagaccauaaugccaagagccccgcuggcccccagggaacugugcggccucuccucagggcaccauggaagggccaccugcaagccucgcucugucuucccugagcuuugggcagugcaccuucucugagccucuucucagagcaggaagucuuccccacaguccuggaucaaggccucuuggccuggggucugugggcucuuugagaccuuacaaacgugagaauagugagccgguguacacuuuguuuauggggacuagguucucagcuuugguccaauucucagauacauucaaguucucccaaaaguaaauaagcagugcucucaggucuaagggcacagauuggauuccccgagccccccuggaagugaagccaaguccauccugccucccucccucccuaugcagggacacucccuucuuguccccucaacugcuggcuagaagacagcguucugggaggaugagcgccaccaugacaaacccacacauuauuaucuuuaugucagaguggagcgguuuuuagggacagggauggcuuccccacugcaggcccagacuguugaacuuggccaaggacccauuucaccuuauccgagcugcaacaugacagcuuugggccacguuccagggucucugaagccaccuuucaccucccaggagccuggagcaugacucaacuguagccagagacugagaggaaggaaggagaggguuuagcccaugagaaagugccauccacagcggccugcuuucuuacaacgugucagcugcaccaacaggcuuaguuucaggccaggacguggcugcccuguuugcucccaugcagcaagugggaugggagucaccauguggauccccucucaggcaggcaaaucccuagcugucccccacccccacccccccucauccucccagcguggccaaaacaggaaugcugcuucaugaaaggccccucacugugacacgcaauacaaaaugauauuuccaagaucuggcagagaauaagaaaaaucaaagcaauuuaauuuguagagcagaggaaguggguuggggaggaccucuaauuugguuucuuuuaaaaaaugucuauugauguuuaugugauaaaugacugcaaaaugcuccauguugguaccagagagaagcagcugccuguaugcaauggcugcaccugaggggcagccucccugaagguaggaaagagaugcccgagagaagacagccacaagcacagagcccacguggggacgguggugagaggaaggcugacgugggcuuauccuucugcccccaucaggugcccaccaagcaccucaccccaagaaaggugccgcauggugcuggggcagacggcaagggcuuccaaauagcucacagugcucccuaaagccagaaagaggugacauuugggcaaagaguuggccgccugguugauaaagguguaagcagcauucagagucccuccccucucuguccucucgccccguaccuugcuuuauuuuccaucugguauguuaaauauuuauuugccuaaugaaugaaugaaaaaagagcaggugcaaaauccuaacagcacaaacacucggccauacgacauccuccuucgcucaucacagcugacccagugauggcccugggagguaagcaagggaagucguugcgcauuuuauugguaagaaaaacugaucagagagauuacacaguuugacccuuguggaauucauguucauugacaaaagcaggauauaaaauugaauauguaguugcaucucaccuaaguagaacaauagagaaugagguaaugacacccggcggggggaggcuggguacaggcaggcagcaggcauuaucugugugcugguucuuuuuuuuuuuuuuuuuuuuugagauggaguuuugcucuugucacccaggcuggagugcaguggcacaaucuuggcucacugcaaccucugccuccggguucaagcgauucuccugccucagccucccaaguagcugggauuacaggcacccaccaccaagcccugcuaauuuuguaguuuuaguagagacgcgguuucgcuauguuggccaggcuagucucgagcuccugaccucuggugauccaccugccucggccucccaaagugcugggcuuacaggccugagccaccacgccuggcccugugcacugcuucuaaaccauugaggaaggcuuggcccggggccaggcccccaccuggggcugugagggcugccucgcccuggggcucuuuugcccugagacuccaucuaacucaugcugucuucaugagccuuauugguaguaaucggcuccugauugagauuaauggagaaaacauuuucaaaacacuuaaauggcacugccauuaaucuaugcucugaaaaugcaucuugcagggcaaccugggaaagguguucauugcaguuucaaauacaaauccaucaaagguuugcaaagggccccucgcauccacgggccagucucuaagagccaauggaaagcaugcccuccacuuggugcuugcagaccccaauguagggggguguggggacugcagggagcccuguguccagguggcaugugccagccccaugugggaagcugccuauggagugggugugagggcccuaggguugacaggcagcguucacagccuggccccauuggcugugggcugcuuggccuuggucuuaaccucucugaccuccacuuucccugucuguaaaagagggauauuaaaauccucauuuucaauauuuguaguccauugucuaaaagauguaucauccucauggcaucccaucucugcuaggcugcugugaugggcagcagcacagcacagauccccccagcacagagggggucuggccauugguguugucaacccucuuccugcccacaugugcccuuuuuccugcuauguccucucgccuguccguggaagccgggaucugcugucuccuccaggguggcuucccugguccugaagccccucucacccacccccagcaggaggauccaccaggcccuggauggaagcccccggccuuuccucugagccucuugcaucacucacugucucccuucagcuccuagcaugggcaccaggacccacagcuggaaaccaggcaucuugaaaacagagaccacgccugcauguacgacccacagcacaggccccugcacaggggagggcccaaucugcccuguccagcucccacucugccccuucagacccuccugccagucagcccugcuuuauguucucaugguuucugacauguggcacuuuucucccugggcugauuguaaauaucuccaggagcuggaagaggugaugaggaaugcuggagauccaugcccuccuccacucccccagccacggcgcaccgagagggcaccugcagaugcacagcacagaugccacacagagcaacgcuugccaggggagggaggcuuccaguguggagugagcgcugcugggucaugccccagugccccgugggccugcaggaggguaugguccccucugucuguugaccacagacacccaaccccaggagaacggccuccugccuccuuggucuuucccuucccauccuccaucacggacccaccugguaccaccaaugagguggcaacagugagugcuggcauggaaggccccucugcgugccaggugccauucugaucauuucacaucaacuaauccucacacagcccaagagggggaggccguuguuaccuccaguuccuacaggaagaaacugaggcccagagagaguucaguaacuuguccaggugaccucacuaauaagucccagagcaauccagcacucgucacguucagccucuccacuccaguguuaucugguuaaaaauauucaaccaauaggcugggcauaguggcucacaccuauaaucccagugcuuuaggaggccgggacgggcggaugagcugaggucaggaguucaagaccaucccggccaacauggcaagaccccgucucuacuaaaaauuacaaaaauuagcugggugugguggcgggcgccuguaaucccagcuacucgggaggcugaggcaggagaauugcuugaauccaggagguggagguugcagugaacugagaucaugccacugcacuccagccugggcaacaagagugagacuccaacucaaaaaaaaaaaaaagaaagaaagaaaaaagaaauucaaccaauaucuacugaacggggcaccuagccgcuauuccaaggggugcuggaaauguccuggaugaaggccagaagacagccaggacacagaagggcagcaccugcuuuucucaggucaagagacaguugggacuuucaucccagggaggccuccccugagaagcccccacugguguguggccuguggcaaaucucaggaucccagagaauguccagcuugugccucagggugcuucaggcucaaguccaggaugaugucagcaccuguggcugggaacgugccccucaggacccagcugaggccccucugccccccuggcugggugcccuuuguggaggcccugcugcacagacacauuuguacuugaacgguucugucugcuucuccaccagcuuggaggcucaaagaauaugcugauuuuggcucagggcauugcuaauauuuggacugggagguuauacgcauggauuuccaggagacugagcauagaacagaaacuuauugacagagccaagacacaucgcagcucuguggagaagcuggugggggcucggugggaagagcaaacgagggccacauggaagggaaacccucccuggccuauucacucccuuaguccuucacuagacaugauuuccugagugccaccagggccuggugcugugguaggcacugaggauacagcagcaaacacauguggccccacgaagcuccacucuaguggagagacagacagcgaacaaaugaguaaacacagcacuguacaugguaagaaaagcaauggagaaaaacaagacagagcaaggagcagggcacugggcagcaggucuggaaaggucucuccgcuggggugauggaacucagccuacccagacagaggggagaggugggggagccaggcggccaagugugcaggaccgggcaggugcuccagguggaugggcucgugagugugaaggccaaaggaggggcacgcguggagaacagcauggguucaggagggugugcgggcccagaguggagguccccacugggguuggggcaguugcucucaguaagcugcaaagccuccuccugguggcuucugagcaggaaagugacauuagcugauggcuccagguaacaaagagaccacgggggccaauggcagaaacaugcagcuguuaugaugaucaggauggagggcgggaugguggagugguccagcguggcaaaacugcagggguggugagaagcagaaagcacucugaaggaagagcccgcaggaucuccugaugggugggggguggagaggaagaauggggugggccauggaugaugcugaugauuuuggcugaauggcuggaaggugaaaacugccauguccugguucaggugggaugacaggaggaggcugcuggguggugguggggugugggcuccauguggccguggucaguuugaaaugcaaacguccaggucaggaggaugagucgacacuuaggagucugagucuagacuucaggggcagaggccaggcccagggaaucaguuugggaagcaucagcuuaaaugugccuugugguguuuagaaccacgagacugagugagcucaccuagggauugugugcagacagagagguggcccaggaagggagcccugggauccccaaaagucaugagucaaggagauuggggcugggcaugguggcucacgccuguaaucccagcacuuugggaggccgaggugggcagaucauuugaguucagaaguucgagaccagccuggccaacaugaugaaacucuaucucuacuaaaaauacaaaaaauuagccaggaaugguggcagaugccuguaaucccagcuacuugggaggcugaggcagaagaaucauuuaaacccaggagguggagguugcagugagccgagaucgugcccugcauuccagccugggcaacaagagcaaaacuucgucucaaauaaauacauaaauaaaaauaaaaagaagaagaaguucgggaagggaagaaagugcugcaugaaugaggagugcucagccaccugucuacacagacaacaugggauggaagguggagcucugagguuaggaauacagaggccgcagugacugggcuuuuaauuugagugaggcaggagcugcugcaggguuucuggcgggcagugaccugaucugaccugugucugaagaucccucuggcugcaguguugauaauggccagaagcgccugggguggagguggcuauggugguccagauucgggucccggcagcaugcaagggcagagccaacaggcugcacugagugggguggaggugggcaggagagcagcguccaggaugcuccaacgugcuugcccagagagcuuggaaggacaggguugccgcugaccaagaugggcaggcugcagugaagugggacucaggaggggaaguucaggggcucagcuuugggcuccugauauuugagacacuuguuggacagccaaguggcgauguggaguggacagguggaucagcaaaugugaaauucaacacaaggcccugggcuagggauccgcaucuggggccacuggcacagagauagccuuucagguccuggggacaagaggaggucaucaggaaguguugagaagccaggcacgguggcucaugccuguaauccaagcacuuugggaggccaaggugggcggaccaccugaggucaagaguucaagacaagccugggcaacauggcgaaauccugucucuacuaaaaauacaaaaauuagucaggcacauugguggugggcaccuguaaucccagcuauuugggaggcugaggcagaagaaucacuugaaccugggagguggagguugcagugagccgagauugcaccacugcacuccagcucaggugacaaaguaagacuccaucucaacaacaacaacaaaaagaaguguugaagagcagaaagaggaccaggaaguggacucuggaaucccagagcggggagaaaagauccugaaauagagaaaccaagggguaggaggaaagcugggagaagguggugucuuggaaaccaagagaagggggcaaucgaccacaccaagguacccaagacuagcugaggaauggccaaggaggugaggguccugaugcuuggcacaggaggaagggccugggucuucagacuugcuuuuuaaaaucauggcgaaaagcuggcuuuagguggagcuaagauggccaaauaggaacagcucgggucuauagcucccagcgugagcgacacagaagacgggugauuucugcauuucuaucugagguaccaggcucaucucacuagggagugccggacggugggugcaggacagugggugcggcacacugugugugagccgaagcacagcgaggcauugccucacucgggaaguacaaggggucagggaguucccuuuccuagucaaagaaaggggugacagacggcaccuggaaaauugggucacucccacccuaaauacugcacuuuuccaaagggcuuaaaaaacagcacaccaggagauuauaucccacaccuggcucagaggguccuacgcccauggagucucgcugauugcuagcacagcagucugagaucaaacugcaaggcggcacaaggcugggggaugggcgccugccauugcccaggcuugcuuagguaaacaaagcagccgggaagcucgaacuggguggagcccaccacagcucaagagggccugccugccucuguagacuccaccucugggggcagggcacagacaaacaaaaagauagcaguaaccucugcagacuuaaacgucccugucugacagcuuugaagagaguagugguucucccagcacgcagcuggagaucugagaacgggcagacugccuccucaagugggucccugaccccugagcagccuaacugggaggcaccccccaguaggggcagacugacaccucacacggccggguacuccucugagacaaaacuuccagaggaacgaucaggcagcagcauuugcgguucacgaaaaucugcuguucuacagccaccgcuguucugcagccacugcugcugauacccaggcaaacaggaucuggaguggaccucuagcaaacuccgacagaccugcagcugaggguccugucuguuagaaggaaaacuaacaaacagaaaggacauccacaccaaaaacccaucuguacaucaccaucaucaaagaccaaaaguagauaaaaccacaaagauggggaaaaaacagagcagaaaagcugaaacucuaaaaagcagagcaccucuccuccuccaaaggaacauaguuacucaucagcaauggaacaaagcuggacggagaaugacuuugacgaguugagagaagaagucuucagacaaucaaacuacuccgagcuacaggaggaaauucaaaccaauggcaaagaaguuaaaaacuuugaaaaaaaauuagaugaauguauaacuagaauaaccaaugcagagaagugcuuaauggagcugauggagcugaaagccaaggcucgagaacuacgugaagaaugcaaaagccucaggagccaaugcaaucaacuggaagaaaggguaucagugauggaagaucaaaugaaugaaaugaagcgagaagagaaguuuagagaaaaaagaauaaaaagaaacgaaaaaagucuccaagaaauauaagacuaugugaaaagaccaaaucuacgucugauuggugugccugaaagugacggggagaauggaaccaaguuggaaaacacucugcaggauauuauccaggagaacuuccccaaacuagcaaggcaggccaacauucagauucaggaaauacagagaaugccacaaagauacuccucgagaagagcaacuccaagacacauaauugucagauucaccaaaguugaaaugaaggaaaaaauauuaagggcagccagagagaaaggucggguuacccacaaagggaagcccaucagacuaacagcggaucucucagcagaaacucuacaagccagaagagagugggggccaauauucaacauucuuaaaaaaaagaauuuucaacccagaauuucauauccagccaaacuaagcuucauaagugaaggagaaauaaaguacuuuacagacaagcaaacgcugagagauuuugucaccgccaggccugcccuaaaagagcuccugaaggaagcacuaaacauggaaaggaacaaccaguaccagccacugcaaaaacaugccaaauuguaaagaccaucaaggcuaggaagaaacugcaucaacuaaugagcaaaauaaccagcuaacaucauaaugacaggaucaaauucacacauaauaauauuaacuuuaaauguaaaugggcuaaaugcuccaauuaaaagacacagacuggcaaauuggauaaagagucaagacccaucagugugcuguauucaggaaacccaucucaugugcagaaacacacauaggcucaaaauaaagggauggaggaagaucuaccaagcaaauggaaaacaaaaaaaggcagggguugcaauccuagucucugauaaaacagacuuuaaaccaacaaagaucaaaagagacaaagaaggccauuacauaaugguaaaggaaucaauucaacaagaagagcuaacuauccuaaauauauaugcacccaauacaggagcacccagauucauaaagcaaguccugagugaccuacaaagagacuuagacucccacacaauaauaaugggagaauuuaacaccccacugucaacauuagaaagaucaacgagacagaaaguuaacaaggauacccaggaauugaacucagcucugcaccaagcagaccuaauagaugucuacagagcucuccaccccaaaucaacagaauauacauuuuuuucagcaccacaccacaccuauuccaaaauugaccacauaguuggaaguaaagcacuccucagcaaauguaaaagaacagaaauuauaacaaacugucucucagaccacagugcaaucaaacuagaacucaggauucagaaacucacucaaaacugcucaacuacauggaaacugaacaaccugcuccugaaugacuacuggguacauaacgaaaugaaggcagaaauaaagauguucuuugaaaccaaugagaacaaagacacaacauaccagaaucucugggacacauucaaagcaguguguagagggaaauuuauagcacuaaaugcccacagaagaaagcaggaaagauccaaaauugacacccuaacaucacaauuaaaagaacuagaaaagcaagaacaaacacauucaaaagcuagcagaaggcaagaaauaacuaaaaucagagcagaacugaaggaaauagagacacaaaaaacccuucaaaaaauuaaugaauccaggagcugguuuuuuuaaaagaucaacaaaauugauagaccgcuagcaagaauaauaaagaagaaaagagagaagaaucaaacagacacaauaaaaaaugauaaaggggauaucaccaccgaucccacagaaauacaaaauaccaucagagaauacuacaaacaccucuacgcaaauaaacuagaaaaucuagaagaaauggauaaauuccucgacgcauacacucucccaagacuaaaccaggaagaaguugaaucucugaauagaccaauaacaggcucugaaauuguggcaauaaucaauagcuuaccaaccaaaaagaguccaggaccagauggauucacagccgaauucuaccagagguacaaggaggagcugguaccauuccuucugaaacuauuccaaucaauagaaaaagagggaauccucccuaacucauuuuaugaggccagcaucauccugauaccaaagccuggcagagauacaaccaaaaaaagagaauuuuagaccaauauccuugaugaacauugaugcaaaaauccucaauaaaacacuggcaaaccgaauccagcagcacaucaaaaagcuuauccaccaugaucaagugggcuucaucccugggaugcaaggcugguucaacauacccaaaucaauaaauguaauccagcauauaaacagaaccaaagacaaaaaccacaugauuaucucaauagaugcagaaaaggccuuugacaaaauucaacaacccuucaugcuaaaagcucucaauaaauuagguauugaugggauguacgucaaaaucauaagaguuaucuaugacaaacccacagccaauaucauacugaaugggcaaaaacuggaagcauucccuuugaaaacuggcacaagacagggaugcccucucucaccacuccuauucaaccuaguguuggaaguucuggccagggcaauuaggcaggagaaggaaauaaaggguauucaauuaggaaaagaggaagucaaauuguccuuguuugcagaugacaugauuguauaucuagaaaaccccauugucucagcccaaaaucuccuuaagcugauaagcaacuucagcaaagucucaggauacaaaaucaaugugcaaaaaucacaagcauucuuauacaccaauaacagacaaacagagagccaaaucaugaaugaacucccauucacaauugcuucaaggagaauaaaauaccuaggaauccaacuuacaagggacaugaaggaccucuucaaggagaacuacaaaccacugcucaaugaaauaaaagaggauacaaacaaauggaagaacauuccaugcucauggguuggaagaaucaauaucgugaaaauggccauacugcccaagguaauuuauagauucaaugccauccccaucaagcuaccaauggcuuucuucacagaauuggaaaaaacuacuuuaaaguucauauggaaccaaaaaagagcccgcaucaccaagucaaucuuaagccaaaagaacaaaggcggaggcaucacacuaccugacuucaaacuauacuacaaggcuacaguaaccaaaacagcaugguacugguaccaaaacagagauauagaucaauggaacagaacagagcccucagaaauaaugcugcaugucuacaacuaucugaucuuugacaaaccugagaaaaacaagcaauggggaaaggauucccuauuuaauaaauggugcugggaaaacuggcuagccauauguagaaagcugaaacuggaucccuuccuuacaccuuaaacaaaaauuaauucaagauggauuaaagacuuacauguuagaccuaaaagcauaaaaacccuagaagaaaaccuaggcaauaccauucaggacauaggcaugggcaaggacuucaugucuaaaacaccaaaagcaauggcaacaaaagccaaaauugacaaaugggaucucauuaaacuaaagaguuucugcacagcaaaagaaacuaccaucagagugaacaggcaaccuacaaaaugggagaaaauuuucgcaaccuacucaucugacaaagggcuaauaaccagaaucuacaaugaacucaaacaaauuuacaagaaaaaaacaaccccaucaaaaagugggcgaaggauaugaacagacacuucucaaaagaagauauuuaugcagccaaaaaacacaugaaacaaugcucaccaucacuggccaccagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacacgcacacguauguuuauugcagcacuauucacgauagcaaagacuuggaaccaacccaaauguccaacaacgauagacuggaguaagaaaauguggcacauauaccccauggaauacuaugcagccauaaaaaaugaugaguucauguccuuugcagggacauggaugaaacuggaaaucaucauucucagcaaacuauggcaaggacaaaaaaccaaacaccgcauguucucacucauaggugggaauugaacaaugagaacacauggacacaggaaggggaacaucacacuccgaggacuguugugggguggggggaggggggagggauagcauuaggagauauaccuaaugcuaaaugacgaguuaaugguugcaguacaccaacauggcccauguauacauauguaacaaaccugcacauugugcacauguacccuaaaacuuaaaguauaauaauaauaaaauaaaauaaaaaaaggaaaagcuggcuuuaucccaucacaaucauucauucguucauucagccacauuuguugaguccugacaugggccaagagucucucucugagcugguacuucuucaaagaucagcugccagcaaggguguccucggucuucugaaucauggcuuaaaaaaaaagaaaguuauuuaacuugauacuaauuccuuuuuuuuuuuuuuuuuuuuuuuuuuugaggcagagucucaccaggcuggagugcaguggugcaaucucggcucacugcaaccuccgccucccagguucuaucgauucuccugccucagccuccugaguagcugggauuacagggccgugucaccacgcccggcuaaucuuuuguguuuucaguagacaugggguuucaccauguuggccaggauggucucuuauaggacgcugaaacauccugcgucagucggggacuagaacugucauugcgccaaagagggggaccccugcucaugccccagggaggcuucgaaaugacugaacuugccaucccaggguccgacgcggccccuccaaaccacagugauggaaagagugugaggaccuguucugaagcagcuggcuccuuauccagaggaacagagcaagauaauagcuuagaaaaccaggaugaccguggugagaaucgaauauauuauggagucuauuugcuucuccaaaaaagacacuaaaacgugcauggaugugggugcacacacacacacagacauacacacacauacacaaacacauauacacacacauacacacacagacauacacacauauacacacauacacacagacauacacacacacacacacacacacacacagacgcccacccuccaugcacguugggaacccacaaccccuuuagugacacaacuagcaaguaucucccagcagagcgccccgugugggcccagaacgcccugcuuuuccacagcaucugcauuuugaaggcauuaaagcgccugcaagcuucagggcuccguauuuccagccccgcuacaugggcuguggggacgucaucaagugguccacacucaaggacucucaggucacgaguucuucaaccugagcugagauaaguacauucugaauucuguagccucuggucauaaauauucaccagggccuccucucccucuuugggugauggugucuccuuuuccuuuuuugcaaagaguuauuguuucuaugguuaucaaaucuuugaagauguugcugaaucaggaauuguggucuggccuguucaaacgcaaaagccaucagaugggcuccacgugucacucugcacccacgugggcuccugacgacaggcgggaggggcccuggccauucagaggcucgagccaggugacggugaggggugggacccucacccagcagcucagggggcagcucugccgcaggcccugggccccauguccaccaguuuuugggggcucaugcccacgucuuugguucuuucuuccccauucugucucuauuucccagguccaggcuguacuccagugaaaaaugcccaaucuaguccuuuuccaauucugccuuaaccuaaguuuacgcauuuacagcucacuuuaaaaucaacuguaacaaauccuuacugcuuuccuucaaggaggggagagcaacuggagaaaagccuccagccacauccuuugcucuuugaaacacaaaccuacuggcccccauucccuucgaagcugucugucuugaggcaguggcagaaagcaacagcugaggguacccggcuccuuccugcucaguaacucuccugaccuccuguucuuggccagguccaggccucagcccacccaucaacagggucccuugagcuugaaagacccugcaaugauuuguccgauuccaaaagaacuugggugucaccuugcugaggugcccaggagagaaaaaugaggugaggaguuggggguuucccucugagaacaaaaaaauuaauuuauuuugcauuugaaagcuaaaugaggggguccuagucucuuguccugugugagcugguggccuugggcagaauuagcuucucugagcccuuguuccucccuguggagacggcaaucccuccuaccccgugggcagcugggagggcucagcacagucaagugggaagucaaaccugggacaggugauagucacgaaaugccagccauggcccaggaagcccuugggagccugcaagugucaggugaguccucaugcuggacucugcccucaagggcggggcgugggucucauuucccacuggccaggcucucgaccagccuguagggcuaagggacugguaagcuuaguggcugguggccagaggggcaggauggaaggccuccccugcaggacagaagggccagcucugauggaggccaggggucuccggacaucuugggcugacagugggcucuccucccuccaagaagaaguauucggacaaucaggucgugcucuuucccaccaucccccucuugguccgcucugucucuccaucugggauugucuaguagaugacggaaguccagccugcaugcccugaguagguggacccaguuuucuucucagccucucagcagcucacugcugggaggucagagcccuugggcuccauguguagcuccuucucucaggcugccguggucacgaccuuggagagagggccacaggcagguacuuaaaggagcgccuagguguugucugcugagggccaggggaggcugggacaggaggaguguucuggagcagccucuggccucuguugcuuucauaugggcagggagguuggaacaccuggcuggcgcugagcagacaggcaccaagggguggcaaaggaaggugugugagugggagggggaaccgugggcccugcugccaaugagugccagacuuggggccucaguuuccccaccugccaauucagagagaugaacuagaugaucaccauuguccucucggcucugaugcuugcccagcaaggcgugcuauggaggcugaggacccaggccgccuggcgcccagggcuuacuguagauggcagugcccagaagcugauagccaugcaugcccaccuggcaccaucaccaaaaucgagagcagccugugaagcuguggcucagcagggagacuccagccagggcagaggugcugcccaggguggcuuccuccucccuacccugucccuacaucuccucugaggcucccacaaguggccaagcggcucaggacauagagacagcugaggucagcagaggccuggccaagacagcacaccuggcaggagcgaggcgaggcauggggaggaggggaggggcugcuccuaaugacugggaccccaccagccccgcugcucgcagaaggcucaggggcuccaccucuuacuccacagacacgcggagcagcuguucugugccaaguccuugcugagcacaaagaugcaaagcuaacgcagacaugcuuggucccuauucucaggagucucugucugccccgccaucgccaggcuugccgggggcccuggucuccgauuucccccugagccacuugcaaccacuucguucagaugacaccugacaugggccagaggaccaccaugagcucugucccugagaugccuccuggacggagcaggcgggacagagagcacccacgaccaggccucguggccggugccaggccugcuuccaaccuuucucccacucagggucuuuggccagcucucugcuugcauugguguuuguugagaacuucuggcuccucuaagaagcaaacaaguccucuccagugggcuugggagaaccuucguugaaugcaggguaggccaagguaaaaaugggauagaaugcaagauggcccuggcucccucccuuccugggggacuguccccaggcccccaaugcccugcgauggccuuggucaccuacauccaugccuggaccuuggccugggcaucaggcucccuucuaaaaccaagcagcaccucgugaacaugccuggcagagaccugcaggcuggcacgggcauccccagugcguuggacggagacgcgcugucucagugcaaaucaaagggcuuucauucuuaaagccagaggggccuagagaccaccuuugcagucaccccccaacacccacccauguccuuugcauuuggggguggggaggugaggccaacacagggaaccaacucccucaagguggcuccacucucuagggcagcucagcuccucccaacucaccauggguggccucuuccucagcccugagacuucagacuucagagugaggagugaggggccccacagagcagggcccuucccagacccuccagucacacacugcaugcaggugccugucuguggucccccaagacagccugugcccuccccgagccugggcugcaccaaaggcccuggcuuuaauagccucuguaucuuccccugcaguuacuaccccagcagccaugagccccccaagucaguucuuuuaguaaccuugccagucgacaggugcuucagggaggcuggguaggaaggagcauauuaucacuaaccuaugcauggggccgagcggcgauggcaccagaaccugcucagaagggccugcuuggccgccugccuucaaugaaucgagcaguguucagcagccgccugaugucucucgcacuaagugcaagguugcaugugccgccgggcugcgggcacuuaguuccaagcucuaccaaagcccaggagacaggugguugggggcugagacaugaaacugaugaggccucagaauguccccucucacaguuggaugugcgugucuuaggagugguuuaugcaaauaucacucagaaagaaaacuggcagaaacucaggugagguuuuuugaaaagccugaguaacucuacccauugucgggaggggggcugugggggcagcagugggccaccuggggagugacaggacacaaaugcuucuggguagagccgccgcccaggcccaggggccuuaggaaguaguccccuuuacacguaagcccugcuuguguauacauguaugcaucucucugugugcaugugugugcgugugugugcucgugugugucugcaugcauguguguguguguacauccgugugugcuugugugcaugugugugccugugcauguguguguacaccugcauggacaugugagcaauugaagauggugagaaaaggcaaagccauggauauuguugucaaaccaaagacacucuccgaguguccaguauaaaaagaauuuucaggcccuucccuaucccgauuguucaucuaagacguggaggacugcccugcauaguggcuucuggccucauguccuaccuuucaggaacacuuacuacugguuagcuguggugccaacugugcucugaaacagccucguccuuccuugucagagucuaggguuuggggcaccccuggugcuggauacuguaaaagcugguucaugcuucuugguccauaucauggcccccucucugccaugcccaggacauugcccacuuggcauagcccuucucauccucuggagccaaagcaaucuggagacuggacaagauuuacuuaucacaggaagugacaggcaccaggagcccaugcugcugcagaagcuccagcucugccauuguggggaccccuguuccucaccauuuaaccucuguccagaguguucugugagucucccacugcagugccggggcccgagcagggggugcagacgguagggcucacccucacaacagcaaaaucccccaaauccccaacagcagggcagcugcuucgagaacggugcccccuucugucccccaacagcuggggaggugcuguccucagccagcaccuaguuaguuacucuuucaacacugaggcaugcuugguccuccuccagggcacugcacugcuguugaccuaucaguguguggaagccucacauccacccggugugguguuauacccauuuacagaucaggaaacugaggccugguaaaaauaacucacauguucaagaucaaagcuuguugcaggccggguauggugacuuacaccuguaaucccagcacugugggaggccaaggugggcagaugacuugagccuaggaguucaagaucagccugggcaacauggugauccccugucucuaaaaaaaaauacaaaaauuagccaggcaugguggcacaugccuguaguaucaacuauucuggaggcugaagugggaggauugcuugagccugagaaguuaaggcugaagggagccaugaucgugcuacugcacuccagccugggugacagagugagacccuaucucaaaauaacaacaacagcaaacaaaccaaaaaaaaagaaaagaaaagcuuuuuuucuaaguguauauagugaaaucagagagagagaaguaccaaggaaguccuggaggaggugacacuaggccuucaagaugcgcuuuuaggcccaucuuguggcccccaagccugguccucuaccgggauaucugacuccauuauugaguuagaaaaugcagagacuccauggaggacgcauccuacuugccugcaggaagugagggaggagggaaggcccggggaccucuuagcccacagagaccagccuccaacagcauggcucaccucuuaccugcaaugaguaccaggcacaaucgguagcaaguuaaugucaccucuauuguaaugauauuuucacuucaccucaacuguauaagucauuguuauacuaaaaaaaacaaaaaacagaaaaaacaaacaaacaaaccccaaaaaacaaacaaaaaaagacccuuuuauuuucugcuagucaugaacuaaggaggcagcauacuccagauuccuuugacuacagaccugaaaguauuugucaauuuucuuguucugcagagacuuucucaaaauguguuguacauugucuuccagcugccccaaaggaaaggaggcuggcucuuccuuucccguaggcggcucuggugaggguggcuccaugucucagagcuuggcuuccuauaggaagcccucagcaggacuccuggggagccagggugaggggacggacgugggccugcagcucaagcugaggagaggguccccaaaacuccugggccagcaaauucuccagcaacgauacaacauagacagugucaccccacaacuccagagcucacauuucccaucagcucugugcguggcaacaggccacucuccucgggaagcccgcacaaaagguggucucugcccaaaggggcucaccuucucguggacacuugggggugaccaacaccagaggacaucagaagcccauuucaaaugcauauagaauuguacggaauaggguguuggguguuggaggaggcuuuuggagaggcucaguggccagagugaggucugaguagaaaaagcaaguacaaaggcaucuuccgggaguuggcgccaaccccagaaagagguucagaaacggguccagagcguggcgagcucguuggccaaugggccauggagggacaagaguguggguggugucgggaguggggaucucugagucaaaaacugugacaucggauggggcaguguccucccuuguaaaaugcagauaaaaccacccacccauauauuugugagaauaaaaugagaucacagauaucugcugcccagcccagcaccaagccacaaaagguguucaguaaacagcaucccuccccgcugcucuccaggagcacucuaggcagguaggaucccgcaggggucaggggcccggacucugccacugagaagccagagaccuuggggaagcuccuuugccucccugcacccauuuccucacuuguaaaaugacuaguccugguacgucccuugggggguugcggugaggauucacugaggaccucuggaagccucagcacagaagccagcaccuguuaucacucaacaacuucuucccaugccagaucaaccagguucuagauggucccaggugcagugcugacccugcagccauagggcugguggugguccucggcuucagagggaacaccacagacuacucaccuuugccgguagcaccaccaaagcaccaugcugcuccccauccccacacucagguugucccugugccucuuccccuucaccccuucacuaacaccugaccagcuccuacucauucuugaaagccuaguguuacaucuuccaggagguacuuuccgcucucugaucucgcuacauacacuuaaagagaucucucucacugggauuccccacagaguguuauuuauauguuuguaucugccucccucacuaggccaugagcugcuuggggauuaauaucauuuucuuucuuuuuuuugagauggaguuucauucuuguugcccaggcuggagugcagugguacgauccugguucaaccuccgccuccuggguucaagcgauucuccugucucagccucucgaguagcugggauuacaggcacccgucaucacgccuggcuaauuuuuuguauuuuuaguagagacgggguuuugccauguugggcaggcuggucucgaacuccugaccucagcugauccccccaccuaggccucccaaggugcugggauuauaggcgugagccaccgcgccugggugauuaauaucauuuucuauucaucuuagugucccaaagagcuagcacagugccuggcacauaaggcagaaucauuuguucauuuauucaaacaauauucucuaaucccuuacucuguaccagguaccauuuugugaaugaauggaugcgagucccgcgugccccauuccugcuguggaaaaggcuuugagaacacuucuuacucucagcagggacacugucugagaaagagacagacagaccaaaagaggguuaaugugauguauuuuagacuugacuuugcuuucaguuucaaaaguuagguccugugcagcccccaagucuccaccagcuucugcucaccacucuucuugccaaagccccugcucacuuuacucauguucacugucaaacccagacagaaggcccucccaagacaacugcaaaccacaaagaaaggaggggaaggaaaagcugcagacccugagcauagcguggcuuuacuuacuuauuuguuaagcccccaucacgacugcagcauauaaugggcccuaugacaggccacagaaaagaugcccuccucacguucauauuuuugggcgaugggacagauaucuaaccccaagcugggggacagugcugccuaucauggccucagggagauugacaggugcuggguaaugucaugcagcagaagaaggugaggagggaaggcucaagcuggaucucucagaugguuaaaauagaaaggugaggggagaaagagguacuuuuggguugggagaguaggcaaaacaagggaggaccaggggucuucugaggcugugugagaggguggaggaaagccgcuggagaccuacagagugugagcagcugucuccugacucaucccaccuuuaucucuuuuucccaacauguaauugacaauaacaccuggauuaggaaaaaacccacaaaacuaccaggucucaauuacgucaaacuauucaugucagagugcugacacccuugcugccuuagucacucaucuuuaacauuccugggagcaauaagagagcaagugguuuaauccuugcuuuagggagaggaaaacuacugcaagagaggcuggugacucacuccuuuaaggugacucagagucaggcauggggaucauaacauaguaaccuaguucccagggcugcuccugcugcuaaggaaacagccuagaggguggggagugggaagcauagagcuggauguggagccauaaagaccuaagcucaggucaauauacaacaaccaaaaauaaacugcauuuuuauauaacagcaauguaaaauuggaaaugaggaaaaaacaguaucauuuaugauagcaacaaaaaaguuaauaaugaaucaaacuaaauauguuuaagaucuggaugcugaaaacuagagagcacuaaugaaagaaaucaaaggagaccuaaauaaauggagaaacauaccauguugaugugaagacccaauaguuacguuaauucuccccaaacugaucuauagauucaaugcaguuccgauuaaauucccagaaggauuuuuuuuuuuagaagugaacaaacuaauucuaaauuuuauaugaaaaugcaaaggaagcagaauuuccaaagcaauuuuugaaaaagaaugaaguuggaagacauucuacgugauuucaagacuuaccauaauaauacaguaaucaagguaguauagaauuggcaaagggguaguuaucaaugaacuagucuagaaacagaaucacacauauaugaccaauugauuuucaacaaaagugcaaaggcaauucaauggaaaaaggacagucauuucaauaaaugguacugaaaauuuguauacccauacauuaaaaagaaaaacacuucuuaaucuauaccuugcaccguauacaaauguuaaugcaaagcagaucauagacauaauauaaaauuauaaaacuagaaaaaggauagaaaauguuugugaucuugaaugaggcaaagauugcuuagauaugacaccaaaaacacaauucauaaaugaacaaauugauccauuuuacuucaucaaaauuaagaacaccuauucuuugaaagacacaacauuaagggaauaaaaugagaauaagaugauaagcuauagacucaaagacaauauuugcaaaucacauaaugauaaaugacuuguaucuagaauauauaaagaacucuugaaauacucccucagcaugcaaacuagucuggugccccacuuccacaggagcagcacccaagugggguggaucagccacacaaacucuagcagccuaggccacugagguacucacaggcaucacugauauugauacagcaaaagaaacuucauagagauuacuacugugccuaccuggaaccaaagccaaugcacccuacccaacguauacucuaggacauaucugaagaugaaagucuuucccuaugaaagccacccuauaaaauugggagaggugaccauuccaccagauguacagcuaucuaugcaggaacacaacaaacaugaaaaaaaaacaacaaagaaauaugacaccaucagagaaacaauaccucuccacuaacugaccccaaagaaauagaaauuuacaaauugccuggaaaaagcucaauauaauuaucuuaagggaacucagugagguaaaagagaacauggguaaagaauucaaugaaaucaggaaaacaaaucaugaucugaaugagaaauucaacaaagagauagauguauauaaaaaaagaaccaaacaaagucuuacagcugaagaauucaaugaauaaaauuaaaaauguaauugagaacaucagcagcagacuagaucaaguagaaauaagaauuucuaaacuuaaagacaugucuuuugaaauaacccacaguacaaaagagaaaacagaaucaaaaagaguaaacaaagcuuauaggacuugugggacacaauuaagcugacaaauaucuucauuaugagguuuucagaggacuaacaguugguaaaaggcacagaaaucuuauuuaacaaaauaauaguugaaaauuguccaagucuugauagagauauggacaucuagauccaugaagcucaaaagaccucaaacagguucaacccaaagagguccucuccaaggaacauuauaauuaaacugucaaaagucagagacagagagaauuuuaaaaggugcaagauaaaagcaugaagucauuauaagaaaauccccauuaaacuaucagcagauuucucagcacaaaccuugcagaccaggagagaaugggauaauauauucaaagugcuggaagaaaaaaaaccugccagccuagaauauuaugcccaacaaaacuaucuuucagaaaugaaggagaaauagucugucccagacaagcaaagcugaggguauucaucaccacuagaccaaccucacaagaaauacuuaagggaguacuucaaccagaaguaaaggaacaauaauuacuauugugaaacauaugaaagcauaaucucacgggugcagauaaauuuguuaucaaauucagaauacuauauuacuguaaugaugauacauacuuuuucaaaccucuaguaugaaggugccuuaguccauuuuuguguugcuauaaaggaauaccugaggcuggguagcuuauaaagaaaagagguuuauuuagcucaugguucuacaggcuguauuagaagcauggcaucaccaucugcuucuggugagggcuacaggcugcuuccacucauggcaggaaggaaaauggaagcaggaaugugcaaagaucacuuggugauaaauaaaugcaagagagagagcaaaggugccaggcuauuuuaaacaaugagcucuugggggaacucucacagaaacuaacagagcaagaacgcauucauuaccaugagaacagaaccaaaccuuucaugaaggauccacccccaugauacaaacaccucccauuagguccuacuuccaacauuggggaucaaauuucagcaugagguuugagggacaaacauauccaaacuacagcagaagguuaaaagucaaaaugaucaacaauaacuaugcuaaaauaaguugcuaaggaacacaaaauauaaaaagauauaaauuaagcaacaaaauuaaaaaugggggagugguuaggguaaaagucuggaauauuuaaauguagccaaagauaaguuauuaucaacuuaaaauaguauacuauaacucuaagauuguuaauguaaaccccguaguaacuacaaaggaaaaaacuauagcagauacacaaaugaaaaagagaaaggaaucaaagcuuacuauuauagaaaaucaccaaaccucaaagguaaacaauaagagagaaagaaaggaacacaggauguacaaaagagccaaaaaacacuuaaaaauggcaggaguaaguccuuaccuaucaauaauaaauugauagauuuauuccaccaacuuauggaauaaauucaauguaaauggauuaaguuucccagguaaaagauacagaguggcugaauggauaagaaaacacaacuugacuaugugcugccuacaagagauucaguucaccuguaaggacacuaauaaacugaaaguaaagggauggaaaaugauauuccaugcagauggaaaaugauauuccaugcaaauggaaaauaaaagagugcaggaguagccauacuuauaucagauaaaacagacuuuaaaucaaaagcuguaaaaagagaaaaagacacucgcuauauaauaauaaaguggucaauucaucacaggauauaauguuuauaaauacacaugcacccaacauuggggcacccagauauauuaagcaaauauauauauauauauauauauauauauauauauauauauauauagagagagagagagagagagagagagagagagagagagagcaauauuauuauaucuaacuucugaaggaagagauagauugcaauacaauaauaguaggagacuccaauauccagccccacauucagcaaugaacagaucauccagacugaaaaucaacauagaaacauuauauuuaaacuaaacucuagaucaaauggaccuaaaaaacauuuacagaacauuuuauccagcagcugcagaauauacauucuucucuacagcacauggcacuuucuccaagauaggccauauguuacuuaggucacaaaacaagucucaaaaaguuuuuuuaaauaaaaauaauaucauguaucuuuucugaucauaauggaauaaaacuaaaaaucaauaacaggagaaacuuuggaagccauaugaauacaugaaaauuaaacaacacgcccaugaauuaccaauggaucaaugacaaaauucuugggacaaauuaaaaauggaaacauaacauaccacaaccuauggaauacaaguucuaagagagaaguuuauagcaauaaaugccuauaucaaaaaaguagaaagaucucaaauaaaaaaauuuaacauugcacuucagggaacuagaaaaacaagaacaagcuaaacccagaauuaguagauagcaauaaaaaauagagaugagagcaggaauaaacaaaauagagaccaaaacccaauacaauauaucaacaaaauaaagguugguuuucuuuguuuuguugauauauugauacaaaaaaaucaacaaacuguucucuagacuaccuaaggaacaaagagagaaaacucaaauuuaaaaaaaaucagagaugaaaaggcaacauuauaggugauaccacagaaauacaaaggaucauaagagacuauuaugaacaacuauauggcaacaaauuggaaaacuuagaggaaauggaaaaauuucugaacacauacaaccuaauaaaauugaauuaugaagaaauagaaaauuggaacaaaugaauaaugaguaaugaguuaaauuaauaauaaaaucuccuaucaaagaaaaguccaggaccugaugacuucauugcugaguucuaccaaauauuuaaauaacuauuaccaauguuuuccaaacgauuccaaaaaauuaagagggaauucuuccaaacucauucugugaggcuggcauuacccugauaccaaaaccagaaaagaacacacucacacagaaaagaaaacugcaggccaaucuacaugaugaaaacagaugcaaaaguccucaacaaaauacuagcaaacugaauucaacaguacauuaaagagaucauuaaccaugaucaagugguacucaucccagggaugcaaggaugguucaacauaugcaagucaauaagcaugauacaucacauuaacauaaucaaggacaaaaacuauauaaucacuucaguagacacagaaaaagcauuugauaaaauuugacaucccuucaucauacaacucuuuaaaaaucagauauacaggaaauguaccucaacacaauaaaggucauauaugacaaacacacagcuaacaucauauugaacuggaaaaaauuaaaugcuuuucuucuaagaucuggaauaagacaaugaugcccucuuuuaccacuuuuauucaaaacaguacuggaaguuuuagcuagugcaauuaggcaagagaaagaaauaaagggcaaccaaguuggaaaauacaaacucacauuguuccugucuuagucuauuuguauugcuauaaaggaauaccugaggcuagguaacuuguaaagaaaagagauuuauuuagcucauggcucuacaggcuguacaaaaagcuuagugucagcaucugcaucuagugagggccucaagcuuuuuccacucaugguggaagaggaaagagagccagugugugcagagaucacuugaugagagaggaggcaagagagaggugugagggaaugugccaggcucuuuugaacaagcuaucgugggaacuaauagaacacgaauucccucauuacugcgaggaugacaccaagucauucaugagggaucugccugcaugacccaaacaccucccauuaggucccaucuccaacaguggauaucaaauuucaauaugagcuuuggaggggucaaauauccaaaccauaacaucccuguuugcagaugacaugaucuuauauaaagaaaacccuaaagacuccaccaaaaaagacccauuagaacuaauaaaugaauucaguaaaguuguaggaaauaaaaaucaggagguuuuuuuauaugccaauagugaauuaucugaaaaagaaaucaagaaacaaccccauuuaccauagcuaccaaaaaacuaagguaccuaguaauaaauuuaagcaaagaggucacagaguucuacaaugaaaacuauaaaaaaauugauauaagaaauggaagaggacacaaauaaaugaaaagauaucccauauucauggauuggaagaauugauauuguuaaaauguucacauuacccaaaucaaucuauagguuugaugcaaccuguaucaaaauaccaauaacauuguucauagaaacagauaaaacaaucaggaaauucauauggaaccauaaaagacucugaauagugaaaucaauuuugaguaaaaugaauaaagccagaggguccaucacauuaccuaccuucaaaauauacaacaaagcuauaauaaucaaaacagcauggcaccaccauaaacacagacauauagacgaauggaacagaauagagaacacagaaauaaaucuguguacuuacagggaaccaauuuucaacaaaggcaacaauaauacacacuggggaaagggcagucuuuucaguaaguuuugcugggaaaacuggacaucuacaugcauaacaaugaaauuagagccuaucucucaccauacaaaaaaacaaaauggauuaaauauucuuauauguaagaacugaaacaauaaaacuacuagaagaggccaggugcgguggcucacgccuguaaucccagcacuuugggaggcugaggcggguggaucacccgaggucaggaguuugagaccagccuggacaacauggugaaaccccuucucuaccaaaaacacaaaaguuaaccaggcgugguggcggacaccuguaguccuggcuacuugggacgcugaggcagaagaauagcuugaacccaggaggcagagguugcagugagcugagauugcaccacugcauugcagccuggucaagaagagcgaaacuccaucucagaaaacaaaaaaaaaagaaaaaaaaagaaacaccacacacacagacacacacacagacacacacacacacacacacacacacacacaacuacaagaaaauauaggggaaaugcuucaugauauuggucuggguaaggauuuuuuaaaaauaauaccucaaaagcauaggcaacaaaaggaacaauagacaaaugggauuacaucaaauuuaaaaagcuucugcacagcaaaggaaacaauaaacagagugaaaagacaagcugcagaauaggagaaaauauuugcaaacuguguaucugacaagggcuuaauauccagaauguauaaggaacucaaauaacucaguagcaagaaaacaaauaaucugauuaaaaagugggcaaaaaaccugaauagacauuucucaaaagacagcauacaaauggucaacaaguacauuuuaaaaaugcucaacaucacuaaucaucagggaaaugcaagucaaaaccacaaugagauaucaccuuaccccaauuagaauggcuaaucaaagaggcaaaaaauaacaaaagcuggcauaaauguggagaaagggggaaucucauacacuuuugguaggaauguaaauuaguacagccauuauggaaaacauuuuggaaguuccucaaaaaauuaaaaauagaacuaccauaugauucagcaauccuacuacugaauauauacauccaaagcaaacgaaaucauuauaucugcacucccauguuuauugcagcacuauucacaauagccaagacauagaaucaaccuaaguguucaucagcagaugaauguauaaagaaaaugugguacauauacacaauggaauacucuucagucauaaaaaagaaugaaauccugccauuuguagcaacauggaugaaccuaccuagaggacauuuuguuaagugaaauaagccuggcacagaaagacaaacacugcaugaucucauccauauguggaaucuuaagaaguugaucucauagacguagagaguagaauagugguuaccagaaccuggagagggaggaugaagagggguugguuaaugaguauaaaaauacaguuagauaaaaggaauaauuucuaguguuugauagcauacuagggagacuaugguuaacaauauuguauucuauauuucgaaauagcuaaaagagaggauuuuaaauguuuucaccucaaagaaaugguauaugugugaggugcuaaauaugcuaaauacugugauuugaucauuacacaauguauacaugugucaaaacauugcacuguaucccauaaacauguacaauuauccugugucaauuaaaugugaaagccaaaaaaagaaaagaaaaaacaaacaaggcugggacaggaggaucacuuuagcccaggaguuggagaccagccugggcaacauagggagacccuaucucuacaaaaaaaagaaaaaauaaauaaaaaauuagcugggugugguggugcaugccuguggucucagcuacucgaaaggcugagacuagaggauugcuugagcccaggaggucaaggcugcagugagcugguggucacaccacugcacuccagccuggguaacagaguaggacccugccucaaaaacaaaacaaaacaaaaaugaaaaacagaccacagaaauuuggacaccccacuaaaguaaacauacagauggcauauaagcaaguacaugaaaaaacaucagucauuagggaaauggaaaccaaaaucuugaugaaauacuauguaccuauuagaauagcuuuaaaaacaacaauacuaaaugcuggcaaggauguggagcaacuaaaacuuuuuuuuuuuuuuuaagagauauaguaucacucugucauccaggcuggaacgcaguggcgcgaucauagcucacugcagccucgaacuccugaccucaaaugauccucucgccucagcuucccaaguagcugggacuacaggugugcacuaaccaccacacucagcuuauagauugauugauugauugauugauugaucgagacagagucucugucguccaggcuggagcucaguggcgugaucucggcucacugcaaucucugccuuccggguucaagcaauucucaugccucagccucccaaguagcugggacuacaggugccugccaccacacccggcuaauuuuuuauauuuuuaguagagacggguuuugccauguugcccaggcuggucucgaacuccugagcucaggcaauccacccaccuuggccucccaaaaugcuaggauuacagcaugagcuauugcgcccaccuccagcuaauuaaaaaaaaauuguaaagaugggggucuuggccgggugccguggcucaugccuguaaucccagcacuuugggaggccaaggcagguggaucaccugagguugggaguucgggaccagccugaccaacauggagaaacccggacucuacuaaaaauacaaaaucagcugggugugguggcacaugccuguaaucccagcuacuccugaggcugaggcaggagaaucacuugaaccugggagguggagguugcggugagcugagauugcaccauugcguuccagccuggguaacaagagcaaaacugacucaaaaaaaaaaaaaaaagaugggggucucaccauguugagguuuggagggucucaaacuccuggccucaagcaauccucucaccuuggccucccaaaguguuggaauuacaggcaugagccacagugcccagccaacuaaaacucuuauauauuccugaugggaaugcaaaguaguagucucuuuggaacacaguuggguaguuucucauuaaguuaaacagauuuacuauacgaccuggcaaucuuaccucuauauauuuucccaagagaaauaaaaauguaugaugacaccaaaaccuguaugcaaauguguagaguccuuggcauguaaugucaacuggaaacagcccagacauccuucaauaggugaaugguuaaacaaauugcuguauauccacaccauggaacaccacucacccauaaaaaggaaggaaguacugauacaugcaacuacauggauaaaucucaggaucauuaugucuggcgaaagaagccagacucaaaaggccacauccuguaugauuucauuuauaugacauucuggaaaaggcaaugcuauagggacugaaaacaggccauucauucccagaggcuggaguacgccgagcagcuuaucugacaaagaggugcagugaguuuuugagcugauagaaaccaucuccauauugauugugguggugaucacuggaccaagcugauggaaaccacauacauuugccaaagcucucagaauggccacagaaagucggaauuuuuaccauauguuaauuguaucuccagaagugcgggacaccaagcgccccuuagccauaugaccugggccaaaugauuuaauccgucugagcagcagcuuccuaaucuauaaaaaggggaugacaauaaaacccacagacuuugaaggaucagcugaagauguacacacacacacacacacacacacacacacuguguaaagggaugcauaaaacauccagauacagccgggugugguagcucaugccuguaaucccagcacuuugggaggccgaggugggcagaucaccugaggucaggaguuggagaccagccugaccaacauggagaaaccccaucucuacuaaaaauacaaaauuagcccagcaugguggcacaugccuguaaucccggcuacucgggaggcugaggcaggagaaucacuugaaccugggagguggggguugcggugagccgagaucgcgucacugcacuccagcccgggcaacaagagcaaaacuccauaaaaaaaaaaacaacaacccagauucucggagcacuaaaaccuguccccagucccaggaaccagcuggaugcaccacucagccacuccaacggaggcgaggccuccuucucaugaaaguguagaaauggccaucuugagagaaauggcuaaacaaguccagcccccagugcuugguguggagucacgucacccuggcacaccuggcgggcggugcagagcacaggcucucaauggcagccagugagggcaccagggcugcaagccccguaggaaugcaugugggggagaggugcucuuuuucuuugcagaguggagcagauucauuuacacccaugaggcuuucuuugguacugagugcuuucuguaggguggggucccuuccaggaacuuuucacagccugggugucugaacagcaacccuacugccacaggcacuacuagcgacccuguuguagacaggaggaaacugaggcccagagagcagaacucacuugcaggggcucaggaguaguaagcagcagggccaauccugggccgugcacugguacuggcguuggcagugggaucugcgggcuccuuuggggacaugucagacaaguaauggcauccaucacaaggguccagauagagcucugaggggaggcuggucugaggcccagggccaaggcacccaccuggaaugagccugaggacagcaggucccugagcugugucagaugcuuagagaaggcaggcacccugggcggguugugucacccucuugcucuggcccugugaacccuaagcucgcuuugcuuaagagagggaggcuuggcagcuccuagaggcccaggcccuggcugaauuucuccaggguccucagaggguggggaagugacugggcagaagugggaaggaaccagcccugcgccgucgcccgggcucuuggcuccugcacccagagccguccggcagggaagcggcagguaaagaugaaucagugauucagggcugcaggccaggcaccaggccaggcuguaaaaguuauugugcagcaucacaauggaaggcgggggacacaaauagcauccgagggaaacuaguggcccugacuuggaaagcaaaccucucugcagccacgggacccccaacagcagccucacagagccugccccggccacccuagucugggcuaacuguccugccuucuccuccaagauucccuugccugggucccuccucccucggccucaccacacuccucuggggacccugugcuuggacuccacccuuuccuguccagaccacugugaaggccuuuagucaccuccuagagaagcaagauuuucagcccuggcuuucuacccccacacccuacaguaaguaagauaaauuacccacccaccaccugcccccacuucucuccacggagccucguucggccuguggccacucaugucuguuucuaagggaacagucaagggcaaaucaguggagaagcuggccugugcuggcaggggugcugcaauggggcugugccccugccuuccugcacuuccugccagggagccacuccauucuuuuuugccaucucccaggccggccaggggacagggucguguucacacagugcuaagggaacacgcugacgugugugacaucaagaacuccagugcccacacagcccgaguccggauggugagcuccagggagacccagcagggcugcagggggagcacugacugagcccaugggggaaagaggcuccugccgagcccagagcccagagagcuggccaagggguaggguuaggagggauggagcugggggcaacaggcuagagaagagacagcugggggugggaggaucucuccagggucgucucacagcacccagcggacucgcucugugcugcugcagagugacucugacagucagagccaggcagccggggacaggcacagagccagacucccuuccuccucccccucccucucgccgugcagugccuacucagugcugggaggcucugaauggcacggggauggagaguguaacaacagagcguuagggcccugccccaguccggcaggaagcucggucugguggggagaccagcccaggcagacacagcagugcaugcacugggcacacccuggcucuggcuggagggcucagaggccucagggccuuccagcacuggucuccgugucugaaccccccaugggacaggaugggagcugccagcagaaccaacaacucaguuccugguaacuccaaguggagaugggcaggaacgcucccaggaggcgcaucagcagucagaaccaggggcuugggccucaggaaggcaggcugcuggccaggcccccuggacucaggagaccaaggccaggacguucaccagggccaaagagagcaacaccaacagggcugggcuccaaggccgggccgccuccccucuagcuucccaacaccaguccucccugaacauuuccuuccaggaagacaggggcuauuaacuacgucccauccgauucacagggacguuugaaaucaggaaggaguguggguuggauccacguuucuguucauaccaggcaggcacaucggaaggcucacggucagaggaugcugggacaaacgccacgagagguuccuuuuugucuggcucacccagaagagaggcuccucuccucccuucccugcagcacaacggccuggcuggcacccaaagggcagccggcaugggcugaccucagaggagcaaggcguguuugcagcucugccgcucacauccacaguggccaugacaacaggugcagcaccauccauuaaagcccugugucauuucacuuaauucucacaacgacccccggagaaagggacuacuauccccauuuuccagaugaaaaaggaaauugguccuuagagugaucauccacccaaggcuagugacagggcucagauuggaacccaaggcccuccaagaucucaagucacagacaaagaaagcccaucucugacuuggcaggggaagggggaggucacacugggagagcuggauguugauucugaaggccucccccaguaaaccgcuccaacaacaaaaaggggcuuucuguacauuaucugcgaaaagccaagugagggggagggaggggaaagcaaucaaagcaaagaucaauuguguugcagacaauguggcaagaagacagaucuugcuggaaauuccuucugacuggacucugccaggaucagaguauuuuucauuccaagauuaagcaaaauucuuucccugucauaaccuccuacccaucuguguccaaacucccacuaucauuuuuacaccgugcacauuuuaaaaccuguuuugcagcuuuuucucuguguguguuaguugacgcuaaccugccuccagcuuuaagaaaagcagagaagcacgagaggccccaggaggcaccugggcugggugagccucaggcugggacccuggcaggacaguggcuggggucuagggcagcugggacccugcuugcuggcaggggcagcugcagccgugaagcucagagaccccacggccuggccuggacagaaauggaaaacagaugggagaagagaaugggaauuucuuaauaagggauuggauuugggaagugaagggcgagcagaaacuaggauugugaggucuccugguugggguggcugugugguggugccaugucggugggagagagaagccagucacugggugguggaaaugguggugaagagguguuugguggaugggaggaagcaggguaggguccaagccuguucaaugagaggggucaacagcauacacaagggaaggagcccagucuggaguaauggauuugugggagagaagucucccguuggaggggggagacugaagccaugggaaugggugaguuccacccagagacagacccaggaagagagcccaggaagagaaggaagccaagggcaggguuccaggggcugcugacuuucagggcaagccagcaaagaagauugggaaccaaacaguuaggaacauaagagggaccggagauguagcaucauggaaaccauggcaacaagagcaggcagcagcacugaacgucaccagcggagacugccgugagauggaaccaaaguccuugacuuggcaacagggacuucucagaacaguuucaguggccuguauggguguuaggaggggaggaaggagccaagugacccgggaaaguauuuuuuaugcauuuuccuacugacuucuuagccuugggaaacaggagcuguugccacuuguguuuuaccaaggaggagguggaggcugguggggaucaaguaacuugcagcaggucacgugcugggaagggagggcugggccuccaaccccaucugcccaucgucaaggugcacggccuucuuaggaggaagggaggcaucgcugcguaggaggaggccuuggcagauguuaguuggagagagaaggccaagaacauccaccguggggugggagaugagaugcuccaccgagcaggcugagggcccagccauggcuggaaacccagccccuuggcaagguugacacugccauugucccaccauccuuggcagggaugacugaguggcuacagccucccagagggcccaagucuuccggacacugcaucucucucucgcuguacagcucagcugggugacggcggcugcucaugaugagucagggcaucacggggacucugcacaagaugcuaaccgagcucugccucuugggccugcgaagcugacuacgaaccaugucuuuagcacaaauguggccaguucaguacaaacuugucccagaugaaaagacgggcucaaaacgcaaccuuucugacaacagauggccuuccagcgggcuggggcugugcgcaugugucucugccugacaauggucccugugaagccagacuuccuuuggggggccaaugccuuucauucucugggggagcggaggagccuggaggagccagggugggcuucugcagcacccuuagcaugggggaggcacacgcaacacccaggugcccagaggcccucacagcccagaaggagcgagugagugaggcuccugcauguggaacgaagcucagcaccgcacuggacacaaccaaauggccagugagggccucggauuucaaucagaccgucagaggcgcccagugcugggaggccaaauguggaagagaguggcuagcaguggguggugagagcugagcuuugggagaaagugcuggggagcgggcaccccagaaucacuuuggaaagcagggagcaucgugcuggguggagcacgcuguagagaugucuccaacaggccucggggcuggccuggccucugcagccucauuuuuuccugguguuugcugcucuccaggcagcacucuuccccccggggcucucccugugagugaggaguggccucuaagggcccuucccuggccugucuggcucccaucacuucaaacacuggcccgcgagcccaguacuugcacauuuggaaauguaagugcccagaauaaaccugcagagacgcuauucaaacagcaaggccgaaaucaacagauucaacuugaaacguaaaacgccaaaagcaaaugucuaagcagcuguauuuguucuggaaauauugcugcagugguuugaccggcaaaaucaaguguccuguuaauagugaacaggcuccuggcuaacacggugaaaccuugucucuacuaaaaauacaaaaacuuagccgggagugguggcaugugccuguagucccugcuacucaggaggcugaggcaggagaauaguuugaaccugggaggcggagguugcagugagccgagaucacgccacugcacucuagccugggugacagagcgagacucugucucaaaaaaaaaaaaaaauagugaacaggcaagcaggaugggcagggggcauaggagggcuguucugcugaagcugggugguccaacuuccagcuggugcaguacugccuccugcagagauguccuauccugggagcucacacaggaaaggagaggcugugaguccugggcccauccccacgcucgccuggcugaaccaucccugggcaguggcgcugacggguacagggaggcagaggcuucaguggcccaagagguaguuggacauguccccggagucuuuccacuccuugccaacccaggguccuugccaggaacucaucuccaaagccgcagcucugccccuccuaauuagcaaccacacgcacacccaguuacaugcugaagugauuuacagaauuuuauggucugugauuuagcacaccuagacuugacuaucucuauucuaauuaaauuaacaaaaaauuaagagugacaaaauggcaaagauugauuuaucuaauguguguccuugcugcuuugauagguacaaauuucuuuuaauuuugaauaacaaaaagggaaauaucaagcauuugaucuacuuguucgccaaaaaauuagccacggauucacaaaaggcccuccaaggcccacacaucgacucauaucaaucaucacacacaguauagggcccacagggcaguggacaugaagaagcuacccaggcacucaggauuagcauccaggugaggucugcagccuuagggggcccuggccagcuugcuccccuuuccugcaccaggccagcugccccggaaaguuggacuggaaccaagccacugagccaccgugaagcugcggccacuuucaaaccucuggcagaagcaguaaguacaaauugugcugcagguggugcuuucagaauggagccaacagccaucuuucgcuccauucccccuuuucccacaucccuggcacagaagccuucccaugguauuuccugcaagagaagccacagcuuuccccugccaccuuuucuuucccaggguggaucuagcacugggaguuggagcagggcguggcagcccagucccguccuguguuucagugggaagggaguuccaugcccuucuuugcuccauuacauguauggggcucuguggucaccuuuggacuuugcucccacuauacuggaaaaaugggggcagauucucuguucuucucugcauacccgcaccgagggugucauuggcacaugguggggacucaagaauccuccacgaucaucauccucaucacccucauccuccuuaucaaaauuaucaucaucuccaucauccucauccuccuccucaucaucauucuuaucaucuucaacaacaucagcagcaccagcaccaccaccaccaucaccaucaucuuguucgacagcaucgacaguagcagcagcaccaccaccaugaccaugaucaccaccaucaccucacccccaucauccugagcuagcacuuacauggagcucacucugugcccuauguuguucuaagugccuuauauguuguaaugcauuuuaaugcucucaacaacccuaugaaguagauauccuacgcccauuuuuacagaugagaagacugaggcacacagaaguuaaccuaacuuguccaagguuaguuacugggcagacaggaccaggguuuuaaccgguuugaaucuaacuggcaccggagucuguauuccagauugcuauacuacacacguuagaugagugagaaggaguaaaugaauaauuaggcgucugaguaagugcacagagaaauguucagugggugucaaggagccuuagggaauauaaaaugcuuuucucacuauuuauauuuggcaacaauguccguccuggcccuccuucuuccuuuucugcggcaaaggucuuaguguguugauggcguaggaagcccugcaggguuacgacccacacucuccauguggucucaguguacaauuuccaggcaagcaugcccuugauuuuuaugaucaugugauuaucuuacuucuucccacauagaacgcuaagcuccacacaagcauggagauggucugguuuuguucaucauuauauucccaguguuuagcacagugccuggcacauacuaguugcucaguaaauagauacugguuguauaaauaaaugaacucauuggcaaaaggaaagcauuuucucaaaauuuccuagacucaaccuuugaggcuauaggaauaucuaucuaucuaucuaucuaucuaucuaucuaucuaucuaucaucuaggaagcaaguaucuaucuaggcuaagaaaucacugcaacaaagaggcaugugcuuaauguuuuaugucaaauauuguuguccuuuuauucuuuugccugcaggagggcucaucaauguauggagaaaugaaagagcgccgcauuucacauuggagggaucuggguuugaguccuugggccagccuugcuacagugggggcaagaacaccaaucacacuggcuuauuacggaauucaaauguggcagaguauuuaaacuaugaaguguagaauaaauuaauuggcuugcaauuccccauagcuaguacuagaggcuggccucagauggaagaaccaggggcugugccuguccuggggaaugauggcaacgccuuccauccuucuggcccauguuuacaucugguacuacgcuaagcaucacagagcaauuagcgcacauccucuccaaguaccagauuuaccugauuucauagauaaggaaaugauauccagaagacauaucccaauucacccaaggaaaacaacuaacuuugcaucuaacucuauggcagagauagcuaucuguuucccuuugcccagcuuucucuuccuuaaguauuagaauccccaaauuuagcugggcauguggacacucagagugaagccuacauuuccuacccuccucuguaguuagaugugacugcaauugcauucuggccaguaggauacaggcaaaagcguuguucucuccuuuccugcuggcuggaaugcaggcacuauggcuugaacucaagcagcuauuuugugccaugaggugaaggcuaucuauugaggacagugguacugcauuauuggaggcugggacucuaaugagcaaccaguugcccagccaguucucaacccucuaaccaaucguuucccagguagaaaaaucaccaucacuggccaucagagaaaugcaaaucaaaaccacaaugagauaccaucucacaccaguuagaauggcgaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacauguguuuauugcggcacuauucacaauagcaaagacuuggaaccaacccaaauguccaacaaugauagacuggauuaagaaaauguggcacauauaccccauggaauacuaugcagccauaaaaaaugaugaguucauguccuuuguagggacauggaugaaauuggaaaucaucauucucaguaaacuauugcaagaacaaaaaaccgaacaccgcauauucucacucauaggugggaauugaacaaugagaacacauggacacaggaaggggaacaucacacucuggggacuguugugggguugggggaggggggagggauagcauugggagauauaccuaaugcuagaugacgaguuagugggugcagcacaccagcauggcacauguauacguauguaacuaaccugcacaaugugcacauguacccuaaaacuuaaaguauaauaauaaauaaauaaauaaaaaauaaaaaaaagaaaaaucaaaccgucuuauuuaagucaccgcuauuaugauguuuucggucacuugcagcugaaccuaucuuaauacagccugucugacuccagagcacauuuuccuaaccacuuucuuuagaaagcagcuuaucuuugccauccuugcaugaccuuagggcauuaugauaaaacccuuggcacagagucuggcucagagugagugcucaauaaauuccaacuagccacugcucucauugucccguggccacugcugcugcuguucacaagcaugugccacccugacagcuuugcuuagcaauccagaaugaucagaucagcuggguggaccaggcaagguaguuuucauagagcccaaagugccuaacccugccuggcaucagaagggaggacuguuuguuaucuuggcuccagaaagacucuucaaacuauuucuaccaauacuguauuuaugccacauucuuacuaagaccugauggaacuaggcccuaaagaggaagaguggccagaaguggugaaaucugauccaacugggcaaccuucuuuucuuuucuuuuuuuugagacagaguuucgcucuuguugcccaggcuggagugcaacagcaugaucucggcucacugcaaccgccauguccuggguucaagcaguucuccugccucagccuccagaguagcugggauuacaggcaugcgcuaccacgccuggcuaauuuuguauuuuuaguagagacgggguuucuccauguuggucaggcuggucucaaacucccgaccacaggugauucaccugccucagccucccaaagugcuggaauuagaggcgugagccaccggacccggacuuaacugggcaaccuuccuugggauaccagaggagagggacgugccgggcaaauggacagucacuuucugagccuacaggaaaacuaaccccaugggcuccugggaaauccucuuugaagagccagauuugcauauaaauaauagguauguuaaaacauaugaugucuggauuugguauucauccuaagaguugaaugcacaauuuguaauaauuuccucaaauucuagcaauguuccugcagacccugucuucagcacuggcauugggcaauuaauuaaauugccauuauccuccacaaagugaugacuacugauuaagaacagcccuuuuucuccaccgcucacuuggcaguccuguuucugccuggccgcagccucaagucucugcuccauggcgcaaggcagacgcacgcagacaggcuuugucgguucgcugauguguguuguuuggaaaaugagaacacaaggaaagcuguccuuaggaggaagaggcaaggagaggcaucgggaggccaagagaucaaagcgaggugucagaaacaaagacagugaaggaguucaguccccuuuuaaugcugccugccaguucagacggccacugcccuugccuucuagggaauucugcugguuaagaagcucagacaagccccagaaugccccgaugaggacgcaacaggaagacaauccauagacagagaaagugcuuuguuuuacgguuuccugggcacugacaccagcagccuuuucugccagcgguuugaaauacgagacgcugguguuuuuucccggcucccugaauuuaaauuacaucaccaaagaagaaacuucccgaaggaaaugaaucucugcagauaacgaucccucacaauggauucaaauuguaauaaaaauauaacuugaauguuaaaggugaauuucaauuaaggauuccaucacauauuuugcuccagaccacaauaaaaaaacuuauuucacugccaacagcaagucuccugcgacaucucuuugaaaaucaacuauuuuugaaagcuaaguuagaaaaacacaugugcucuaggguauaaagaaagcagcauuguguauaaauuguaauacugagagguagaucuuaguauauugacauuauaaaaacuggguagcaaugggaaauaauauuuuuacaaaggugccaaacauaaaugccagaccugcaggcaaauuuauagacucugucaugcaugguggcauuucaccaucaggugcucaagaaagccagggaggagggugccugcaggugccacccugaggcgcacaggccacugucaggccacccaggcaagucagagacagaguggggauggggauggggugccucgaggagccggugcaagauaugagcuaaggaaaagcuggaauaaagucccucccaggaagcccuggccccuggguccccacuuuaaaugcaccugcugggcccacaggccucaucccccaccagccccauaguuuagugcggccucugacucggucuccgauuuuuuuuuaauugaaguaaaauucacauaucauaaaauucaccauuuuaaaguguacaggucaguggauguuaggauguucucagcuguguaaccaucaccacugucuaguucuaaaacauuucaucacccugaaaggaaaccccauucuccugaagcagccccuccccacuccucccugcccccggccccaggcaaccacccacccgcuuucugugucuguggauuugccuggacguucacauaaaugaaacacaccaugugcggccugcugcgacugacuucuuucacucagcaauacguccucagguucauccuggugguagcguggguucauacuucauuccuguuuaugggugaauauuauuccaucguauggauagagcacauuuuguuuauuccucuguggagggacuuuuggguugcuucuugcuuuuggcuacucugauuauguaacacggcuuccucucucucucugaagcuaggaucucucuggcagagcacacaguuaguuacauacaaggccgucaggcuucuuuggcugaauggcuacaggaauagcaggugcuacagugcauagaucaacugcccuccagcacuuauguaaagcucacuacaauugggagaauuuccucuaacaccaucucccaggacagacucagaugugucugagugagggguuugcgaacuuguucuguaaaaggccuuuucuguacaucuuuuuggcuuucuaggcaauacugucucuauggcgccuucuugauuccgccauagucuuggaaaagccacacaauauguaaacaaaugugcauggagggguuccaauaaaacuuuauuuuuuuaauuauuauuuuuuugagacaggcucucacucugucacccagacuggagugcagugguacagucucagcucauugcaaccucugccucccggguucaagcgauucccuugccucagccuccccuguagcugggauuacaggugcacaccacuaucacucggcuaauuuuugcauuuuuaguagagacaggguuucaccauguuggccaggcuggucucgaacuccugaccucaaaugaucaccugccucggccuccucaaaaaccuuuauuuuuaaaagcagaugguggacuggauuugguucaugggccauaguuugucaauccuuagucuaaaugaauuguauccacuagcugcagugauugguucaggaggucagaggaccuaaacagauccagagcgaaaccucggacuuuuuacccaaugguugggaaaagagagguucucucuucuuuaggacaguggagaauaucuggggccugagaugacuacagucauuuuacuaacacagggaagucggccugagaauagagaacaguaaggaggagggaggcauugaaagaaucgcaggacagggccggacucuugguugagccaugccagagguccccucuacaccuggccuuuucacugcugcucuuacacauuuauuacuugucugucuccccauagcgaggacgguguuaauugcugcuguauucccagugccuugcgcuuuuuaagucccuaguaaaugcuugaaugaaugaacucugggagguggucaggucucuccugggguagagaggugaagggggccccucagcccucggucaggcgagugcucccuauguguugggacuggguuggacagacuagauuuggucuaaauuaauuguauuaauuaaauuaauguagaguggagcuugagugccaucuugccugggcagagcacuuuucagaauggacaugcagcagggguccagcacuuccagacagauccgaaucugugauccggucugugaucucauccauuagagccuuuggacacaggcugaggacagacuagcucccagggagcagccuaucugagaggucauuuugcucacauaggcaagggcuggggacaaauguuaaccaauccugggcagacaguaccauuggcuuccaucuccagggcaaaagagacaccaguguugagacaggggaagacgucggacagagccagguucaaguccuagcuccaccauccuccauguucacaaccuggggcuacaauuuugaucucuuccagucucuaguaugaaaugggugugaugacacuuaccucuuaggagggcgguaucauccaggaauagagggaggacaaugaagcccagcuaauacugaccccuucugcugcaugaguucacugguauggaacguccacacugcuggacucacuaaauuaggcacugcuuauacucugucuccauagaugcuccagggaauugggccagggucuccaggaugacagcacaccuuggcucacguguaugugugguggcagguacagucuccucgcgagcccccuggagcuaacuagcuuccuuuuugcagcugaggacuaaaugcaaugcagaguuccacuuagaugcucccugagcaagcaggcagaugccaagggccagagcagggccaugugcuggccaguuaugcccaggcccuucgaguuggcagagacagcgaaaauaaauacauucauaaccaaauaaauaaaugaagagcugccuucuuacuauucauacuucugcacuuugaaacauuucuagauggagguggccaggaugcuauaaauaaacaagacccaagggagcccuuaggugaccuugaaauauuuauuuggccucccuauuaguguuuuaaaaacugaggacucaggggcucuuagucugagggaagcgagcuggugaggcagcugggagaccccuugguaggccugccuccugauaggaagggccccaccugggaagagcagaguggcccuugccccaguccgcugcuuccuguccuacaggguaccucucccugcccccuucuguccacccugucucuguugacaaagggugacuuagaagaagccagcucuauaaagcuuuaauguuugcauuaauuaauggaaaggccuuuaugguaggaaauauccaauucucacauucacaaacaaaccugagucuaacaucucuugccuggaaucgaggccccaguauuuacugccauccuccagccuggguaaccauggggacacagguccccuaaucaguggugccagccugcacaggggaaggcccggccuguugcugcuccagacgggaagauggguuuugauggcugaacaccucaacucccuugccuguccccacggguguuggucccagggcuggcauuuuuuccuuucucugccaacacaccaugugcguccgccucagucccccaguggcaaccaggugagugcauaaggccaguugccauagcaacaauuacucuuugaaacaggauuuugcuccugccuggugaggugauucaagggccccacuggagucucuaggguguggccaauggugguuucgggucaggggcuggguuggguaauccuuguuauuugguuggaagcugaggacaauggcccugcaugcacuggcguccucucuaaaaugugccccacggugcccuaucucccagaagcucaucucaacuccuaaugccccaacacaaaggacccagccacagauucauucauccucugcuucuagaaccuucuaggaaaaaguagcucuaccaaggagcccugcaagcacccugcagacaaccccaggggaugcagggaagaaacgaaacaguguuucaucucugggucugaccuggcugggcugguggcuaucugcugguuaucgcauccaccagguuagcccagggcuacuuuaacaggacccagccccacugcucuaccagggugcagccauugaaagcgagaagcauuguagggugaaggcuauaugggcagcucuagaugguuguuuuggcuucagauccuggucccgcugccgacuagcucugcgaccagaagccacgugucucaucucugagcuucauucccuugcaacguggggguaauaacagcaugaauagugaguggccuagaggcugguaagaagcccagagaguuccuugagcccucacuuccacgcacacaacucuccaguguccugguaucuggugagcgugcaugcccauugcucaggggugccgcacgccugcuuccuuauauuuggcuccuuguaaagguaaggcuagaagccauccaccaauagguguggcaucucuagagccauuaaucuguuccaaggugcuggaagucuccaaucuucuucccuuccacccaggcaaggcugcaauggagcaaacugcuaggcagaauuuuuugucauuguuggcggccccuccuccucuccccaugccugcguccucugcuaagcagcaggcugggcucuuuucucguuugcccuaggauugcaacaauucccuuuuguguugaaugugaaaguucuuccauuuccaguuugaagcuauuacucuuauuuucccucucucagcagucugugaauuuucuaauacggagaaaacaagagcaggcaugcauacaugcucacaacuuugcccaucccugaguugugguauugaauaagggcucuauucgaauuucaccuccacguagaaaggagcguuugggaccaggcgcacugucugugcugagaugggcaguuuuccaucaggggcccggcugcuuccugggcaauuugucaaugacguguacuaacuccggacuuccaccacaggcugugguugccagugaggcggggaggcaggcucuggguccuucucccugggcaggagccaccagucaggauccuucuugcucuuccugacuuugccaggcucagagcagccggucgcuccuguucaucccauccaugggagcauucuuuauuacccaaggaaauugaggauguccaauagugagggaggaauaaaucauuguucucagcuaaauggaguagugcagaucugcugaaaaugcugccuuuuaucaacagugcaaauaaugaagauuccaugcacugagaacaaugaaaugagccacugcacuauugaugggguauuuguacaacucugugaguuauguuucaaaaccaggcucuaucaaagaugcagaaccuuuuucagaagcaaaaagacuaauauugcucuccaaauaauuuauaaguuuccccacaaggcaaaaaagcaaaguugucuggaagcaggugaucauuguuuuggguuuccuguugucucuuggcuccucugcucugugggacucagagugagucugagugcaaccuucccccgcugcaguguggaggccacguagccaccacccuacaaggcuucccccgaguaggggagaggcgguggacugagguggagcacucccacccaucugcgcacagugccuaggcccacgucucacuucauucagucgcagccaacucggggcucccuggggcugggggaacugaaauccacagcgaaucaaauccugggcuuuagcaaaacccuugcuuaugcuggagcuuuggcagcuccagcgacauuuagcaaagucuggagacuugcuuagcagucacgacuggcagagacgggguacuacuggguagaaauacuccaggagguggaggccaaggaugcugcugcauguccuacaaugcacaggacagccccccacaaccaagaaugacccagugccauggcugauagagccaagauugacagacucugcacuagaaucaccaauucauuucuuccccugguucccaugccuccugcaggcuacauguugggguggaaggagcuggcaagaaccuguggagcuucuacggugacaccagguuggugacagagcucugaguaaaggcacuguggaagcacuaccugguuggcccagggccacuucaauggggccuggccccuuugcuccaccagggugcagccauugaaagggagaagcauuguaggaugguggcuaugcgggcggcucuagauggcuguuuuggguucagauccugguccuauugccgacuagcucugcaaccggaagccacgugucucaucucucugugcaucacuucugugcgacaggguaauaagagcacauggggcuccaaggcugcuguggguaucaaauuagcuccuacacacaaagcacucauggcagcgcuggcacggggcuccaucacuguggcgauuguaauuauuaacacugacggugaugaaguugauugagaaacacagagacguguucacgggcaaggcuacguaauaacgcgagaugcccaaucacgggcccacuacguccgcagcugcucagugaucagccugcaacagacccagcccaggaaagacgugcagcucgacuagacggugggguaggauguggauacuuuugagcuuuugaaaaagaaacugcaugcuaguuuaacuaaacaacaaacaaaaaacuaaacacauacagcaaggauacucacaaaaaucucaccaacauuuucagucuuaccuagauuugugcuuauuggcaucaagcaggucugugcuguccccuaaaggaccugcaauggccucacccauauugcacgaaggagagcagcuucugaagggcaaggaugggcucuggcgguggcuggagauuaagggagguuggggagggauuuaggauaggaggacggcuaagccuggcagccucaacccaggaagaccuggcuguucuugacacugugagcccaagccacacuacuggcguagaagcuucagggagaggucagagcccggguggggcaggggugcaacaguaaagaagagaggugcacgcucagcccaggacuuccccaggcugggucuggacuccaggaguuuugcuccaucucagccacuggccaguugugugaucugagaugaugcagaaccuuccuagaucucagaugucaucagaugcccagagggccacccucuacuuccuagucaugguaaccaaaaaugucccuggaguggggggacaaaaucauccucaguggagaaccacugaaccagaagauuucaggauuucuucagcccuaaacugaagaucauggaaacggguucaucugucaaaugaaugucggggaugugggcagauuucugcaggcagcugcugcaccacccacagaggccgggccauuccugagaacucucacacuguguugagccauagaaacuccugagcaccuuugaugaggacggccaggaaacucugaaauacagacagggcgauagaaaacauggaguguggcugggcaugguggcucaugccuguaaucccggcacuuugggaggccgaggcgggcagaucaccugaggucaggaguuugagaucagccuggccaacaugaugaaaccccaucucuacuaaaaaugcaaaaaaaauuagccaggcgggguggcaggcgccuguaaucccagcuacucaggaggcugaggcaagauaaucacuugaacccaggagguggagguugcagugagccgagauacgccacugcacuccagccugggugacaaagcaggacuccaucucgaaacaaacaaacaaacaaacaaacaaacaaacaaaacccagagcauuagaaagugccacauccaggccaggcacgguggcucacgccuguaaucccaacauuuugggaggccgaggcaggaggaucacaaggucaggagaucgagaccaaccuggauaacacggugaaacccugucucuacuaaaaauacaaaaaauuaccugcgcgugguagugggcaccuguaaucccagcuacucuggaggcugaggcaggagaauggugugaaccugggagguggagcuugcagugagccgagaucgcgccacugcacuccagccugggcgacagagugagacuccgucucaaaaaaaaaaaaaaagaaagaaagaaaaagaaagugccauaucccaggacccagggcaauaauggcgggcucugaaaaaucauguuuggugggaaggacaagggggauauagacaugugacagucggaauguguuuuuaaugaaauguaagaauggaaaauuugccuuauuucucaauugauauauccauuuauguggcaugugauuuuaaauauaucugaguaaaugcauucaaaaauagcaagaaacccaagaacgccgacuaucaaaaccccucccaaccacacuuuucuuucucacuuagcgauauauuaauccuugaacacuaauacgugucaauaaauaagagucuguggaacaugaaauguuaaaagccuuuccaggaaugugugucuucccucgaauacgacccggacaguaauggauuauuuuacuccauuucuggaugugcacguuucuuacaucgauuuuaaaacccuuggguucaaauguaccuuauuacauuuuaaagucuuuggauuguagcagaaaaacguucugcacuauaaaacacagagcauaguugggguuugauggguuugcuucuauuuucuaccacacaaaacgcuuucuaaaugccauuaaaauuuagcauacaccauaauaaccaagcugcauuguuccauguuuaagucaauugacuucugaguuuuauuucuucauauacaucaaaucaaauaaaguugcugcuguagcaagaggugaggacauggcugcuguuguuggguggaccagucccugcugcccccgcggagagcuggcugggugcuggagaggcuguggaaugugacugugauugcugcugucagucuggaaaagagagaagugccgugauguaagcaaggggccugaacgccgcagcagggacccacgucaccagugggccauggcaagggccugaaguaccuugacccggggugagaagagucuaucagggaauaagcccgaauuuaguuccuagacacucuccuacauaguacucuauucaaucaagaauuaaccuuacccacagagaggucugggcugugcccugggcuccuaggaggggacugaucaggugagagugucuuuggagcuuugggccaugcucgagagucuaacaaugugauaaggggguguguuuggggucccaugaccucagcuuguccuaggcagggcuggaggcugaagacauguggguagcuaaccaggucuaugugugagccccaguaaagacugggcaccaaggcccagcgagcuuccugguuggcgacaccgacacacaggcuguggggagacgcuaguggucccacaacuuacccauagaggauggcuggaauccccacccagaaccugucugcacccuaccccaugugucucuucccucagcugauuuuaaucuguguccuuucacucugauaagccuuaaccacacgcauaacagauuucagcaaguucugugaguccuucagugaauuauggaaccacagagugguccugcccugaauuuacacuuagugucagaagcgaggguaugcuugugaaugacccccucaaacucuuacacucauuagggcaccucaaguucaagucugaacucuguucuuccccuaaguagccagauaaacuuagguagguuauucaacuuccugaccuucacggaucucaccuacagaaugggcaagcugugacagagagcuuccugcauugguuguccuaauuuccaaccaaccaugacuccucccucugcuccugggcccccuucagaccauccucacugaggacaccacccuaccuucuccaggccccuguggugggggaggaggaggggcaggaagcaaccuccacacccaggaccuggccauccucuccggccuccaaacucuccccucuagucuugggcaacaugucagcuuugacugaacucccaaaaacagaagcagaaggaggaagguggagguacacugugccacagugcagugugacagucauggugccaugggaagucaagaaggcauagugacuggcaagggcuucguggcaggacagcccaggcucuguggaugagcagcuggaugacucugggcagguccucaucucacgucaggcucauccaaucauuuaacaauuuaaauuuaacaacaugugcggaacaccacagcgagccagguaccacggugggugcugaagcugcagcagcgugcaagacagaaauggagcuacagcuuaggggagggcagacgagaaaagaagaaaaggcaguccaagugaugagggccacccagagccaccccagagccacgccaugggugcacacagcgggaacuccugugcuaguggggguggggccugggaaggggucacugacugugagcucacucugcucagccauagaugggcaaauaggacugcuuugugugcuagguaucugcacccagugaaaccaugagugcccagugccugcgcccaaugaaaccaugagugcccagugccugcgcccaaugaaagcaugagugcccagggccugcacccaaugaaaccauccaugcccagugucugcacccaaugaaacaauaagugcccagugucugcgcccaaugaaaccaugagugcccagggccugugcccagugaaaccaugagugcccagggcauacacccaaugaaaccauccaugcccagugccugcacccaaugaaaccaugagugcccagugucugugcccaaugaaaccauccaugcccagggccugcacccaaugaaaccauccaugcccagcgccugcacccaaugaaaccauaagugcccagugccugcgcccagugaaaccaugagugcccaaugucugcgcccaaugaaaccaugagugcccagggccugcacccagugaaaccaugagugcccagggccugugcccagugaaaccaugagugcucagggcaugcacccaaugaaaccauccaugcccagugccugcacccagugaaaccauaagugcccagugucugugcccaacgaaaccaugagugcccagugucugugcccaacgaaaccaugagugcccagggccugugcccagugaaaccaugagugcccagggccugugcccagugaaaccaugagugcccagggccugugcuaaauaaaaccaucagugcccagugucucaugaucugggucagggugagcacucagugaaugacaucuaucgugguauuggcauccaaggccacagacuuaggccacuuauucuuguaaugucccaggaguagaggaaauaccaggagagugcagagggcccagagcucagcuuggccccaaaugccaggcaucagcucucccaguguuucuccaaaggugccaucucaaucccugcccagagccaggugcuggccaaggauacaagagccagugucagcugcaagguguucagcuccaccugcugagccggccucacccaugcaaugugcaaccacccuaauguguuaugacaggaaggaaguacaaguaaacauaauaaaucuggccaaauggccauuaugauguggagugagcagggcuggggacgggggcagucuggucuccuuuaugucaggggagcuuauagcucuuucguuuuaccuggggcucuguucuuuacagcaaauuggaccuuucgcucugaaagaaauaauuacucucugaggagaagagagcuggccaugaaugcugauaugacacucaaugucaccuugccagucaaaagaggcuccagcuccuuggcuugggucccagccaacuccccgucucuuucucauaauggaggucaccucucuauagaauuuguugaugaucuccaaaaugacaaguuagaaagcuccugucagcaggauauuuuuuuuuaagaggaaagaauggcacagagagggaggcagcaggagcccuggggugaggagaagggaaggccccagagugaagccaaaggucagguuuugcauaaccagacgccaggugccugugaaguuccauccaaaauuaacuucuggaaccagugacccagacagaugagcuguaucagaaaucggcugcucccccuuguccauuccagggagggaacccacagacagagcucaggaagccagcaaccaagcuggcggguuccugcagucuccugucaacgcacaaggcuggcgccagugcccucugcagcuugcagacccaagggccuucacuucagacaugugcaccgaggagccgacuugacugggcaaauaaaaauauccacagcugugccaucaaagacacaucaguggggugggaagagcucaauguuaucauuagcucucugcaaggagagagcaucuacuucaucugcugcaaaucaucugcggagcagggaaauauuggcccuggugguuguaaauaauuccauuugccaagaguccagaaaagaauucuagccacaugcacacucacccagcaucagcauggggccacacagcuauucugagcuuucuccaaggcaacccgcggccuuggaggagcagcccuggagagaagggggucaccuccccuguguccauguggaauauaccucauguggagcucagugcggccaggcaagaacagggcaggcaaugaggaggacaggcaaggugggcucuacugagcagggugugauuggcaaagggacggagaugugcugaagacauccccucugccccugggagucacauggccacucgcugauaaaacuccccaaaucacacugcuuucugggugcuggugaauuccaccauccauuugacaaauauuuucugagugccccaugccagucccugugccaaguacauuggggucacagagaacgggcagagucccagaggaggagaaaggagcaagucaccagguaauauucaugacacagugggcucggcaugugauagugccaagugagcccagagggccauagaggacacccccagguuggggauucagacgcaggaagcugaugacccugugcgcggagggagcagccuccagagaggagcaggagcugcccggaggagugcuuuccacccauccccacguauugcucuggguggaaccagcuccccugacuccaucagucagcagagaagccauaucuuggacccuaugccccaagaucccagaaucaguuccuggugaaaaaagccagagcugaagucucaaaccagugguaacgggggcugccuguuuuggccagaacugucauuagaaucuuaggaagcaacugagccagaggaaaagaaagggaucauucuccaagaaggggguccaggaggagacuccggugucucuacuucugcagagcugcgcucacucuccaccagcaggcccagggaaguccacacccaggcgcggggccuagggaaagaagacgcuuggcugcacguuuauacuuuuagaagcauuaaaaaaaaaggucugaaauuauuuuuuaaauaugaacaggagguuuuaaucagaacaggagagaggaauuccuuuccaguaauagcccaguaauagcacuuccuaaaguaaugagauuucaguauucaacaauaaaaugugaucuauucaggauucuaggaaauaaaacucuagagauaauucgagggugauuuucugaugccugaauggguguuauggguucagaccaucaagcccauccacagcgcagccaccaggugcuugcugcucaaaggccuccagacagaggcuggaauucagcguccacuggggccucccucccgacaaccucugaagaccacagguugguccucaugggguccggccuccaggccaagugugagcuuggcuggaugucacaacugcucccugggcuuggacucuggggaaggucaugggagguguucugcacucucugggaugacucucaguccuucaucaccagccacaccgagccuaaggacauccacuacagaagcccauggccaccgccauuccccugacuggacugaucugagaaagcaguuugacagguggcucauucauucauucacucauucauucauucauccauucacucaguauauacugagcccuugcuuugugccauggacuccgacugauucuagaagcacuguguggaguguuuuuauggggcuuauccaaacuccacagacacgcaucucugcagccccagagcccacagcacacugggauacccucucccacugcccagaaagcaucucacgcauccuaccucucaccuucgacauccccuccucagggaagccucccaccaucccauaucugcagcugcagccuccuucacgccugccuucuagcauagguugaagcuguaaugaccaccaugcacucauaggucugaucuguguacaagaaacccaggaaagcagugagcuaggauugugccucugcacuucagccugggugacagagcaagaaaguccuugucucagaaaaaaaaaaaaaagagucacaagggaaccugugugcccccuccuccaccaugugaggacacauagaaggugccaucuaucaggaacagccucuuaccagacacuaaaucugcuggugucuugaucuuggacuucccagccuccagaacugugagcauuaaauguauguuguuuauaguuacccagucuaaaguauguuguucuggcaccaugcauggacuaagacaccucgcuggucucgcugccugcaguguccucaggauguugcacaccaccugcauagagucagcacucgauaagcauuguuuaugaaugaaugaagugacucuagagucauccugugaggcagggcacuggcuaaagggaccacaguuucaggagucaagugaaaaaucuguucuaacccaugagcuacccuggaagaggcacucucggcuuuucugaccucagucccucucuguaagcugauggggcuggacucugguuucucuggcuuuagcccccgugacuuuaugguucugugacucucuaucaggcaucuguucccaaguguucccggucccugggauacucuggcuugcuaugccuuugaggggggcuaccagggugaagcagguuuaguagagggcagaucuacaaaugcuuauuggagaaacaccccucaccuggccagcuaaccacagcgcugccacacuccacucauggagaguccuugcuggggucagccaagccucaucacagccaagaugagacacacaccagaugcccucccuccugcacuugguggccaaaaauagaccugcuaaucacggggcuuaaauccuucugagggucccagaggcaaccacacaggccaaucguuccgaugucacccauccugugaaaugucacucacuggcaggaaccaaaccaccugauuugcaaacugcuauauccugaaagccagaagacagcguaagaggaaggauuaagugaaguucggcugacagaugauguucuacaaaaggucacccccagaucauuccuccauccauuauuuauuaacaaccuccgagacacgaguguuacaucaaauguccugcaacgggaagaugauaaaguaauauuuuauagcuagagcccucuuaaagguguuaacaaagagcuuacaaagugauuucaauguguuacaaaauaauuuguuaagaauucacugcagcugaacauuaaaagagauauuaaucacccagugaaauggaugcaagaaaaacagcccagcucauguccaugagugauguaacaagugggcaccauguuccuguugauuuagcacuugggucagacaagggcacaguuccuacucacucucucacguuucaaacuugguaucaugucccuauuuaaaaacuuccgcaaugucuuucuucuucuacagagcaccucugcgagcuagaaggguuggcauaaaugguuauguuccacuaauugucuuugccccacacgcaucaagucuauccaaguccaccaccucuacccaaguucacucgcucuauucaaguccaucaacccuaccaaaguccaccaagucuauccaaagccaccaccucuacccaaauccacucacucuauucaagucuaccaguccuaccgaaguucaccaccuccacagaagucuacucagucuauucaagucuacuaacucuacccaaguccacuaacucuauucaaguccaccaauccuacccaagcccaccaccucuauccaaguucacugccucuacccaaguccaccaacucuauucgaguccaccaguccuacccaaguucaccaccucuacccaaguucacucacucuauucaaguccaccaauccuaccaaaguccaccaacucuauccaaagccaccaccacuacccaaguccaccaacucuauccaaggucaccaucgguacccauguccaccaccucuacccaagucuaccaacucuauuaaauuccaccaguccacuaacucuauucaaguccacuaacucuauugaagucuacuaacucuuuccaaguccacuaacucuacccaagucuacuaacuguacccaaguccaccaacucuauccaaguccaccaccuguacccaaguccaauaauccuauucaaguccaccaguucuacccaaguucacuaacucuacccaaguccacuaacucuaaccaaguuuaccagcacuacccaaguccaccaacucugcucaaguucaucaauucuacccaggcccaccaaucauaagagaaaugcuaguaagacaggauaaacauuaguuauaaagucacaugaccaggacaugaagcaggcagggcacaugugucaagcccuugugaagacacuggaucauuugcaaguaggugugaccauuugaaauuaggccuucuggcccuguccaaguauagagaaaauuuucaggguugguuuucuaagacauauguauggauuauggccuaugcauucaagaaauauuaaacuccuagagggcagauaucaaggauucuucuucaaagaggaccccagaaggaaggcagccccagggccugaggaaucaaaugacaggugcagaaagagaggaaaggaaacagaggcucaaagaugauuaacacacaggaauccagcuugaaggaaacucgguuuacguuacuugcuaaacagaugagucgggauaauccccaccaaggcaguuuucaccccaaauuucuuuaacuaguagugaguccucucuugcauaagaaauuuauugccaugcauaaaaguuuaauguacccccaaccuuccagguuaauauuuauugcaugaaaugagauucaucuugacuuuuaaaaaagucacacuguggaaaaguugcucagguggcuggguacacaggaccuggauauucugguuccuucuacacagcuagcagggaggaucucagaagucccugaaggaagaggauguggcuccaggaggugucccaggcuucuccagccuccccuucuggucuggccagcuuugacucgcccaacaaaugucagcuagaaggucaccuccccagcuuuuccuggccaccaacuucuccccugaagauucccugguugacucuuaguuccaugacacuggggaccaaaucuguccuguucgcauugaccagaauugaugacaggucuggcccaagcucacagcucagcagauaucuguugagcaaacgacucaaugaauguucagagagaacugaggacccacccuauuguuccauccaaggaugacgacuugccaugaugcaggaucacagauuccaaaugaauauggcgccacuccuauuuuguugcccaaagcagcccauuggccaggcaggccggcagcaacggaagagccaaacugagcuucuauuacuaaauccucucccuucccaaggaagaaacauccagaacaacacucuaacacccacagccccguuuuccagggacaaguccauuaacaauggcugcucuaccagccacccaggauccucagcugagcacagacagauuuaugugaagcagaaaacgacccuauuaaguucagcaguaaacucccuucaucccagcugcugugugucccgacugccaauuggugcaggcaacuccggcguggagaaaguggcaggcguggcaggagagggauggccucuuguucucaucacaccuucccuugcugcaaauccuugcaccugugcaggccagcacagccugcucacucugccaggccagaaugggacaaggcuaagagggacagggugaaaagaaacagcucuagggacuacacaguccugagagagccacaaaaggcaugagcaccucccaugcuccuggcacaaugugggcacaccgaggcuugucaucuuugaccucauuugaucccagaucaaucaauccuccaagguagguaguguuaacccuauuuugcaaacagggaacugggcuuuggagaaguuaagccacuugaucaaggucaccugcuggugaaugguagaccugagauuugagccugauucacaagagugcaaagaccaucuccucggauuuacacuccagugcaucaguguagggguccuguccuggcauggcuguggugggaaucaccuccagaaccugccccagggcugagucccagcccccaugugaacaggaugcaccucccuuuuuguagcuguuauggguugaguccccuaacauuuacaugcuaaguccuaaccuccaguaucucagaaugaacccuuguuuggagacagucuuuaaagagguaaucaaguuaaaaugaggccuuaggguggacacuaauccaauaugacugauuacuuauaaaaagguggggguuggacacacacacagggagaaugccacgugaagaugaaggcagaggacaaggugaugcuucuacaagccaaggaacacugaagcacaugccagcagccaggggagaggcucaagacagauccucccucccagccucagaagaaaccagcccugcccacaccuugaucugagacuuucacccuucagaaccaugagacaaugcacuucccauguuuaagccacgccguuugugguacggcagcccuagcaaaccaacccacuagcucugaaaaaccccacgcagaccccacuucagaagggacaaguuucaccuucccugcuuaucaugcaaacaccgcacccuguacccuuucagagcuuguauuccaagaacacaggcuggagcccucaugccagcucucaggaagcuguugcaucuggguaugguccacuggcccaucugcagacugccucaugucugcaaaugacaaugcuccagaacauuuccugcuacaaaagagugaaacacaaacugcagaaggagagcaggaagagggagcugaauucuaaguaaaggcuucaagaaaaggugccgucgaauggggugagggaugaggaggauuguggugcuaggaggaugggcugccugaguccucugcguccuguucacagggcccaauguaaagggcaccaaagaggccaagagaaaaccaggggguggggaggggcucuccagccucaccagagcacaguuuggugaggccagcgauugccuucucuguacugggaauggugcuguccaggugcccagcucuuuuaugaagccuaggacccacucagcaugcccuucuccauggucccugcacauggcagagaugaggaaaggcuggcuccccacugaccccugggucuccagagacucacuggaaaagggucaccugguacccaugacugauaacagggcuuuaucgccagagcaagagcaaaugagaccacaaaggacucuuccaccugucccaccuagagccccucuuaugcacgugagccugcuccaucccaggcucugcagacagggaaagccucuagaacuuucuagaagggaggcuccuaccucccagugugccacaugggcugcugaagggugagauuuuauagccaaagcugccaggcuccagggcccccagggcuggaggcuccucugcuucuuucucaacccuugcugcccaucagagauccacuccuuggcauggggcugaggagacaaagccggggccacccuguccauccauaaacaacacauuccacagcaaggagccccauuaacaagacuccaaggccucauuaggucuggaaacagcaacuuccccugaccaugugccuaucaagucacaugaggguggcuggcucacacaagaaaaggcugcaaaucacugcucuccaaggaggagaaaggaaaauauaucuauauucagcaccucagauuuauuccugcaagcucacagagguagccaagucugacgaggcgagucugggcucugugaugaaggagcagccggggcugcccggggcagggguggcgcggggcaugcagggacgcuggaggaggaagggaggcuccgcaccggaagcagccccaccacugcccgccuccagugauggccaccuaagcgugacuacaucaauaaaaaauacaaacaguguaaaaagucaucaagcagagaugaguuuauuacuaauuaugagcagcuugacaugcucugacuucucguaaaauaaauggaguccauuuuuagugucugcuuccaugacuucuagauaauaggcaaauuuacuucaagguuacaucucauuuaucaagucaagguuuucagcuacagauucagaaaagcaaccgaaaagcucaccuccucgguaccagaggaaaaaagggaggacguggggcuuuuuguagccccagugaccagugacuacaaccuuuccaauuaaccucuuuauuugcaaauagaacuugaaggaacugggaaauaugggcuguucuccguguccauucccccccuccacaaagaucugggcuuggaccuucauuuugaaaaggagcccccagaucccuccagcacacaagcagcccuuuagcauaguccagaaaacacagggcccugucugucaccauccaaagagucccugagggagaucagccuucuagggaagaugcuguuggucuccuaucucauuccagguggggacagggaccugggagcagggaccccaagcuccagcagcccggcacucugcccagacacugcauggaguccuuuccagggauuucccugaaucaaaaggagcaggccccauggaaagguccagaagcacugagucauaagacccuaaggacgaaaaacacacauggacgaggacaucuguauaaaaauaauaauaaaaacaaaagcaagcaaaccagaaacucuucuauggcuuuccagggcccuuuagauaaagagugaaauuuuuuggauagcuuagaggggccagcucaaacccuuccuccaagccucaucccuaccccucucacauguauuaaaugaaagaaugaccauuccugugagauggaaaucgugaccccuauuuacaaagaaauggaagcucagagagguaagugaguugcccaggguucugcagccagguggggcagugccaggacuugagagcccggcaagggggcaacucaguuccucugccucgcugcccccuaaaucagcucaccccccuccucaccaggagcccagauggccccuccugagccaaaaagggcaaggcuugggcagggagguuggguccugggcucuuggcuauagcggcuccaugcaguguucagggaggaagacaugaaugaaaaaaugggagggcggggcaucccucgaugccuucuuuccucccuguaggaugcuccaggagacuggaugacaucgcagggcccuugguuucauccugaaauucccugagccgagaaauccaccagagcaccaguagggucugugcauagcuauauccuucaccuggagcuggagaugccagaaugaauggacuccggggagccucugcuucaacuaggaauggauugaaaagcccaugaugggagggaaggggggaagggagcugaguguggacaaucacagcagcagcugacaugaaccacagcuuccacgggcccaaggcuuuauagauauccugucacauccucucaaccccaggaagcagguacuaugcccaccuaaucucagagaagggaaccaaggcucagagaaguuaaguaauuuguccucgguuggucaguagauggaagaggcaggauuuaaacuugugucuaaaugauuccaaaggcccuguucauaaccaacauucuacuguuucccuauaaaagcagccaccaggaauggggcaggcuggguaccugcagagccaagcccugacaugcuagagggacccuggggacagacagccugcugaugguccauagguucagggaucuccauucacugggauucagagacuggaggaggaggcgguggcagucacucaugcacacuuccaaauuucccugaaccaucuguaggcuccaccugcaucuccaggaggaagaggcucugaggcucuggggacacaucuuucaaaaagcaggucucacucaagaucaccugguguggcuucaauuucaggauggugcuaaaacagcaucagcaaaagcccagcgccaggcaggaagauccugcagcgugugacagguguggugcaauucagcaucccagccugucggccaagggcacuugagcccugcccaaggccuccacagaggccccaggaacugccugcagagggcacacaccucuucauaggcauguucauccaggacagggaacagcagagccuggggcuccucuagguguguaagaacaccccagccaaagcagcaagccugcugaagccagggacaccucgggcuuccaugccucccucccaaacccguccaaucauccugcccacaguggccuugacauuccauuauuucaacagucccugccugagcucucuccagccuucuggaugguuggugaaccuuucuguucccaagucaugcacagugaugccauaccuagaucuuccugagagcaaagaagggacauuugugcuuaguccuuucaugaguggauccagcuauugaaaaucuggauuaagaguauucagagggaaaagcaugugcaaaggcccuggggugggaacagaugugcaacgccaagaaccagcaagguggccugugagccggagccaagggaggagcaagagggaggcuggugggagaugaggcuagaguguggaccugagaggggagggguggaaggccauggcagggguuuagauuuuacuccagccacaauagaagccacuggagcaucugaagacaggagguauuaagaccugauacauguauuuaaaagauggcccuggccgcugaguggagaauggauugcggaagacuuggcagagggcuuuugcagucaagguaggaagaagcagauggacuugagcuauauuuuggggguagggguguaaggguuggcugagugauuaaauaaggaagagagggaaagacagaaauucaggcugacuccuugguuuuuagagaaaauggauggguagacagaagaagauuugaguuuuucuguuuguuuuauuuuguuuuguuuugagacagggucuugcucuguugcccaggcuggagugcaguggcaccauuacaacucacugcagccuugacccccuccgggccaagccaucuucccaccucagccucccgaguagcugggacuacaggugcacaccacaaugccuggcuaauuuuuucuuucuuuuuuuuuuuuuuuuuugagacggaguuuugcucugucacccaggcuggagugcaguggugugaucucggcucacugcaaacuccaccucccagauucaagcgauucuccugccuuagcaucccaaguggcugggauuacaggcacccaccaccaugccuggauaauuuuuguauuuuuaguagagacagguuuucaccauguuggccaggcuggucucaaacuucugagcucaagcaaucaauccaccccccucagccuuccuaagugcuggaauuacaggugugagccacugaacccagcccagaugaagacaauuuggaaggcauacauccgauggagauuuagaaagaguucagaagacauacacauagccaacaagcauaugaaaaaaugcucaccaucacucaucaucagaaaaacgcacaucaaaaccacaaugagacaccaucacacaccugucagaaggacgauuauuaaaaagucaaaacauaacagaugcuggugagguugcagagaaaagggaaugcuuguacauugcaggugggaauguaaauuagugcagccacuguggaaagcaguuuggagacuucucaagaacuuaaaacagaacuaccauucaacucagcagucccauuacugaguauauacucaaagguaaauaaauuauucuaccgcaaagacacauguucauugcagcauuaugcaaaauagcaaagguacagaaucaaccuaggugcccaugaacacuggauuggauaaagaaaaugugguaggucgggcgcgguggcucaagccuguaaucccagcacuuugggaggccgaggcgggcggaucacgaggucgggagaucaagaccauccuggcuaacacggugaaaccccaucucuacuaaaaacacaaaaaaauuagccgggcgcgguggcaggcgccuguagucccagcuauuugggaggcugaggcaggagaauggcgugaacccaggagguggagcuugcagugagccaagaucgugccacugcacuccagccugggcgacagaacaagacucugucucaaaaaaaaaaaaaaaagagaaaaagaaaaugugguacauaugcaccguggaauacuacgcagccuuaaaagaggaaugaaaucauggucuuugcagcaacguggaugcagcuggaggccauaauccuaagcaaauuaaugccugaacagaaaaccaauacugcauguucucgcuuauaaaugggggccagacacugaguacacacggucacaaagaggagaacaacagacaguggggcccacuuguagguggagggugggcagaaggugaggaucgaaaaaguaccuauuagguacuaugcucacuaccugggugacaaaaucauuuguaccccaaaccccagugacacacaauuuacccauguaacaaaccugcacauguaccccugaaccuaaaauaaauguugaaaaauaaaaauaaaauaaaauuuaaaaaagaguucaggcccagcacgguggcucacaccuguaaucccagcacuuuagcaggcuggggcagguggaucaccugaggucaggaguucaagaccagccugaccaacauggugaaaccccaucucuacuaaaaauacaaaauuagcugggugugguggugugugccuguaaucccagcuacucgggaggcuaaggcaggagauugcuugauccugggaggcggagguugcagugagccacgaucaugccauugcacuccagccugggcaacaagaguaaaacuccgucucaaaaaaaaaaagagagaaagaaaaaaaaaaaagaguucagauuugguuguauuaaguuugggaggccuguuagcuacuggagaggagucacugcauagguggcuagaugcaggagucugggguucaggugagagguuagaguugaagauauaaaugagggguucucuguauagagacagcauuugguggcugagaugggccaggcacuaugcugccaacagggaagagcaggugcaacccugcccucauguaauuuuauugugcaauuaugaucucuguguuacagaagaggaaacugugccuucgagaggguaggugauuggauguggccaagcccacacaugaccuaggcugacccccgagguucccaacugcuggguucucugucuccauuccuuucaccaggcggucaagggcgauggccucugagugucucaugcagagccugggaccuacagaugcucuguggacuucguggacaucucauccuaacugcauuaaucccaaggaggaggcaccguaggccugucccucuguuccucgaugaggcuggcucacacggagugggaagagcuuucaucccagcucccuggcucuucccucaagauccgggccuugccaagagucauggguccagcuagggaggagguguaaccucuaggugagauacuuggaaaggucuccacccccaaauuaaaccccaaccugagcccaccccacuucccagcaaccagaggcccucugcacucacagaggcuuaugcaggagcagagccugcugggcugaggccaggaggcccagaagacauguggcucaugaccauuuacuuuaaaaaucccuuuccuggaaaggggcccauggguggauggccaaggagucugcccuggagaggaaaucagugaggacaccugcagagacacacgccacacacagccuggagcugggacagagucaucagcucagccacugugucuccguuaauaacccgacaagaugucgggccuuugugcagacaccaggacauaaacacauggugaaauccaaccugcagaaucuucccaauuacccuuucuagggggugccaaggcacaccugcacucagaugcauuuuugucaccucccagaugacaaaagugacgccccuuuggaaaggacccaggaagcccagguucccaauaacuggagggaaaaacaaugcugaugcaguuaccacccaggagccguuucucucuccccuccucacuuuuccuucuuccccccgcccacuuccuccuucucuccucccucuucuucucccugcuuccuucuccuccuccuucccucucuccuggaauccuggcccagccauggcgggggagccagugccacuuaucucaacggcagugacuuuugucugggccauccuggaccuggcgcuuucccgaugguuucaauuuucugcucucugcuuuucuguuucauggcaggcauauuaaaaguggcagcauaucacuuuguucucuuuuguauaaaaacuccuucucacuugcgugcucucagcgcugccuuccucuuggucggaggcucaugauuugguaguaauaacgcucuguuuauacuugccauaaaugucaagcccacauaauauacuguaaucauaucuuauccugcaacgcugggauuuaugcacagcuccgagugcagagccuuuuagacuuuccaaaugaccacggcuccuugaaggcccucugacugauccgaccccggccagacagguaggugagaggggacgaugcccucgacagaaaauggaauguguuucuccaaucuccauguccaaguccaucaccccgaauggccugccuccauggaagcuggacucagagcgcagccuuggccgaagaccugugugugcucagucacugaccuccacgcugggcagaggucccccgaccugcugcuucugcugaaagaacaguuccuggauggugggacuggcucccuccuuggccagugaccacugagucgugggagguaccuuggcccucucuagcagagcagccucaccugcccgaucugcaugugggccggcucaggagccuggcggcauucaggccauaauuuugcuagaaguuccuaccuggcuauuuccagcuccugagugcguggcgucacuaagaaggcagaacaauucacuagcucugcgcaguccccggaugaaaggcauuccucagacaucaggaucgugccugggaaaagcgugaggccauggaugcucucccugagaaaaugcucacuuuggcagauggcccugucucugucaaguccugggggucacgcugccuaguccccacaauuccuagguuuccuacgacgcugaggucugccaccaccaaaaugcucaggagggaccucagagugccaaagcaggaaugcgccccacccgugaugggccuagaggacccaugggcagcugcuggggcagagaagugcccuaccgggaagcccuggaagcuugggccacguguaaggaacacaggcuacaaagcagauuugaucuuuaaacagcagcaacucccuucucauccccuacgggaguuaaaaggauccuggcagaauguggagggacagagacccaaauccaagaagugcucucuuuuguacaaagcauggugcauauguguugugcauauacacagguacccagaugcucauacacacacauacacacacacacacaccauaugacuuccuuuuauuaaaaauaccugaccauucuguacuaacaguucaauaugaaguuagaaguccuggcagacagauugugacucagugaaaagaaaaaaaaaugaaauuuucuaacaguuggaacuucccgguaaaggaacaggcuaaacaaguggcuccucacaggagcuuuucaaaggccacacggcuggcuucuagcagugauaucgcagaaacggagaggcuacacuuuuccaccuugaguucuuucuggaauaagagaggguaagauuaacaaaauaaaagguaacaccaggucucauccaaaccugcaacuaugugacugugcacccagggguucagggacauagagggucucaggggaccuggcggguauaggggcaggaggacucucugcaaaacaacaucucucuguggcuccugcuccuggggacccuccuggggcucuaggacacagagagaauccggcauccacuguuccugccaaugaggggugcucagugugggggacacaggugggaggcaggggaugggugcugggauagugggggagaacaagagcaggugccuggggagcccacaggagugagcaccccucucgggaggcuggggcagggucuugccaagguccccagcccaguugaggauccauaggugagauacuuguaaaguugcccacacagggcaccuuuagacaaagauacucacacagagagcccagugugagcccaagcugagaccccaucccucuucccuucugccagaaguucccuccuguucucaccggggcuuauacaggagugaagccaggaggcccccaaggcccagggcucaccagggcuuacuuugaacaugagguucagauucaucuugcuucaggacuguuauggagugaauugugucccugugaaaaggugucaaaguucuaagccccagaaccuaugaaugugaccuuuuuggaaagcgagucuucgcagaugauaaaguuaaagugaggucaggagggcaggcccugauccagucugaccggucaccuuauauaagaggagaugaggacacagacacaggcagagggaagacccugagagaaccaaggacagaggccucaggaggaaccugcccugcccgcaccucgaucucagacuucgcuucuccaggacugcaagaaaaucaaggcugcugcguacgucgccccgugugcggugccuugucauggcagccagaguacacacauggcaugggaucagcccuaggcagcuggacagaggacacaugucaaugacagacaggucugggauauggagggacagagaugugcagggagugaguuuccccuuuaggcccccagaaagcggcuagaggugagugcugggcucugugcgcucauaaggugguaauuaacaguggcaggacggugccccauuggaugcucugggauaucguacaagucucuguuuugcugaugcuggagaaaagaauggcgauaaauaaauguaaagcacgcuggugauggugugaaaugaugcuucaucuaauuaucacuauucugugcugucguuaacaugcgcucgaggagaacgggaaugacuuuuacauuuauaucacagcucggauuugccgucuuaagcccauagcacggggacacaauaugcccugggauggaaucucuuacagacaaaugacgggauuacacaacuugguaagaagaaaugauucacuguggcugaguugaaaacagcagaguaauaacacacaggacuccaggagagcccgaagaagacccagaaggugaggaaaugagaaguaggcaacuuugaugggcaacugagggaugucguuggaaaaucuuuccucaaucacagacguccuuuucugucuaaugagggucguaauacagugaacguggguggccccaucucucuuugaugcuuaacggacuguggcauuccugaaauuugcuguuuugaacguaaggggugaacggaccuggauugaagccgaacacccccuguggcugcuuuuucuccagguuccuauuaucucuugcucucuccucucaaacuggaaauacuucaguuaacugacaauuugacaauuccacuuaguuggauccucgcccuggaaguucuccugcagggaccacgcagucgccuuuguaggcggccgaaccuuuacccuguuucugccauguuccugcaccuuccaagggccagguggaggugguuaugcuucguaccacagccccauccugcugucuggaccacgagugggccccacgacccccaggaccaucaauccaagguuggccuggcggggugucaucugugcccaugugagaagacaggcaugacuggcacgaccuccuugcucaggaacccaacugggaaacagcaugggcaugggaaugaggcagucagcagcagaaacugcagccaagaagucgucgagaccaaggccagaacgcugaagcugggccaggaggaauugaggcaaggcgugagaaccagaggccacaagacgaagagaaaggggacaccagagggaacacaaagcuggggggcagugagaagacagagagguaggcaugcagaguggaggcagagacaccagaggcccugcgagugagcacagccccuggucagucccucgccagagcugccucugucccacggccuugcugugagguccaguccucuacacgguguaucaaaccacuguccuccuaagcugaauaaauuauggcaccccaaaacauacguccacauccuaaccucagagccuaugaaugggaccugauuuggaaauacagucuuuguggguggaauuaaggauggagaugauauagugcauuagggucgugccugacuccaauggcagcuuccuuaggagaggcggaaaagggcacacagagccacggggaagaacacugccaagugaggauggaggcagaggcuggggaggaugcagggacgcagcugcaagccggggggguccuggauugcuggcagccaccaggagcugaagaggggucgggacagauucugccuuagagcuuccagaaggaacccaccugcccacaucuucauuucagacuucuggccucuagaacugaaaagaaaacauuucagugcuuuuaagccacccaguuugugguaauuugcuauggaaaccaauacaagugacccaaggaaggcuuagcucccugcaagcgaggagaacgucuucaaaaaucaaaaccaaaggcugugaccugggggcuggugugaaagagaacaucuuuacaaaucaaagccaaagcccgugacccuggggcuggugugacggcagaggcccgacuggcugggcucuggagcugccugggcaccggaccacucugugaccuugggccacucccucuccggagcuuggcucuccuuugagaaaaugagggaugaguccagaagccccuucccgauggaacaguccgggccucauuguggaaagacgaaguggggacaggccagugaugugugcccaaagccucgauucuuucugagaaccauccgccgcucuccccaccgaggaauguuacucagacgcugccaccgggaugaggcagccggaucucuccugaccauaaauagcucagaaucucuucaccaucuauugcuacggaguuuggagaggaacauuuggcucuuucagaggcuguccccaaacggcugaggcauaugggacaggucacccuacagagucagaggacaacacauccgugcuggcugccagaugcacuuugcccuucagucugugacaguugaguguagcugggacucucugcucucagcugcaaggccuggccccugagggcacccaagaaacuagggggaaggagcccaaccuccugggguaaauggggcuggucucugcugggggugccaccugcccucagacccaggaggaggggcagaaccaaacagccuccuucagggccgagagcacugagagggccgccuccugccaggccccauggagcugggagaaugacaguccccuuagauuaagccuacccugcuucuggaggcgcaaacuuaacuucuacccucuuccccgcaaauuccauuuuaaaaauacuuuugauuuucaaaacaggacucaaugauggacaccaucccuaaggggggaagucuuaugggcugagcuugcaggccaguguagagguguauuaugaucuuuaaaauuucacccaguuaagaagaaagcucucagcuguuuacauuuuaggcuaauucugggccuuuucuugcuguaguucccccguccucagcaggaggcagcucagagucaucgaaugccuucgucacagauccagagacaaucagaaagaggagaaucugaggaacugccuaggcacugauuaccccuuccauucuagagagaaguaaccugaggaucagagagggagagaaaccuguccaaggucacacagcaaggcagcauggauucuggaccagaauccaugauuccaguguccuuuucucuucucaguucauagcuuccaggaagauaugcuguaggccuugguaagauggacuaacucaccccaggagcuuucaaaccauauaaacacauugacuucacuaaaagugagcccaacugaugcaaccagccuuucuuuagcuuaauucccaaaugcaacugccagcugggcuggucccuggacuucucugguauuuagggauuuacuguggcuaauaccaaagaaaggcuccuacagaggguuucccuguaccccaaaacaccuccucagauucagcaguccugacauuucucagaguccuggagcucucccuccugcuguauuuccacagaugcggugggauucuucucauguauuuaggagcagaaaggcagguaggucaguggcagcagcuuagcccaagugacuauggccauuucuuaaaaagucagccugcugacucucaggcaugaagcccugacugcaugcccagcccugaugucguuaacuggggcauaaucuucccagccaccuggcauggggguguaagcacucaaacucuggcaugaguuugggcucuagcagccuguuauucccaggacuggcaccccaaagaaucagagaaguggaaagugagccccgggguuuacaaacaagcuuccuauggauacaacaucaucucaccuaagucacucugaaagucuucaaaguacaaacaaaaaggcuaucaggaugggcccaccauggcugaugugucagagacagcaggcgaucaugggaaaggaguuggcagcacugguuauccccaaagggguuaacaacaacagaugaaaucaacuccagauagauccagauuucaaaugucaacaucaaaacuuuaaagcuuuuaggaaaauaaugcugaauauccuccugacuuugagauagggaaggauuucugaaacaagacuaagaagugcuaacugugaaauauugagaacacugacuguauuaaaaguaagaacuauucaacaagacaucuuaaagaagcugaaaagcuacaaacugaaaaauacaagauauuugcaacauauaaaagggaugaaggauucuuaucaagaaaauauaaagaauucuuacaagaagaaagagacaacuugacagaaaaauggacaaaagacuugagcaggaggcugggcgcgguggcucacaccuguaaucccagcacuuugggaggccgaggcaggaggaucacgaggucaggagauggagaccauccuggcuaacacggugaaaccccgucucuacuaaaaaaaauacaaaaaaaauuaggcgggcaugguggcaggcgccuguggucccagcuacuggggaggcugaguaggagaaugggaugaacccaggaggcagagcuugcagugagccaagaucacgccacugcacuccagccugggcaacagagcgagacucugccucaaagaaaaaaaaaaaaagacuugagcaggaaagaggagaaacacauggccaauaauugcaggaagaggggcccugcucacccgugaacagggaaaugcuggugagggccagggucagacacccuuucauccucacucaacuggcaacaauuaagaagucugaccucaugcgcagaggguggagacccuggaaaucacuuaugcauggcugauggguccauaaauuggccaucacuuuggaaaacaacuugaguuaacuuguaaaaaugaauauucaugagucucauggaauccaguaaagacaacuacauuugcuaugccucuuacugagaggugaaauccaguuccccugccuucuaauccagccagccuuggucacuugcuucaucaauagaaugugguaggacugacauucugagcuucuggguuggcucuaagaagccuguaacuuccacugggugucuggaaagcucacucugggagcccugagcugcuaugccagggaagaccaggugaaaagaccacaugcaaaggucuuagccuccacagggagaaagaggcccaggccccuucaggccggcuccaaggguccagcccucaaucaucucaucucaggucccgagugugguggaacaaaucagaguuaccccucugagcccgacagcaacacccaugaugugguugugugggaugguuuguuucacagcaguagauaacuggaccacccagcaagcacugucuccuaggagacagacacaaagaugacuauucugggcaaugcuguuucuaacacaaaacuagaaaccacugaaugcccaaaggcagaagaguucggugaauggugguagagacccacgggggaauauuacacagcugcgaaaauugaugaacucuagcuacacaucaaccacauaaaugagauuuagagacacaauguuaaauuucaaaagccaaccccagaagaccacagaagggacaaaacauuuuuuauacaguucaaaaacaggcaaaaaguaaacaagguaguauuuaaggaugcacuuauaagucauaagacugaaauaauaggagggagauguaagcacaaauucaggguugugaugaccuuugggaggugggaaggucggggagggacagagaagagcccguggcagacacaguuaauugguaauguccuaguucuuggauugaccagcaggucaugggcauuccuuguuagaauguuuaaacaaacacucuaaaguaaacaacaacaauagugugucaugaacugaagauuauaauucaucuaauuacucuaauuccuccuuuguuuuaaaugcaaacaccugacuacacagauaauggagguuccagcccaauauggccucggagguggccaagaugccccugguagggaucucccgaauugaaugauggagagugauguugucaucaaucacccgugugccaugagccccacaauccaggagagcugaggcacaggaaacucacaccauaaaggcaaccuuccccucccacaccccaagccaucggagucgcugagcccuguguuuuauuucaccauugugugccuaccacuuaacacggaaagauauuacucaugaaagaugaguccugaaaggaaaguuugggguuuuauuauaccucugggcuagacugggcgaucuuugaagaaguaagguuguacccuuuucauuuccuauccacaggacaauauuuuagccaugcguagggucagagaaaaggagagagggcuggcgcugugugaugcucuguaggacuggugcccacugauugcagagggcacuugucucaggccuuaauaggagcaaggaguuccgugucugauugauggucccagggaaaguggaaaaugccucuugaaggccaggcaugaaguugcagaaaacaguuggggaggugaauaguuugcccacuggccagccagaccugggagugcucaggcccucggccucaagauggcuccaucuucagcuaccugaguuucuggucacagcucuccaaugaccuccugggucucuuagacaaggucuucuguucuauuuccuucuucccuauucuccccuuauuuccaauauuagggucaaauuacuugcucucuaacauggcuccagcccuauguucuaggauucuaaguguuguaggauuuuaagauguggggaccacucuucaagggccaccaugggcacccugccaugaugaugggggugguuucuucccaucccagaccccuggguccucuagcccugcuucagucccagucucacuccuccaggcacaaccugagccucaauucccacacaggaaaccauuuagcagggaaaggacuggaauccugcugcugugcccccaugauggcucaucagggcaauccuggaaccaugagaggaaucgccagcugagucagugcuaaaaggguggagggggacugccucucaauccaggaagcccaggggacccccgggcucugcauccaccuugcugccucuggacaggucguggagccuggagcucuucugaggucaugugggugcagcacccugcccuccacccuaggccaucugagaccugggaccgcucccagauauugcccucaagaggcagacuuaaaagagaccaugcccauuuauuuucaaugaggaaacugcugugugccucaguuucugcauuuguaaaauacagugauaauggcaccuaccuucuacggucaguaugaagacucccugagguauugcacacaaacagcuccuaggccagagcaggccccacuccauggugugcuuacacucagaaggauucuccucacuguuaucugcccuccagcaugaugggcccuggugggggaggaggcgaggaagaagagcagccuggccugcccuccuccccaggaggccagcuccuggagccccuucugaaacuuaauucucauuuauccuauggagacuaagacagucacgauuuugaguucuguggagagagaaagcacuggacccuggccaagaugcugagcccagacugucugaagauaacgcacacacagaugauguuuacggcagaacaaucaugcaggcauuaggcugguggcagccaugggaagcccgggcuggcuggggucaccaccaccccauggcugggcaaaugccagcuggggcugcuuucgucgucauuugcaggggagccagcuccaggcugggugacagcucaauucagagccccaacaagagagcuuggcauauucuuccuuaccagagacaaucucgcaccuacuuuguuugcucuuagauaucaaacagaauggaaauauuuucguuucacuggacaggaugacagcugugccccaccuccuggcgggugucucauucuucucaggcugcacaggcuggucaccugcuucugugggugggaagagaacaguggcuccacuucucuuccucauggcagcccccaccugccaaccaccagacacuccucagcaugguccccacaugccugggaaggagcucuuuccuauuccagccauggggaagcuggaggccuugcacagcugaaaggcagcuccacgcccagcaaacaugagccagagcucagggugcaggcugcccacagcccuuuaggaaauguuccaccucggagacccuuuguggucagagagcuggugucuugaggcagugugauggagugccaucaaggcugugucuuggcauggccuaagaaggaaggucuuguaucaugaaaagcacccuggccagcccaggcuacuuccuuccauaaauauacagccuaggcuuaugaauaccauauuuuuaucauggcguucacuccuuugguuuguggacuacguauggguuuguucauggugugaacuccuugagaacagaaacuguguccuguccuccacugaauucuuguggucuaauucauuguuuggugcagaguaggcucugaagucauguuuuugaaugagacaguguauggauggauggauggauggauggauggauggauggauggauggauggauggaugcacagguggaaggauacauggcuagauggauggaagaagcaaagaaugcaugaauagauggauucaucuaucuucagagagauaaauuaaugcauaaauggauaggugacggauggaagccaggaaggauggaaggauggaaggaaggaagggagggagggaggcaggcaggcaggcaggcagcacauuagcugcucauaggagaaagcaaccauuugggaaagggcuacuuccugggcccuccccuagucuuggucucuccauagagacaugucugcaucugacagggguccugcuucguauugcuccucuggggaaucuggcugcaugaagcacuucacaugccuuuuccuggacacaagcauaagucggggguaggcuagugggggcaggaagaauuaagccucccuccagucuuaccuucuccagggcauuuuuccagagaagagaaaaugacaagcuacaacaacaauuggcacacuauaacugugggccaaauucagccugcugccuguauuugcaaauaaaguuuuaugggcacacagccacauccauuuguuuacauaucgucuaugggugcuuuuguuccauaacagcaaaguugaguugaugcaacacagaccauauggcuggcaaagcccaagauauuuacuggcugguucuuuacagaaaaaaauuugcugauuccugggauagaguguuguuuggggcccuaucauuggcuaugggacccugggucagguucugaaugucuguuucccacuaugucugcuggagacaagauagaaaaucaagaugccuagaagagagugagaugaucagcugggugcagugguuuaugccuguaaucccagcacucagagaggcugaggugggugaaucacuugaggucaggaguuugagaccagccuggccaacauaacaaaacccugucucuacuaaaauuacaaaaauuagccgggcaugguggugcacaccuguaaucccagcuacuugggaggcugaggcaggagaauugcuugaaccugggagguggaggugagcugagauugcgccacugcacuccagccugggugacacagcaagaacucuuucucaaaaacaaaaacaaaaacaaaaaaacaaccaacaaacaaacaaacaaaacagagugagaucagcaugaacgugcuuugagaagagaggaaaaaaacucagaauggccaagcagggcaggaagggcuuagaaggagacaugccugggugugcgucuuagaccugccacucugggcaagucacucauccucucugacacucaucugaaaaaugaugacaauaauucugaccaaaugucccuccuuggagagggcuucccugacugcuguaucugaaauacuccacacucaccuagcuuugucuuuuguucuuuaaacagcuuuauugagauggaguucacauuccguacaauucuuccauuuggagcauacaauggaguggcuuuaguauauucacggaguugcacaaucaccaccaugauacauuucagaacauuguaaacuuacuuuuugaaauacacaguaugguuugggucugugucccugaacaaaucucaugucaaauuguaauccccaauguuggaagaggggccuggugggagggggcggaguucccccucgcuggucucgucauaggagugaguucucaccacauccaguuguuuaaaaguguguagcgccucccuguucucucucauccuccugcuccaggcauguaagacauaccugcuuccucuuccaccauaauuaaaaguuuccugaggccucuccagccaugcuuccuguacagccugcggaacugugagccaauuaaaccucuuuucguuauagauuacccaguuucagguauuucuuuauagcagugugagaacggacuaguccaauagacaucacauaaaauucaccauuuuaaccaccguuaagugcauguuuugguggcguuaaguccaucuacgcugcacaggcaccuuccccacuguaguuucaucaccuuauccuacuuuuuuucuuucucguggcacacacaccaacuugaaaaucgcugauguuucaguucuugacugaaugccuuucccaugugcacuccaugagggcagggcuuugucuuguucacuaucuccaacacuuggaagagcaucagggacauggcaggugcucaaucaauauuugaauacaugaauugaugaugcauugacacaaggaguccauuccugcguacauggugggcuuuauggaaaagcucagcgaugcuccuggugcacagucuguacucaaaggcagacggcuccaaacccuccagaacuaggccaaucccuuugugccagccgugucccggcccuacaugaguagccuucaucccuuguuaccuggcaugacucuauagguggcauugucauugguguacacuuguuucuguggaagggggugcacucucuucuucugcauccuucuuucugggaccuaacgggacugggugcugggugaguaccaaagcaggagggagacugaggugucaagagcagaagccccaaaaucuggaggaggaaguggcaccuccaucucuguaagagucaggguuccccagcaaaaaagaaccaauaggacaauauauauguaguccuauuguguguauauaauauauauguacauauauguauauauguauauauguuauguagcuauauauaguauauauacacauauaauacauauauauauacauguuuauuucuaaggaauuggcucacacgaucuauuguggggacugacaaaucccaaauuuguugggcggacaagcgggcuggaaauucggguaagaguugaugcuguaaucuugaguccaaauuccacuaggcaacaggcuggaaacucaggcagcgcuucuagguugcagccuggaggcagaacuccuuuuucuuagggaaaccucggucugcucucaaggccuuucccugauuggaugaggcccaucacccacauugugacuggaugaggcccaccgcccacauugugauuggaugaggcccaccgcccacauugugauuggaugaggcccaccgcccacauugugauuggaugaggcccacugcccacacugugauuggaugaggcccacugcccacacugugauuggaugcagcccacggcccacacugugauuggaugagcccacggcccacacugugauuggaugaggcccaccaugcacauuacggagggucaaccacuucccucaaagucugcugauuuaaauguucaucacauuuacaaaauaccuucacagagacaucgggacugguguuugaccgacaucuggguaccacggccgggucaaauugacagaugaaaugaaccacugcaaugccuaucagacacgcccucuccuaaccucgcaaggggugcuuaccuccccucaaaggaagaggacgauguggcagucggguggacacagguccuuaguccccgucccccucacaaggugauagguauugauggacuggcucuaagccaggccuccuagaaccaccaggccacuacggacucaccaacauucugcucaaucaucugccguaaucugccuaagcaacucccccagagaggucagaucacuagggaucguauucaagucauguauuaguuauugcucagaggccucagggacauaaaucaacagaaaagcaaaaaggcuucuggaccugccaccucauuuucuuucuuccuggaugggaccuaggagcuaugauccagaggaagauagggagggggccgcuggccuugaguuccuuggcacacauguggggacuccaaaggacaggagugaggaagauagaagggccauggccuucucccuguugcuggccccgagagagcucugugaaggaggcccagugguuagcucugcaggggagguucccagcccccugcccaccucgggacgugaaacagagaaaugcgaucaaggagucaaggccuccugccagguuccucgcccuggccuugcugggcuaggcucucugccuuucauuucucaacagaccucucugcaccugcucaacagucccaagucauuuauguaacaagcccugugccucuucccucugcuaaguguccucucccugcccaccccugcaaucacacguacaugcuccugagaggccaggguggucauggaagcagggacuaugggccaggaaacuugcuccguucuggaaggauggccagagagaagcugcuuccaccagcuggugcaucucaucacccccaagucaauucgccuggucuggguuugcaaguucaugcuaaucaugacuccuccaagccaggaauccauggcaaagcccuaccaggcagcucugggcugcagagauggcccaacugaauagcccaggccucugggcgcugaugaacacacgugcucuccaucacacagccccaggccacagccaguagagcuccuggcaucucagggcuucaugggggaccaggugggcucacucacucacccacacugugaacaacacuguccccaugcaucccuccccaacacccaguccaggcaggccauggccaggcagagggugagagcggccacuccagguggccaauuugggucuuuguuuuguguuucagugggauaaugaaugaaaaauaaaaucacaggugcucaggagagggcugcuucuugggcaggaaagccgguuuccagagucgaugagccggugguuacauuuuaauuaguuugauaaauaauuaugccucugagacacccaaucugccuuacaggcucucuuccccaccaucaauagauuaaucuuauuuaaccacauuuuacuuaguacacaaacccguguucuguguuucaaauaccaagguugcagaggucuugguuuuugccuuuuuuuuuuuuuuuaacguuaucuauaaacacaucuaccuccacugacuggcaaaauuccugcacuguaagucagccuggcagauuccacccuggaggacacacgcgugaaugcuauuugcccauccucucugaguauaaauccuggccucacucuuccucugugugaaagcccugccuggguuuucuccccagagcgagauguauauggcucucaggugcagacccaucuuuuuauccaaagcacugggaagccucaagcuggagccucagcuccagggcaucaggcgggaaguuggcaauguucagggccgagaucacucagcugcuuugacgggcauccccgggacugcugacgucccaaggcacugacagguggcugcugaguaaacggucauuugaccuauauguuuguuuugauaaaugcccgauaggaaugugcuacugguaaauuucaguucucaggaaagauauugauacccaugacauuccucauuuccucagcuuugcaaggcaaaccgggauuacccugaaagucuaacucacugaaaacuuggugggaacuugcacagaagaaucuaaacaaaaccccagaaggguagccucggggucugacaccccccacccccaccccccccccccccccccacacacacacacacaaaagcugugcugccaaacaagcccucuucuccguaguauauagguccaguaaagucauagcaggggugucucagagccuggauuugguuuaaaaaaugguuuguccuaaagggaucuguaugagcuucagcaagcagauucaucaguuuaaauuguccgcggagugcaaaaugagagcuuccuccuaagucaugcuaugacauguucuaguuaggaagggagcuuucccgcacuccagaugccaggugauaagaauuacugaugcauugcuuucaaaacaguugguuuuauggcuuggcagagcuggcucucagauucugcugggcuucauuugcauaccgaaugacagccuaggaaaaggcgaccggaaggccucagacaccgucagccucuuccaucucugcugccaguuauaggucauuuuaaacuaacaucuggugaguauauuuuuaaaccguaucuguagcuuuaauuagggaucuccugggaaugucaggggaggaacaagagagacaucccccgggggagaugaaaacacuggcaguuccacacaugcaaagccccggaagcugccuuggcccaguuuuaugacacuguauguucaacugugauaggggagcccuuugcacaagaagaucuuaauauuagcuacaugcuaggguaagcagaaauuccguuuccgcauccaaaagaacugacugccuccaggagguggcuucugugcccaagauccaagagggguuuccccuuacgcagccacagaaaccaaaacugucccgaaaauguugccaaggaauggagaggucaccuuaggacccuccuuccaagaguauuugugaugaagaacuagucaagggcuccucugcccuggcagggagagugauuuuuuucccccuuucuuuuccaaaaggacaauucuggaaugauaccucauuacaugugacagacuuuacuuuccacguagaccagugcaauuuaauauucuucuuacacguguucauuucuuucagcgauguuugagaucuaaaguacuauuuuaaaauucuguaaauucucagggauguauauuuaaaagccagauuaaaauggccuuuccucuccuucccacuugccuggcuacgugacacaauuugcccacaucaggcuggagagcagagagccccaggagucuaaagagaggcggcccugcugcuuggcaguuuccaaccccaccucuuuccuugauaaauguaaguaauaaaaaaaaauuccuccauuucacuggaaugcccauuaaaauguaaacacagagagaggauuuugaggaggcuacaaaaaugcuuuauucaagagacugcaaacggcaaagcaaaucuaaaguugauuuuuaaaccuaguccgugguauguaaauacaccaggcuccacgccccugcaaggcacacagaucaccgggaugcuuauuggagaaucugcaacauggcggaggcuguaaccccagccucccuagaagcugggacgacagcagcauuuaagccccucagccuuuuccuuucacaaaguugucuuccuggauccaauaugaagauccaaugccuuggcugcgcauggcaggagccccugacauuucucacugccgaaauguaggaccucugccgggaaaucucccagugcaaagggaauuucacagcagagagaacgguguguucucuccaccuguuccaccugugaccuugcaggaaggcgugccuaugcgaucaucacucugcagcguggggucccgugucagauccgacuccccugcgggucucucccucaccggcaggaaugacaacuagguucaacucaugucaauugccaaagcuugcagagcccaaccucgacagggaagcucauaaucaccugagagucauccucugacauguuugcuaucccuguccaaaaacugcagagaagggcgacaucaucaaguuuaccaucaaucaguuuagcuccugaaugccagucacugggugaccugccacuaggacuaaagaggauucuguugcucaugcccgcuggagugggugcagcaauaaauggcugaggaaugcaaggaaacagaccauaaagggcuucacacuugcccccucucauggaagccaacuucuuccaccaacucuccauagugugacaguccacaacagaguggccaugaguccacugugaacuuaucaagccuacggucagcuuucccugcaccucucagcacacaagcucacgcuucgugcaaccauggggguugcaagccuaguaauggguauuguguguguguguguguaucugcgggugugugcucauuucuauaaacuguaaguauauucuuuauuuuuacugccugcuuugcucagccugcagacagcacaaagaucaucagcagccuccuaaauuauggauuggcucaccaaguacacugugucgcucauuagcgacaucaccauacagcuccacacaacaauaaauuaaguaacacaauggcugcgggaaaauuaggugaauaauucucacguuaaacuaaaaaguucuggaugucuuugguuucuuccgggcugcuccuaagacaauacagucccgugaauagacaacagacaggacucuaaauuccaaggguacaauucuucagagcgaguuaggugugguuuacauuaaaaauagaaaaggcuccugcaaacagacuuguauuuauauagaauguugugacaacugucauuuuacauuagucagagaaaucccacaggacugguauaaguauuaaauguggccauuuuuuuuguuuaccgacaaaacauaauaaaaagaacacagccuccuggaugacauucuggaggauuuuuuuucuccucuuuccccgaagucauucauaaaauaaacauguguucccaguccucgcuggccuucuuuaugagucuccugacagggaacucagagugacuggcagaucggggcccccucagaggccccacaccagcagccccucuccagaccuggugcacucuugcugcauuuccauuuggugcacaaacaucaacugugaagcaugaucccagagucucccuggaaccguguaauaaggauggaguuacaggguuucaguguggacauuuauguugugggggaagccaaucuuucugcacaaacggguuggggagaggcgucuaagucuugaaucccaaauaguuugucaugggccuccugcugucaaaauacaaagaccucaaaagagcucugugggaucauccaaagcagaauaagaaggacgagggacauguaaguuacccagagucagcagcccucaauggccaccuuccccauguccccauccauugcaguugagaaggucaaagagguagaaaaccaagaggaacugcugacccaggcaugagguuaccugucuugcugagcacaugguucugaccacggucagcucucuagggggugccaagggcagagguucucaaagcauggccaggggguucuagacccugcucauaauaaugcuagcaugugaugugccuugugugugcugcagcauuuuccagacgccacuggaugugaugaugcugauggucuggcagcucauggaaugugcagugcuuguguauucucuuguuuuaauuuuccucaguuuuaaugcaaauacagugaauauuaggagauguaacccacauaaucaaaagaaugcaauaaggauggagcuuugugagauccucauucauuuuuaagcguauaaagggguccugagacccgcaugagggcugcugcugcccucagggguaccuggccaaaccgaugauggccccauaggcucgcucuccucugaaagucuggcaugggggaccucacugagguguuuuguuuuguuuuguuuuuugguggagucucgcuuuguugcccagacuggagugcaauggcaugaucuuggcucaccacaaccucugccucucagguucaagcaauucuccuaccucagccuccgaguagcugggauuacaggugccugccaucacucccagcuaauuuuuguauuuuuaguagagacgggguuuugccauguuggccaggcugcucuugaacuccugaccucaggugauccacccgccucggccucccaaagugcugauuacaggcaugagccacuguacccgacucuaaccccaugaaccaaacacagccccagccucccaaagcccuacgauguggccgcagccugacucugguggugugacuaugaggccagcccugccugcuucccccaguaucuggcugauaggaugcacacagcuccugcgggccaggcuucacugucauauccauucccugcaucaaagagagaaucaacacagaaaaccauguuggcauuuaauacuuuuuucucuuauaacuuaacagccaguuaguauaaacaguugugauugaaccauugccugauauuuuccaguacauguucacauguccuggguaaugucuuuaucuagaauucagauauccgagacuggggucaacucaaaugugcaaugaaugauuugauucaaugaggugaaaugccccaauccuguugggguucacccaugguacaugugggugcuccugguuccucaucucuggccucaacucacauuuggguccagaagaauccucagaagggggcguacacuccauuucccagccaaggaggaggaugcuaggggagcuccggguaggaaaggcacgacaaacgugucucuuccccagcagcagcugcaccgucaggccucuuccugccgcgugguccaaacaagagcgggcugaauccggguccugcgacuauuacaagccugugcugggggcuggccaucuggugucuuggacccucuguuauuucaccauacuauauucccaccucuguaaguugcucuguggaguagagaucucacgugcagagccuggauuucagccugguaacaguuggcacucaguacacccaaguuucucucccucccuuccugguaguaauggcucaagguuaagcaucacgaccaccaguccuaucuccaugucugcugccugccuagaagcccgagagaaaguguuggggaagaaagaagcagagggcugaggugccccaagaacagccuggaaaucuaucuguggccguuguuacccaugagcaugggccuggagggucugugggagagagagccuucuuacugcauaucuuuuuguaucauguguauuuuugccaguugcguauuuucauaauaauaaaaaaggaaaaacccucuuuguguugggauaaucaucauuaaaugggauuucauuucauuaucuguaaaagugauaguuuugcaagccuuagcauuauagaaccucaguagcaaugaauuugggguuacacauagaagagaugggguaucgcuucuguaauugaacaaucuaccucccucaucucaauaccaucacacacguaggguauuuauuggaaaucacuuuuucugaauggucuguggucagcuuucagggagaaauggaccucuaagucccuucagcugucaggucucagauucuagagagauuagccacgggagaaacauaaaaaagaguuuucagaaaaacaaagccugagagcaaagcauuuuuggucauaggugagacaauuugacauaaauuggcaaaauuuuaaaagaauuuuagaaucucuugguucuaagcuuggugucaaauuuuggaauuucuuuccacuaaugaaaaacgucuuaaauuaagaaaaauaauaauuaauuuugaacacaccugcaacaucuuaauuggucaaaauauuaaauuuaauuguuuagaaaacauuuagucauaguuuguguucauccagggaaagaaauuuuguaacuccaacauaauuagaaguuacauuaaguuauuaauuuagagcuugggauuuuuuuuuucaagauguuacuucaacuucuuugacuuaacacuucuaugaccuacaguaaagugaagauaaucacacucuuuggauuuuuaagggcagauuuaggaaggaugaagaugcauuaaguggaguuaaggcauuuugauuuugucucuggugcagcuuuuggagugcaaggucauaagguaaaaauaaccaagcacaugaggacucaauucuccauaugugagaaccagcacaaagaagaaaaguuaagaaucagaucugccaagacucagauauuggaauuaucaaaaacauaauauaaaauuaguuuguuuaaucuguuuaaagcaagaaaggaggaaaaugaaaguaugauaagggaacaagagaaucuccaaaccaacaaggcagauuuggggggaaaagguaaauagaacuucuagagauaaaaaauacaauaacuaaaauuuaaaacucaguguaaagaaaauacuagauagucaaagagagaauugaugaguuaaaagacaaauaaaaagauauuacuaaggaagccaauacagagagaaaauguugaaacauauaaaauagagguaaagaugcagaaagcagaguacaauacaaaugaucugacuucaagaaggagagaaaaacagggcaguggugauaacugaguuugucugauaauuucuauuuuuuauuauuuauuuauuuauugagacagggucuggcucugucucccaggcuggagugcagugacaggaucucagcucacugcaacuucugccuccugggcucaagccauccucccacuucagccucccaaguagcugggacuacaggagcauaaccacuacaggagcaaaagaauuuuuuuuugcuuguaagaaggcauuuugccauguuucccaggcuggucucaaacuccugagcucaauccgccugccucagccucccaaagugcugggauuacaggugugagccaucaucccgaccugucugagaauuuuuagagcuucugaaagacagccagccaccaaauucgagaaggaagcccagugaaucccagucaggaaaagcaaaaacaaacccucaccuaguacaucacagugaaaauguggaacacaaagcuagagagacaaccucaacaggagucaaagagaaaugacaauuagaaugacgacugauuucucaauuguaacaauaagucucaagagacacuggacuaauauuuucaagugcugggagggaaaaaaaaacaaacaaacagaacugucaaccugaaacuguauauucagcaaaacaaucuugaaauaaugagaauaaaaugaagauauuuucaauaacaaaacaaaaccugagaguucacuuucaacaagacuccagaaaggaagcuucucaagaauauacuucagggagaagaaaaaugaucccagaaggaaggucugagauguaagaaaaaaugaugagaaauaaagugguggaauggagagaaaacauaaacagucccuccucccaugcaugagcugugcuccuucuuaccuaaucaaggacauuccuccagcaguauuccugccugcuguauccuaauauuaucaauauuccacucccuaccagaucauuccaaccugcagggaaacaugcugcuauuucuucaaucuuaaaaaaaccuucuccucaugucuccaacacuaccaccuuauuccuuugcuuuccuugcaguuaucccuaaaaacagacaucuuuacuuacuugucucccauuucuuuccuccuggucuuuuuucuuuuuuuuuuuuuuuuuuugagauggagucucacucuguugcccaggcuggagugcaguggcgugaucucggcucacugcaagcuccgucucccggguucaugccauucuccugccucagccucuccaaguagcugggacuacaggcgcccaccaccaagccuggcuaauuuuuuuuguauuuuuaguagagacaggguuucaccguggucucgaucuccugaccucgugauccgccugccucggccucccaaagugcugggauuacaagcgugagccacugcgcccggccuccuccuggucucuuuuaaaucaacuccaacagacuuucccccccgccuauccacuuaacuacuuuugucaaaaaccuccucauugcugaaucaauggccaguucucagggcucuuugaaugugaccugaagacagcauaucaccuccuccuucuucauccuuuuuuguucgcuuggcugucacagugcacuucuccugagggguccuuccuaccucauggucauaucuucucuaccugcuuuccuggaccuccuaugucccugacaagccucagggcugauucugauguucuuuccuacucacucccucauuguauuaguuucuuggggcugccauaacaaagugccacaaacuugggugaugacagcaacagaaacauauucucucacaguucuggaagucuuaagucugaaaucaaggugcuggcagggccauguucucucugaaggcugugagggagaaucuuuucuuaucucguuucaggugcuugcuggcaacacuuggcauuccuuggcuugaguugcaucauuccacucucugccuucaucacuucacguuuuuuccucuguguaucuguguccaaauuucccucuuccuuuaaggauaccagucauacuggauuuacagcucacuuuagucugaccucacuuuaacuugauuauaucuacaaagaccuuauuuuuaaaugaggucacauucacaggugcugggacuuaggacuugcauaugucuuuugagggggacagaauucaaucucucaacuagaaguaccacuucccugcugaugacguacacauuuaucucuccagcuuugcuuuucuccucaacugcuguaaggcagcucucugcagagcuaguggagcuaaaguuucuggcccucccuuguauuugguuuuuauguaauuuuauguuuuguuccuuaaagaaggcucucaaaauuguauaagcuuaagguccacaaaaccuggaucugucggccaggugcaguggcucacgucuguaaucccaacaguuugggaggcugaggcaggcggaucacuugagcucaugaguucaagaccagucuggccaacgugaugaaacacugucucuacuaaaaauacaaaaauuagccaggcaugguggcgcacgccuguagucccagcuacuugggaggcugaggcaugagaaucacuugaaccugggaggcagcgguugcaaugagccaagauuacaccacugcccuccagccugggcaacagagcgagacucugccucauaaaacaaacaaacaaacaaacaaaaaaacccaccaacaacaaaccaaaccuggaucugcccuugaaaugccagacuuggggguccaguggccccucugaauuuuugaggcaucucaaaugcaguauguccacagcagaucucccaugcuuccuccaaaacugcuucucuuauagcuuccucaucucaguuacugcccacucuauucuucuaggugcucaagacaaaaacaugcagaaaaaagcuugacucuaccccaucucuguuccauuaggaaaucugugccaaguccaagaccccuuucuccccauccaccuggcuacacccuggagcaagucaucaccaccucucuucuggguuacuacauuagcauccuagcuggcccugccacgcuggcuuccuugcugucuuugaacgugcucagcaugcuccaguuuaaaacucuguacuggcugucccuccaccucaguguuuccccucccaggcagacauggcuucuuccuggcacccuccagccuccauucaaggccgccccugagcacuccacagaaaacugccauuugcauucccagccucccuaucuuguucuaccuuuuucucccagucaugaccccuucugauaucuucuaucauuuccucguggauguuuauuguuuagaaucugucaccccagcuagaaugucaaguccaugaggguggggaccugugccuucucuguuccuuguguuuccuauguuccuagaacagugcguggaauuuaauguugaauaaguaucuguugaagggaagaauggaaauauuaauuguguaaaaugauaaugauaaugaugucuauuuuggagggguauagaaaaucaagauauaaucaacgucuucacagaaagaacacauuaguagagugaggaaggccuggguggggguuggucauggauuguucaaaaggauggucaaacuguagauuaaccuuaggcccuguuaagguaccauaucuauguuggaauuucuaagguaaccauugaaaaauagaaauaaaggauaucuucuaagcacagacuuuuuuuuuuuuuuuugagauggagucucccucugucacccaggcuggagugcaguggcgcgaucucgggucacugcaaccuccaccucccagguucaagugauucuccugccucagccuccuaguagcugggauuauaggcaccugccaccacgccuggcuaauuuuuguauuuuuaguagagaugggguuucaccauguuggccaggaugagcacagacauuuuaaaauggaaaagggaaaaacacaaaacucaauugaaaacauggcgaaagaaggaaagaaaaaagaucacaugcaaaacaaacaaaaacacaacaaauggaaagugcuauauggaaaaaauaaauucaaacaaaucaauaauuacagccaaaguacauacauucaauucucaaaauagaagauuacuagccuggauuuuuuuuaagaaucuuuauauaugcuauuuaaaccuggaauagugaaaacacaaggaaaugaaauguuuaaaauaaaacaauggaaagagagagaucaaauacuaagcaaaagaaagcagauaaaauagauuucaaggccaaaagcauuacuagagauaaagaggaucaccauauugaugaaauauucaagaggaaguuacaacucugaacuuguguacacccaacaauauagccuuaaaaucuuuaaagcaacauagagcagaagcagaaauucaagaagaaaugggcagauacaucaucauaaugggaaaauuuuaauauacaugucuuagugcuugguagaucaaauagacaaaaggagaagaauagaaaagauuugaauaacacaauuaauaaaucugaccaaacauauagggcauugcaccacagaacauacauccuuuucaagcauacauggaacacauuuuggaccauaaaucaagucucaucaaauuugagagaaacuauauuucacaaagcacgaccacagggcaauuggauggaaauuuuuaauaaauguguccuuccuucauucaacaguuacuuauucaagaucuacuaagugccagacagugcuuugugcauuaaggcuacaacggugaacaaaagaagacaaucaucucugccuucaaaggaauguauguucuagagaggucguucuaguguuuuaguagcaggggaaauaacaaacagaaaauaggaucccaccgacucaggaggcugaggcaggagaauuguuugaaccugggaaguggaggcugcagugagcggagaucgugccacuacacuccagccuggguaguagagugagacuucaucucaaaaagauaaaaaaaaaaaaaaaaaaaaaaaaagaagaauaaaggaaauagaaucaucccaggcuagggguagggaguacuaaggaagcacaauuuuacaauuuuaaauugggugguuuggauuuccuuccugagaagguaaacucggagcaaagaccugaaggccaugggggagcaagccacauggauaucuggaggaagauuuuucuaaacaggauauaauggaaaucuccuccuccccauauauuuggaaacuuugaaauacuucaagaaagccauaaaucuuagaagaaauaaaaguaaaaauuggaaaauauauugaauuaagugacaguggugcuacugacccaaacuucuagaugcaucuaaaguaguacuuugaggaaaaaaguuauauacuuuaagguuaauuuuuuaaaaaaaggaguaaaaaacaauaacuuaagaaauagaacaaaauaaaacaauagacacaugggaaaaauugaaucaacacacaaaaaguagaaggaaagaaggagggagggagggaagggaaggggaagggaaaagggaaggggaaagggaggaacggaggaaggggaggggaggggagggaaagaaagagaagagggaggaaaggaaaggaaaggagaggagcugaaauuuaugacauggaaaacaagcauacaagagaagggaucaaugaagucaaagcugauucuuugaaaagucugauauugacaaaucucugguaauucuuauuaagggaagaagaagaaagguacaauuaaacaauauuaguaacaaaacagacacauaaguacagaugaaacagagacuaagaagauaaggcaauguuauaaacaucuuuaugccaacucauuugaaaacuuaggagaaauggacaaauuauuagaaaaaugcaaacaaccaagugugacucaaaaagaaacagaaaguggcuugagcauuuuacauccccaccagcagugucugagaauucuuguugggaugaugggauuggauggcuauugccacaguugcccauaguggccaucuguuuuuauaaauaaaguuuuauuagaacauagccacacgcauucauuuacauaccauuucuggcugccuucuacaaagacagaguagcugcaacagagaucauauggcuaguaagccuaaaacauuuaccaucucucccuuugagaaaauguucacugaccuccgcuuuacagaaagaucagaaacagcccaauuaaugugcaauuggaaaccaaaugagaaagccagggagccuucgauuguggggccgacaaagcccaagaccaagccuaggaucuaaccgaucaaguagcagagaugcaaagcagguuagacaggcaaccaacgcagguuuguuaugccagagucagacaccgggcucaaaaaauugauaacccccacacaggggauagggacaucugugcaaaugcccccaaauaauuugacuucuucagacucuuccaaaucuuccaggccugcagaagcauccaccccuccccuacuagagcuagcaaaccccugcucuagaaaacagugcagaggucucucuccugcaagguaacuggugccucgacucaagauauguucccaauuucccuacuaacuauugggccuaggguuacguggugguguaacccagcaggggaggugcugggccugauaagaaaggagaaggaggugcaaguucuagccaacaugugcuaccaggaaggagggaggauaaagggggauggacucugaggaagccuggucaagugggccugaccaaaaaauuggauagagaagagguacucuccugauguccaacaccaugguagggaucccuggggauggugugaacucucuacugggauggcuccuaaaauaugcaaaaagagaugcugaaaugucagaaaagcccugacagcuugcagaagaagggauuaaagggccuaggagcuugggcaugcuacaauggaucuaccauguaugcccagaauaccuggggaugagcauguuccacaggaaagaccaaacagcacacuguucuccagggucauaaggauugugccagugagagggccaagcaucacugagaaguucagcaguggcuccccucugcuggccagggauggagggcugacagaaggagaggcugacagagaaccugacuugcugauagcaauggugcaauaggaccccaaaacgguaaaggcuagugcuuaaccaucagaagucaggagccacaacuaccaaaaugagcagcaaggucagaguggcagccaacggccuuguugaguagaagaaaucaaaguuggaugccugggaggcugaugacagucacuuccauaaaaauucacaaucccuuaccaaucucuggacccaagucaguuuuuagaccugcaacuuguuggaaaaagagaugggcaggugcccaagagaaaggacccugcaauuccgcagcaaguacaugcaaugagcucauucccccauuccuucaccaaggggcuuacugccauuuauuuggguaacuaugcauugggaaagacccaaguauuuugaggaugguuuggcacagaguccaaguugaucugagacucagagaccccaggugucauuguaggcccccuguuggauuaggagccugaucauaaauggaguccugcccaaagucucauuacaauggauccacugagcccaugggcccaacugauggucauuuccucuucuugaauguguaacugggauuagccuucuugacaguugguacagccccacauugggcccuuggucugugagguacaugagggaaaaggcaagcaaaagucucugaaauuaucccucucaccaugcuggcuaagauagcaaaaaaaaaaaaaaaaaaaaaaaaacacacacagcacagcccagggggauaguggagaugacagccacccuuaaggaucuaaaggaagcaggggagugguccucaucaugucuuuaauucaccaacguagacccugcagaaaccagauggauccugaaagaugccuaucgacuaugguaaguucaacugaguagcaacccugaucaaucacacccaccagccagaugucuuuccuagaguggauuauuacagccucagauacauagcauauggccaacugauucgaugacugugaucucuucuauuucaaucagaaaacauuuucauucauacggaacagauaacaaucuucauuugcaauaaaaaacaaaaacucugagaaaagcuggauagaagagaacuuccucaaucugauaaagaauacauacuaaaacuuuacagcaaguaucguaauuaaaggugaauuauugaaaguuuuccuuuugagaucaagagcaagacaagaaugccuacaaucaccuuaccacgucuacuugauacugggugggagagccuacucaguguaauaaagcaagaaaaagaaaucaaagcauaaagaucagaaaggacugaauaaaacuuucauuauuugcagauggcaugauuguauauguagaaaauacccagaguacugcagauaagcuauuagacuggguaaauaaauuuagcaaggaugcuggguacaaggcccacacacacaaaagaauugcauuucuccguauuggcagccauagaauaaauaacaaaauuuuuaguaugccaaggaaaaaaaaaaugauuuaguauagcaucaaaaacauccacucuuugggaauaaaucuaacaaaagacgcacaaacuuuacgcuuuguuuuaagcucauugagagcaaggacuuuauuuugcucauuguugaaucuucucaggacuuggaaugcggcugacagaugguagcugcucaguaauuauuugcugaaugagugaaugaaugaaugauuauauccugaugcccaguauguguuuccuccuuacuagccauauuaguccauucuugcacugccauaaaaaauagcugagacuggguaauucauagagaaaagagguuuaauuggcucacgguuccacaggcuguacaggaagcauggcagcaucagcuuuuggggaggccucagggaacuuacaaucauggcagaaggcacagcaggaacaggcauuucacauggccggggcaggaggaagcgggguggagaugucacauacuuauaaacaaccagaucucaugagaacucacucacuaucacgaaaauagcaccaagggggaaucugcccccaugaucaaaucaccucccaccaggcccccucuccaacacuggggauuacaacugaacaugugauuugggcggggacacagauccaaaccauaucacuaucucacccucaaccuuccuucagaucuccauguaaaugccacuuucucaccccugcaccuuuccucugaagugcccaccacaaauguacauaaguaauuaaucauguagcuggucauucagugucugccuuccccccuccccuagacugaggacuccaugaaggcaagaaauguaucugguauaagaaguuucccaaaauauccuuugacugacuaguugaaugaacauuacccacaauucaauaagcugagacuccagucguccauuuucaccccaacacacacgauuucgugcugccuucauauguucccgguuucccuagcaguccaccuucacccaccuccauucccuuguucauucauucacugaauaugcccagaggcacgugcauguuccaggcacugugcuaggcccuagggauccagcaaugaguaaaacgcguggcaccagggagcuggcuuucauugguaacaugugaggcccugcagaacaaugaggaaaaucucgucugauugcagagaaggguucucccucugcaacauuuuaugucauccuccaaaauagcugaggaacccaaccauccucuccuguggaauucugauuugguagcucucucagcugaguggucaacuaagaaaaccccuuucauacagucagagcucauauuagcugugauucauuggauaccaagauggaggcgaaaaaucagaaauacguagcucuggucacauuacauuuuucuuuaaccaagguaagggucccuuguaaauauccccugaaaauggcugugaaacucacuggccuucgccucccauucccuguuaaguuguccagugcuauauuuuauucauuauauaccagguaaccacccaggagagagacuuccagccaaccagucacugaccaaguccaccauaccccagggaagccuuuacgggcugacccaaugccugaaauucagaaaaucuccaagugccaccugccacugcucagugccucccuguguuuguacaacuagcaaugcaggaaaauuucugccuuauuuggaggaacacaggccuguucucugagcugcaguaaauuuccagccagggauggggccucccugcuucugcacuggcacacugggcccugacgucagccuugccgucaucuucccccacccccuuucuuucaagcaugcuagcuccacauaccugcccauuuccccaggccauccauagggaaggcaccugagccaucagagccugggugguaggaagggccucaauaggcaaagcaaguacaucuccccuuggcuuaaaaaggaucaagaaaugugcccuaggcaggaaaggaacagagaagaucaauaauuuguagcucuggucacuuuacaauuauuauuuuuuuuaaccaaugcaagugucucuuauaaauauccccaaaaagaguuuugaaacuuaugcccucuagccccuuguuaaguugcccagggcuguguuccauucaggauaugccaguugacuggucaccgacacagggcacaggcucagacaggacaccugcguguggaugucauccagcucaaccgcuuccaggccugugccaucuucucugccuccugugucuaaaggcaucaaguacaacugagagagcaccgacaaagagucauugccagcucauuuucaaagcccuuugauugggaauuuugcuuagauaacaacacgagcaaacuuguaagcaguguuuacuguggcaagcacuguucuaugggcuagacacguauuaauucacugaacccucacagugauucuaucaucauuuccauuuugcagaugaggacagggagccacagagagguugagugacuucuucagugucacacagguggaucacagaguugucauccuuucaacagccacagcuaacagcuaacuaaccuaagcugcugccagcuuccaggucccagacuaagugauggggaagaucagagucaggugggcugucccaggaccacacgccuccuggggauucgcccuggccuccuuccuacucccgcaggccugcuguggucccuuccccauccuaggccuuccuucccuguacccccggcaagggagcaacuucccuucacaguguuggucuccagaggggcugugcucccuacagcagguuccuguccauccaguuccaagaacaggguccacaucuugauaguuuguuucugcaccaccuccucaccccuggcagacaggacggaauuugcuucgaaguugaggccccacauggccacugagugaacaaauaggugcucucuuacucucugccgcucucccauacacugcuguaccccauuuguauggggggaauccuaacucacccucaaguuucagcucaaaagccucugagaauccuccugaucuguccaggaggccucccccagagcaucuuccucccauccuaucugggcacggccacccuccccuccugaggaucucagcacaggcuguucgugugugucugccuccuccccagauugugaacucccugaaaacaaaaggccaggccuuucauuucugcaucccccagucuagcagauugcugggcauauaaacaucugcgacuaaaugaacgaacagaauuguuacgaacacuagauguuaauaguacagccaccuggaaaggauucuaugaaugguacaagcaacaauaacaucagcaacagcaauaaauaccacuuauugaguacuuaccgugcgucaagcauucugcugacuacuucacuuguguuaucucuuuuaaucuuuaaaggauccauaccaagugaauagaguccuuccaaaaucuauguucacccagaaccucaaaagagaccuuauuuggaaauagaggcccugaagauguaauuaguuaagaagaggucauaucagauuaggguaagcauuaaauccaaugccuggugucaauagaagaggccaugugaagacccagggaggaugacaugguuuggcuguguccccucccaaaucucaucuuggauuguuaauccccauaaucccugugugucaugggaggaacgcagugggagguaauuggaucaccgcagguuguuucccccgugcuguucucaggauagugagugaguucucaugagauuugacgguuuuauaaggggcucuucucccauugcuccacacuucucucuccugccaccaugugagaagguccaagcuugcuucuccuuagccuuccgccaugauuguuaaguuuccugaggccuccccagccauauggaaccgugagucaauuaaaccucuuuccucuauaaauuacccagucucagguagugucuuuacagcagcaugagaauggaugaagacagaggaggagauggcaugaaggcagaaaugcacagggagaacaccagagugcagugacgcaucuauaagccaagaacacuaaggaucacugcagccacuggaagcugggagaggccaggaaagauccaccccuaaaggcuacgagggagccugcccugcccacgcuuugauuuuguauuuuuggacuccagaacuauaagacaauaauuucuguuguuucuggcuacccaguuugcaauccuuuguuaaggcagccucaggacacaaaaacaagguccuacagaacagaauccccacaucuggcauuugaggcucaggaaaguuuaaagaguuguccauguugacccagccaauaagugauucaccacgguaaaagccaggccuguuucccaggcuucacccugagcugcugaaccagucuacauucagggaaagaaauggagaaggcgaaaaggucuucccucaucucuucccucucuuaggucucaaauccuuugcauagaaaagaaaaugccaagugaaguucugccuccccgacaaauagagucaggccaaggccuauccuuuauauccagacaauuuucuucagcugacaacaggaauaauguuucugcagcuccaagccccgaacaacccucucuccagcugcacaaaguccuaaggugcguggguagauucaacaugaacccugguccaagugaugcucugcaagucagcagcugccaauugcuuuccaggagaaggggcaaugaaauugagccuccagacauguucucauucacucuuugucuucucugcacccuucacugacccuugagucaaaaccccuucaacauccucaucccugcucucuuuuucacugaaucuaaucauucuucuugucaaugucucaaggucauaucuauccuucagccagagacagucccaggaugauuaaaacuuuuguaaucucuuugggacuuggaagaaaaguuagguuuucugguggucagaggcuguuucugccagaucucagaugcacagcaaaguacugucaggccuuaggggugguguaccugaagcugaccuccaugaauguagacuuuauguuccagagggggaacucuguaacugucagaaaugugaaagauuugucaauagcacaugaaaucagccaccucaauugugaaaccuaagucacgauuccauuugucacauggugauuuaaaagcucugcucuuguucuuuuucacagcucccucugucucuuccaucacagccuauuugcucacuugguuuagaauuauugggaaccaucauuuaagacacucagguuccaugauaaaaaagaguuaauaaugccuggacuggagauggcaguugggaaccacaaacagcaccaugauacacagggcaugaaucuacauggaaugcaaauggacugucuccacccacaaggauacauuugagagcauccaaaaucccaaacccuggggcucccauugcaaggcccucccuggaccccuuccaugucccacacugggagcuguggccuuugacccagauaauacagggugugcucacccagaacugcuguccucugcagagcuggcuuuggggaaggucaucugcuggaggacccugcuucaguacucaaacgguugcccuauguguagagaggaacagauuccaggggugcucuggauggaagaacagcaccaagugaccaaaauaacugguauauagacuucacauuugugugagaacuugcugguaacugaguuguucagccuaggaauggaucccucccgggggaugaacuuucugccuuugcaaauaaucgucucuuaagaauuuuaggguugguugccuggccugcugugggugggaaucuagauuccugaugcaaaacugucuucaaaacauguaaucccuggauucaguggcccuucugugccucugagagcucugaugugcccucuccgcacugcuuucucgcugccuuccaaggaugaccgauggcugcagcuaaguagcccaccuuccaaaccugccuuccagccuuuucacaggcacugucugucucccuacguacuucuuuccuaguaaaucagguuaaauuuauaaagaaaauuauaaggacaucuaagauuauugagggcaauuugauaauauguaucauauuuuaaaaauaaauauacccaaacucugacuuucauauaguggaguaaauaugauguuacuccuuuuuccuccaggaaauuaccccugccccaaugcuaaggagaaaaagaaaaauaccaauucuagguuugauguccagaaauuaucucuaaucucuuuuaacagugucuggagaagggccgaccaaugcaauaaaggucuaacaggguuacaggaagaucccuaacgaggacgucuaccgcugcagcucucaggcaaagccguggagugcaguucaucaaaacagugagcacaugccccgaggcacaaaaccaacaagcuucuguucagaaaaaugaaaacaggauucauagacuggcagcagaguaccgccaggacucauaggcugguccagggaacuggauaugggagagggaaagaggagaugguagagaagagaaauugaauugguaguauugucucugcagcugcugauuucuguuggcuggagauagggaaagguucacaaauacagacacagcucugugucuaaggaccuuuaugauucagaggaaauucauguuagccagaggcccuacccuagaucacaacccguaagaaauuccuucauaguaguucuggggggugggagagugggauccacuuuaucgaaagacaggaaucacaagaaaggaaccauaauccaauuaguauaaacacacagaaaaaaaggaguaacgagauagaaauaaauaaauguaggauacucaccaagaaaaugucauggagccauuaaaaauaguugaccaaacacuaccacaacuucaaacaauaaugaacaagugcuucuuuaaaacaaaaacucaaagcagagacacaaaagcucaggaaaggcacaaaaucacaucaaaggggaauaaaacaugaauuggcagagcucaggaaggaaguggaaaaaauaaauaaauaaagccaucaaagaaaagaaggcccuuuuggaagcagcccaaaggagaacaaacccugcugaaagucaguuagggacagagaggacagcaccuggaaagugagcaaaaguauauggaagcaguucugguuccaggcaagauggagugagcauccugaaugcagcuauaaaaccuggacugauguugaagcagcaaaucugaggacauugaaagguacauaggagcaggcaaauuaaggaggaagaccagaauuagaaacaccccugaaagagccacgagcuuccuauuccuccuucaucccugagucuggacuccaggcagccugaaacugggaauuggacuguagaaagagagccacgguaagcucugguugcagcucaaggagcaagaaaacaggcucuggacacucaaagagagcagaagaaaucccguuuuuuguuuuuuuuuucuuuuauccauucacuugcacugcagcccccaggcaauccuggguggugauggcagcaacagugaggcccacaggugccuaaaaccaugaaagaagggaaacucucucacaauaguuagaccuuugaucccaaggagguaaggagaacucauguugcuuucuuuccucucucuaaccuacugcuguggucccagaugugggugcagucauggcaucuguacaacugaccaagguaacuaaaaucccagcuuuauggccagaugacugaaaaagagaggcccaaggagaugguggagagggaaaaucucacaaaauuguuuauaaacuccugggcucaaccucaagcagcauaugcauggaucugaugcuaacagcaugccaaagacuuugagaacugaacuacgggauaaccuacacccacaccccagacuggccacuguauggugcacacacaggacagccccuaggucccacacacaggacaacaaaggcuuugaaaacagaacuaaccuugaaagcacaguccacaaaaguucaggcugaaaccugcagccugaacccaccuggcuggauuaccuaugagaacaaaaaugucaacauucuccuuuagaucucaacaugaccuagagucucaucacauaauauucaaaaugcacagaauaaaauccaaaauuggcuggcauaauaacaacuagaaaaaaaaaacucaacuuucauagaaauagauacauagaugguagaauuaucuggcaaagacuuaaaagcagcuauuauagaaauguuccaagaaguaaggguaaacacucuaaaaacaaauggaaaaaugaaauguuucagaaaauaaguagagaauauaaagaaccaaauggaaauuuuagaacugaaaauuaccauaacccaaacagaaaacucacugagugggcuacagagccaaauggugauuacaggaaaaagugagcuugaauaaaaauuauccaaucugaauaagagagaauaaaaaagauuuuaaaaaaugagcagagccuagggaacuaugagaugauaccaaaaggccuaauaucuguguuauuggaauauuagaagaagaugaaaaggauugugauacagauaaaauauuugaguaaauaaucaucaaaaacuucaaaaauuuggcacaagacguaaaccuacagaucugaaugcucagugaacuccaaacaagauaaaucuaagcaauccauaaucagauacaucagaaucaaacugaaaacuaaagacaaagaaaaacaaucuuguuggcugggcacaauggcucaugccuguaaucccagcaguuugggaggcuuaggcccguggaucacuugagcccaggaguuugagaucagccuggccaacauggcaaaaccccaucucuacuaaaaauacaaaaauuagucgggcaugguagcaugcaccuguagucccagcuacuugggaagcugaggcacgagaauugcuugaacccaggaggcggaaguugcagugagcugagaucgugucacugcacuccagccugggcaacagagcaagacugucuuaaaaaaaagaaagaaagaaagaaagaaagaaagaaagaaagaaagaaagagagagagagagagagagagagaaagaaaggaaagaaagaaagaaagaaagaaaaaagaaagaaagaaagaaagaaagaaagaaagaaagaaagaaagaaaagaaaagaaaagaaaaagaaaaaucuugaaagcagccagagaaaaacgacacauuacuuuccaggcagaggucagcaaacuaugguccuugggccaaauuuggcucacugccuguuuuguaaauaaaguuuuauuggaacauaaccauaacuauucuguuaugcaguaucuaugacuguguuagugagacaauggcacaguuagguaguugugauauagacuguauggcuugcaaagacaaaaauacuugccauuuggcccuuuacagaaaaaaguuauugaccccauaggggaacaaugauuugaauggcugaagauuucuccucugaaauuacaggggccagaaagaagugaaacauuuuuuaagugaugaaagaaagaacugucagucaacucaggauucuagauucggcaaaaauauccuucaggaaugaaaguaaaauuaggacaauaucaugugaaggaaaacuaagagaauuaguugccagcagacaaguaauucucuagaauugcucuaagaaauuucuaaaagaaguucuucagauggaaggaaaauuagauaccagaaguaaguuuggaacaucaagaaagaaggaagaacaacagaacuaauaaagaucuggguaaauauaauagacaauuauucucaaguaguuuaaaauauuuuugaugguugaaagcaaaaauuauaacauuccuuacugggguuuuauauauauauauaugauauauaaaacaacuaaaauauaaggggugagggaguaaaggaaucuguaugauguuaagcuugcuauguuccacuugaagugguaaauguugauucuaaguagauugcaaaaagaauguauuguaacccauagagcaaccauuaaaaaacuauacaaagagauauaguaaaaaaacacaauauguaaaauacaauacuaaaaauuguucaaauaacauaaaaggcggcaggaaagaggaaacaaaggaacaaaaacaaaggaauaaaaguuuucaggccgggcgcggcggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugaggcacgagaauugcuugaacccaggaggcggaaguugcagugagcugagaucgugucacugcacuccagccugggcgacagagcgagacuccgucucaaaaaaaaaaaaaaaaaaaaaaaaaaaaaauuuucuaacugcaauaaugaaaagacagagauugucagaaugaauagcaaagaaccaugacccaacgauguguuguucccaaaaaaugcauuucagauauaaugauaugaguaggcuaaaaguaaaaggauggaaaaagauaugccaugcaaaugcuguggaaaauaaaguuugaguggcuauauuaauaucagacaagguagacuacagagcaaagaaaauuaccaugauaaaaagagacacugcuuaauaauaaaagagacauaaugauccuaaacauguacauacauaauaacaacuuucaaauauaugaagcaaaaacugaaagaacugaagggaaaacuaaacgaacccacaacuauagcuggaagcuucaguacuucucucucagucaguaauagaaugaguagacagaaaucagucauagaacaacucaauagcaccaucaaccaacuccaacugauaguugagaguacgcuacccaacaucagcagaauacacauucuuuuuaauuauacauggaauauucaccaugaucaugucuugagucauaaaacaaaccuuaaaauaacuaaaagaauugaaaucuacaaaauauguucccugaugauuaaauuaauuuagaaaucaauaacagaaagauaacaggaaaaucuccaaauauuugaaaauugaaaacucucuaaauagcccauaggucaaaaaaauuagaaaauauuuuuaacugaucaaacaauaaaaauauaauguaucaaaaucugugggauacagccaaagcaguguuuagaggaaaauucaucuuauuaaauguucacauuagaaaagaagaaagguuucaaucaauaauauagcauccuucuuaagaaacuagaaaaauaacagcaaauuaagcucaaagcaggccaaaaggagauaguaaaauaagaaugaauuacaaauggaauugaaaaugaaaaaaauagagaaaaucaaugaaagcaaaagcuaguuugcugaaaagauaaauaagauuaauaaacuucuccacaagacuaacaaaggaaaaagaaagaagacaaaaccuaccaauaucagaaaugagagacuagauauuagacuccacagacauaaaaaagauaagggaaaacagugaacaacuucacauagauaaauucuacaacuuagaugaaauaaaccaaucuuugaaaaccacaaacuaccaaaaugcacccagauuuaaaaaaaaacaacaacaacccuggaauaguccuguaacuauuaaauaaauugaauuaguaguuuaaaacuuucugaaaaaaaaaauucucuaggccuagaugguuucccugacaaauuuuacuaaauguuuaaagaagaaauaguaucaauuuuacacaaacucuuccagaaaacagaagagucaggaauauuucccaacucauuuuaugagaucaguaacaucuugauaccaaaaccaaagacaguaccacaaaagaaaacuauaaaccaauaucccucagaaacagaaaugcaaaaaucaccaacagaauauuagaaaauaaaauugagcaacauauaaaagaagaauauacuauggccaaauggaauuuauccugagaaugcaaagaugcuucaauauccagaaaucaaucacuguaauuuaccauguuaagaaucuaaagaagaaaaaacauuauuauauucucaaccagaugaagggcaucuaccaaaaaaacccuacaacuaacuuuauacuuaauggugaaagacuugaauguuuucccucuaauaucaggaacauggcaaaacuguccauucucacauaagcuuuguagggaaacccuagccagugcaauaaggcaagaaaaagaaauaaaagccuguaaauuggaaagcaagaagaaaagcugccccuauuuucagauagcaugauugcccacacaaaaaauucuaagaaauuuacagaaaaaaaaaaauccuagaacucaagugaguuuagcaaggucacaagauacaagaugaacacacaaaacucaguuguauuuuuauauacuagcaaugaauuagugaaaaccaguucuuaaaaaaugccauuuaaaauagcucaaaaauggaaauacuuagguaaaaaccuaauaaaaaauauauagagcaucuauaugcugaaaauuacaaaauacuaacaagaauuuuuuuaaagacuuaaauaaauggagagauauaugguugucccuuggcaucugcagaggauuaguuccaggaaccccuguggauauaaaaauccacagauccucaagcuccuuauauaaaaugguauaguauuugcauauaaccuaugcuuacccucccauauacuuuaaaucaucucuagauugcuuauaauaccuaauaccuaauguagaugcuauauaaauaauuguuauacuguauuuuuuacuuguauuauuguuauuguuguuauuuuuucugaauauuuuugauccacuguugguucaauccaccaacguagaaucugagauauggagagcugauuguacugcggucacauauuggaaaacucagcauaggaaagguuuccaguuucccccaaagugaucuauagauguaacacuauaucaauaaaaauuucagcaggauucuuuuuguaacuauagacauacugauucaaaaauguauacugaaaggcaaaguaauuaguauagccaaaacaauuucuuaaaagaaaacuaaauuuugggaaauuugacuaaccaauuugaagaccuauauagaccuacaguaaugaaaacaaugugguauuggugaugugauaggcacaaaaaugaauagaacacaagagacauaauagaaauaaacuccacaaauacagacaauugauuuuugacaaaggugcaaaggcaaauucaauggagaagauuuuuuuuucaauaagugguauuagaacaauaagacaucuaaaugcaaacaaaaacaaaaaaacagagaacccucaaccuaagccucacacauuagacaaaaguuagcucagaauggauccuagcucuaagugcaauauguaaaaucauacacuuuuuaaaagcgaacauaggagaaaauaucugugaccuggaguuaagcaaauauuugcuagacauaaaaccaaaaacagaauccauaaaagaaacaaucgcuaaauaggacuucaacgaaauuguaaaacuuuucuucuaggagacacuuuucagauaaugaacagacaaguuacagacuaguuaaaaauauuggcaaaucacauaucugacucaacagcaagcaaacaaacaacccaauaaauaauggacaaaaauuuggacagauacuucacuuaagaggauacagaaauggaaaauaagcccaugcaaaguuguucaacaucguuaaccauuagagaaaugcaaaccauuaaaaccacaaugagauaccaguacacgccuauuaaaauagccaaaaaacaaaauacacacaaaaucaaaauaauaaaaauguguugacaauuucuuacaauguuaaacauacacuuacuaucuaacgcaaccauuccacaucugaguguuucccuuggagaaaugaaaacuguuuacaugaaaaccuauauauaaauauuuguagaacaucuauucaugaucaucccaaacuuauauauccaggaagcagauaaacaaauugguacaugaauacaauggaguauuacucggcaaugaaaaaguaaugaauggcaacguugagcagaaugaaaguacuggucucaaaaguuuccauauaguauaauuccauuuauaagacauuuucaaaaagacaaaaccuaugguguuggugaacagaucagugguaauagguuucaggguaagguaagggcgugacuccaguaaaaauaccagcugggguuuagugggggguuuuuugcuuuguuuuguuuuagaucagucuaauuccaaagaguauuagagaaauacaagcagaaguagccaagaacauucugaaaaagaggaauaaagguggacuuccuucaugaauaugaaaauguauuagaaaacuacaauaauuaagaguguggcaaucaaauguggauaaacagacaauucauugaaacagaauagauaguccaaaaauagauccaaauacaauucagaauuuaguauauaacagagaaggcacaugccuaccagcaagaaaaaaagguagaugauucaauaaauaguuuggcaacacuugagcagcuaucuggagaagaaaaauaaaguuguauaauauauugacacugucccuucuaccauaauacauucuaaaucauucagagauuuaaauuaagaaaaaaauaaaaauauuaaaauaccaaaaacauuuuuuuguaauuuuggaacaagaaauggccucucuaugucauacauuuuagagaucaugaaagaaaagagauaaauuuggcuacuuacacuuuuuuaaaugucuagaaaaaauauuaaaaagcaaaaucaaguuaugagcugagaaauuauuuacuauauaucauagaaaaguuaauuucuguaauauauaaagagcaucuucuaaccgauaagaaaaaaaaccaacaaucuaauacaaagauuugcaaauuucugaauagaaaagaaguauguucaacuucauuaauaagauaaauuuaaaguaaaacuguaagagccauuuuauaugucagaccuaaaaaaaaaaaaaagcuuugauaacacaauguuuugauaagggcuugaggaaacaaaugauuucacauacuguuagcuggaauguaauuuaauuuaccaucuauggaggacaauuugucaauaucugugaaaauaaaaagucacacaguccaucgucuaaacuguccucuucuauaauuuauuuuacauagucacauaaguguaaaaugacauauguguauaaaauaauugucagauauuauuaaaauauugcuuguaacaacaaaagacuagaaacaacuauucauuaacagaauguucauuaauuuaaacauugugcauucguucuauccaauaccaacucccaucucgaggucuuuuuaaaaaauagugguagaaaguacauaacaugaaauuucccauuuugaccguuuucaagugcaccauucaauggcauugaggacguucgcauuguugugcaaucauugccacucuccuuuuccuaaacuuuucaucaucccaaacagaaacucugccuccuuuaagcaauaacucuucaucucccuccccucccccagcccuugagaacuucuacucuaaucccugucucucugaauuuaccuauucugagaucucagagaagcagaaccacagaaugcaguguguguccuuuugugucuggccucuuugccuuaguacaaagcuuuuaggacuuguccagguuguucugugaucucaaaggcuuucgcuugcuguuguaauuggaaagccucuccccagauuucaauagggcuccugaccccuucagcucuuuccucuccagucaccucaguaaggccugcccugaccacuggauuuaaaguugcagccacgucccaugccuuuucucugcuuuguuuuucccugugucucucaugaccaucuggcaugcuacauauucuaguucuuauugucugcucaucccuugucucuagacugugucaacaagggcuaggacagcuccagcaccuagaacacuggguucuagcagcugcucaguaauacuugugggaucaaugaaacaauggaaacgauguaaucauccaacaaaaggguaagaaaauaacaccuacgcugguaaaauguacuaauuuguaugacauaaauuauguccacuauauaguuguggcuaaaaacgagacauagaguauagcucagcuucauaaacauauuugugcauguguguauguauacauuggauuuaggggggacuuuuuauacaguuuuauacuguuugcauuuuuauaacagauuguuuuugauaucaauauaaagacaagauauuucuguauuggacaaaaauucaauguuucuuuaauucaaagcuuguggugcugaagccaugcucuuuaagaaggaagagagugcucuaggcaccaucucaacuacgaggcagaagacaggaagaagucaaguaauaauaacggugcuuauacuaguuaauguuuagugagugcuuaauguaugccaggcaccacucuaaauaaaugcuuuacaugucguaacucauauaaugcucccagcagcaccaagaggaaggcggugguacuguccucagucaugaaugaggacacagacacagagagauuacagaauuuguucagggucacccuagccucccacagcaccuggguacccuuccccuugggcccucaucacacugcacugucauugccugguaauuuguucaucuccccaaaaugacgauuuggaagauuaauucugcugcagauugccagccucgcacaggucugaaacauggugggugcuagugaaccacguuuauugaauccaugugaccaacaaaagaaaaggcaucaagcggggaagcccaauaccugagagaggcucccccaaaggguccccuugagacgcaagacccucaugagggacucugggauggggagaagcacaauaggggcuccaaaugggaaacagaugaagccccccaacuccucccaguuuauggcacaugcaggcagaauuacaaaucuucuaacugcaguuauuagaggugcauauuucauuacucgcagcauugcauauuuauaauuuagcgguguguaaaaauuuauaaaggcacaacuagugguugguuaaugacagccaccguggcagcccauauuucggguauuucucaugucacagcaaucuggccuggaacagaaugccacaugcauaaaacaggggaugaaaagacaggaaaugggcugggggcuuuaugacaaaaccguuccuagacucacaaagguucucccuguuauugucggugagaggugagcugcuccaaaaagggagaguggggccaggugcgggaggggauugaggagcaucucucugugggcagaugcacagaagcccaaugccagccaggcuucaaagagcaaagcuuucugauggagaaugauuaaggcaagagaccccccacccccaccaaagagaaagcagucgaugcuuuugcuguauugacaaaugcauaauuuugucuuggaaaaacaaucccccugccuuuccaaaagugaguccuaaaauagcugccuuucaaagaccagcguccugaucgaguuuuuauucauccauggcugcagaugagccagaacgaguccuggaaguuuacccccgaagccacagcucuggucucacaacucaucaauuccgugugcuggaugacagggggccaggcccaggggcccgagaaagccugcagcccguuccagagcccagagcagcuuggcucagggugggcuggacagguggaggccucugugcugcaggaagugagagcacuugcuggguagcaggaggccaggcugcccucgagaagugggcuagagagaaaagcaucucugcagcaggcaucccaggagcaccccggaccugggcgcccccagcacucaucaugucugucccagucuucaaagaugaugaaugggccuuggcuuuuucuguccuauccaugcuguggggaagaggugagcagacucccccgagaucugguuacauccaacaugaacacacugccuggcuccacacaagucaucugaggggcuggcugagcccaaggcaccagcacuacaggcucacagggauccuccccgggccccacgggcaaagccccucagucaucaacaagggcugggaaacuauaagacuccuuuguacgcuccaccacaaagucaaggaaguugaucaacagagccaucuauuuucacuugguacaacaauuagagcagaucuguauuuuuccaaacuaucacccugaaaaagucaaaccacauuacaaaucaaaaaagaauaauuaaaaucuacaccucucgcaauaccgcaggugaaggcaauuacaaggcacuucuaaugagcaauuuacguaauuuaaaaagucagacccauaauaugcaaagaaugcuucagaugaauuacugccgggugacuaggugcacuuugauccuugugucuggccccugcuggcuguggcuccucugucacccucacgucauauuucugggcuccuggguaauagccauggaagauuuucugcauaagcucagacugugacucauauuuagaaagugcauuuaauaccgacuugcauaaaggaugguggguaauugcugcuagaauccaauguguguguuguaucucaucuaugauaugcaauuuagaagcuauauucuaguaagagaacuuuaugacuugcugucaugauaaauaaaaguuuauggcauaauggaauuaauauuuacuuugagugcaacacagacuauggaaauaaaguugcucuggaaucacuuuaaaccaggagaguuugcaaaugucaccaacggacaacacgacacuuccucucauugccugccaaucauucaccaucuuucaggguucugcuuuaaucaauaucuauacaauuuuuuuuuuuuugagacagaguuuugcucuuuguuguccaggcuggagugcaguggcaccaucuuggcucacugcaaccucugccucccggguucaagugauucuccuaccucagccucccgaauagcugggguuacagaugccuaccaccaggccugacuaauuuuuguauuuuuaguagagacgggguuucaccauguuggccaggcuggucucgaacuccugaccucaggugauccgccugccuuggccucccaaaguauggggauuacaggcgugagccacugcgccuggccucuauacaauuuucuaaacaauucauggaguuaaaaacauugaugcuggaugugaugcaguaaauguggaagugaucugcugcaccaggaaugagccuggaagggaggaccagaguggggaccagggugauucugugccagggucuaggggagacccuuggaggaaggaaaaucauguuuucugagugagucccucuaaugcagcuguuuucagaagggcauuugugacucaucggacauucaaucuggugcuuuauugcgaagggaauuuuuuuuuaagaaugcuaucucaaauucaaauuauacagaagcugcuugauucuaaaauaaacagacagcaagcaauuuucugacuuuauucuaaaugauaauuacuuaagguacagggagcaguuguucuggaucuuaaaggaaucagaccacagucaggguugcuaggaagucaaugacacuuaagcuuucggggcaccucugguugcacgggccccuucuaagacucuaggucucauuuuguguuccuuauuuuguauugcuuauucuuacacaagguccuauaaaacugagaucugcccugaucagaagucaacuuacauuucaaagcaaaaugacacaaaccaaagagaggggcuagaaauccugucucagugagggguuggaacaccuccuuguacccucucacccacagucccugcuuguacagggcacugauugggcgugugucucugugugggguuggggcauugcugccugaauguggccagggaggagauggaaguggaggcuuaaucggaagguuccaggagccugagacacaagggccagcgucugacuccggggagccgcuggcucauugcgagguuggaagcucuccgagucugagucaugcagcagcaggaggcaaauugcccagacuauaaacaagugggagaauuccagagaaagccuggauuacugggguggucuguaccucccacccccugcuuaguucauauugagucacauacagcauuacauuaagggggagaaacugcugacagcacuggcuucagagucaaaggcgaagcucuugcucagaggcucagaugauuucaacaacauuuuuagauguacaaaguauguuucauauaaagaaaucaagucauuguuucauauacgauuuuauuaugaagaaguaauaucugcuuaauaaagaauccaugaaaacgaaggaagcacuaggcagggaaucaggucuccccaccuccagcacauauuuuaaaacagaauuuucagagacuuugaauuuucaggaagcagaccuagagaggggaagguacuugcuuaaggucacacagcaagucaguggagaggcaagaugcaaacucaggacaucugacuucaucaucuuggccccuuagucaaagcaaauagccuccuuagcucauugcuacaaaaggaaacaguugaguccaaaacccuugggucuggucggcaagggaagagagaggaaggaagggugaaauguuggcugcucgggacuguucugucuuaaacauuuuggugauucucuucugagcccauuagggacugacucacccacgugucugaaauggucccugagugcguuccuggggcccuggauaaggaacugggagagcuucagaaccuaacacaaugccuggcauuugcuuaauaaaaguuugcuggauaaacaauuugguaaauauauauuacaaaauguauugauaaauaccuaauucccccagagagaagugguaaaauucuaauauacaagagaccuugguaaccuggggcccuuuagaaacaaaaaucuagaauuuccccuguagcaaaugaccggaauuccgccccuguagaugguggaaauguacuuguguagacagucccagaagagagggcugcauguggcaggucaggcaguauuaagggucccguuucuauucauggcucauggccaagaaaaagauacucacuggcccucagaguagaaauacauuccuggggaccccaggggauccacaggaacuugucagugacuuucauagagaggaaaagaccugcggggugggggguggaucaugcaucucuggagaaggcuaaaaugacaaugcagccccuacuguuauacccagggauuccugauuuguuucucugaugcuaauccuacaccccgcacaggaaggccacccucguacucagcccuguagcuugccauccaaaggcuucccauugagucuuccuugagaauccuucccugggaguccucuacagacagauaccagccuaaaaaggcaacugaaaagaauuuacauggucuuuguucauuucagauuauaaauuguuugacucaauuuuauuucaacugaaaggacuacaaacauauauagaacugccgcugacaagggugaugagcugguauagggaaugggaaggaaugguaaacauuaaaccaaauagauauugauuccugccacaaugaagugacuaggauuggauuugcccuccugcuguaaacaaucaugaaacuagacaaaaauaucugaggcuacucuuuguagggauuguacaacaggcaguucaggacugugguucugccagaaaaaaaacacacaagauaagccccauguuugcccagccuuuuggcccauuaugcaggacgauggggcacagcagccuagauuauaggagaaggcaaaaaucaagaguuuggggcugcuaaagcagcuagaacuuacaggucugggcucuggagagaagaaucuugugcagaaaguaggcccuagaagucugccuggagguacccugugaguacuugguugagggcagaacugcccacaugcagggcaaaacuccauagcuguuauaagacugaaagcuaagcagagauacuagaagucaugcagagcuggcagagcuuugaauucuggccaagccagacgagagaacccuugcugaguaccuugggcauuuguuccccaaaaggccaggccuuaggaacaaggacuauacccuacaggaaaggccaaagccuaggaauaagggcaaaauaaaaauggaccaacucuaauaaagauucaaaccaagccugaccagaccaagaggaucugccaguaauuaacugaccugccagaacaaaauucaacaccuuuuauagaaaacaacauaacccacacuccccuaccacauaucuucuaaaauaucuagaauagagauauaccauguucauggauuaaaauuggacuacagauuuaacaaacucaaagagcuuuuuacucuuuuugggcagggagaaauuauuuuugcaaaauuaggacauuucugaaaauacaguuuuguagcuuucuuuuuccauuugguccuccauccccucucaccaagcauuuggcacagcuaaccauuuccuccuucuuggaagccccucuucaccuggcuuccaggucaccaugcuuuccugguuuucuugcccccugugucuccauuuccuuugcuggcucucccuuuuuguccaggcagcuaaauguuuuaggugucaggggucuaagucuuuagucauuuucucuccuuuauacucuuucucucgguggucauccgugauuaaugacuacaaaagucuguaucucuggucugacugcuccccugagcuccagacauauguauucaaugggccacuugacaucuacaucugaacaucacccuugacguggccaaaacagaacucuuuauucucccccuagaccugcuccacuaccaucaucuucuaucuugaggaauagcaccgucauucacucaguuucuuaggcacccaacuuugggaucauuguuaacaucuuucuuucaccuuauucccacacccaaauuaucaagaaguucuagcaacaaucucuucaaaauguauucccagucaacccacuucuucccauccccacuacugcugaaguuccugagucaucaucuucucuugucaagaagacugcagcagacagugugugcaacuaaaaggcagagcaaugguccacugugguaguuaggagcacaaguacuggagccaaacagguugggaucaaaccucggcccugccacucacuaguuacauaguuauguaaccuuggccaaaauacuuaacucucugggccuccauuuucgucuguaaagugggguuccuaauggcacuuacuuuacugggaagauggugacucaaggucccuggcguguucacucucucuggcucuucucacuugcucacucugaugaagcaagcuuuccuguuguguuccauggagaggcccacauggcauucaccaaacagcuggaaccugagcucuuaguucaacagcucaugagaaacuguauccucccaacaaccccaugaucgaguuuagaaguggauuuugacucaguugaaccuugcaaugaccacggcccuggccagcaccuuuucgguagccuuguaaggagcccugagugggaggaucagcagagcuaugccuggccccagcccacagaaauggucagauaauaaauaugcauuguuuuaaacugcuauguuuggggauaauuuguuacacagagauagauaaccaauacacccugcucuauuuucucuguggcacugaucaccucuugagauuguaucugaccacugucagucugcugcagguaagugacaagggcguggauauuuucugucuguucauuuuugaaucuucaggaaccaaaaccaugccauggaaaguacucgauaaauauuuguugaacugaugaauaaauuucacacagugggcauuuucccauguggccgugugauacugaaaugaugaacgccuggaaguaauuuggaauauacugcuuaauucacacuccagauucccagcaucacuaacuauccaaucagucuguuuuacucaaacccuuaccaggugccuagaacgcugcuaaguaccacugugcagauccaaaggaaacacacaacaagcccuccccucagggaguuacaaucugguugaagaggaaaaggccugcuugugagaaugaguagagggguuuaguucucaaccccggggcacugagugaaagaucacagauggagaugcaauguaggagacagggccggaaugggucccaugacagcauugaguacgggcaugugugaggcacuguucccagcauuguccauguguugccccguuccagcuuccaacuccagggaggcagaugccauuagggucccuguuuacaacaaaaaaaaccccaaagccagaagguuacauaacugcccgagucagauguaagugaagguggagucaguauuugaacaccugaagucugacuucaagccagugugcuugaugcuaucagugauuggccuggcagcaaagcggaggugguggauuccuccugaggucugccagcauagacaaggaggaaaguccacaucagaacgaucuuggagaccagaccaagugcagaggggagucgggagucacggggcagaugcgagaggaccagggagaaccagggacacacuugugaucaagggccuugccuuggaggccauuuggugaaggguccacggagagucucucugagacuucacccuggucugggcugguccucaccugcaggcucagaagccccugcaugacuugcagccucugacagugacugucaaaucuuuaaccaaguucauaaggcacaaggauaaaaucacaaugcccauucguuaaugucaagaacccacuacuccagggaccagaaugcugugucacugacagcauucccucuggaagcugaacgagagcaaagugggugguuucuacauugagguuuugggugaauagggcugaagcagcccuuucucugcagagcuggucucaccgaggaauaugagcaagcaggaugcuggccaagaucaccugucccccgcacacugcugcccgcagccucuccuuugucuugcagacaccuuccaucagaggcagucuagcagccagugagagcugcuguccuuuuaaggugacugugccucuccgugguuucauaacauccagagagcugcugaacuucccuaccagccagcuccagggagaagcucaccauccauagccccccaguccugacacucagccaguguuaaacagcguaaaccccugaaagggccacauccuggcugaacagaacagccccaccacaaaccaccgagggagccuccugccaccuuggguuauccccucucagccucucccugccccagcuugagcacccccaucaucagugcuugugauggagggugagcuuguucuggagggaccuucucuugagggcaccaggaucaacuaacgcccucugcauagaaaugaggaaagccuggauuauucugggcuuuggacacaacugugcuuccccugggaaaaugccugccgaugauaucuuugcaagcuuuaacaggugggaagugcgaggcugcuagcacgaagcagaaaaaggauuacaaaagccaaaugcucauuacuacaaaaucuccuccaacaggcuccaaagaggccccccggggcaugccgaguuuucagagaaaagcgaggggcacgggagagcuggaaacccugggcagccaucgggaggcagcaacauuacaagaaccaagaagaugcuccccaggggaaccccaauaacuugaagcauuaagcugggauaauucauguuuagacucccccacugagaguccuaagugggaugcaaucuauuuccaccccccuucaaucuuauugaaauaccaagcauuuugcuuguaaaagaugaaaacagaccaccaaauuauacaaacuguagugauaaauacauuucccaguggauggcaagaaagcaaaugacaaacaaaaccgggaacacaugcacauggaucauggagccauccgggccucugccccacaacaccccauguacucuauaaaucggcucauugugacucuucugucuucacugacaaacgaccaaaugggcuuugcucacaccgagugccagagaaaugccagcccugaaacaguguccaggugcaggaaggaaugauucucuuggacaaguggccugccagcacguuaucccuugucacagcaggccucuggcgggagcuccuggagacgaguggcggucucucaucacccagacaaggucugcauuugcuccccagccuuuaccagccccagcuucugcagcgcaaucccuucccaggaaggcagccccaccccgucccuguccacuggaaagcaguagaaagggggcaggaauacagcagaaaagcaacgaagccugggcucuggaagcuccagugacccagcagggaguaggacaccccgccggagcuugccacuuccuagggugguucuuccccaggauucccaggaggcagggaggacaugccuucccagagaucccacccaaccucugccuggugugacaugggagguggcgcugggguggccuagugcucuguaggaauuccucugccugcuuccuaaaggcggaagcgaggcugcaggaaacacguggcaugggaucaguugucuucucaaagggaacugagcccaugaagggcaauaagaacucacuugaacaaaaugguugcauuuucucugagugguccgugggugcagaggagugcagaaacgcaugcaaggauuuggcaucccucauaggaacugggaaaaaacuaagcagcucuugauaauuuucaaaggaggaauucaaucagggaucaauucagaaauuuaagccagagcugagucugagcuucucucuccugaguacggagaguggggaauucagcaucugggcucacauuccuaagaaaaaggcaguacccguauggaucaucuuucgagaaauaauuaagucuucaggaugaauggcgaggcugggggagcaaagguuaggugguuuuaaugccacauccagccucuccggaguguucaagcaauucccauaaagauccacaggagacacacauauucaccgaagcugaaauacaagguggcuucaagaaaacacagaauauuggcucugccugcuaaauaaguucuuucaaagaacuuuuuuuuucccuuuugaaacugccaggacguaagaguaguucauaauugauccccagagaaggcucuguccaauaagccuucccucuagcucacaucccaggaagccgcagaacaagccagcgcuucagcaauucaaucuccauauauuuuauuuuaaaaauauuucauuucuggccaccaguccuuagaucuccaauuugauuugguuucuauaaauggauuuuucaaaguguagguggaaaguagauuuaauugcgaauuucugcaaacuaaaauauucaauauaaacgucagaguauguuugcacccagcauccucccugcaaugcacacaccagcuuuaagaugggcacacgcacccuuggauaguauucucagcuguuuccauuuacagagcccagucaaaacagcgggggaagcuggcaucugguuuucuucccugcaccacuuccuguuuccagacaguuguuggaaggaggaauguaccucuagaguuucagcuaagaagccaaaugugggugacaaccaaaacuguccaagggcaaugccgccaauggaguggagccaggcuggcugcccaguucucacuggccacccacuccugggcuaggcucucugcccuuccaguucugccaguaaaagaaaugugaaggcuuaaagcccagugagugcuguugcugugauaucagccuccugaggucaggcagcugaagcaacacccagaggggaucucccagcagcgcuuaauucaucgcuagggcccagaagacaagcugaccauuugcuggugugaugaggggcgugcacacagaggaaagcucagccaacugggaacaggcucugggccaggcacuuaacauucaucucugaacaacuccuaggaguugugcacugaaauuccauuucagaugacgagacugaggcccacuguuuucacguaacuacuccagcgcagaacugggucaggcugacuccauagccuagguucucccuaacaacauggcacucucccgagauacacucuagggagauuccccacuccagcacgauggaugauccugccagaguccagcacccccuuugucucugcccgucuucgucccuaacuuucccagccucuggguacugugucugucauggagugaagguccuucuaggcuuucaguaggugcacugcaaggaacccagauauggcagcccacccaccagugcuucacugagcaccuuccacagcagucccggcagacucagaagaggaauguggcaaugggauugggagcauguuucaucccacacaaaagacacugcacucugcagggggaaaccaggggucaguucccauucugccacugagagcugagugauccugugagagucacuucacccccccaggagcccccauuuccucauuugcaaaaugagggacauuuuaggacaguaaaguuaaaaggaaccucagacuuguugguaaaaguaucgauggaauaaauguuagggguuuucuauucauugggaguuucauucuaugacugucaucugucggagaguccccgagagccacagcacuugcuggcaucaugugauaaugaaaaugaugaugguaauaauaauaaaaugagaauaauuuacgucgcagcaaguaaagcuaaagauagcagucaguuuauaugcggagaaagcacuaaaaaugugugucaauacacgcaggaagauaaaagcaauacgugcauggggggggugguugcaacacauaauuuggaaaugcaaaauggcccaacagagacccagagguauggaacuuucuagugaacaucccaggccccgaguuacucucacugaaggcagguguccccugcccagguggaaagcugggugacauauaguaacauccacuacuccacauauaucucucuuuccaaaucuaaaacucagggacaugcacugcuucugcugaggugaggggcaacccguaaggaaagagaacaugguguuuucaucaccuaaauccagagggacugaauaugaugcaggaaaaagcuccaggccaaaggaaggcacugucaaaggcagaaccgaguuuccucaccccaucccuucccucugccaggccauguccacacgauggacuugauaaucauucugauggaaaugcugcacauuuucauggcaauuguacaauucccaguauuuuccaaugcaccucacauguuccccacuauaucagucucucagggcuuccauaaccuauugcuuacaaacuggguggguuaaagcaagagcaauuuauugucucagaguucuggaugccagaagucuaagaucaagguguugguaagaccacauccucucugaagccuuggcagagauuaagguguugguaaagaccacacccucucugaaggcuuggucaagauuaagguguugguaagaccacgcccucucugaaggcucuggggaggagccuuccuugucucuuccagcuuccagucuugugucaauucuggguguuucucagcuugaagacacaucccuccagucucuaucucugucuucacgcagucucuccaugccugcccugagucuguguguccuauccaaaggucccuguucuucuaaggacaccagucauuagauaagggcccacucaaaucuagcaugaccucacuuaauaugauuaauuagaucugcaaagccuuuauuuccaaagaaggucacauucugagguucaggguggacaugccuuuugggaggauacuauucaacccaggaugcccacaaacacacgaaggugagagugcaaaccggggcaucucauuuuauagaugaggaaauggagccccuguuccucuuucucaccugccuccgaggacagggugccccuuccucuccaaggacaguccuucuccuguuaucucauccucuugucuuccuuugucgucugggacuggaucuugaaaccacaccuucucccucuauuuuucauucucaccccuccugcucauuucccuuugcucagacacaagaggcuggaaaacucccacccucacugauaugguuuggaucugugucccugcccaaucucauguugaauuguaauccccaguguuggagguggggucuggugggaggugauuggaucaugggggcggauuuccuccucggugcuguucucaugacagcgagugaguucucaugagaucugauuguuuaaacguguggcaccucccuccccucucuuccuccugcucuggccaugugaagggcuagauuccuuuuugccuuacaccaugauuguaaguuuucugaggccuccccagaagccaagaagauaccagaaucaugcuuccugugcagccuguggaaccaggagccaauuaaacuucuuuucuuuauaaauuacccaaucucaggcauuucucuguaguaauacaagaacagacuaauagacucauccugacuuugauccuccuuccccaacucucccgcuaauaccaaaugcuucacgagagccgccugugcuggcugcagccaccucucacugcucucugcuccagcccuagcuuucuggcuucugcucaucacuucuugggcuuugcaugggcaccagggaucucacgguuacugcucucuuucaguccucuuccccaguaugcuucuguugcucauagcacaauucaccaacucuuccuucucaacuuuugauucacccuugguuuuccugcauccagcacacugcccuguccugagucuuuuccugccugccucuccucuuccaugcccacaaccccaaacucucuauugacugaacggcccacacucaaccagugugguugaacuggugguugaacauucaaccaguguucacuaaguauccuuugggcuauggacaaugcagagaugaacgucugacauuaauucugaaacuucaagucuaguugaggagaucaauuaaauaaccacaaugcaaaguaaaauagagauaaagugcucuggagacaaaaagcaaccccuuccuguuaggaaagcacucuagauuauaagcucuuugugugggaaugaacugugccguguauucucauacccccacggugcccagcacgcagagcgcuacgagugugggcuucagagucacacagucuuauuccugaaucccggcuccacugcuuaucagggaaggucagguggccucucuguacuucaaguuauccauacguaauacggauaauaauagcaccugguccaugggguucucuagaaaauuaagugagauaauacacacaugcagaaacuaacuagucaccaaacuaacuggauaauuuucucuuccuggacaaagaaagacuguauuucccagccuccucuguaguuagacuggccaugggacugaguucuggccaaugaaaugaagguaaaauugauguaugccacuuccaggccuggcugcuacaacaccuucacucucuucccuguccucagggaugagaaacaaggacucuaggaugguggagccacacaauagaaggagccaggaucccugagucaccaccuggaggggaaccacucugaugcagcauuugccucacaagaguugcaaugugagugagaaauaaacuugaacuuguuaagccacuggcauuccagggcuuguuuauuaccagcacguggccuaaccuagccugaccaauacaacauguaaaaauaucaguggugaugaugaugaagaagaagaagaagaaggaaagggcuuguuuauuaccagcacauggccuaaccuagccugaccaauacaacguguaaaaauaucaguggugaugaugaugaaggagaagaaggaaagggagaaagguagaggaacuugguuagaauagcucaacucagucccaagagcaguuacaaaucucaugagaaugugaugcucagaggucuucccucucagaugacuaucgccccauguccacaccaucacagggagaugacauccgauuugagaccuaaaacaaauucacaaugauggccauauucucccugaaucacacugccaugcauucugcagaacacaggggcgcccuugggcccugucucccccuggcugcucacugaggucacacugccccgccugcugaaaucccucucgguagcaccucucucucuaccccaagccuguucuccuugccgaguguuuccugauaaaaauaacuuagcuuuuccucauucucugaucuuccaaaaaaaguugcaguugcuccaggcagcugaucucugcuagaucaaaucagaugaguuaauuuacuuacugauggaguaagucucagagugaccaucacaauuuugacacuuacagugauagagguaagaguagcuccagcuucuguuuacugagugucaagucgauggaaggcacugagcuaaacucuccauaacaaucuggaguccucagagcaccucuguccucauuuucagaggaggaaacugaggcuuaggaaaguuaaauaacuugccugauaucuuacuacucagaaguguagagcugggauuuucacucuuuccacucagccucaauagcuccccaaaucucuaacuuguugacuguuaggcagggauauuuggggucauuuaagacccuuuacaaucuuagccuaacaugcucugagauacgacaccuguacucuagcccagcagcuccaaauaucuccacuucuuauagaaacgcauugcugccaaaauccugcauugauacuacaaugauucugugcauuaacgucagccacagguacaucuccccagccucagaggaugacagcagggugagggugacgacccugaacguucaugauuccagcccaaagagaagagauuggaugccacggccacagaugcaccugucauggaagaucucuguuuggaccuucaaaaugccaccaauagcugaagacccccaugacgaucuuccaggaccacccauagaccucaaaucaagaaucguugcuggggcagcucuaaaagcacguggcacacccuggcgccuccgccccuccaccugugccaucaacuccaccagaugcccaucucugccugaccugcuccuccucacccuucagggcccaaucacaugccaaucucccugugaggucuuuccucucugccccccaccagcaggcucacucauccccucagcacgcaggcugugcacaccucaagaacagagaccauguggcgcuggucccugagucuucagaaucuggcauggugcuuggcacacagcaggcuccauuggcccggugguggguacaucugaaacagcugauuuagagaaagcaugcuagcgggcaggucucuuuccuggccucuacacugugaaaagaggacacauguggccugggaauuuguagcagauuuagaaauguacauggucaccccuaucaugagccuccuguugguucuaguuuuugagguggggauuucagccaucaguggggcuccaaacaggugacaccuaaucauaguggcugccagguacacaggugucguuaugggcucaggggcccuacuuucaccccaaaagcaggcccaugugaaucucugguuuagaauaaagagauaggcuagaucuuggagcugguucaccugugcgccgaguuccccuuaugugauguuuagguuagaggguucuguuguaccaacaucuuuaaaauagcucagcucuuuaaagaccauagaaucuguggucuguauuucagaaagaaaaaaaggcagcuuuugagcaucuguucagaggagcugccaugagacaggcgaggcacugggaacucccuucagauaguuuggcgagaaccacugaucauccguaggcccaagugaauagugccaugggcuacaauguucccauagaggcagccccauggccagggucagcuugcacgucgcagaacuucccgaaggugcaucagcgccacccaccaugaaaugcagugcgagucccagacuuggcuggaaagcugcuccaauaccuuccagucugggguguaauuaccugacaaggauucucuccaucuucucucaaauuaaaagaaaacaaagaacaggaaaugggcucucacugacucauuuucucaucaucaguggugauaggggcaggggugcauggaagugagcugccuguaaacaaucuauccuuggaucccucucucccaucaggcugaacaucucucucuaggacgcauggccacuggggccgccggaccaaaaggagccuuggagggccagccaccagaggccaccaagcacccugugggagggucuuggaaaccaauggguuucccagagggcugcuugaguugugucuuguccccacauauggagcuggaaagcggagggcucccuccacugggcuauccuuccuugcacgaguucuguggauucucuaggaaggaguaccagacaccagggagaaguggccccaccagggagaaguggccccaucagugaggucaggaaguuguugaguuacgaccugaagagugcaagaaggagguaaagcgaggaaaguguuccaggcaggagcagaacacgugcaaaggccuuguggugggugggcauguggcgagcacaagaacugcagauccaguuaagcacagggaaggaagaagcccacggcccaggagaggcuggaaugccaggagccacagcaaacgucgcaugaaggacuuacucugcaguuagcacacuugugagcauucugcccauauuaacccauguguuucucacuacagucucuauuuuacagauaacaauagcaaaauaaaagcagcaagccuggacgugguggcucacgccuguaaucccagcacuuugggaggccaaggcgggcagaucacgaggucaggaguucaagaccagccuggcuaacauggcgaaaccccaucucuacuaaaaauacaaaaauuagcugggccugguggcacgggccuguagucucagcuacuggggaggcugaggcaggagaauugcuugaacccgggaggcaaagguugcagugagccaagauuacgccacugcacuccagccugggugacagagcaagacuccuucucagaaauaauaauaauaauaauaauaauaauaauaauaauaauaagaagaagaagaagaagaagaagaagaagaagaagaagaagaagaagaagaacagcagcaaauaccgaaacagcauuucuauguggcagggcugaucuaaggacaguggcugugauugacucacuaauccucauagaugagaaaacgggagcacaggggcaagccccacagguagggagaggaagaggaacugggacucaacuuggauaaguggcuccagaugccuaguuccuaaccagagagccacaaaucucacccuaagaacggagcagggacugauggggucugcacuguggaaagaccccucagcugcagcauggagaacaggcuggggcaagcaguccauguagaaagaugauguccugguggugguagcuugggcugcuaugaugaccaaggagauggauagaggaaaagguuggauuuuacagcucccagaggaaaagggaauggaguuuauuuggacaagggggugauagagggcuaagaagguaucaggaaauacuaccagccuuaugacuugcacaacugaaugaauggugcuuccuuucaugaaaugaagauauuugaagaugaagaucaugacuugggguuuggacuuaggggaguccaaagagucuaaggggagacgucaaguagugaacauuugacauccaccaugggaugggugguugacucuccuaucuggagcccagagaagaggacugggacagaaauagagcagugugagucaccugugugcaaguaccacuggagcuguagguauggaugagcuggaaccucggagaaaguagagagcgggaaaggaagacaguuuugcccaaaacuugaggagggcugaccacagaacaauauacauccauucaaagaugggaucacaaagcauaugcaaggacaugagaaaccaugcacaacauaauauuauguggaaaagcacagguggggugucuccuguaguugggguggcaguguguaaagugcaucuugguggagguuggagaagggugagaauacacaaaauccuugccugcagcggugagguuagagauuuuuuuucguauuuacucuucuuuaugcucuuuuauauaauuauuuauucaacaaauguuugcagaguaccaugauuuauuuaacuuguuccuuaucauugaagaguuagguuguuccaaauucccacuauuaucaauacugcuguaaugagcaucauccuacaugaaucuugcggacauuuugucauauuguccuugucuuggagcucccugucuuggugcuacuggaaaaccagaaaaaggcuaugucacgagacacaaggguguuaggacugcagcuuuccuguuugaaaacuaucauuguuccugauggccauaggcaacaaacccauaucccucugucccccaguguuguguaaauacagucaccucuaucccacugccacccccugcccaaucuauuucccucccucacugcaggcucccugagggagggcagccccaacucuccuuucuggcauauccuucuuuacucagccuucacguggaguccuucuagagcuuuagauccagaaggaguggccagagaggucaccaagacucagauuucuaggucaaggaagccuagaaaaggaguuucaggaaagaggcugaaaugaacugucaucaaaugcuacccagaaauucagcugagaugaagaauagaaaccacccguccaguugaguaaacuggcagucgcuggucccugcuggccuggugauucugcucuuccagaucugggggcaguuaucagagaggugagagcuacaggcaaugagaaagagacuuuuggaggagagagaaggcuggacuugggcagaggggcaagagcagauggggugcauggaagaacccagucuuggagcuacuggaaaaccagaaaaaugccaugucaggcgacacaggugguugggccugcaggaucccugggcaagcgugcuucgacaauugccauuuggaguuccucucuaguguacugagguauuuuuaauauagucuaugagucagaaaauccagaagaaaugaggcucccuaaagcucucuuucuauaagaagguggagugaucaucucccucauugcaaaauaaagggcugaacuaaauagcugcuaaggcuccucucugcucuuugacucuccuugggagcagcugugcauucuucaggaugacacagaaagcccuggcccuggguggccgagguccaagaagcggaggaacauggauuucuggcacaaugggaaagaacaggggguugguuucuacccguuccacaaaguagaaauuuggauuuagacucauuaaucauacacacacacacacacacacacacacacacacacacacacacacaauuucuuuccccuuccauaaacaacaacaaaaaaaauccacauggauuuggaaaauuuugcaaugauaauuuaaaaaccacuuaauaccccgugaaauucaagcugguaaauugaauggacagugauauuaaaauauuucauuagaugcuuuuuaugccaaauuaagcugcugcaauuauauugauacucacagucugcauuaaucuaaaacuauuuuaauacuuuuucuaauuuagcaugauuaauucuuucauuuaagaacaugcucguuuucaaguuuugauuguuuuccuacuuugcugcuuugacuucucuuucccugaauauuuaauuuacaagagauucaaauucaaggggaugaaauccaauuuuucaggacaucuaccuaccugguaauaagguuuuacucuuguuucuacaacuuuuauuuucuccauguggcagaccaggccuuugacauauuaacuguaaagcaacucaauuuauuaaauauauaccuacaaccuugaaacccaaaaggccacauuucaaagagauucuugaauugguuugcagaauuaauauucugccaguuauaaagaaaaaaaguuacaagucuguguuuuucaaacugaacgaaugucuuuaauauaauuucugcugccaguaggggaacuagacauagagguacccuuuguuuagguaaaguggcugguugggugaauaaaaagagaauauguccauauuugccagugcucauaauuuuucugcagaaaguucaucaauggaauaauuaauucuguguuuguaaauaauuuggcucuuuaagucaaaacaaaugugucacauuuuggauucuuguuuaugaaauauguguuuuuguuuuucagcaguucucuccuaauuuggcuuuauuuuuaaaaaguguacaaguuacagcgccaauuucuuucuccaugaugcaccacgccauuguccuaucaauuacuaugacaauuccuauccuuccagacgcuaaugucauuaguccauggagaaccuuuugaaauaauuuacauagaaacugccuuuacaugcuaaaugaaaaaugcgcaacuauagucaauggaauuugaauuacaaucccaccacuggcggguugguuucauuugugcuauuuauuaaacaggaagaaggugaugcagucaauuacaaagcaauuaccugaacagugacugcaaaccggugccacauggcaauuauaaugcugccucuccaagaagggcuugcccuugguugcucuuucugacauccacguggcacccugggcccacccuuagcauccugccaccauuacacucagcagugcacagccagagccaagcugcuucugcagaaaccucuucuuaaggucauagacuuuuacuaaccccagggaugucauacuugggacaggagggucuuacccuauaagcagggagcuugggaagcauucuagcacuuccucaaaugagccaagggaaagcugacuagaugaaaucuucaguguuccuucccuggugggcgcaauucagaaaaccagagggcuucucgcugacuggcgagccagauggggcaaaggaaaugagugugaggccaggugccuuggugccucagugcccaggugggcaaagggcacagacacacaucaggcugggaagacugguuacuggguuuugguuuuugguuuuugcaaagccagcaucucugacauuugcaaggauaaaggcauccaaagagggcugagaggucugucuggaugcugcaaguucuaccagcaacgagcaggcuccuucccuggugcaauucacucccucccgcucuggaccuggcuggcauagaggccacucccucuuccugcucucccuuccaaccccaggagaggaggggacucuggauacuaagggucucucuuggcaaguucuuuuuuuuuggucuagagggaccaccagcaguaaccugaggcuguagcucaggcuucuucucauuccagggaacagacacagggaagccaacucucaaaguccuccucuugccuugauuccaggcauuuuagcauucaggcugaaaacgucccaaagccccacacugugggcuuuggaaguaccaaaaacagaugccgaagagagagcuuggcccucggcacggugccgcauggggucggaggccaggagguuaucucugcagaaaccugaccauuuuguuuaugguguucugacaaugcucagagccaugcagagcagcugcuccccguaccgagcugcuugacauucugccgagaagguggcugcggcucugcaaggaugacuuaugacauugacagcuuuuggggcugccgguccccuggcuucccugcuccaagacccgggccaucugccucuuacuuaagccugaggcccagaauguuagcacagggagaagaaacucaccagaaaagaaaaauaaggagaagagaaacagaacugggaccaccuauuuuaaccaauaagucaucccucccaugugaaucugccucccaccccaguggaugugccuggcagaagcgugggcaauguuuuuacaauaaucagaggaugacacugcccugcuuacaagcuuucaugggccccaucguucucagguuacauuccaaacacuuucacauaggugcacugcgggguucagugcccaccugcucaccagcccccucaggcucugcgcucuaaguaccugaacugcccacccuucauuuccuccagcacacacuuccucaggcccccagggccuuugcauaucccuuucccccaccaaaugccuuccccuucuccucauggcccuccccagccccauuaacuggcaaccucagugaaacaucacuucuucagagcuucucucucugauccccagauuagaucauauccuccugcucucagaucuuagaguuccugcacuuuuccucuauggcaguaaucacaguuuuuucauacaauuggaugauuaaauuguaucuccucuaccggacuggaagcuacgugagggccaagaccuugucaacgcagcucuccacuauuccccuuccuggccuguggaaggugcucaauaaauauuucuagaguaaaugaaccccagaaucaggaugauuagaaaacgaagacugacaaguucaagucaaaaacucaggauuggacuuagagaaagagcuggacccuggcauuugauccacggaucugugacgagcuaagugaccuuggaaauuauuuaaacuuucugagccucaguuucucaucgaugaaacauugcagaguuguuguaaaauucagauaaugccugaaaagcacuuauuguaguaaaggguagcuuccauuuuuuuauuguuguaguuaauaaauggcagaauggcaaguuggaaaacuuacuacagaacucugagaagacacuagagugagcuguacaguuccccuccaugagcuagaugaaugcuuuacacacauccccauggugaugugguacaaaugacuuuugcugaacaaaagguuucacccaucacuaagucaauaacacuaggcaccagguguggcccccacccugcgccaaguccugugggguggggcauguuuguuaaucagcaggacuucucaaacaucccuagagcaguuguaaauuaacacagccuuucugaaggaugauguagccauauggagcuaauuuuuaggcaguuauaucguuuaacccagcacuacuauuucauuucuaggaauauucuccagaaaacaauuguucagguaugaaaagccugguaccuaguaacuccucaaauaaauauuuguugagggcuuacuauaaauaaagauacaaggaucuuucucacggugugauuucuaauggcaaauaguaguaauagucucaaugucuaaugucagugaacagguuaaguauaugauaucacacagagucauuuaaaaauauguaaaucacuuaacauggagucaaguaaaaaaauacaaaauagcauauaugauauaaccccuuauuuuaguaaaaaaaaaaaguguguguauguguguguaugugaaaagcauucagaaagauggacaucauaggccauuauaucaaugucuuccuugucuuuaucuacuaucugaagucuucuacaauaaauauaaauucauuuucaaaccauaaagaagaaaaaacugcuuuuauucugagaagggggagauagagaggagaugauauauagucugccauggagggccuucuugggaaacucaguuuaucuguaaguuaauucaaaaaugagaaugagaaugagaaugagucucucucucuuacacacacacacacacacacacacacacacacacaccauugcuuggaaagauuaauuuaguucucuaguuuggcuccucagaaaguucagaaacugaacccugaaaucuaccucuuuggaauaucaacucagugauaccaguaucacaucaucuugauuacuguagcuuuagauuaaguauugaaauuaaguagggcaauucuuuuaacuuuacuuugauuuuuauaaauccuuuuagcuauucuuggucauucuuaugcuauauguaaauuuuaaaaauagcuugccaguuucuacaaaaaagucugaugagauuuugacagggauagcauugaagcuauagaucaacuuggagagaacugccaucuuaacaacacugagucuuccaauccaugaacaugguauaucacuccauuuauuuaagucuucuuuaauuucugucagcaauguguuauaguuuuaaggguacaggucuuacauauuuuguuaauuugauccuaaaauauuucaaggaauauuuuauguuauuuuacacuguauuuuucuuuaucuuuguuuuccaauuguucauugcaaauaugugaaaauauacuucaaaaaaauauuggccuuguuccuuuggccuuccuaaauucaucuacuaguuccaguaauuuuuauuagauucuuuaacacuuucuaugcacaugaucauguugucugcaaauaaaaagaauuucacuccuuucuuuuccaucuguaugccuuuuauuucuuuuccuggccuuauucaacuuccuaggaccuccgguagaauauugaauagaagcagugaaaguggacacauugaugauuucccagucuuagaaggaaguacaagaauaugcuauuaaauaugaucaggugccugggcacggugacucacaccuguaaucccagcacuuugggaggccgaggcaagcggaucacgaggucaggagauugagaccauccuggcuaacauggugaaauccuuccucuacuaaaaauacaaaaauuagccaggcaugguggcgggcgccuguagucacagcuacucaagaggcuagaggcaggagaauugcuugaacccaggaggcggagguugcagugaggcgacgucacaccauugcacuccagccugggugacagagcaagauucugucucaaaaagaaaaaaaaaaaaaaaaaauauauauauauauauauauauauaugaucagguguaggcuuucuguagauuuccuuuauuggauugaggaaauucucuccuauaucuaguuugcugaaagguuuuuuuuuuuaaucaugaauggguauggaauuauaucuuuuucuucaucuguugagaugauuauauggucaauauucuuuguucuguuaauacaauuaauuacauugauuagcacauguuaaaccaacuuugcacaccuucaaucaacauaauuaaucgugguguauuauccuuuuuacuuauagcugcauuccauuugcuaauaucuuguuauggauuuuuacaucuauguucaugagagauauuggucuguaguuuucuuguaacgucuuuaccugguuuugguaucagauauccuggugucauaaaaugaccugacaaguguucuaucauccuauauuuucugaaaauguuugguaagccuaacauuauucuugccuuaaauuuuuuuaaaucaaauucaccaugaaggagguuucuuuuuggggaaagauuuuaaauuacaaacuuaauuuaauaaauauagagcuacucagauuuuccauuuugugucaguuuuaagaauuuuuaucuuuuaagaaauuuguccauuucauugaaguugccaaauuuauuuccauaaaauuuucaugauauccuuuucugacaccucuuagguuaccuuuaauguguauagcaucuguagugaugcauccuuuuuacucauauuaauaauuuguauauuucucuguuucuuaaucaagcuagcuauaauuuuucaacuuauugaucuuugaagagagauagcuuuuuguuuuauuaauguuuucuauuguuugucuacuuacuauuucauuuauuuuauucuuauuuuaauauuaccuuuuuccuuacuuauuuugguuuuaauugguucuucuuucucuagcuucuacauguaaaaguuuaggucacauuuuaaaccuuuguuaauaucaauuacauuuacugauuuuaauguaaauauaguguaagcacuucaaacuauaaauuuccuucuaauaucugcuuucccuguacuccauacauuuucuaugugggguuuuaauuuucauucauuucaaaauauuuucuuucuucuuuuuuuuuuuuuuuuugagauggaaucucacucugucucccugcccaggcaggagugcaguguugcgaucucggcucacugcaaccuccgccuccuggguucgagcaauucuccugucucagccucacaaguagcugggauuacaggcacccaccaccaugcccagcuaaucuuuguauucuuaguagagaugggguuucaccauguuggccaggcuggucucgaacuccugaccucaagugauuugcccgcuuuggccucccaaagugcugagauuacauccaugagccaccacgcucagccaauauuuucuaguuuccuuuauaauauuucuucuuuuaccuuaagcaguauguuguguaauuuccacauauuugggaauuuuucagauauuuauucugcuauugaauccuaaauuaauucaguuacugucagagaagcaguaaucuuuuuaaauguaaugagauuuguuuuaugacacaguauauaguuuauauuaauaaauguucuauguguaagaaaagaauguauauucugccacuguuggguauuuauuucaaaaaugucaauuagaucgaguuguuugauaguguuauccaaguuuucaauguccuuacugauuuccugucuccuaugcaucacugagaaaagaaucucccacuacaauugugaaauuuauccauucuuccuuucaauucugucacuuuggcauguauuuugaagcuguguaauuaggugcauagacaggacggucauguuuuccuaacggacugacccucuuaucauuauaaaauaucucucuuuaucuugaguaauaguucuuguccugaagucuacucugcuugaucauauauucacuuuaguuuucuuaugguuaguauuugcacacucuauuuuuucccaucuuuuuacuucuaacccauuugugccuuuauuauuaaaguguuucuuguagaaagcaugucauugaguauuaugguuuuuuuguccagucugauacucucuagcuuuuaauuggaaugcuuaagccauuuacaguugaugcaauuauguauauggcuggguuuaucucuaccaucuaacacuguuuucuacuuguccuguuucauauuccucuuuccugacuucauuaauuugaauauuuuugagucuuucauuuuauauccacuauuggcuuauuccuauaucucuucauuuuuaguaguuugcucuaggauuugcaauauauaucuucaaucauaguauucuaccuucaacaaauauuagagcacuucaccaaaaauguaagaaucuuucaacaauauacuuccacuucccucugcuuuccuuuguaucauuguugucacacacuuugcuucuauauaauguuauuacuuauguuuuagacaaucaauuaucuuauuuuaaacauauuuuugagcuauaauuuauacaccauaaacgucacuucuuugaaguguacuucaaugcuuuuaguauuuuacagccuugugaaacugucaccauaagcuaauuuuggagcauuuucaucaccccaaaaagaaaccuaauacucauuagcagucaccccucaucccuaccugacacacacaccuccagccuuaggcaauuauuaaucugcuuucugucucuauagguugcccuauucugggcauuucauauaaaggguaucacauaauauauggucuuuugugacuggccucuuucacuuagaauaacguuuagaaguucauccacguuguggcauguuaucagugccucauuccuuuuuauugccaaguaauauuucauuguauggauagacuacauuuuguuuauuagucgguggacauuugaguuguuuugacuuguugcuaugauuaauaaugguauaaguuuuucugugaauaugcuuuuauuucucuuggguacauaucuaugagugaaauugcugggucuucugguaacucaauguuuaacauucugaggaacugccagaauguuuuccacagcagcaccagcauuuuggaucaccaucagcagugugugaggguuccaauuucuccacgugugugaacacuuacuauuaucucucuuuuuuuguuauagccauccuaguggguaagaagugguaucuuguugugguuuucacuucucugaugauuaaugaugcuguuaaauauauuuucguguguuaauuggcuauucauauaucuucuuuggggaaauaucuauucaaauuauguguccauuucuauuauuuuucuuuuaauuguuaaguucuaagaauuccucagaauguuaaacauugaaaucauuucucaaccuaaagucacuagauuuauucccauguuaucuucuaagacuuuuauaguuucagcucuuaacauuuaggucuauaaucuacuuugaauuauuuuuucuguaugguaugaggcagggguccaauuucuuuucuuuucuuuucuuuuuuuuuuuuuuuuuuuuuuuugcauguguuuauccaguugccccagaaccuuucugaaaagacuauucuaucaugauuaaauugucuugguccuuuguugaaaaucaauugaccauaaaugcuaagacuuacuccuggacucucaauuuuauuccauugauuuauacgucuauucuuaugccaauaccucacugacuugauuaccauagcuuuacaguaaguuuugaaauugagaauuuuuaguucuccaacuuuguucuucuguuaaagauuuuaacuauuccaggucccuuguauuuccauauaaauuuuagguucagcuugucaauuucuuuuaaaaagccagaugauaguuugauaaagauuacguugaaucuguagaucaauuuggggaguacugccaucugaacaauauuaaguguugugauccaacaacaugagaugucuuuucauuuauuuagaucuucuuuaacuucuuucaagaauauuucuguaguuuuccauuuacaagucuuaaacuucauuuuaaaaauguaucccuaaauauuauauucuucuugaugcuauuauuuauaacugcaauuguuuucuuaauuugauuuucaaauuguuuauugcucauguauauagauauaauugaaauguucccuccucuucuauuuucuggaauauuuuguguuauuauucuuuaaauguuugguagaauucaccagggaauucauaugacccuugguuuuucuuugucagaaaauuuuaaauuuaauaucucuguuuuuggucuauucggauucucuguuucuucuugaguaaacugcagucauuucaucuuucuaggauuuuguucaucuaaguuaucuaauuugauggcauacugcuguucauaguauucuuuuuauaauccuuuuauucuagaaggucaguagugauguucucccuuucauuccugauuuuagucaccugggucuuuuauuugucugucuauccaucuaucugucuaucuauugaucucuuuuuuagcucuuuucucccuuuuuggggucucauauuaucuaucuacugaucuuuuuuuuaagcucuuuucucaguuuuggggguauuguaucuaucuaucuaucuaucuaucuaucuaucuaucuaucuaucuaucucuuuucucaguguaauuaacaguuuaccaguuuuguugauauuugagaguaucaacuucugguuucauugauuuucucuauuguuuuccauucucaauuucauuuauuuccacucgaaucuuuacuacuuccuucuauaguugucugcucaggacgcuauaacauaaugccacaucuugcaugccuuaagcaacacaaguuuauuuuaucauaguucuggagucuaggaguccaugaucaagaugccagcaaauuuguuucugaugagaguuuucuucccggcuuguagguggcgagcuucuuguuacauccucacauggccuuuccucuuuccucggucugugcucacagagagagugagcucucuggugucucuucuuaaaugaauacuaaucauauuggaucaaggguacaucccuaugaccucauuuaaccauaauuacuuccuuagaggccccaucuccaaacacagccacacuggggcuuauguauucagcauguaaaaauuggggggauaugcaaacauccaguccauaauacuuuccccuggaugauuuuggguuucauuuucuuuuucuaacuucuugcauauaaaguuagguuauuguuuaagaucuguguucuucuuugauauaggcauuaagagcuauaacuuucccauaaguguuuggccaauuauauuuucaagaaaguguuuuuaaaccaagaauaaaaguaucuuauauuuacuuacacauuuaccauuguuuuugagacagggucuuacuauguuguucaggcuguccucacacuuuuggacucaaacaauccuccucccucagccucccaaguaucugugauuacaagagcacauaacuguguccagccauauuuaccauuucuagugcuccucguuccuuuauguaaauaggaauuuucauccuguaacauuuucuaucagccugaagaacuuccuuuaauauaucuuguaggccaggcacaguggcucaugccuauaaucccaguacuuugggaggccaaggcaggcggaucaccugaggucaggaguuugagacuagccuggccaacuugaugaaacccccucucuacuaaaaauacaaaaaauuagccaggcgugguggugggugccuguaaucccagcuacucgggagggugaggcaggagaaucgcuugaaccugggaggcagagguugcagugagccgagaucacaccauugcauuccaaccuggguaacaagagugaaacuccaucucacaagaaaaaaaaaaaaaaauauauauauauauauauguguguguguguguguguguguguguguguauguauauauguguauauauauguauauauguauauauauguguauauauauaaauccuguaguauagaucugcuagcaaauauaucuuguaguauggaucugcuagcaacacuuuuuuuggucuaaaaaugucuuuauuuuaccuucacucuugaagaauaugcacacugaauauagaauucuagguuuuuccuuuuagcaauuuaaagauguugcauugucuuccagcuugcaauguuuguaaugagaaaucagugguaauucuuaucuuuguaauguguuuuucucugccuaauuaaaagauuuccucuuuguugcugguuuuuagcaaacuugauuauauuucuugauguucucuucuuuguauuucuccugcuucuaggaucugugacucuuuaguuucaucacauuuggaaaagucuugaccaccuguucuucaacuauuuuucugccacccacuccucauggucugggccuccaauuauaugucuguuagaucauuugauguugcucucuaguucucugauacucuaccacacucuauuauuuuucccccuaccuuucuucucugagugcuucaguuuaagcaguuccuguugcuuuaucuucagguucacuuaucuuuuguuuccacugugucuaaucugguauuaaucccauugcgauaaccagacucuaaaaugaccccaaaugaaaucuacugccugguauucaaucccuuguguaaucucaaccuguugauucugggcauauugauaacuggcuuccaacucaugggauacaucaaagaugaugagaugucacuucuguaauaagguuacaaaaaacugugacuucuauauugcuagcaaacuuucucuauuaucuuucuggcuugcacucuuugaugaagcaaccugccauauuggagguccauauagcaagguaacaaagguggccugugcccaacagucagcuaagaacugaagcccuugauccaacaucugucaaggaacugauuuuguaaaacaaucaagaaugcuuagcagcagguccuccucagucaagccuucagaugagaccucagcccuggcucacaccuugauuucagccuugugagaggcccugaugcagaggacucagucaagccaugucuggauuccugacccucagaaacugugagaucauaaauguguguuguuuuaagcugauacauuugugguuauuuguuacauaucaauagauaacucaucuggugacauuuucacuuuagauauuguauuguccaauucaaagaauucucuuugguucuucuuauauauuaugguucucaccucacucuguucuucuuuuccuuuaaauggcugaggauauuuauaauagauuauuugaagcucuugucuuuuaauuccauaucuauguuauuuuggguccucuuucuacuggcugauuucucuccuggauauaggucauauuuuccuguuuccuuauauguuuaguaaugaaugcagggcauugugaaugauauacuguugaguguggauuucguugucuuacuuuaaagaauuuuggauuuagcuuuguuaggcacuugcauuauuugcagaucagcuugcucauuuugauuuguuuauacgcuuuguuaggguaggucuggaguugucuucacuccagggagaguuuagcuccauuauuaagaugugaucauucuggggucucuguggaauacccagguguucauuagcaucucuucacaccgacuaguuugaacuugaacaucugccaguucugggugagcucugagaagucuuagcuucuggcucacagugguucccaguucugugugaacccugagaaguuuuagcuucuggcccacagugguugucuuuugaccaaccucauacaguuucaugaugcauacacagcuuaguauuuagccaaagaaucaaggacaucuucuauccagauuucuggaccucuuucucugcugacccccccuucuccucuguacucuucagcacucuacccuauggauuccauuugucucagccuccccaaacucuaguugucaccuccucaacuuugcuacacugcuguacucugccugguugccacucacccccaugcacugucuggaaaaugccuccagccagaaagccagagcuuguuuauuuccuccucuuagauauuacaguccuuccugccugcuguccauuauccaacaauaguuguuuccuauauuguguccaguguucuaguugguuugggugggaugauaaguucacuaccaguuacuuugccauggccauuggaagccucuggacauuuuuauagguguccaagagggagucagauuagcacuuagcucuaccccuuggguucuuaagcuuugugcagaugcucagcuggcuuccucacugagaggggcaggggaacaugcaucagaauguugcucaccagcugugucagggccccaagaucccaauguucacuagcagcccucaugacaaccaaucccuuugccaucucagcaaaugacucaucagcaugugacaaaagcccaucacagggccccucagccuaccacagauuuguuuauucugugagcuccaucagauuccccagcugcaaagugaggugcucagaaucucugaacuaaaacccuuggccugcugguaggucugaacaguuaaauauggaguaugucacaggcaucuggcacacugcuacagagagccucuggagccucuggcuacaggggcccucuuaguccccuaauagaggcacaaacuccaggggaucaauccugcugaugugcagaaucauugacccagaaagcuccuaaaacuuuaccaaugcacaggucucaccauggaacugcugagugaaaaccuaggcacuccauggcaauuccaacacaguccugugcauucugucuucuuuuaucuuaugaagccaaagaacucauggauaugaauugaugacuucacagaaaugcuggcacugugaagccaucuaaaauccaucccagaagccauaaagguaacucuacuccaagaagggaaaaaaacugggaucucuccaaaucauggcacuuuuaaauaggaaggaaccucggagaacauucuggcccaccucucuuccacucucuuagccuuuccacuccauagaugaagaagccaacagccagagggucuaagggacauauccagcaucacucagcauaaagcaaaguuaccuguccagaaccucccccacugccuuccagaccccugcuacgaucccaucaguggcuucucaugacacuuagaacagaauccaagaucuauaccacagcugauccugcugugccaccuggguccuggccccuccaccgcgcccccuccuuguccacugcucuccaggcccacagaucccuuucuggcaguagagcaaccaagguccuuccagccuuagggcauccacuguccuguccccaagaaagcccugcccagcucuuugcagcaauggccuuuccucccuuagucacaggccaaauguuccugccuccuccgucaccaagggccagugccuggccacuacuugucaucuaggcauaugcauugcacacuguccucuaguccuucucucagggcuccuaagggacuucuugcacuccucuguccugucuguuucuuccccgcucccacaaguugggagcuucgagagggugaagaaccuaucuguuuugugcauuacuguauccccagugccuagcaaaguguggcacaucguggacuuauguuucuucaauaaauggaugcagggaagaauuaaauuauuaaccaucaacugauaaauggcagacaucccuuugucucuaacucccaagucuuaugagggaaagggcucuggggucccaggccgucccugugguggacccacaguggcgcucccagccagaaguccugcuaguaucagaucacacucugaacacaccgguguccaaaguccaggcacccuggcacauggccaggccuaggucuggccgcaacugaaccauguuccuuguucccuccucugccaagcacgcccccgcucugcagaccugccucggggcaggcuuguucucuugccaaucuacuggaucugcauaagcaaugaaggcaaauuuaggcuucaccaguuuccacuuugaaacaaccugggagcugggcuccuccauccaccagcagagacuuuaauauuuaagcuagaagcaacagccaaguacugucaagggaagagagcuccacuuucuuacacuauguuguucucccaggugccuuucaagucuccaagcaaaccaucaaacaagcccuacccuugucacugagccguauccuguuucucauuaugagucagagccugacgcaggaccaguggaagaaucagagucuugguaaugggugugauuaagaguaaucuaggucuccagccucucuguuagucuagggcaggcccagggcuguccaguggaaauauaauaaagccauguuuaaacuuugcuaguagcaacaguagagaaguaaaauggaaacaggaaaaaugaauuuuaauaauauauuuuaucuauuauuucaacauguaauccacaaaaauauuaauggguuauuuaaaguggcuucuuuuuggccaggugcaguggcucacaccuguaaucccagcacuuuaggaggccaaggugggcagaucacuugaggucaggaguucgagaccagccuggccaacauggcgaaacccugucuuuacuaaaaauacaaaaauuagccaggcauaguggcaggugccuguaaucccaguuacuuaagaggcugaggcaggagaaucacuugaacccgggaagcagagguugcagugagcugagauagugcuacuacauucuaaccucggagacagagugagaugagacucugucucaaauaaaaaaaaaaauuaaaaagcuaaaauaauaaaaaguggcuucuuuucaugcuaggucuuugaaaagcugugugggucucacacucauggcacuuggaugagccacauuuccaggacucaccaccacauguggcucauggcugcuggcugggacagcgcaggaacaguucaccugcucaggagcugacccugaguggguggcacuggcacaucuaacucgaggcugccugagaaguucugcagcagaaaagacaagcacgaggccagaaaaacccggcucccuggccccugaggcucccuccccaccccugcaggcccuggugucagccaaggaagccgcgacugcuacucagagcauucucuugcugcuuggauuaauucacuuguauuuauuuggcuuuuuauaaacaaaagucaaacuuaaggcauucuauucaucaaaaggaaagggcaguacuccuaaggggaucugucaaacagaugcucuuucuguaaauaaauaaaaagguggccgugcaggaaaggaaaauuacacugaacugaagucugcgauauuuuuuccccuuucagauccauaagccaaaauauugcuaagucuuuuuauaaacaaagauaaugaguuguauaauuuauguaaauuaacuaacgcugccgcauuuucuagaaguaacauaaacugcauuauuuauuugaugugcuuuuuggaguaaaaauaauuauaauuggauauuauaccuaacagguuucuccuauuguuuucuuauuaguguuugugguuuugaauacaaaacacagaaucaccgagugcucuacacacguggcuuuccuuuugcacacaugaaagcagggaugaucuuuuuaaaagacaagagucugaccaagguccuugaccacaacuccugcgccagaaggaaacugcaugugccagguaucacaggcauggcuuccaucggcaggcacuuguucucuuccauugugugugguacuuguugaucagcagccuuuguagaauacaacugacuucacuuccacaacacaaaguaggauccguggcaccagcagcaucagcugcaccagggacuugcuaucaaugcagcaucucaggccccacccagaccaacugaaucagaauccccagggcaccugucugcacaugaaaguuugaggaaugcuuuucugcauccuuugcagaagcguccuuugcaggagcauccaggcccuuccugggccccucccagaggagacaacuagagcugugcacaggaaagacacugagcugacccccaaguucaucuguuccuggcucucagcauuaacccacacauccccucauaucuaacauauauugaaaugagcaauccauaaccacacacugcaauucuuaauauuaucauauuaggagcauuaaaaauucaagaaaguauaauuaagcaaaaugaauuaagcaaggaucuugaaauauacagccuuggaaauacuuuugcugccuaaaugcucacuaacaucuguuggcuucgaucaugcuugcuagccucuucugauauucuaagcacagaauaugguaaaaugccagauguaaauagcucugauucguguccuuguuuauguagccaaagauggcccuaaaguggaagaaggaacucuacugaaagcccauagaucucugggcuuucaaauauugggcucucuagcuccuuacacccgggaaaaaggguuaugcacucaauaccaggggugaggaacaacagaacaaaaacaucucagaccuaaaagaaacggaggauaauucacugaauuuauuucaucucaucucccuuaaucauguaaaaacaaaacccaaaaauguucugcauucugguuuguguccaacacaauguacaaacuaauugaguguaaaaagcguugcuuugcauuauaucaguuaaaguaaguguaacaauugcucucccuacccccgagcucuguuucauuucugguuuuguuauaauucaguccauucacaauaugucacggcaaacacuauuugcaaaagaaaguauaaaaaacagauucuuuauuucuuagugcauuuauuuccauuuccccuucucagccucuccacauuuauaccaugcuuccaucuggagggcuuaaaaaaaguuauagacgaaguuacuauacauaaugaagcgcacacuugucugguauuuagccugagaaucuuguugccagguguuaugaaagggaaaaaaaaaaugcggccaaaauaccgugucgcaucucguuuccaaacauuucauaucaugucugaaaguauucauuaaucugggaggggagcuacuucaauaagguuuacuuaaccaaccgccuuccaggaaaaggcaagugugaucgguucugcaccuggaaggaggcugcuggcacccgaccucucugccaaugucaacacacgcaucugcucagucacugggaggaagcaaccacccuucaucagacaccagaagugcugcagcagcagcucucagacgugcauucagucauucaggaaacacacaccaagccuuacugugcuaggugcuggugugacagaagcaaccugggcaacaacaagaaauggcaucgcccaggcuggugucccuugaagggguguccuaggaguuuccugcaaaggggaaaugaguuugaugagaacagagcaaccccaccagcuguaaagcaaugaucaaggcagccucguucugcccaccuuuuagguggaagcuauaauuuaagacuuuuuuuugagguggaguucugcucuugucccccaggcuucagugcaacagcgugaucucggcucacugcaaccucugcuuccuggguucuagcaauuuuccugccucagccuccugaguagcugggauuacaggcuugcgccaccacgcccggcuaauuuuuauauuuuuaguagagacgggguuucaccauguuggcuaggcuggucuugaacuccugaccucaggugauccgcccgccucggccucccaaagugcugggauuacagacgugagccaccgcgcccggcccauuuaagacucuuugaacuaugucacagugaugaaagaaugagcagucagcagcaaaacucacuuguucauggacugaucaguccauggaaggccaagcagauucuguguguaagaaauaauugccgagcaguucaguguuuacucuuuugggaaacuaaacuuaauauggcauuauguugacaauuaggucuaauuccauguauaaaagcauccaacaaaaugaaggguuuaaguaaaauaccagugugagggcaccacaucauauaaaaggauuaagcguugcuucugcugcacagcauguagacggguaaggaaucugggggaaaacaaggagucuugggguuucccaauuuauuuucccacagucuccuauggaaaagauuacaguauuuaaccucugucugauauuuuugaaagaaaaagaagucacacaguauuuugaaacucaagcuaucagacaacgccaacaccucguuaaugucacuguaagccugugggcuuguuauucaucauugaauguuaccugggagcuccgccugcauccucuguccugaggugauggcuggggcgccacaugccggaugccuucagcaaagcccucccugacucuguuauuugagaacaggaaugccuccaccuccaccauccgcaaagccuagugaaacggggcauucugaucugcuguccuugguccagaugcaacucacuagaugugcuuggcggccuuguuggcuucugcaugaauugguucaggguaacauucuacaucccaugugagcugaccucacuuccguuggaaaucugagaucuaauaguuacucuuagucuuuuccaagacuuaacccaaucuguuaggaaauuucaagccaaugggaugacaggcaaauacaccauccuggucucuaccagcaucucagcugcugcaaaacauagaccucaacagagcucuuagcauuaaaaguuaucaauagaaacacaaaaccauggagacuaaagaacgaugaaugccagguacuaacuaaggaauaaaaacgcauccucgacgcacaaaggauguaaggaaccagagggaaggaaggaacccgcagccacuugcuguggaauuuauguuuccauaagugaagcauuagaauucucacaucgagaagaaaguauugauauguacgcucccuaaggaaggauucucaagaggcccauuccagauuuaauaauaauccauauucuuucucugaaaaggcaaaccgaaucuuugauuuccuuaucaccaccacagaugcaugaaucauuaagcugcaaaccagcagagguucaguuuaucacaugccaccuagaaucuuuaauaaaauacauucuaaguaaucaauucaugaagagucaacauuucuuacacuuuugugauaaaugucuaccucucgcauccaucauaaacuguagguaaauuguggcagcaaagaugaaagagagccucuccaguuuucucgugcugucauguaaauacuuaaacauggacaaauagcaucugugcccucccaucggucacuauucuagggggacucuguugcauccagcaacauacaggcuucauucaaagcacugcacgccuaaagaugcaggcaguuucagccuaucuucugugacaccccaauccuuuaacccaccuggucucaacaaggacacaugccauuggcucagccauccccacuagacaggagaacacagaguguaucacugggacuagcccugcccucucuacaaugccaugaagcagugcccugagcuuuuaagagaaacaggacauuucucaauucccacauucaaacucuccuuugcaagagacauugccuaauguuuucaggcugaggacaauucaagaagaaacaaacaagccuaugcuacaugcauuaaagaagaaacccuaaccucaccagguauguuguaaauaaaaguauacauucauugcagaaauauaagcugaguaugaauagcaucaggcggcuguaaacaugaguagcaggacauacacagagcaccccacuccuucuagaaaccguggccauaaucuaaaacaggaguggaccaacuacauccaugguccaaauccagcccacagucuguuuuuguaaauaaaguuuuauuggaacacagccacgcccauuccuugacuauugccuauggcugcuuucaugcuacaauggcagaauugaauuguugggacggacagucuggcucgcaaaacugaaaagauuuacugucuggcccuuuguuuuaaagguccauucauucaaaaucuuucauucuuuugaaaaauguaguuauuuggcaccaaagguacucaauacuaggugccaugccaagcacugggcuauagcagugaacagacaggcaaguuccccguucagaggagcuaaaggauggaagaacaggaccauuucacccagagaacaaaggcugagggaacuguuuagucaucgccacucaguguguucugauuucagaaaccugcuauucucuaucgcucauugccaagggcagaauaaagaaugauaagcuccagccauaucauuggagauuucaauucgauauuuucuaaaggugcuugaagucaagucauaaauugccagagcaacuugugaaauuuucccuuggacuuuucucuuaagacaagguaaaauaaauaaauaaauaaccacuugccugggggcaaggcacugaggcaggacccuacuggcaacaacagaauggcgugucccaauccuuuccaaauuaaagugugugugaaccaccuggggcucauacuaagacgcagacuuggauucuguagaucuggguuggggccugaaauucugcacuucuaauacccccugggugaugcugaacauaccaaucuuuggaccacacugaggguagcaagaagcaauacugaccgcuucaguauuugcgccggucucagguuuugcgcgaguuacaagcuguugaauuacgaagugcaaggaggacguggaagguuauuucaucuguccaggagaaaaaccucaugaagcagaaaggcgcucuuucaugaaaucaccugcuuucccucuuccacuccggccuugcagugagggagggcauccacagggaagcucagcagccagaaacccacacacccgcacagaaggaaacaaggggccggagccagcggccaucaaagcagccucaccagagcugcugcgugaggagcucguuccuucuuuaacucguuugguaaaauuuuucuccccagcuccuacugguggcaaaagagcccuucauuuacacccuguuuuccucaugauuuuugccccggcgugugggaagcagagugguaugagccuacuuagcccguaagccauaucccugcccucugcuggugccuaauccacgccaacuaaagugaauggccgcgacuauccgaggacaagccuggagauucgugcugacugagcauaaauucacacggacauaagccacagccgccaaugacgggaggaaacuuccccagcaacguuccccagcaaugaaagaugcagagaggaucaauauuugaugauucagucaagugauggccagagcuacucuucacccaaggcaaauaaccaugucuggucacuuaccaaggggaaaaguaucuauuauggucuuccaaugccugcccgguuucugggugaggcuguaaauuaugcuugcaaacauccagguugugugaccuggguaauaccucacucagucccugcuguguguuggggaccaaacagagaauggcccuuggugaauuucgacagugguauucaaggguuuacauuguaacugaauaugcuaaaauuuccauuccuguccuuaugggcuaacgugcagugauguugagggacuauuaugauaauaauuaaguacaaguucagcacaccaaguugauaugcugcugcucuaccuucaucagggaguuucuagcuuaauaaggcucauaucaaguuuuaaaaaggaaauuacaaaauauuguauguauugucaucuaccagagauacaaggaaggcagaaacuacaaucacacuuccugcuacauauuccuggcacaucuuuuacuaacaagcuucucccccaacaccaguggcagaagaaggcuugaauuucuccagguugcagcaucuaacggcaccagaucuggguaucuggaaguccucacguuuugguauuugagaaacauccaggacucacuuuucagagggagcacgaaaguccccagcccuggcagcauuuggcuuugcuagcaaccugcuagcgugucuucuccucagcaauggccaguguccuuccugccuuuuaugguccccacaucaaugaugugucuggagauaaaccaacucacuuccucaugucuucaaugggaccaauauccaaaacagacaaaccucugucugcaaagguucaaaggaacagcucugaugcuuggaggguugucagauaaaauacaugaugcccagcaaacugugaguuccacaaaagcaacggacaauauuuuaauauagacauacuuguacuaaaaaaaaacuguuguuuaucugaaauucacauuuaacugggcaucaauauucucccuuguguguguaugcacacaugucugugcauguacauacuaaaucuggcaacauacaaucuggccugcguagcaagaguacgcacagacccucgcugccagagugggugugccguggaagcucggaagcuacggcuucaggacaaauggaaaugggcaguucaugcugggaggagauaaacaacuuguuauuccuaagugaaagcucucgugugaauguauaggacucaacagcucuuggaucaaauugcaacugaggagugacagccaguuaugcaguguguuuggggaccaacucccaaccacugaaguggacagcgagggaccugcugugucuuugucuugcagaccguggaugaaaugaggaugacaauaguaucuaccugauagggauguuaccaaguaacugaaugagaugaugcagauaagaugaugcgcacaggacuggauagucaguaaaaguucaaaaaaggaugcugugauuacugcugcucuugucauuuggcuguaguuagggaagagagagccuuaagaagacugaaaaucuguguucccccaacauguauaugaugaaaaccaacccccgcccccgccaugcgaugguauguggaaguggggcuuuggggaggugaucagaucgugagagugaaggcuuucugaaugggguuuguuugugcccugauaaaaggaaccccagagagcuccuccugcccucccaccauguaaggaugcagugagaagauggccaucuaugcaccaggaaacaggcccuugccagacaccaaaaugcaccaggaaacaggcccucgccagacaccaaaaugcccaggaaacaggcccucgccagacaccaaaaugcaccaggaaacaggcccucaccagacaccaaauccgccugcaccuugauccuaaacuucccagccucuagaaccgugaggaauaaauuucaguuguuuaagccacccagucuaugaucuuuugugauagcaacuagauguggcuaagacagaaggagaagcaaaaccagcacccugccaggccuuugugaacucagcagaugcaaacagaaagggcugcucuugcuuuguuuuugcuuuuguuuuuguuuuugagacggagucucgcugucgcccaggcuggagugcaguggcgcgaucucagcucacugcaagcugcgccucccggguucacgccauucuccugccucagccucccgaguagcugggacuauaggugcccgccaccaugcccggcuaauguuuuuguauuuuuaguagagacgggguuucaccauguuagccagguuggucucgaucuccugaccucaugauccgccugccucggccucccaaagugcugggauuacaggcaugagccaccgugcccggccuagggcugcucuugcuacuucaaaauggagcuagcuuaauguuauuuauuaguuaaauuuuuaauuauaugaauuggguagaaacaugucaccagggaugccaaguaauuagaaauuaaggaagaacuauggauuugagcuccugaauugauucuaccaaaacacauccagguaacaggaaauuaaguuuuaacuuguuaguauaccagcagaacgaggcacaaaaauucagaugaugaaaagccagcagagagccccgggagauucccugaggugccccugaacagacgcucccuguacuagaaacggucaugagacuaagacaccucaaccagcagggcuugaagccagacaggaggggcagccccacuucugaaaccaaagaccuagguucaagucccagaugcacaaccaacgaggauaaacguaucugccaggacugaaucacaggguuggggugagguuugcaggaaguguaacuguggaagcaguuagucacugggcaaaucuacuucccagagcaaggucgugugggguagauucuguagacacucuguggagacuccuuguuacuuagauuuggauaccagauacaggauuucuagcagggagaaaauaaauacucgauguaucuuuuuugaacuggacaaggcugauaggaaggcaaccugaacacuuccuuaagaaggguacagauggaaagcaacggcaauguaggggaggaaaucaucacuucuggcuaaagaagaucaggggagauagccuuggggcggggcgggggagaaucagaaguuaugaggcuaagacaauguggaccuagacgugggaaaaaaacagcuucugaaugaggaauacgguaggguauggacuggugggugcacagugaggcuggaggguaauggaguaaaauaaucuguccacagaccgaagacacauguuuuucuuuuaauuuaauuuucuuauuauuauaauuuuuuauuuuuuuauuuuaauuguacuuuaagcucuggcguacaugugcagaacaugcaguuuuguuacauagguauacacgcgccacagugguucgcugcacccaucaaccugucaucuacauuagguauuucuccuaaugcucucccucuccuagcccccgacucccugacaggcccagguaugugauguuccccucccugugcccaugucuucucaguguucaucucccacuuaugagugagaacaugcgguguuggguuuucuguucgugagacacaugauuuuuuacuaaaaguagaaauacguauuguaugugaaacacgcagcgccucccugcugguuuguuugccuucugugagcuccugccccucauucauuucauuaggcaccuuaccuccacuuuaucuauuuauugcuguuuuucaaacuugauuugggcaccauacauguucauggcuggcuauuuaaaauguuuuccaguggcugcaagcaagauaccaauuuaucuuauggcugcaagcggagcugaaaugaucuggcauugccacagggcagacaguuauuucaugcccuguuaauuccuaaugcaguaacuacaauaucauuccuauuuuaaaagaggugcuuucuuuuuuuuuuauauguggccuaagugcccaaauaaagaacaucacuucuaaugaggccaagucucaaaacauaaccucauuaccaccacugccauccuaaugccgggcuucuagcuuuaaggcaguuaagaagucaaagaaacucuucguuguuuacaggcaauacaaacacaucagcaacacuguguguucucuucacaucugaaaaugacagucagacgugaggggcugguguuuccacccaaagaugguccaggcuaggggguuccuucugccacagaacaggcucaguggacagggcugucucugugcaugugacagccaugaaaccaacagccucugugcugugaccacccacugguuccaaaggcagaacauccauggcaagucacgccuuaagagccgagagggccgcguugcuaggaggauaagaccuggucuggauaggccugggggaaauacugacccaucacgauucugguugccuguugcuucaagucacauuggcugauucucaacagacucuauucauuaauauuucccagcccuccucugucacuugacccgcucccaccgcaccccacuuccuuaugcucaugucacuuccuucaggccaagucggccucagguuccccuccugcaucccccacacagggccuuguaauucuaucacagcccucaaaacccugcaucaggguugcaugauugauuuuuuuagucuccccaugagauaggggaccacacguucucuuuacaucacugcaucccagcaccuauugccauacuagguggauagaaagccuccaauccccaguggaugaaggaaggaugugugcuaaauaaauaggugcugacuucaucugaaaagucuacaggccccacccgaguaccccgaaggaacugauauaauggcaagagcuugagcuuuagaaccaagcagacccaggcucaaguaccagcucugccacugacugagguaugacguagggcaagagacacccucucugagguucaaucucuccaucuauaaaauggguauaauaccauguacuuugcauggauguguuuaugaggauucaaugagaugauauaccugguauauaggaaauguguaagcccaugacugucucaguaguaauuguguggcucccaucuguugugggaacccagcagcaaagaaacuggagaggacaagagcccagagcugccuuggguucugggacacccagcacucucagcagagagaugcggacacaggaccuaaggcagccccacaagcuucuggggccagagaaaaguaucaugaacuuggaaggaauucuuccaguguggcccagagaacagcaucaccucugacuaaccucccucagcucauccgaccacaaagcugcagugaccccggaaccagggugaugcuucacauccagcucuucgcucucugagagucucccacucccaaagcuccuccacacugucaggcaccaaagaagcuggcauaaaucuguauggggugcagggccaacuccagaccugcugagauuucaucuccugaaacagugacaucgcaaccacccucuuuuuccuuccugccaaccuuugucaucccuggaaaccuuaucgagcuagcuucuccuuggcuugcagacaagacaacuaaucauggaccuaacagcucgucagcuucaaaagcagcugcccccauccugugccuggcugagaaaaucaaugugccuuugaauugccguguguagagagggccccagccucugagaacaaaagaagcgagauggcugaacaguuccauaaacagggcuggaaguuuuccuggccugagggaaggcuuauagcaagugauauauuaaacgguagauccaaauaucuuuaucaugccccugaacugaggaaaacagccccggugguagaaaaaucacagcuccaagacccugugcaggacuguccaccccaaccagcagaagaguagcuggcuggcgccgugccugacgugaugaagaugcugagucuaugggaaccaccugauugaauccaccaaagacggacgcagaguccaaacucagaagcccccuccuccugugagguacaaagccccauggaaaucccuguugcaauuuccugguggaaaggaccaaccacccacugugccagagcacacccccugggcuuccccacccuugguccagaucagagguaaugcagcagaaaugcuggugagauguggggguugaucuugucugaaaaggccuucuucagggcuguuuaaaaauccauguccaugcccaugguagaccauucauagcaacaggcucccauuaacauaagaaggcacucauccucacuaauaauuaagacaaacucaaauucaaauaaaaggggguaccaucucucaucuaucacuaagcgagaggauguggggaaaacuguaaucgccaguucuggugggcauguaauuaugcagccauaaggcagugucuaauaaacugaacaugcucagaccuuauaacccagcaauucuggguccagguugccuaugugcccaaaaagacguguauaagaacacuuauugaaguguuauuuauaaugcuaaaaaacugaaaggaaucuaaagugggggcuauggccagggaaacggcucaaguguuuauauaguagaaugcuauaggauugugaaaagggaugaagagaccucaauaucaacauagacacagcucagaccacaaugcagaguggaaaagguaaacugcaaacaauauguaaauugcacauacgcacacacacacacacaaacauauauacacacacacagagucccacccgacuuuaagggcucagcuuguaucccaucugaccuaggaagugucucugaccauuccagcccacucugcacucccgggaugcuuaucauaaaagcccaggcugcucugcgucucagcacuauugaugacccucacguacuucaagccucuucaacuugaccaugaguccguggggcagagaauaugacuccuguucucucugcugacaccauagugccuugcacagaguaggcacacagggucgauaucugcugaguggcucagugggacaacucgcugagcucacgggcaaggccaccacauaaugcaucauaguagguggccucucucugagaacccaaagcaagcaucgugucaccggcucuucccgcugcccacacugccauccauguuaggaggucauggaaaccccuccccauccugcccgucucccuuucccgaaguucugaggggacagacuguugccugcaaguaugagcacacaaauaacuccaaacacaaauauggccuaacaaauagccauaaaucauucugauuccauccagugacaacucuaauuuauaacaugaggaaagaaaacgaacacuguggguuguuuucuccccucggcuucucagcugcugcugaggaagaauuccacccggcuguuacucacgagcagaaguuccugauguacguauuacuaaagaugaaauauaccaggggccuacgggcacaggagcugccgugacuuccaguuugaauucccgcagcccuauuacucccggugcgagcagccucguuguucgggggccccacccagccuugccucacucucuaccucucccuccagcguaggagaugaggguccucccaggaagaaccaagcccucccuccuuuggcucccugcgaugauggcuaaugccuuuguacgaucagcggucaccguccuagaggugcgcccagagcaguguguuugggggaaucugcauuuuaauguucugugcagucaauuaaaccacacugugcaaacacugagcacaggagaaugcaggaacuggaauuucuuggauagaggcuuuucuuuuugcaucuccauaaagcauuguuauuagguauuuaaaaaaaacauaaaacaaaagucaucccucugugaggucauauaauacaggccauuuggugcuauuuuuaacagccauaaaagcacaugauuuauacggaaaaagucaucaugacaaagcaugucacaaaaaacauuggcguggaaggguaacacauugaauucaaguggguuuauggucccagcuauccauccuguaugcucgcaaacucaacacaccaacagacuccagaaugccucucuuugacccguucgaaauaacagguggaucacgagccagcuucucagcuccgggcccaaggcaaugccuucccuguucccaggggaaguuccuucccaggaccaguuaggaacgcagggaaguggaugcuaguuaaccagcaggccaagacuucaccuugacucaugcccucccccucuacggcugugacacauggcucaggcccucaaacgauggcaaagaggaauaagggaauuucuccauggcugcccaagguugagagucuguggggugaaaacaacagcaaggaaaccagucuuuacccaagggccaaaacccgaagucggcccaagaucccaagauguuucugcaggaccccaaccaugcaagaaucaugcacaccugugaucccaucuaaugaucucaaaccucuauuaaggcugacacacccaggguuugucgguggagggggugaagccaggcucugugaggggccugccagcuuggcagggggaggccagggucaccucaagagggaaguuccuuacgcugccuccccucuucccugacacuuugcaaacucucaaugcauccagaggcucuuccgugauaaauacaacaaaugaguccacaggaaacuugcaaauccccaucuauauagcaaugacucccaagaaacaggagugcuuuaguucaauccaguuucacugaaaacuugaauggagacuauaggguaagaagguagaaaaacgaaacaaaagcaaaaaccagggucuuggcaaacaaaaauucuuuggacagaggugacucgcaucaaauuacuccaagcaauuccauucuccacugcagccugcaaaugacauuugugcaccaagggaaccuuuucugcuguuuaccuccacucccuggaccuugaguuucaugugguccucucuggucguuuucccaucuuuccucuuuuuccagcaauacccaucuuuccuguauuucacuuucuuccuguuguagaguaucauugagccauucuguggucuggaaacaacaaaugguuaaguuaccaagaguaccaaguagaagaaaaauuuaugaagaaagauaucaucgaccaguaaaagucucuacagaaaagcaauauuccacauuugcuggaacauaauuuuucaccuuuuauugcaucucccuggauuaaccauguuuuauggccagccaaaauuugcuuuggauuugguaccuaaugaauuaaaugugucaaugauaggcuuaaaaaacauccccucaguaauaaccacaaaguaaucaggauauacgaugugggggccugagcucugcacugaaaaguaggcaaaacagagacagaaagcaaaaagagccaggggugucguggcagccugcaauaucuuaucucuuguggaaggauuuucuacacaucuuuuaauccaucacccagcauuaggaaauaaauaaguuuaacgcagacgcuagaugacuauguuaagaacagaccgauggcagagcuguucaccgaggccaaaugcuguugguucauugccugcauuuagauuacugcuagauaugaaagagcaucugcggucuugcuucucaagcaagcuaaguacccgauucuuucccauuuaggcuucagcugucaggggucucagauacugccagguaaagucaucuauucaguccacagccagagcaucucagggaaauagcggcuugcucccuaaaugcuaagaguuagauggucauucgugugaugaugaaaaagguaaagaaccuugaauuugccaaaaagaaaacacgcguccaccacagagaggagaggcugaugacgugcauaucugcagaugcgguggucaggucacauauuuggguuuggaaaccccaaggagagaaagaacuaaaccccucuagcagcugagggcaagugcugugauaaaccacuuucagaauaaaguuucaguagcugugggcagauccaacgucaaggaagacucccccaaaaucuagcagcaccccacgcagugcugcaccacucugcaccugaacgugcagcaggggaagaggaaugccagcgauucugcgcaccacgaggccagugcaggcuugccaccucacucucagccacggccagagagcucuuuacacaaauaaggcaaaugaaguggggcuucuucagccuggcuuguauguugcucugcuacaacggaggcgaggaaaccauaagucagccaucugucccccgcagggcuggggcaagacccuccagcgccuuucuuuucuucuugcuacgaacaaugggccauuucacaagcagcacagaacauuggcuguugauggcuucauauucuauugucuggggggaaaaaaacagucccaccagggugacugcagcuaauuguaguuuccacccagccccacuaugucauucagcggcaauaugaugacuaaacagcaauuccgcuggaaauuacagacuuucaacagcgacucccgauacuucauuguuucccgaucagggcacaauugguuugugucaguguugguuuccucccuaagucuguaucgacuaaaacaaucaggaaauggcuccacgcgcuugucacaaugcugucacccgcugguaucugucuccugcuuacaagucugcauuggaaaccuuacaauucacuuccauuucuaaauggcagguaggcuugcauguggggccaacgaugucagccucuucccgcuucagccccucucuagauguuuguccuuaaucuucaccgugcuguaagcccuccccgccccugaaagacccauuagaaggugccugagguccacggacugugcuuaggaccacuuccuaaggaauaagcaagggaacuuguuuaaugaaacaggugggcucugcguguggcucauucucuccaaaaaaagaaugaagacacucaugagaguguggcaaugccgggucuucuucuguggauggguuuucugugacuggagaaugaagauacuccauccaaggagaagacuggacguugauccaaucuagccucuugugagcuaagacaugaacugugauuuguuccaucccuugcccuuucuaaauaugacuaauaaccucagcaggguacucaggcaaaccguucccacaucguaagugguaugacccacagagagaggacucucucaaacacugucauguacacagucagaaucgcaacugcacucacccuaggaaacccaccuuccucuggugacccgcccuuuggcauucugagaguagcccugucauccggcacuuucagcaggauacaaucccacagggaacuuaaguguccagcuuaaauggccuuaauaaauggaaucaucauuuuaacuugcaauaaugagcaaccuaauaguguuuaauccaccaaucugauuuuauuagaacuuguucggcucugugugauggggaaggcccuuaccacaacucaggguccuaggaacagcaaaggagaaagacaggcugcagaagggcccacgugcccccaaggcaaagaaaaugaggccguacugccgucccagaaaagaaucaaaagcaagucagacccaguacuuugggaggccgaggcagguggaucacuugaggacaggaguuuggaaccagccuggccaacauggugaaaccccaccucuacuaaaaauacaaaaaauuagccuggcaugguggcaggcaccuguaauuccagcuacccaggaggcugaggcaggagaaucuuuugaaccugggaggcagagguugcagugagcugagaucgugccacggcacucuggccuggggcacaaagcaugucaaaaaaaaaaaaaaaaaaaaaagcaggucagagcuggugggaagggaucagaggaaggaggagggaagugggguccugcucugggacgaaugacaggugggcuagaccacagggcccagucaggggagggcuuuaacacacuucaugauggcauaaaagauagccccccuccccacaagaagagcaggaaaacaggaauggaauugcaggcagacaggauaacagaagcuucauggggcaggcauggaaguccugcaacuuaauaaugccacccacuuccaguuauuguugauuuacugugugcccgguaccaguggggcacgccacuugcgugucuguaucaucuacaccuaaaucuauauccguacuuauaccuauaacccuuaacuaugauccauauuauuggcauccuugcacccacccuaugagguagguauuauuaucauucccagcauauaaucaaaccauucuagccacaaaguguucaggcaggauacacgcugaguuggucugacuccagaguugccccugaggcugcugggcuagcacaggcuguggggccagucuccguucugcuccaccugcugggugaucauuaccacccugaaagcauccuuuacccgauagacagggauuucaugggugaaucccaggcuuccuuucccuguggcuggggucacucuggggcaaucucaggcuucccugcccgguggagggggucgcucugagugcccuaugugaaacuccccucugcuuguuagcuccaguucccacaguggugacuugcagggggaauggcccuucauuugcauuccuccuccuccucuuucacuuccacaugcccugacugguguuuccugggauggcuucucagauaaacuguucacacucaagucuucaucucgggaucuccuucuggggaagcugaacgaaggcugauggugugagacagccacagggaaaccuuccgagaccuccacugcagccgugcagaggcaugucaagaaaaauacggggacaacagggagcuuuauucucacuagggagguaucuagccaaggaaaccuuuuaucuaagagacuaauagcgagcaaaaccaauagcgcucagugcaacauggcaaaaaggucaggggaucaauggaaaccuacuacaaauuauaacaguaaagaaauggguauaaaguuagcuuauauuuuaauuaucuagccaagaaagauaucguauauauauaauaucuauaagcuauuggcuuauagauacaucuucuauaagaucuguuauauguauuauauauauaauacagucucaguaagacugcguagauuacacagaguaaaacuguauaauauauauuauauauaagacagaaauauaugaaacaucuauaugcuauuggcuuauagauuaucagccaauagcuuauagacauuguauguauguguguguauguauguauguaugugugugugugugauauauauauauauacacacacacauauauauauauaucuuggcuaaauaauuaaaauauaaacuauugacuagauagauugaugaaaugauggaaguccccauuuacuacagaaaaacaaaauuaaaugccuaggcauacauuuaacaagaaauucccaaaaccuaaaagaaaaacucuaaaaauauucuaacagacacaagaguagguuuugauucaugcaaaaacaugucuugguuagguagaguuaugaucauuaaaaugucaaucuuccgaaguuaauuaauuaauuaauuuauuuauguauuuauuuuuauuauuauuauuauacuuuaagcuuuaggguacaugugcacaacgugcagguuuguuacauauguauacaugugccauguuggugugcugcacccauuaacucgucguuuagcauuagguauaucuccuaaugcuaucccuccccgccucccccaaccccacaacaguccccagugugugcuguuccccuuccuguguccaugggcucucauuguucaguucccaccuaugagugagaacaugugguguuugguuuuuuguccuugcgauaguuugcugagaaugaugguuuccagcuucauccaugucccuacaaaggacaugaacucaucauuuuuuauggcugcauaguauuccaugguauauaugugccacauuuucuuaauccagucugucauuguuggacauuuggguugguuccaagucuuugcuauugugaauagugccgcaauaaacauacaugugcauguguauuuauagcagcaugauuuauaauccuuuggguauaugcccaguaaugggauggcuaggucaaaugguauuucugguucuagaucccugaggaaucgccacaccgacuuccgcaaugguugaacuaguuuacagucccacuaacaguguaaaaguguuccuauuucuccacauccucuccagcaccuguuguuuccugacuuuuuaaugaucgccauucuaacuggugugagaugguaucucauugugguuuugauuugcauuucucugauggccagugaugaugagcauuuuuucauguguuuuuuggcugcauaaaugucuucuuuugagaagugucuguucauaucccucgcccacuuuuugauggggugguuuguuuuuuucuuguaaauuuguuugaguucauuguagauucuggauauuagcccuuugucagaugaguagauugcaaaaauuuucucccauucuguagguugccuuuucacucugauggugguuucuuuugcugugcagaagcucuuugguuuaaugagaucccauuugucaauuuuggcuuuuguugccauugcuuuugguguuuuagacaugaaguccuugcccauuccuauguccugaaaaauuuauagauucaaugccauccccaucaagcuaccaaugacuuucuucacagaauuggaaaaaaacuacuuuaaaguucauauggaaccaaaaaagagcccacauugccaggucaauccuaagccaaaagaacaaagcuggaggcgucacgcuaccugacuucaaacuauacuacaaggcuacaguaaccaaaacagcaugguacugguaccaaaacagagauauagaccaauggaacagaacagagcccucagaaauaaugcugcguaucuacaacuaucugaucuuugacaaaccugacagaaacaaucaauggggaaaugauucccuauuuaauaaauggugcugggaaaacuggcuagccauauguagaaaacugaaacuggaucccuuccuuacaccuuauacaaaaauuaauucaagauggauuaaagacuuauauguuagaccuaaaaccauaaaaacccuagaagaaaacccaaguuaaucuauaaaugugaagucauaacaaugagaaucccaucaguaauuuuuuuucuggaucuagaacauuuuauuguaaaguuuauuugaaaggaagaagcacuaagaauagccaaauaaaccucccaaaagaagaccaaggcauaggggcuagcguuaccagcuauuaacacguaugagaaaaguuuuauaucuuaaaaaguauggaauuuacacaugcagagacaagccaauggaacagaauagaaauuucagaaauaauuccacuuacacauacaaauucaguauacacaaucaaggagguaucucaagucagugggagaagaagucaaguuuuucuuucuuuuuuuuauuuuuuauuuuuugagauggagucuugcuuugucgcccaggcuggagugcaauggugcgaucucggcucacugcaagcuccgccuucuggguucaugccauucuccugccucagccucccaaguagcugggacuauaggcgcccgccaccaugcccggcuaauuuuuauuuauuuauuuauuuauuuauuuauuuauuuauuuuauuuucaguagagacgggguuucacuguguuagccaggauggucucgaucuccugaccuugugaucugccugccucacccucccaaagugcugggauuacaggcgugagccaccacgccuggcugaaggggucaaguuuuucauaagugaaauugggggaccuagaaggcacauggaaaauaccaaaauggguuuaccccucacaucauacagcagcacugaugcuaaacagucagagauuucaauguaauaaauaaaaucauaccuacccuacaagaaaauacaggugaauuucucuauaaccugaaaguggagaaaacuuucuuaaccaugauugaaaacccagcaacaauaugugaaagauacuuacaucuuauuagauaaaaauaaaacugccagacuguuuuccaacauggcagcaccauuuuccauucauucccacuaggaauggaggaggguuccaauuucuccacauccuccccagcguuugacauuaucugucuuuuggauuauaggcauccuagugaguguauugugguuuuaauuugcauuucccuaauaacuaaugauguugaguaccuuuucauguccuuguuagccauucagauagacauugaaucuauuugaaucucuugccuauuuuuaauugaguugccuucuuguuuuuugaguuuuaagagcucuuuacauauaaucuagauacaaguccuuuaucagacauaugauuugcaaauacuuucucccaauccauaacuugucccucuuuuccuuaauggcuugaugguuucuuuaaaagaguaaaaauuuuccccuuugguaaguuccaauuuaucaauuuuuucuuuuaugaauaguacuuagucucaucuaagggugcuuugccgaacccaagguaauaaacaugucuuaugucuucuucuauaucuuuuauaucuuuagcucuugcauuuaggucaugauccauuuugagugaauuuuugcauauggugugagauaaaggucaaguuuauuuuugucacugaauauccaauugucccagcaccauuuuuuaaauuuaaacagccuauuuucuccacccccaacuccacugaauugcuuuugcaccuuuguugaaaauaaauugaccauaaacauaugauuuuauuucugaacuuucucuucuguuccauugucuauuuuuaugccaauacuaucuaucuugauuguagcagcuuuauaauaaguuuugaaauccgggacuauaaguccuccaacuuuguucuucuuuuucaaaacuguuuuggcuauuuuaaguccuuuguauuuccauauauauuuuaggguuagcuugacaauuucugaggaaaaaaggcugcuagaauuuuaauuggaguuguacugaaucuagaaaucaauuuugagagaauugccaucuuaacaauauugagucuuccaaccacuuccaauugcagaacauggaaugucuuucuacccagguaaauccguaauuucuuucauuaagacuuuguaguuuucaauauauggguuuuacacuuuguaacuuacauuuauccuaugcacuuuauuauuuugaagauauuaugaaugaaauuguuuucucaauuuauuuuuggauuguucauuuguacuauauagaaauacaauugaauuuuguauguugaucuuauccugugacccuugcuaaaccuauuuauuaguucuaguaaauuuuuuuuguagauucuuuaggauaguuuacauauauaauuaagucaccugugacuccacuuucuucuucccauuguggaugcuuuucuuucucuugcuuuauugcacuggcuggcaccuccaguccaauguugaauagaagcggugagaaucaacacuuugcccuguuccugauuuuagggggaagcauacagucuuucaucauuaaguaugauguuagcuguauggaagacuuaagcuaauaugaaaaggacuccagaccaggugugguggcucacguguguaaucucagcacuuugggaggcugaggagggcagauugcuugagcucaugaguucaagaccagccuggacaacauggcaaaacccugucucuacaacaaagugugguggcacaugccuguggucccagcuacucaggaggcugaggugagagaaucacuugagcccaggaggcggagguuacagugaaccgagauagcaccacugcacuccagccugggugacagagugagaccccaucucaauuaaaaaaaaaaaaaaaaagacucuggaaccaacuugaagaggcucccacuaaccaaagaugggacaauuugaacaucaacauucgacugaaauacauuaaauauguuuaaaucuaugaguucauaauaguccucaaacaaacaaaaaacuaauugcucauuguuggaagaugcuagugacccaauacauuauuuugaaaacuaaaaaaauaaaaaaagaaaaggagaauuaggccacauauccugccuuuccuguacaaacuguucuuuugaguuaccaaauaggaggagaaagaacuuucucuauaaaaguacuccagccaauaaaugaagaagaaaugagagaauuaaaauaucauuguuuugucaucccuaaugaauuaauggaucugggcauggaucaucaaugguggcugacaucacaaaagagagacaaccagauaguacauguccucugcuaugguuuggaugugucccccuaaaggucauguguuggaaacuuaauccccacuacaacacuguugggaggucaggccuaauaagaggugauuaggucaugaauggauuaacgucauuaccuugggagugaguuaguuauuacaggaguggcuuuuuuuuaauaaaagugagucugguggcccccuccuccucucucauucucauucucucauucuugcccucucuugcccuuccaccuuccaccacgcgaugauguagcacaaaggcccucacaaggcgccaugcuccugaacuucccagccuccagaaccaugagccaaguaaacuucuauuguuuauaaauuacccagucuguaguauuccauuauagcaacacaaauggacuaagacauccccugauggaaguacauuuugcugcaaaaaaaaaaaaaaaaaaaaaaaaauugaccuugaagcuauugagaacucuugcucuaaccuccacuuucuacaaucugcagagggcgcugggacaugguaucguaaaugaugccauggggauacagucagcaaaauccagacuauggaagacucuacggggcaaaugacuuggcuucuuuaaccaauucucugaggaagaaugaguaaguaagagagaaaaaaagagcaggagugugcuggaaugagaacauauagccugaaaaagucaaagaaauaaucaaccaauugcaauauguagaccuuacuuggauacugucugagccaaacaaacuguaaaaugaaagauggcauuugugaaacaaccgaaauguugaacagugacuggguauguaaugagauuuagaauuauuauucauuuguaacagugaucaguguagugcagaaguauuuuuuuaaaagagaacuuaucuuuuagagaaguauacugaaauauuuacugaugaaauuauacagugucugagagaugcuuccaaauaauguugagggaaggaaugggagaguauggaugaaauaagacugaccaugguauaauaacaagaagaauucaaagaaacaacaauuauugagugcuuaccaaauagcgggcacugauauaaaauuguccuuccuccccacuggacugcaagcugugcagagguggggcuguggcacccacggcaccccacgugaaugcucggccacgauagcugcucgguaaauauauuuuguuuuguuuugagauggagucucgcucugucacccagacuggagugcaaugguacuaucuuggcucacugcaacuugcaccucccggguucaagcaauucuccugccucagccucccuggaagcugggauuacagguacaugccccacgccccgcuaauuuuuguauuuuuaguagagacaggguuucaccauguuggucaggcuggucuugaacuccugaccucaggugaucugccugccuuggccucccaaagugcugggauuauaggcaugaaccaccacaccuggcccugcucaguaaauauuaacugaacaaaucagugaacaucagcguagaguuucaagcugagccccugggagcccugggaaggagccaugaaggaauuccuccagucuugcucugcagcgagucuuggucauuccauguucuauucuucacguacauuaacugcuuaaugcucagaacuaccuaugaggaagcacugcucuuauauccauuuuagaguugaguacacugagugguuaagcaaauuuucaaggucagaggacuaguaagcgugagagucaacauucaaauccagacuaucugacuucagcccauuugcucuaaaccaccgagucucaucccuguugccauucugugcccaagcuucagauguaucucucccuuugaauccuauaaaaccauccaguauuuccauagcaaaauguuuuugcuuuaaaaaaaaaaaaaaagaaagaagacugaccauauuaaaguugaaugauacguauaugugaauucauuaugcuagucuguuuauauuuguagauguuugaaauuuuuccauaauaguauguuuuuuaaaagaagauuaugagauuuggagugagaucuagguuguaucuuaaauuuuagcucagcuccuuaagagcugugugaucuugaacaaauuacuuggucucucuguuuuagugaauaggauguguguaaggugcccggugugcugccugucauauagcacauguucucuguaacuaacagacuuguccucuuuuuguaggguuccccuguggggaguaacaaugaggggacugagagaguaaugaaauggugcauuguaagguguagccggcaaacccacccaugggagaggccagcuccaaacacuugcagcucacagacucaccuaucacuuuagggagugaucuuuuucaaauuagguagauaaaagaugauuaauaacugaagaucagaggggugauguguucuugagacguuuugcguguggauauuaaguagaaauuuauggagcaacuggggauugaaucgaagacuagguuaauucugcaaaauaaaaaguguagacacucuuuccagcgucuugcuuuagaaaucaaugcauccaaaacaggucugguucauggccccucucccucaaacccccacuuucucugucacuaacugaucauuuccaggaccucaacaaccaccaauuucaucugugcagacaacugagacccagccugcuauuccagugagccguggacuugcgguggaucuuucuccugucagcccauucccccagcccuggcccggaggcagcagauuuugugcaauaagcucuguucagguugaccggcuauugcuccucugaauucauaagaucuguuacuugcagcaccccuuuaagaacagaugaugucccaguucccagugggacuccaggaacaguaucuggauggcuucuaaagaacucuuuuuccagcuggaacccaaacccuaggucagcuccacuguuuccucccaaugccuuugguccuaucgcuccugccacaaggcacagggaagggccuggcuggagggaaaggcaguucaugcaguuccaacugccucccagcccugaccccaaaugucaaucaggcucccgugacaagacagggccugcaguguccuagaagaguggacacuauuccugaggccagugcagaaucucuguuccagugggcaguuggaaaaugaggaaugucacccuuuauugcagcuuacauauuucaugcaccugcaccuuucuuucugaucuuuccaacacggaauggccugauuuccaugcaccauuagagguacguggccuggacuaaaaugucaguaacaaccaggacaacugcgaccaugagaagagcugccauuuauucugcauggaccuugugccaggugccggggagggcccuuuacacccauguuccauuuuaaucugacagucacuuuaguagcuggguauugcuaucuucauuuuacagggugagaaggcuuagggcacagagaagugaaguaacuuccccaacgucgcacagccgguaaggggagaaccagggaauugccccacugcacccccuccugaugucuuguuucaaaucccuggcacgccccagcuaccccuccccuucuacagucacaacaacucauaguacuuuggggagcccaagaaccgcccauggcaaaacacuucauacagagcaagggcgggcugagccugauuuaaauuguaguucuuccuuuuguugcaaggggagggaaaaagugcgaugaaggaacgucuccucugcuuaucucucccucgcacaaacccagcgagggcaguaauugaugccuugcacauagcaagguugacaggaccgccacauggaaccucaagaagccacggcgacagcccgaaucucacaggaaggaacuggcuuacuaacuuucaaccuggagacuuccucugacuuguuuacaggggucuucacgauuugggggacaaggagcaagaaaacugguuacaagcauuccguguccucccccacaccccgcagcccggccacucucagcuguuuaugaaaagagggggaagagaaggcugacaggcccggcccaggcugcaaucugccagauaugaaaaccaauugcuucucauaauacauuccagcuagagccauacgaauaauaaggacaaggagaagguagcaccaauuugcuuuauuugauuagcuccuucuugggcgguccaaucccagcuucuuuucauuaaaauaagggcaaauugaaaaucguaaaagagguuuucuuaucagagaacaaacgacuagauagauuugucggccuaaaagccccccacaagccaccagacggccgugauugcuccugcuuuugccguguucaaugggcagggcccagaagcuggugcuuccgaagagcuucguucccagagauucagcgugugcuuucauuuuucuuuucuuuuuggagacaaagucucgcuuugucacccaggguggaguaccauggcaugaucucugcucacugcaaccuccgccucuugggcucaagcaauucuccugccucacccucccaaguagcugagacaacaggcgcccaccaaacacgcccagcuaauuuuuguauuuuuaguagacacagggguuucgccauguuggccaggcugguuucaaacuccuggccucaaaugauccacccgccucagccucucaaagugcuggauuacaggggugagccaugcgcccggccucauuuuucugaauaaaagcaaggauagccaauggcacuauccuguagcuaguguuucaugcagucagucucaucgaauccucgcuauaacccuaggaaggcugaucccgaacaaccaagcaagaggagaaccuggcgggucgggacacaccuagauuccaucucuaagggccacaaugucuuuguggagaguugagaacaggaugaaggguggcuagggcuuccagaacucagagucagaaaucaauuuguauuuuuggcugggcaugguggcucacgacuguaaucccagcacuuugggagccugaggcaggaggaucaccugaggucaggaguucgagaccagccugaccgacauggugaaaccccaucucuacuaaaaauacaaaaauuagccaggugugguggcaggugcuuuuaaucccagcuacucaugaggcugaggugcaagaaucgcuugaaccugggaaguggagguugcagugagcuaugaucacaccaccgcacuccagccugggugacaaagugagacucuaucuaaaaaaaaaaaaaaaaaggucaacuuguauuuuccaauuucccaagaucguuaagccacaguuuguucacauaaauugucucuggaggucccugaaaagaagaggcugcccauuuggagagaugguaaugaccaagacucgcuccagagcaagacuggaggaacgccuccuucauggcaccuucccagggcucccagggccucggcuugaaacucuacgcugacguucacugauuuguucaguuaauauuuacugagcagcuaucacggcugagcauucacgccgggugcugagggugccacagcccugccucugcacagcuugcaguccgguagggaggaagaacaaugacgcacagaggcccgcccugggcaggccccagagcugcaggagggaaaggggacccaccagagauagcgaaugaguggguuugagaacagcugugaguggguggcaaugggcagccaagaggccucucccaggacgcagcaucuggguggaagcggaggcgaaggcaaggacaugaaugcuggcucccuggaagggcuuucgguagagagcguggcgaggcccagguuuggagaggaagcuuggcagaggcuggcagacaaagaacagggcaggggcaggagacggggcgagagagcggcucaccccaaguaaucugggcuccugaaccaggguggauuuuacuguaagagugaugagagacacgaauuaaccaaggguacacguguauuaacagcgaugaaggaaaagcgaggacuccaaucuuaauacaaauguagcauaaaauguaagacggcauaaauuaaccuggagagugcaacuccgguaagcgcaaggaagaaaaagcagagggcaccugacagcauccuacagagaggcuggguccagaccagggcagagggguuaugacccccaccuccccggccccuugaaaaagugauaguaggccgagggauuaaagagaguaaaagucagccaaaaagaacggggagaggcgccuuccagacaaagggaacugcacguccagagggguuagaucccggggcuuuguggauccuccgagaauuccgaacauugcucucgaggccauggaagcaacuggagguuuugaagcagggaagugggaugaucacuuagacuuggcaugucuggcugcugcuucugccucucuaccuucauaacuuguaaacagcaaacacuccauaaguccucaucaaaugagcaaauuaaucaagaaacagcaacuuuucuuaaaaauagaaaacuucacuuauuacgcugaaagcauuuggucagugacaagccaaagaaaaggggguuuaagaugagagagaauuaauggcaucaccugucuuugcauucaacacuauagucaagaaagaggaucagccauuccugcugcuuggugcagccaggucacguaagccccaucccagcacagugaugggagcccugcuccaaugccacccagcgccuggcucauguucagccccaccgcagucuccuccggccaaaguccaugccucccaaauggugccuggugcuuccguggccccucacuugucauauuccaacaccgauauuuuauuaagaauccaauguaaaucugagagaaaauuaaugugucaucuccuagcaggaaggacuaaacaucucaaugugacggucuguuagaguugucauuuaucauuagcaugcaauucaaggcaagcuucucacauucuggugggagcuuucgagacaaugaaucucugggaauuagcuucugguccaauuauuccuauuucuaccccccaccuaccuaagagauaaauuccgucucggugggagggaaaaaaaaaaaagaagagcaggaggagggaguuugcucuucuccuuucuggcugaaaucaauuuuucucaaggagacaaggcaauauucauuuugugagaagggaauaaggcugcacgcgaaaggccaaucaauggagccauucggaugaaaacuuccucaaaucaaauguaggggaaccucuuaaugcgcuuuguucuucuuuuccauaauccauaacuauuaagagaaagaugggcggagaguagcugccacaaagggagagcuacauaaacagccggccccugcaaacaccggucugugcacccucucaaccuguuucuggaggcucccuacgugccuggccccgugguaggcaccgggaacagagugcuacacaggugugcccugguccucagggagcuuauguucuagcaaggagauaggccaauaaaaauaaacuaauaaaacauauauggcuguaaagaagauaacccaagauaggaauucugugcauuaaaauagaauuguuuugucuaggaacuguuuaaaaccuuuggugcaaaacauaaaaacgcacucggacguaaaucaugcuccugguuccaaagcaaacaggacaacugggaugaacaggcagaugucggugccuccggggaagcgagagccggccaugagugcugagaagccggggcagccgugugcagcacagccacaccuggggaguccagggugccuugcucagccacugagacugggauuccaggcaacugucccuccaucugcuggccaaccacguggugucccccagccacacaggccagagacaaagggcuggaggguccuggaucaggaaggcaccucugcccuggaguccucuaacaggccccgcucucucugcggggaccacccacucagggagaacaaaaccagccuccgauggguggugucucccagccaaguccuccccggcaucgcaugcacccccaacaugaaaguuggcaggcugagccaucccugcugcuggggucuccaugagggcagaggccacauuuguucuguuugagcuccaagaagucucugugagggcagaggccaugcuugcuuuguuugcacuauaagaagccuuuccuuuaaccugcacaauccuguucaauaggauuagauccccauuugacagaagaggacagcacaugucagaggccaagcagugacccgagggaggcugcgcuuggccccaggucuggcugccgcauaggggagcugucaucuccaucucaucggagccacauagcagcuuugauugaaaaucucggccgggugcagugucuuacaccuauaaucccagcauuuugggaggcugagaugaguggauuaccugaggucagaaguucaagaccagccugaccaacauggugaaaccccgccuccaccaaaaauacaaaaauuagccaggcauggugguuggcaccuguaaucccagcuacuugggagacuaagacaggagaauugcuugaaccugggaggcagagguugcagugagccgagacgagaucaugccacugcacuccagccugggcgacagagcgagacucuuucaaaaaaaauaaaaccucucucucucucucucucucucacacacacacacacacacacacauuaagccaguaugugaugaaugcuggggucacgcagugccugcaacggcccccugagccagccugcuuggcuucccuggacucuccugcuauccuccuccucagcccuugccuggacaccaucaggcuauuuccaagcuucaggcccacgucaaggggccaggagguugccugggcagaucccccgggggcugcuuauccuacuuagggagguagccaccggggcucucaucccacgaucagacucgacugcacccugaguugggagucccucuugccaugugacccaguuggccuccuuccaccuuggaugcagccauggcuccuauuugcugccacacccuccaggcuccuggggggucccucuguacacugguucccucagccacgagcauggugcugagugacucuggguucaaggagagaggaucccacugugugcccccaacaagacaggacugagggccucagccacccucagccaacagcuccuagagacauugcgggcgccagucccucaugccaucuccccaacuggcguggcucccgggggcuggggcuggguccaggagucaccuuggcugcccugccuggcugcucuucaccugggccaacaaauaaggaugcuuucccagaucucuccggcaugggcucccgagcugaagagccugagggauaacccuccacccuccaccuccuuggcuaaacaaugauuuucucgcacaccuaagacagccaacugcagccacucugccaggacuaacacuagaaucagaggaauggcuuuugguacagaugaugggcgaugaggcagagauucaggaggauguuccagauggcgggagauaagcagguaaggcgcuuuccacagagcuuugcggggcggggggggggggucagcccagagcagcagcccagccaagauccacagcacccaggagcccaagaaagccgggagagggcacaggcucagagcuggggguugccagugcccucaaagacucuuucuuccucuuccacccuccuccccagaccccggccucauuccugcuucccagagcucucucaaauugcuaaggccuucuuuaguuuuucaggagggcgcuggcaaccaaaagcgcagcuguggaucauuaagccacaauuucaaaccuaggcuucagggccgggccaggagccaggccaggcugggcuuuccccagaugugguggggggggacacccuaggaaccggcuuucugggugcuccuguccuucacaggcccacauaccucagccccuucuccggcugcucagagcuccuuggggugaaagcgccccaggaacacuucaccagggccuucaggucauuccuuggagcuucagcccaaccggccucucaaaaccccaagaagaaacaucuggaugugagucauugugaauaccaggccucacuucucaccaauggucaucggggagccgggggacuaugcgggcuauuuucuucuuuuuaccuaucuguagcucaacuucucuauaaagaacaucaacuguuuuauaaccagaggaaaaagaaacauccucugccauugaagaauugaguucuucaugaaggacgcugaggcccaacccccgcccucugugcuccuggcucacaggcucgcucccuccagacuggcucuugccuccuccccucuccuccuucucuccuuccuccucuccuucccccucuccuccuagccuccccuccuccugcccuccccuccucuccucacccuccucucccccucuccaccccauccccauccuccaauccuccccuccucacccccccaccuccucuccgcuuccucugguccuccccuccccuccccuccuccugcccuccuuccuucuccccuucacaccccccuccuccccuccccuccucucaccugcucucaccacugcacuuggcccugcaacccugcccaguccauuguccuggccuccagcugccucgugguccagcccugcaacacuucaccaucugcccucacuuucccggcucccugggaacaggggugcauuugacaaccucuacaaaucugggaaauggcccacagugccagggcaaagccgugcagaaggcccagggaggauggaaggacagcaaccccuguccccuagagcucucucagcccccucugcucucaccuccacucucccuccucugccccaggcccugcugucccugggguggccucaucaucuccuccuggacucugcggggcugcccucugggcuccccuccaccugcuccagggagaugccuguccugacgcacacacuuucuguacugcugugaagggaauuccugggcugugugcagagcccucccccugggcucagccugcucuguggccccuucccaugcauccuuaagcccccugacccaaacccaucccccuccagcagcacaaugugcccuaaggccuuggugucacagcacacacugucaccuuaguccaaagugccccaaggcagcuguggaucaugaggcuccuauuucaaacccagagcuucauccccuggccaaaguccagcauccugguugguuccucagggccaaucccgaaugccacugccuccugcucugcuggcagguucucaccccuccugugccgcaacgccauccccgguccgaggccccuguaggugcucuugcuucauuacaguuugcuccacaugucuguccccagagggcugaaaaccccugggagagccacagcccuuuaucuuggggucuucugcagaucuagaagagucuccaaaaguaucuccaguguguuccuaacuggggcugggaacagagaccacagggcccugcuggaaccgcagugagagcccacaccugcugagcacgaagugagagucaggagcuaugccgagggcucacaugcacgagccccacuugacuacugccaugaaccugcccgccucggccccccaaagugcugggauuacaggcgugagccaccaugcccggcugaguccggaguucuugaagagcucgcaacaccacccuuguuuugacgggcugcgugaucacaggacugcaucucuggauuucgauaaccauacaugaauugagcugaagguguuuuggucaauggagaccucugugccuccagagcuuauaaaucagagcccuguggucuaacagccaugauguuccccaaucauguuacugcaauauuaauaaggcuguuuaaugcaaccaguuccuucuaaauugucacauaaaaauuugguaaaugucagacauaucauuucauagaaaauaauguuuuacugccaggggagcuagguggcugagaagaugagugcaaagccuggcgacaaccuuuggcagguuugagggacaaagcgcugccagccuggggcucccgccuuggcccuucuuucuugcagucagcagccaccccgaguccccaugugcaggggcccugggugaggaguccuggggaggggaggggcuagaagaaacagcccuuccuguccucacgcagcauacaauccuguugcagcaagagagacuaccagguuuucucagucacuggucacuccucaggaugccccuugucauaaaagaucauuacccccauuuuaggaaacccaggcagcccccaggaacauuggcccacacaggagaaacuugacguuuacaaagggaugaguucggcugggagcaauggcucaugccuguaaucccagcaauuugggaggcugaggcagguggaucaccugagguugggaguucgagaccagccugaccaacauggagaaaccccgucucuacuaaaaauacaaaaaauuagccaggcaugguggcgcaugccuguaaucccagcuacucagguggcugaggcaggagaaucgcuugaacccagaaggcagagguugcggugagccaagaucacaccauugcacgucagccuaggcaacaagagcaaaaacuccaucucacaaaaacgaaaaacaauaaaacaaagggauaaguucacagaagcaaaguagcauccuguaaacuacuuauaaaugggguugguguccuguaaaagggguuggucccacuaauuugggcggacaggggcacagagacggacagagugacauucuccacagccuaguuuaugauaggaagaguguggaaaaccccuaaaaauggcuucaguuggccgggcgugguggcucacgccuguaaucccagcacuuugggaagaugaggcggguggaucacgaggucaguagaucgagaccaugcuggcuaacacagugaaaccccgucucuacuaaaaauacaaaaaaauuagccaggcgugguggugggugccugcagucccagcuacucaggaggcuaaggcaggagaauggcgucaacccaggaggcggagcuugcagugagccgagaccgugccacugcacuccagcccgggugacagagcgagacuccaucucaaaaaaaaaauaaaaaauaaaaaaggcuucaguuaacugcuuugguaaaugaaucacaggauauugauagaauaguagauaguuauuagaaaaaaugugcauaucucuauuuguuaacauggaaagagcuccauuauuuaaaaaaaaauugcaaaauggaaugcauggugagaucucauuucuauagaauucuucacuuacccagcaccuauaugucuauguguacauaaggaaaaguccggaagcauugaguucucuaaaaccuugacccuggcuaucucugggaaaugggacuucagaggauguuugugaaguugguugcuuuuuguuguaucuuucugugugguaagaauguucuucaaugagccuguucuaucuuuaucagagagaaagauguuaauuuaaaugaaauuaaaggacagggauuacagcaugaacucagcaagcauucacggggcaccugcucugcacccaguccuagggauguaagggugaugaaacucagccauugccuggaacagccugaaggcaaguggaaaucacaaauaacaagcagaugauuguaauuccacgaggggcaggcaaugagggugagguggcggggcgggaauuugagggggaggcagugagcuuugugucaccuccuuuuacugcaauaaaccuuggccugcaugcccccuaaaaguggguucuuuggaggcacguguuuggccucaaggaaaguucucauugagcagaguuaaaaagccccuuuuggauccucaggggauguggggacaacugaacucaaagccagagaaggcaagaaggaaacaccugccucaaggggcuguggacaggcacugggcugaacacgccaggccaucccacaucugccauccuaggauacccccaaaaggggaugcuaggaucccaaccccugagaugaggaaucaguggcucggaaagguucgcugcuggcaggaacccuguagggaugagcagaggagccacacuggaacagucgaggggauguguuucugucacucaccaucuuccugcagggagacuagacccugaacuucugagcuggaaaugccacugucgagggaacucugagccaaccaaaagucuaugaucaugcgccugugaccuucuccaaagagggacugaugcagagaagugaacccccgaaauccugcuaagugucugagcuuccacccuuuccucugggguagcugucaaccccgcuggcacauugcacuggggugccggccucgccacucuugauggguuguugauggacccucccagguguucucagcaacaccccacccacaaccccaggaaagggaaguuccaagggaaauccaaugccuuaaaugaagaauucccagggccacucggagaaaaggcucccaggauauuguugguggggagggaaagggugacaguagaggucuuucuggguaauaaaagagaucugcuggccgggcacgguggcucacgccuguaaucccaacacuuuaggaggccgaggcaggcggaucacgaggucaggagaucgagaccauccuggcuaacacagugaaauuccgucucuacuaaaaaauauaaaaauuagcugggcaugguggugggcgccuguagucccagcuacucgggaggcugaggcaggagaauggcaugagcccgggaggcagagcuugcagugagcugcgaucgugccaccacacuccaaccugggcaaaagagcaagacuccaucucaaaaaaaaaaagagaucugccaagaucaguaagaauuugccccaggcuccagugcccugcccagcuggccccuuacagccccuuccugacucuuccuagccucuccuccagccuccucaucucagucaaggagacacuagacgauggggucaaggcgcuuucugccaucugcuggcugcggcaauaaggaugcagcucaugugacccgagacucaucagggcagcagcccaugcagguggcagcaagggaagcugaagugcggugggcagggugccaacggaccauccagacgacauggagcagcuacggagcagggcccuggggagcggggcagggaggcauauccaccaaacacucccacaucaagagccccaggugggcuuucaucagguccccacuaacccuagagccuugcccuuagcaaucaaugacaccagcggagaggcgcgggugucacgccuccaaccugggaccccgcuugagcagggacggaauucaugaguuuugugcuccuguacaaaacgaugaugacauuuaaaaauaaaacccguacacagcagauuccugaaaaauaauaauaauaaccuuaauuuuagcaaguggaaaauaguuucagaaaacuguuuugcucuuggaucucguugggaacaugaaaaccuucucagauucagccagcugcugguuuuuccacuucccuuuggguggacgcugagccauccagcuguggcgcccuugccaacugggacgagagccugcagagcggugcaaauuuaggccauccaguggaaagcucaccaagcgccucggccacugggcacagccugaccuugagcagcgauuauguuuccagcuaagccugcagccucuccugcaguaaaaggagacugacaagaccuaaggccuccaccuggcagagcaucauucucccucccaucgggugagguccaggauggcuugagcacucuggcuuuauguaaaggugcuacaaacguuaaggugccccauccuuuauacaacugcaugucauguggguucaugguagugauuaugauuaagauuagucuguggucauuacacacccagaagaucucuggucaucuggggugaucgaguuauucagcaaucuuccaccccgcccucuaacaacugcagugaagaugggaugauaccuucguuaaauaucccauaggccccaagguaaaccugagaacuaauaaauacauguaaauacaucuaauaaaauaaaauuugagauuaaaaggaaucucgcuugcauauucaugaaccacguggaaacucaaaugagcucuucuaagcuccuuauucauggugagucagagauuuaacacaugcugggaagauugcuuagcaaauauaagccuggcaauggcacaugcauccaugaauucaucggacaaguauuuauuaacugucccuuugcauuacuauuuauguugcauauucaucccucuuugcaaacccagggccucauauaaauggcaggcacucaccuguugacgaugcugguguucugaggcccuagaaagcacaaccccuggccucagguugcuuauaucugcucaaggagguaagagucacuuccucuaugaagcuuuccugaccccucaggacccuguuaggugacccuaguauccauuucucaagacucucccuguuagcaccuaccucccaucacacacucacacacacauacacacacgcaugcauacacucacacacauacgcacacaaucacacauacacauacucacacgcacaugcaccuguuccauugucucuauccucuccugcacuaaguuuaggguagggagacacugaaucugcuuugcucacccuagccugacauacacauguaggaaacauucaguacaucacuggaugaaugaagcaagaaaugaaugguuggauggguggguggguggguggguggguggaucaacagguaaguaaaggcaaggcaaaggccuaaguuguggcccaaggaaagauguaugaggggguggcccgcaagggcgagaggaacaagagcguuggucaucaagggaagaagaucaagaaaaaaagguuugagaucuuaaggacagugaagacuuggcauugggugaguugguauuuucuggucauuucugugccacacagggugccgggcaccucaugagcaucaccccggauccucacagcugcaccugaggcagauauacccacguagaagaggaagcuaggcuuagcaggauaagcuggcaccacugcagagcuggcacgcggcgaagccaggauuggagaccaagugggccugacccaagcucucuccaugaagaccaaugggcauccucuggcccagggaccauugccaucaggugggaccguugccaucaggaaagaagagagcgugcuccaggaggcagcucugggcagugcagagggaugaaacaaucaauaugguggcugggccccuuggaacaaagagaaagggcuggggcugucuagggaggacucaggacucaugacccacuccugcccacagaaacauaacucacucuccgccugagcacagccacuaugucauggggugauguagagccagggagggaggcaaggacacguuccuaaauaauauccuauuuuguagucaacagucaggcaagaggaagggagaaagaggagggcaggaagacagcgagaugcagaaaggauugaauguuccaugaggaucaaaucucagccuccccgcaggugcauugagacagaagacgcagguccucacagccagaggugcucauggaaccagcccgggcgaugucucaucacccagacgagcacagaaaaagacaggcuugcagggucccacggccugucugacacaaugcucaugggguuuucucaaaagcaucaucuauuuagcugauggccccaaaguguuucauuuagcuggaaaucgugcuugguccauuucccagaucucagugacauuaugagaagccagcaaaaugugucuggcagcagagcaguucagcaacccaucaccucgagucacaguccugucgccccuguuuggaaagcagacaguucagacgacuucuagaaggcagagucacugcugccucccaggcaaccgaggacuacaggaagccuguguguguguguguguguguauguguguguguguguguguguaugcaccagcuugugcacaugcccucugaaggaaggcaggggucacccauggcacaaggcagucaccauccucccugaccaugggauaaaacuuugccauuccuuuaucuuauuuaaucuucccacuaggcaggaaucauuauccccaaacuauuucugagaaagccaaagcuuagccgguucauguggccccagccccacagccagcaagaagcagggcugagacuguaauucagcacugucugaauccaaaggccaggcucacacugagaccccagcguuccccaccccauuccacgggccuggagagguguuucacgacgcauucacuggucugccugguaccauauaaagaagaaucaagucccaucaccaaagaaauuugcagaauucucagugaacacaauggaacaggucugauucuggagggacuuccuggaggccuucaaaggcuaaugcacacuauggaaacccaaaagccggagcaauggcucugcucgugaaagcccccgaaggcaagacucuggguguguuaccaacucuccgagucucacacagucucuggcacaagguaggagagugcaauacccaucaagugcuugagugaaugaaugaugaaugaaugaacaaguaacuaaaugcugugaaugagaguucugucuaaagauuaaaaaaaaaaaaaagaauaaggcucuggggaaaaggccccagcaucucugcugucauggaguauuccugcugccuaagguccucucauagaacccggcccuuccugcacugccuccagcguuccaggggauggguucugagaaagccgggccauucaucugugcuggugccgugccggccuucggugcuugcugcccuggcucucccaccuggugggcucuaggaggaauuccccgugagggcacagcagaagcugacugacaaccaggugggagggagaccuccugggcccagcuggagggcccuagggagcgggaggcaggagacaggaccucagugacccuggagaucgcuccccauauguccucauccucuccaccacuucuucuccauguccaggcacucgugggaaguuaaaacccaaaguugggcccguggugccaggucaggggacagcaggugccaccugggugcccgagcacaauuccuuucucccuguccgacucagccuaagauuggcucucauuuugaaaaugcagcucagauguuggcugugucccauuggagaagcuaucugaggccuuaacccuccucuggagagauccaaagccacagagccgagguggucccuuuuucuggaacccacagagaacaagagaagacaggguggcacugugggaacaccaggugacaagacucagcaguggucucggaggagacagaagcugucuucagggaucugaacgcucccgggaaugggguauccacccagagaaaaaauaggccaggccaggaucccugagcccacagcaggcgagacucaacccagcagaaggcggguuuguaaauggaaauuucccagcgugccuggccucuuuccauuauuccucugggcccaaaguacagacacuuuacagguuuucccuguccuucgaggaggccugggauuucucuacuauaauaauucauagguggucuauuuccagaacaaagauacuccauguauucaucucacaaacauucuugacccccugcaaugagucaggcguggcgcauucccuaagccacgcagcgcugaaucugacuaugguuucgggcuuuguaugagaaugcuguaaaaauaugguuggcugacaucugaguuagcucaggcuuccguaacaaaguaccagaggcuggguggcuuaaacagcagacauuuaugucucacaggucuggagacgggaagucugagaucaagaugccagccaguuccauucuuggugagggcucccuuccuggccuacagacggccaccuucucacuguguccucacaaagcagggagagagcucuaguaucuuccucuucuuuuuucuuuguuuugguagagauggggucucccuguguugcccaggcuggucucaaacuccugacuucaagcaauccuccugccucagcugcccaaaaugcugggauuacaagugugagccaccacaccaggccccucuuccucuucuuauaagggcacuaauccuaucauggggccccacccucacaacuucaccuaaaccuaauucccucccaaagaccccaucuccaaagacuaucacacugggguuaaggcuucagcacauggauucuggagaaacacagauauucaguccauggaagauggugugucuccuuuuuuuuuuuuuuuuuuuuuuuuuuuuuuaagaaaaaauucaaaugucaggagagagcacagacacagucccccacuaccacaaaugaugcagugaguuucccacauuuggggaaaucacaagggucaacacaucuggcgcacaauggauaagccucacccugggaguaccaccuucaggauccugguauaucucccgugccagguaagcauggcgggucccuucuugauagagaccuacucgcauauacacaauguaacagccaccagaucacacucaccccuggcagcagaauggcaacgcucccucccauaugccacaauaguaaaaggcucguugaguccaaccguaaacacagaaacggaaaacacgccaguauuuggcugaagugucuaugaaaaagggcuggcugaacagaugccgguguaaacaagcuuacaggggagacacuucaccuucguaagagagcagaccuuuuaaagauauccucaagauucuuuuaugguacaauuaacaugaaaagaugguguucauaacaggcuugaguuacaauuguacuugaaauugauauaacugcacacgucuccuaaaaugccacguaagggacuuccaggucgccaagguaaugauagccacaaaaacucaaaucucccaacgcauccucugaaaacuacacagaucaacaagaagaacaaaaacaaccacacaaaucccacacaccuuucacacgacuggaaaaaagagacacuauaaacaucaaauuaacaaauucuugaguucccacccagaacuuuuauaaagagcaagaggauaagauggguccaaaagccaaugaaggcagacgucgagcauggagaguuuaggaauaaauuacaauuaccugaagaaagagaaaguacauccuacagggaagaaaauaccaaaaaugaauccagauagaccagaauauggacuagaaggaagugauuuaaagguaggcaggggcagcauuggcaaaugugcaggggagggagggagaagccagaugugggcauuuaggauucugcaaaacaaaaaauaaugauacauccaaggacccucaacuccucccgccccucccccaaaaaccagucauaaagaaacugcacuucgcugcacugacagaagagggagcucuugaacuaaaaaucacacgaaccacucaauguggcgauguaaguggucuucaucuguagaagacuaugaaagaaaaaaaacuaaaaugagaauacgacacuuaccccaaaaucccaaccauaagguggagggggaggaacugugucauaacacuacaaacugaauuaaaaaccucaacgaugcauuugaaaaauauccucaacgcuuguaaaugaaaagaucaaauaacuuacuauaagggcaacagagacaguugucagccuucucaaaaacaacuuagaagguggggcaaggauggagcagcaguuucauaaaacucaaagauuuuauaucuagcgaagcagacccucaaaaaucagagguacagaauaagaguuuaaaauaugggagaauugagugauguacccacaggcgccucugaaggaaucuucuagaaaauuaacuucauccaaccaggagaugacuagggacucuuuggcaaaggaacuuauggggaacauuuaauauauuuaauuauggaccuaaauuaaguguguaacuaagguuaagagaaucauacauagauuauauauguuuugucaacuacaaaaugauaggaaacaaaaaaaggaaagacaaaaccagaauaagcucagugaugcuuguauaagcaacagguaggagucaagagacuccauuaacaacugaaagaccaaaugguaaaaguuaguaagagacuaaagggauuuuuaaagguaaugaguacaaagguacccauuagacuaaaaaugagaauuucuuauauauaaaaagaaauuaaaugaguauagaaaaugcaucauguagaaagacaaguacagcaaguagaacauaauacacauugcauuuauuauauaagauauuauacauauuggacauauaaauaaaagugaauggguuuacuuaugaaaauaaaaaaauuuucaauuuggcuuaaaaagaaagauccaacuauauguuauauauaagaggcauacuuuuaaaaagaguguauuaguuuguucucacacugcuauaaagaacugcccgagacuggguaauuuauaaaaggaaagagguucaacuggcucacaguuccacaugguuggagaggccucaggaaacuuacaaucauggcagaagaggaugcaaacacuuccuucuucacauggcgacaggagagagaagugccgagcaaagggggagaagccccuuauaaaacgaucagaucucgugaggacucacuaucaugaaaacaguaugggggaaacuguccccaugauuuaauuuucuccaccuggucccacccuugacacauggggauuguuacaauucaaggugagauuuggguggagacacagagccgaaccauaucaaagagauucagaaagccuaaaacuaaaaggauggcaaagacauaugaggcaaauggaaauaacaaaacaaguauugcaaucuugauaucaaaguagaauaaguauaauuuaagaaacaacauuaugacaccuucuaaugcuaaaaaucacauuccacaauaaaaauauaaccauaaugaguauuagugcaccaaacaagacuacaaccacuuuuacaggagaggaaauuguaggaaauauaggccagguuugauggcucacacccagcaauuugggaggccaagaaugguggaucacuugaagucaggaguucaagaccagccuggccaacaugacaaaacccuaucucuacuaaaaacacaaaaauuagccaggcguggugguaccugccuguagucucagccauucgggaggcugaggcacaaggauugcuugaacccaggaagcggggauugcagugagccgagaacucaacacugcacugcagccugggcgacaguucugugaaagaacgaaagaaagaaaggaaggaaggaaggaaaaugaaagaaagaaacuguaggaaauauagaugaaaacacuaagaauaguguguuuaccacaccgcugucaguacaagagaaaccagauagacaaaaaauaaguaaggacacagaagcccuaaacaauauaaucaauuuccuugacaaaucaauuugucacugaugugguuugcauguguguccccacccaaaucucaugucaaacuguaauccccaguguuggaggaagagccugggggaggugacugaaucaugggggaggauuucccccuugcuguuuuugugauagugagugaguucucaggagaucugguuguuuggaagagugcaggaccucccccuucacccucuuccuccugcuccagccacgcaggacacgcgggcuuccccuucgccuucugccaugauuguaaguuuccugaggucuccccagccaugcuuccuguaaagccuguggaaccaugagucaauuaaacuucuugucuuuauaaaugacccagucucagguaguucuucauagcaaugugagagcagacuaauacagucauacuucauacuuuuuccuugaauuaccuauuaguagauggggaaucuacuauaccuucuccuuaaguacacauagaauauucacaaaaguuggucacguguuaggugauaaucaaugcauuucauaaaauagaaauauuacaaagaaauauuuucugaucacagucuaauaaaacuggaaaauaauguuaaaaaucuuuucaaaauuaaagcaauagaaauuccaaaaauguacaugugaucaugaaaacacuacauaccagguaaggcacgguggcucacaccuguaaucccagcacuuuggggggccaaggugggaggaucaccugaagucaggaguuugagaccagccuggccaacauggugaaaccccgucucuacuaaauauacaaaaauuagccaggugugguggugugugccuguagucccagcuacucgagaggcugaggugggaaaaucgcuugaaccuggaaggcggagguugcagugggcugagaucgcgccacugcgcuccagccugggcgacagagugagacuccaucucagaaaacaaacaaacaaaaaacuacauaccagaauuuaugagacauauuuaaaacaguggucggacugaauauucauagccuuuuucauuauuuuaguaaaaaugaaaaauuaaaauuuuaaaauucuaagcucaaaaagcuagaagaagaacaacagcaaaaccauaagaaaggggaaaauaaaguuagauguagaaauaaaugaggugggucaaauuaaccaaaauuucgggucuuuuuuuuaaaaaauaggauaaucacaagcuaaacuucaucaaagaaugagaaaacacaaauauuccaaauaagaaugucaggauacagaugaaggcuuauuauauagcuacaguuaucaagacugugugguauuagcaaaggaauugacacauaaaccaauagaauagagaacccagaaagagaccugcacaaauacacccaacugauuuuugacagaaaugccaaaauuaauucaagauagcuuuguugaaagauagccuuuucaacaauugguguuagagugaucagacauccacaggcaaaaaaaaaaaaaagaaagaaagaaaaagucuccaccaaagucuucuccacaccugcaaaaacuaacuuggaagggacaaugggcuuaaaacauaggagaaaauuugggaacuaggacuaggcaaaggguucuuaaacuuaacaccuaaagcacaacauauaaaaggaaaaauggguaaaguagacuucaugaaaauuaaaaucuuugggccgggcacaguggcucaugccuguaauacuagcacuuugggaggcaaaggcggguggaucacgagguccagagaucaagaccaucccggcuaacguggugaaacccugucucuacuaaaaacacaaaaaauuagccaggaguggugguaggcaccuauaguccccacuacuugggaggcugaggcaggagaauggugugaacccgggaaguguagguugcagugagcugagauugcaccacugcacuccagccugggugacagagugaaacucugucucaaaaaaagaaaaaaauaaauaaaaucuuuguucuguggaaaugcaaaucaaaaccacaaugagauaccaucucacaccaguuagaauggugaccauuaaaaagucaggaaacaacaggugcuggagaggauguggagaaauaggaacacuuuuacacuguuggugggacuguaaacuaguucaaccauuguagaagucaguguggcgauuccucagggaucuagaacuagaauuaccauuugacccacccaucccauugcuggguauauacccaaaggauuauaaaauaugcugcuguaaagacacaugcacauguguguuuauuguggcacuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaagcuggaaaacaucauucucagcaaacuaucgcaaggacaaaaaaacaaccaccgcauguucucacucauaggugggaauugaacaaugagaacacauggacacaggaaggggaacauugcacacaggggccuguuguggggugggcggaggggggagggauagcauuaggagauauaccucauguuaaaugaugaguuaauggguacagcacaccaacauggcacauguauacauauguaacuaaccugcacguugugcauauguacccuaaaacuuaaaguauaauaaaaaaaagaaauuuaaaaaaaagaaaaaaaauauuugcucugugaaggacaggaugcaaaagaagauacaaauuaggagaaaauauuugcaaaccaccucucagaaaaaugacugguauuuaagauauauaaagaacccccaaagcuuaauaaaaaauaaaauaaucuaauuagaaaauggacaaaggacuccaaaagguaauucaccaaagagaauauacagauggcaauaaacacaugcaaagguguucaacaucauuagccaauuagagaaauacaaacuuaaaccacgauuagauaacauuacacaccugucaggggagcuaaaauaaaaaauagugacaacaccaaaugcugauaaggaugcagagaaauggggucauccguacauugcuggugggaaaauaaagcacggcuacuuugaaaagugcuuuggcagauucuuuaaaagcuaaauauguaguuaucauacaacccagcagcugcauuccuaggcauuuaucucaaagaaauaaaaaucugugaccacacaaaaaccuguacacaaauguuuauagacauuuuauauguaauugccaagaacuagaaacacccagauguccuucaauguauaaagggcuaaacaaacuguagcacauucauucuaugguacaucacucagcaauaaaaagaaguaaacucuuaauaaaugcaacaaucuagaugaaucgcgagacaauuaugcugagucaaaguagccaauuccaaaagguaauuuauuguaugauuccaauuauauaacauucuugauaugauaaaaauuauagacauagagaacagauuagggguugcaaagagucaaagaggguguaggggaggggaggaaguggguguggcuaaaaagggcauccugcagcaccccggaggugagggacauguucuguaucuuaauugugccaacaucaaguauccuggcugugauacucuacuauaguuuucaagauguuaccauugagaaaaacagcucaaagggugcauggaucaucucucuguauuaguucuuacaacugcaugugaaucaacaguugucuugaaauagaaaguuuaauuuaaaaaaaugcaaugugcaaaggaguauuuauaguagcugucuuuuguguaagaaaaaaaggagaaaauaagaaaguauacauguaucugcuuaucucagcaaagaaacacaaaacagauaaggagauaauaaugagagugguuacccauguguggggagggaugggggcagugacacgucucuggaucuaacuuuuuugcauaguuuugauuuuuauaaacauguuaauguuuuccauccuuaaaaaaaucaacaaggauggggagagaccauaaaauagaacacaagcaaaaaaacaaaagagccuaauuauauuuuauuuccaagaauaacauaaccagagagaaaggggguagagauuaacccaaaaggcuuaugaacacaguauuuugauuauaugcccucaggcuaaagaaaaagugcuauaaacaaacauugaacuauaguugguagguuugcuuucuucagugguauagguuaacucuuauuucauuauuuuauauauauuuaggauuuagacaauaauauacucaggaaaauuucuccauguuggaaaagaaagugccacauauggaaagaugaacggcuaggaggaacccugugauguuggacuagaauugguaucaucacaaugcaugguuuuacacacauccaugaacacggauguuuagaaguagguguggauauauauguguuuguguaucuaugaauguauccucacacaugcauugcuuagcuucuucuacuaaggcagagagugucuagaagcaauggcauaccacucgcaaggcacacagcuggaauucagaaaccauucucugcugaaaggagccggggcucauuagagauugagcuaaucccaggguuggugagaggaaguggaaggcgaccuugggacauuuugcuggaccagaaaaaaggaagcgcucaaagaaugacgggugcaaagaaccacugauaacaacaacacggaugaaucucaaaaucacaauaaugagugaaaucauccuuauacaaaagaauguauauugcacauguuccauuuagaugaagugcuagaacagguaaagcuaaucuauggugagaauaaaaucagaacagcgguugcugcugaagacgauggagaaagaacugguuagaaagaaacaugaaagaacuuucugaacuggcugcaaugcucuacaacuugauaggggucugagucacacaggugcaugcacuggucaaagcuuguucgaugguacacuuacuauguguaccuugcacuguaaguaaguuuugcugaguaaaagaacuguaaauaaauguuaaagucgagacacuaucaugccugccaaaguguuuauggaugaagugugcugacaucuacaacuuacuuugaaaugcaauuuaaacacaagaugcauugcuggguggauagcugaauagaucuaugauaaagacagcauaauaaaauguucauuaaagaaccuaggugauagguacaugaguguucacugaaaaaaaucuguuaacguucucuaugcuugaaguuuuucauaauaaaauguuguggaaaaauauuauggggauuugucaaaaggacacaguagccaaauugaaagggcuuccauuggccaaaucugugacaauauaauuaccaaaacaacuagguuauaaaccacuggacaaauauauaaccuaaugaauguaacucagucaacauaaucuagucaaugucacucacuaagauagaaauccaugaguccauauggguauaaacgaaucaaugaguaaauaaauaaauguaagaaagcaaaaagcuuuccaauuugguacagaguacuaaacaauaaauaaauuuagagaaaaaucaccaucuggcaugcauuauaauaauugauucagacaagaauuaucaauggaugcuaaaucaagggguaaaaguuuaaugaaauacaagcuacuuacacagaccuaaacuauuuuuccauaaaaugcgaauuaauuaugaagagaauaaacaauaacuuuacacuggagaaaccuagcagauaccauccuaaccaauggucaaagucaacaaucccaguaaaggggcaggcaaccaugcaccuucuaacacgaugcacuaagaacaacccaaugucgcuucugugguguuccugccaaaauugcauauccugaaucugguccuaaggaaacaucugacaaaccccaaccaaaggacagucuacaaaauaaauggccuguaugcugcaaaaauggcaaggucaugaaagacaaagacugaagaauugauugauggcgauuacagagacauggaaacuaaacauaacgugagauucugaauuggauccuacaacagacuauuguuuuuauuauuguauuuugcuaauaaaggauauuguugguugcaggaauaaagucuacagauuggauaaugcuauugcauuaguacuauuuuccugacuuugaccauugcacuggcuuaugcaagaggauguccuaguucucaggauauacacauugaaguguuuaggguuaacggggcaucaugucugaaacuuacuuucaaaugguucagucaugugcaugcacacauacagaaugauaagacagauaugauaaaauguuaauaucgggaaucugcgugaagggcauaugggaauucuucauuuuauuccuacaacuuuucugaaaucuugaaaugacuuaaaaauaaaacauuaauaaaaaauuaaaugcuauguaaugucagaauucucuauucuuuccugguccaaaauggggagguucuacugacucggaaaucucuaaggauuaagaacuucuguggccauuugacccucccuggagugucaacauucaagguaaaccaggagcuuaccaaccacugcgaccuguggaguagguaggugaugcucuugagcugaagaacgagguuguuucauacauuacgcuggccaauuccaacagauuguugcugacagagcucuggguucucucaaagagagugccaagaaacagaccugacagcugccucccccucccaguucuggaaccaccaucaaagaugcaauuaauccaagggugagacuccuuuuacucacacagccucagauaugaaucaaccccaaaguguuaauagaucaacaguuaucucuaauaccaaauacaauuugcauuugagaugacaucugcaauauuuuaaaagccaaugucuaaaacaacaaacuuggcaguuuuucugaguagcaauuaacacagugacuaauccuaucaagaagacaguaauuggcauggagacauccuucucacaccagcggcagguugaaaaacuuaauccuaaccucuuuuuaacagcguagacucuagagcaucucugcgcaucaaggaaacuaaagcaauuauuaaggacaaggguaauuacccuacaguuucaacaacaacaacaacaaaauagaaguauucaaacaacaaucacauaggagaaaggguggggccuugaaucaugguuaaaggcuauuucgguaucauggccagacuaggaauagacuauggugucuccacggccccacccaggacagagucaaccacagccccaugccagccagucggcccagcaauggucacuguagcacauagcuuucuauacgaagggcucaagugcugaucuagucaaguaggaggucccaaggauuuaacaugugaaacaacacauaucaucaagcuggucccuucgacaucaucagaacccacuauguuuacucucagcccacauagucaaguuauucuccccagguaugacaccuuuccccagaaucugucuaaagccuucccacucuucaaggcucagcuaugguucuaggaaacaaucccaacccacggcagcccucaaugaacacugggcaauuuaagcgccucuucucggacccacaagagcaaaacacagaggugcacauguugacucauugcuuccugugggcuggcuugauuuacaccuucaacagaaucacaugguuuucaagagucaagccccugcccuauguagcuuucacaucaccuagcacagggguagacaaacagguaaaauucuggcaaaaauuccacagcaucucagaugcccaauaagguacccaauacucaauaggguaaagggagaaagaggcucuuugugugugugugcauuuugacugaccugaucauugcagaauuuucaaugaaguauguaguauguguuuaccaaaugaacaaacaaaugaaugaaugcacaaugaacaaaccaaagaacaaaccaacuuucaugagccuggaucaguuugucugggagguuagcaaguguauccaguaaggucaaggcuauggacaagaugucugcacaagccagcuggcuucugccagaaagcacugccugacggaagcccggucuacaccugcaaugcuccccaguugccuggagggugugcuguuggccacaagaggagcaagcauggagagagaggcuuccagcucggaagggauguguuacccuuuuauaaaguagaugacguggcauuuuauugagcauggaaacuucuuacccauaugcuguaaccaaaccuuaguuuaacccugguuuugcugggcagcagaaugagggaaaugcuaauggaggacaucccuggaccugaggugagugggcacuuagcuuucaaaugcccaggagagguagcagggccccaaacacuaaaggaagagaagagcucuuauuucacgaagacuggggagauaaaggcaggucuuggauccacaagauaccaggagcuuggaauagaccacaccauauggagaagcacagagccggugguuuggucauaagaaauaagggaaggacaccugagucaaggccacaacuggaccagccacuggccucgugacccaggauccugcaauguaccccuuuagaaauaggguugauccuagauccacccauuagaggugggacagggcuccaaggucaauuuucaguugugggugauugugucgguuggaaaaauagaguguauauuuuuaggugguauauacauuuuuaucagaaugaauucagcuuuuuaaaacaagaagaaaacauucaaugacagauuuuccuccugaauuuguaauauaauaugauagaagauuuucuuuccacauucauuuucuacagaccucccugucagugucagcaaccuggcccuugacacgcucacuggguaucacugguguuauccagcgauaucaccuaauguaaacaugucuccucuuccaagcggguggaaagccccaggagugguggggaacugggucuuauucaucacuaagcccuguucagagccuaguaaagugucagguacaagaugcuacucaguggaugcugauuguugauaauuauacaacagauauaaugcaaguaagucagcaaagaaauuccucuaggaggccaguaccagggccagacacuucucagcuaauaaaguguuuaauuuuuacagaaguguguuucccucucaggagacuaggaaagcagcguugccauucucaacuccuaccagcagccacugaaugagagaggggcacuuagaagaagcaggccggggguggggugugcaauccauggagacuguguccaugugggaagcagcauuugggucagaauuuggaaaccaaggacuuaagagaagucauuaaaaagcaugcugcuucugugccauuugcacucccucagacugacaaaauuuaagcauugacaauagcuaauguugguaaaaaugugaagcaacagaggcucccacauuacagaaaggagugagaacagaauuaacgccuuuggaaaacuacuugacaacuucaacaaaugggaaacaaucuaaauguccauccaaauacaaacagauaaauauccugugauauauuuauacaauggaauaguacacagcagugaaaauaaauaauagaguuacaaacauccacaaagaugaaucucaugaaaauauacuggaaaaaagcacauuauaacucgaacacacaaaaaaggauucaguaaacuagcagaauauaaaacuggcacucagaaaucaguacuacaaagaaacucccauguauaauagcaacaauaaagauaaacuauuuaggaauaaauuuauucggguaugugcaaaaccuccaugagaaaaccuuucaaaacuaaauaacacaaaaguauuccucagcaaaugggaagacauaaauucuucuuggaugagacaacucaguaucaucacaaugccaguucucccuaaauuaauuuauaaauauaaugcaauuuuauggagcuagacaaauugauacuauaguucaugugggaaaauuaaccuucaagaauagccaggaacacagaaaagccucaaugggaacauaagcccuaccagacacuaaaaauacuacaaagccuucauaauuaaaacaguguauacugguguaugaguugacagagaaguggaguagaagaaguccagauaugccccaaccacauuuggaaacucaguauacgauaaagguggccucuaaaauuacuggagaaaacagauguuuuuaaauaaaugcugcuggaacaacugaauaacaauuuuaaaaaauuaaguccaguaucuccuaccaagcacaagaaugaauucuaaaugaaucaaagauuaaauguaagaaaaaaaaugaaaccauacgaguacuagaagaaaauuggguuaauuucuuuuugaucuggauguaggaagagguuuucuuacuaugacucaaaaauacacacacaguaaaagaaaagauugaugaacaggacuacacagaaauaaaaaguuuuuucacagaagacacaucugauauucaaagacacaaaaagguugaaaguaaaagcaugaaaauaaauaugucaugcaaacacaaaguuggaguuguuauaccaugucagauacaauagacuuuaaaaaaauguugcaagagauagaaggacauuucauaaaaauaaaauggucaaucuaucaggaagauauaacaauuauaaacacaaugcaccuaguaacacagcaccaaaauacaugaagaaaaaauggauagauaugaagaugaagguagaccauucaauaauaguaguuggaggccgggcaugguggcucacgucuguaaucucaacacuuugggaggccaagguggguggaucaccugaggucaggaguucaagaucagccugaccaacuuagugaaaccccgucucuauuaaaaauacaaaauuagccaggcaugguggcgcaugccuguaauccuagcuacuuggguaaggcaggaaaauagcuugaacccaggaggcagagguugcagugagcggagagcacaacauugcaauccagccuggacaacaagagugaaacucugggccgggcgcgguggcucacgccuguaaucccagcacuuuggaaggcugaggcauguggaucacgaggucaggaagucgagaccauccuggcuaacauggugaaaccccgucucuacuaaaaauacaaaaaaauuagccgggcgugguccgggcaccuguagucccagcuacuugggaggcugaggcgggagaauggugugaacccaggaggcagagcuugcagugagccgaggucgugccacugcacuucagccugggugacagagcaagacucugccucaaaaaaaaaaaaaaaaagaaaaaaagaaaaaaaaaaaagaaacucugacccaaaauaauaacaauaauaauaauaauaauaguauuuggagacucuaauaguccagguucaauaauagauagaacaacuagauagaauauuggcaagaaggcagaagaucugaacuacacuauaaaccaacaaacuaacauauguuucuagagcacucuacccaagaauaguauacacauucuucuuaaggguacaugaaacauuauccaggauagaccaucugcaaggccauaaaacauaccucaauaaauguaaaaggauagaaauaauacaaaguaugucuucuaaugacaaugaaauuagaaaucaguagcagaaaaacaaugggagaaacucacaaauauguauaaauuaaacaacacauucuuacauaaucaaugccuuaagaaucaaaugggaaauaaaaaaauacgaauauugguaaacaugaagacacaacauaccaaaacuuacgggaugcugugaaacuucuucucccccaaaaauauuaaaggaacucagaaaaaacuaagaaagaaaaaucucaaauuaauaaccuaauauuccaccuuaagacuggaaaaagaggcacaaacuaauccaaaaguaagcagaaggaagaaaauaauaaauauuacaguggaaguuaaugacgugagaauagaaaaauaaagaaaauuggccuggcacaguggcucacaccuguaaucccagcacuuugggaggcugaggcgagcggaucacgaggucaggagaucgagaccaucuuggcuaacacagugaaaccccaucucuacuaaaaaauaccaaaaaaaaaaauuagccgggcaugguggcgggcgccuguagucccagcuacucgggagguugaggcaggagaauggcaugaacccgggaggcggagcuugcagugagccgagaucacgccacugcacuccagccugggcgacagagugagacuccgucucgaaaaaaaaaaaaagaaagaaaaguaaagaaaauugaugaaacaaaaagcucauucuuugaaaaugucaaaaucggcaaaucuuuagacugaccaagaaaaaaaaaagagaaaacucaaauaacuagaggcaaaaaugagaacagggacaguauuaucaaccguacagaaaugaaaaugacuacaaaggaauacuaugagcaauuguacaccaacaaauuagauagcuuagaugaacaaauuccuauaaagaccccaaacuacuaaaacugacucaagaaaaaaaauagauggucugaauauauuaauaccuauaacaaaugaaaagacugaauaggcaauuuaaaaaaaaaaaaaaaaacuacccacaaggaaaaacccaugcccaggucgcuuuaccacugaauucuaccaaauauguaaauaauaaugaaugugauucuucacaaacucuuucaaaaaauaugaggagagaauauguuccaauucacuuuaugaaaccuguguuacucugauaccaaaaccagacaaaaacauuauaagaaaauuauucaccaauaucucuuauggguauggauaaaaaaauccucaacaaaauacuagcaaacugaauccagcaacauguaaaaagaauuacauaccaugaccaaguaagacuuaucccaggaagucaagguugguucagcaucugaaaaucaacuaaguuaugcaucauaucaaucaauagacuaaaaaacagaaucaucucaauagacgcugaaaaagaauuugacuaaauccucaugccuaaacacccaacuagaagaaaacuuucucaaccuaauaaaggacaccuacaaaagucccacagcuaacaauauacuuaaugaugaaagacuggcuggcuuucuccuagggcaggaacaagacaagaaugucuacuuuuacuccuauucaacauuguacuggaaguucuagccaggguaacuaggcaagaaacauaaguaaaagaccuccggguuggaaaggaagaaauaaaacuauauucacagaugagaugaucuuuuauuuagaaaaucgugaggaauccacuaaaaaacacuaugagaacuaaugaacaaauucagcaagguugcagguuacaagaucaauauauaaaaauaauuguguuuuuacccaauugcaauaaauaaucugaaagugaaacuaagaaaacaauugcauucacaauuuaacaaaaaauaauaaacuauuugggaauaauuacaagaaguccaaaacuuacauugcaaaaacuauaaaacaugguugaaacaaauuuaaaaagaccuaaauaaauggaaaaacuucaauguucaugggucagaaaacuuaacaucguuaagauaucaguacucuccaaacugcucuacagagucaauucaaucucugugagaauuccagcugacuucuuuguagauauugucaagcugauucuaaaauucauaugaaacuguaagagacacagaauagccaaaacaauacuaagaaaagaacaaaguaggaggauucacacuuucugaauucaaaauuuacuacaaagcaaugguaaucaagacaaugugguacuagcacaaaggagacguacagaucaauagaauagaaaugacagccuagaaauaaacccauacagcugucaucaauugacuuuugacaauggcaccaaaaccauucaacugggaaaaaaauagucuuuucaacaaaugaagcugggacaacuagcuagucacaugcaaaagaaugaaauugaauccuuaucucacaccauauacaaaaauaaacucaaaacagauggaucaaagagcuaaaugaaagaguuaaaacuaaaauucuuaaaagaaaacauagguauaaacauucacggccuuggauuggcaaagcauuuuuuagauaugacaucaaaagcaugaacaacaaaauaaaaaauagacacauggggcuucuucagaacacagaacuuuugugcuucaaaggacaccaaaaaaauugaaacuguggaagaauaggauaaaauauuugcaaauuauauaucugauaaagaacuuaugucuagaauauauaaagaacucuuacaacuuaauaauaaaaaggacagguaacccaauuuaaaaauaggcaaagccucugaauagacauuucucuaaggaagaaauacaaauggaaaauauacaaauauacacacaaagacacuugauauuauuagcuaucagggagauucacaucaaaaccauaaagagaugacacuuuaauacccaggaggaagaugagaaucugaaagucagauaauaacaaguguugacagagaaacuggaacccucauacccugcugguaagaauguaaauugguguggccacuguggaaaauggucuaggucuaacaguuccucaaguaaugaaacacagaguuaccaugugacccagcaauuuuacucagguggauacccaaaaaagaaaugaaaaaaaauaugucuacacaaaaacaugugcacaaauguuuauagcaucaugguuaauaauagccaaaugaguuauauccauauaaugaagccaaaugaguuauauccauauaaugaaauauuauucagccauaaaaaagaaugaagcacugcugcaugcuacaauguggaugaaccuuaaaaacaugaugcuaaaugaaagaagacaguuaccaaaggccacauauuauacgauuucauucuuacaaagguccagaacagagaaagcuauagagacucuaaguggauuaauguuugcagagggcuggcgguggggaguguggauggggagauagugaagugauggcuacauaacauggcauuucuucuggagguuuugaaaauguuuaaaaucaaugggggcacauuuaugugaauauacuaaaaaccuuugaauuguacacucuaaauggugacuuguacagcacgugaauuacaucacaauaaagcuguuuuucaaaauuuuuaagccugaugagaaacaagauauucacacaguccccaaguaccaccucaugagauacuuauuaauuagaaaaaauaaacaguacuuuccaguagagaaaccuggcaggcaaccaccuuaaucaagcaaugaguuaacaccaaccagcaaugcgcaaaucuccugauaugagguacugagaaggacauaacauggcuuccguaguauuuuggacaacacuguguaaucuaaucuaugcggaaccucagacaaaccagaacugagggacaugcugcaaaauagcaggccuguacucgucaaaaauguccgauucaagaaagaaaaagaaagacggcagaacucuuccagauuaagaaacuggaacuaaaugcgccccaugaucccagauugaauccaggaccaaaacucaaacaaccauuuguuuuucauuugcuauaaagaacauuacugggacaauuguugaaauuucuguaagggaugaggauaaaauaauaauaguaucacauugauguuaauuuccugacuuugauauuuguacugugguuauguauaagacgugguuauguacaagaauguccuuggucuuaaacacacagugaaauauuuagagguaagaagcuucaugucuucaaucuauucucaaauauuucaaaagaguguuaaaauguuacauauguacaccacuucauauauauacacacacccacauacacagagaauaauuaaguauauauagugaaaugugaacaacuaugaaaucuggcgaaugauauacaaaugguacuuguauguuuuaaaaaacuuuucaacuuucugaaauuguuucaaauaaaaauuuuaauuaaaaaagcaugcuugcaguacaaugucauuuauauaaaguucuaaagcagaugaaagaaaauuauccucaucuauauacacaugcagcaaagguguauaaacauucaugacagugguuagcucuggggaggauggggccagguacgcaauaacuguguuuuacuucucaagcugguggcggguaugaggcuauccauuuuauuguuauuuaucuuuuuguauaucuagaauauuguauaauaacauuuaaaauuuaaaaacccacuccccacccucccuccccagccaccauccuccuuuccaccaacugcaggacugcacugggcggccaguucccaugcguccuuggauacauuucagccacacugagaaacucucccugcgcacacggcuggguucccuggagaacaggaccaagggcugggcgugcccaccgcugccuugggugggagggaagaauucuuccaggcggcggcuggugcuucggagaaggacaggggaaggggguugugcaccaggcacaggacaugggggcagaugacuucccagcccuagggucgggugcccgugucugggaaagagaaugggguccccacagcuccuugcagaagggacgcugagcagcaggcguccucccugaagcagggcugacgccaccaccucgcauggacugaguaacaaaagaaguggucucugccuggcucccuuuuacccuccgcuuggaacugaugccccgcugagcgcagcuugcuucccacagucagacaugaggaggcuucuccaggcaggaugcccagcggguggaggcgugggggcgggcuccaauccgagucccaggccucgccuguccucugaacaggaguuggggggggcaucaguaaacaaggaaccuucccuccuucagcaaagauggagacaguacccaccacgugccgcgcaaaccuccaggcgcuuaggggagagaagugggggggaaaagacaaacaccucugcccuccugggaggcgguggaagagacaauaaacaaaacaaacaagccagcacacaauaugucaacugggaguaagugcuuuggagaagaaaaaggucaggaguagggaagaagaacuggagccugggggccugugugcuccugccugcauccagcguugcccgcggggcucccugccugcagagggcucccccagacucacuacaggaauggagcagcggugugcaagcaucugucccaaaccagagggccagggucagggaagaucuggccaggaaggagacuuuaagcaaagacuugaaggaacaagggaagcuaugggugucaggaaagauggucccaagcagagucacagcaagaagagguccuagagguggaagcugccacucgccucuuagcagaggcucaaagaagccagcgcagcguggccaaggggguaugagugauggagacacccucuggaaaugagacccagagagguccuggggguuucucagggugaugucgggagcacccagggcugcugagacauggaagggacacauuccugacaccuucugaagugcagcagcaaacacgguccacaggagucaucaggggcacacacaggucagcacccagcuuugcaagcagaggccuccuguaccacucacaccacgugauuccagaagaguuggggucaggaccagugacaggucggggguaggggagugggggcacaccuaagcugcaaacuguggugagcccaccuccaggccuccaaaugcagggucagcugggacauccuggcucuacuagaugcacugagcagggccuggggaaguucaugcacuugaaugaggcacaauucaaccuuuuaugcaagagaaaggcaagggcagaaacuggauuccuggguuugggucaccccaauauccuagaacuuacuaucaguaaguucuagcaggggaucuuuaggaaaugaugcuccguccuggucacaagaaauguccaugucuaacagaacagaugucucccgaacccugugugggcagcugagagagcaucucccggucuuuggaaacugcauccagcucuggccacaggucuugcucauucgggacaaugagcugucuccccacucuggccaagucuagcaggggaagauacggcuuccccugcuguugauuggaauguuccagugucccgaaaaggggcaugaccuggauuugaagaccacucugcaaccuuccagcuaaaugaccuaggguaggauuccacccucucggagucuuucuucucaacuaggaaaagggaaugaaaaauaccccaguuguugggaagcgucaaugaaaugagcagauaaauaagcaaguagauuguguguguguguguguguguguguguguguguguguguguguguguguggugggggacaauaauuugaguguccuuuccuuccucucucuucacaucucccaagaacaucccacacgcagguuccuaaaacagagaacagucaucccccuggucccagggagcucugagcccccaccucuuuaggaaaugaugcuacguccuggucacaagaaguguccauguuuaacagaacagaugucucccgaacccugugugggcagcugagagagcaucuccuggucuuuggaaacugcauccagcucuggccacaggucuugcucauucgggacaaugagcugucuccccacucuggccaagucuagccagugcuucagagccccuuguuuggccuccaccucccugaagcaaugucagcaucuccuggcugcugguccuuccauccucacauuugacacacacguguggcuucaguguucucagagggugucacagcuucaucuuccuaugaaauguacacuuccagagugcaaggaccacagugauauucuauuuuucugcauuuuccaagacacauggcacgaugccagaugacccgugugugugaaauaauuacuugagaacuugaagaucacaaaauauauaugcauuaaaaauucuuaauuagaaaaaaaaugacuaacguuagaucauaaaaguucugccuugugugccaaauuugaacuuguucuaggaacacuuuuguuacagacuuugcaaggaaccaagcaauuaaugccuuuucauuacaaccgaggacugaaacuggaauauuaaaauugccauucagcggaaugugcaugaaaugcugcaggucuccuggugaauaauuccuggucauaaugacaugcuauggacuucaaucuuacuccuagacaugagagaagacagcuaaaucaacuuuguccauuuaaauaucauuuuaagguaucuagaacccaucucuuuauugcucaacaacccuuagcaauuucuuuugcccucauuuauuucugguucccaagggaauccugucugauuuauuggaaauuaguuccuacagcuaguaaaugcuuuaaacuguuuucauauaaaucacuccaaaaucuguuagugcacugaagcccguuuagagugauuuccuccagccacgcugugcuccaccacacccucucuccugcuaacuggaaugucccaucacuggucaggggcucugugagagcaggcaaacagaucucuaagaauguauguuuucuucacacauacuguauuagucuguucucacacugcuauaaagaacaaccugagacuggguaguuuaugaagaaaggagguuuaguugacucauagugcugcaggcuucacagacugggaggccucaagaaacuuacagucauggcagaaggcaaaggggaagcaagcacgucuuaccagguggaguaggagagagagagagagagagcuaagggggaagugccacacacuuuuaaaccaucaguucuccugagaacucacuaucacgagaacagcaagggggaaaccugacccgugauucaaucaccuccugcaggccccuccucucauucaaugugagauuuggguagggacacaaauccaaacuguaucacacauuuuuuuuuucuuugagacaguaucucacuguguugcccaggcuggagugcagugggaugaucucagcucacugcaaccuccaccuccugguucaagugauucuccugccucagccuccuaagagcugggacuacaggcaugugccaccaugccuggcuaauuuuuguauucuuaguagagacgggguuucaccauguuggccaggcuggucuugaacuccugaccucaggugaucugccugccuuggcuucccaaagugcugggauuacaggcaugagccacugcgcccagcccacaagcucucuuaaucgaaccccuuuauccuucugcugugagcaauggcuggcuaaauauaagcacucacaagccaaccuccucauggggucagaguggucucaggagcagugcgggcaccuggcugaaggugagugugccauguguggcgggagagugucacagugccaaccacuguugccugcugguauccaccugcaucagucaggacaggugaggccaugaugcuguaacaggaaagcucuauucccugcuugugccccauggucacuacgggcagcuggggagucugcacuccucacuccacucggccaccaagcccagggaagcucagcacugaaugugcuuccaaauagccaagacaagcagagaauguguauagcaacacuuggacuccgaaaaucugugccaugaagucgcacuugucauuuccacuugcauuucacuggucagagugcaugacuuggucaccccaaaugucgaauggugugagaacgugggagcugccauaugccugcaagguggacggcacaaauguccaucaagcugcccagcccuucucuugcacgugcuggacgacagaaaaccucgccugcugcugggcuggguuaguuggugguuuaugugcguguuugcuuauuuguguguuuggcuguuuucaccauuaaaccagaaaccuucuaccuagccagcagacaucuuccuacucugagaaguuugacaauuuaccacguuuuaguccaugagaugcuccacguacuguuuauaggaaucaaucucaaaaacaaaugauuguuaucuagauaacugcuaggaauagaaagagagcucuucaaauugacaaaggagaaggagggccuugcaggcagaagcagaaaauaaaaaucacagaauucuaagccucuuagcagaagagaagagcccaauauuucucuuagccucaagcugcuucccgagcacagggaaggagggucauacuggggacugcacggcccucuccucuccuuacuaagcucuaggcagaugaaauaucgcaaguccucuuccugcccucucccuuucagcuugccacaaauaaagggcuauuuucaggagaaauccuccaaguaucgcuguaaaacagcaggauguaacgcucaccacaauaacaaauguauguaaaagaucaucuguagaaaucauuuuuaacugagacaucuuucaaaggcaaaaaugaucuauaugccaaaagacagugcucauauaucuuuuggagaaaugaaaggaccucguucaaugauuuaaagaacagcaccauaaaaaaaaauuucacguauaaauauuuaaauauaguuuauuauauucaauaccuguccaaacauauccucuguguagauguuuuccagcugcacucaaagcuguggacucuaagaauaccaggaaguauuaaaaaacaguaacuagaaaacuuugccauaucuuuggaggacagagcuguuuuuaaaaccaacguaccaaaaaaguagcuauauuuugaccagauaggaggacgguaggggauuguaaagggaaggaauuugguaaaaguguuuuugguuugucaugcuucuaaaggccgcaugucaugggccaaaaauaguucauauuauuagguacaauucuuuuaauaugcauccuuuaaaucuaggucacacacaucccuacguuuacguauaaaaugcuuccguucacaugugucuaucuacguaucagugagauaugaugcuaagggcaugaaagauagugaauaaaauauagguuaccacuguucuguugcugucuucaagaacccugucauuuaggccucagagauggugggagacauuaauggaaaucugauggcuagccuccccuucgggccgucagccucuucuguaaaauccaccugaacaccuaaaggagcacucggaggagaaguuuccaaaccucauauuuucuuuccauuggguucuuacagaauuccagacauccaaagugcucacauucuaucccucagaaaagccacugccugggcucucugcauuugggaccagacccucuguguguggcucaagcuuccgcacccccuucugcaggugggcacaugaguggaaggacuuugucuucagggucugcguccuucaccucccuauguccuuucuuccacuaucccauccccuccccucauguuucugaugacagcagguaagugccacugaacuuuagcuguucacuggcacuuaucugcugucaucagaaacauccgauacaauugggcugcagucaccugcugaaguaccaucaauaucagaaggcauuuggcuuucaugggagacuugggacuuggaaacugacacuacagagcaaaugacuuuuuuuuuuuuuuugagacagagucucacucugucgcccaggcuggaguacaguggugcaaucucggcucacugcagccuccaacuccugguucaagcaauucucccugccucaggcucccgaguagcugggauuacagacgccugccaccauacccugcuaauuuuuuuauuuuucaguugagaugggguuucaccauguuggccaggcuggucucgaacuccugaccucaggugauccucccgccuuggccuuccaaagugcugggauuacaggugugagccacugugccuggcccaaaugacuauuuuuaaaggaccagcagaagacgcuggucuccucuaaguuuugaugcaugugggguuuaggcaccugggaugagccccugcccagugccaccuggcuacaagcucucugcauaaugaagccaaggagugacucugcagagaccuucacagcaugacuuagaaccucagacuaaagcuugccugagacagaucauccuccaguucuccuucuuuccuuuuccuuccggugacgcugcauucacuccucacuccuggguucagauccuaacccugucauugacucacaauguaaccuacauaaucccacuaggcucgcuccuucaucuguuaaaugggagucacacgucuuaccuugcaggguugugagggggccgugaugcccagcacacacuggcgggcagcgugcacucaggggcugggccugacccccaucaucacugcuccugcagguggcacucggcucaauggcuagcagcggccacaagcacagacaguuccauccaacuugccuccagccucagguucuagaucuaacucaaaaauucccagauuugagaucccaggcccucccuucuacaaugacgggauuuccaccacugggcuauccggccucagucccuucucacauugggauugcccauaaaguacugacauguucccuccgcucugccccuccgcagcugccagugaugaaucaaguggugcuaucccaaccaaaggccaagcgucauggcuuucagccaggucagacgccauagcacaccaagucagcugaggagcuugucaaaccuugaccccaaaguggagaaagaugcagaggaagaggcuggcugcuaccacgcaagcgacaucagugucagcaucucacagaccugauccuggagucccaaccagaagagccagaaccaggagcauuguagccaagaagacagacaaaugcaucuugacaugcgauuauccaaauaaugcaucucagauguguccaauagcuccuagcaaaagaugacacuauucccccaccagucccagcccccaacaagcuaauggaagaggaucucaagaacaucagcccauuucccagaugggauguugaggcacagagagaggaaugugugucuagugacacagugaguucccaggguucucaaaaagugaacccagaucucuugaugcccagcgguucugcauuggccuucucgcugcaggaaggggacguucuuagagaaauaacacaaggccuaaugucuccucaggaagcuuauuccuggggacugcaaaccagcagugcagaaacugucgaugacaaagcguuucuuccccauccucuguauuuguuacagcacuguguccucaucccucacgccuugcagcuguaccagauguggagaaaauuacauguucccugaaacuuaaugaccaaauuuaaagcaauuuugaacuaaucaggguucuguuaagcugauuuuauuaauuuaacaguuuuaagaguuuaacaaaaugaugcacuuagaaaucuuuguugugaaaucuguucauuuagguguaaaaaagauggugccacccaagagagcuaauuuaaagaaaaggaugauuuguaaaggaacuaaacaacgcuucuugaaaacgcaacacuauugauaauauggugcaagguggcauaccauguccgccacucagccuucuaggagcaauucaugcauggugcaugugcagagggaaaucaauagaacgcuuauauccagaauuagagaauucaacagcaacuuuaggauaaacuaugaagucuccauuuacaucuagaauucagaacaaagcuaugggguguccuacccaguaauucucuuuauuuaaaaagaaacacagcaccauuuauuucugauagagauggcugacaagcuccuggcacucuucccaugcccaagggcucuuauaaucagagcuguguucaaauaaagccaaacaaacaaaaugcgagacccuaaugguccuugaaucuuacaaacacaaccugcacuaucucaguauguaaaaaaauaaauaaaucagaaguuaaaauccauguucuaaaaaauuaccaguguaccugucuggaagaaagaagucucaccauuaaagcacuaauuacacaccauucacuagcugugugacuuuagguggguaacuucaccucucugagcuuauauccuuauguguaaaacauggauaaccuccuucauaguguaguuuucugggaaacuagguuauuucaagugcuuagaauggagucugccucccaguacgcauuagaauaaugcauuaccauuacgugcaccuaaaacauguguggccccaugauugaggauuuguguuuuaugacuugcaggcugggcuuacuauauuuguuuuuuucuauuuuuuuaaauuacaaaaguaauauacuucuuguuaaaaaaggaacaacacucaaacaguuggaagcauaacaaguaaaaauugaaauuccccuccgcuacucaccucagucucuuuuucagaaguaaucacagucaacuaacucugccuauuuuuccagagcuuucuguguguuuaaaaaaguuauauguacauuuauguuacaucaugauuauuuucuacacacguauaagaaucauuuacauauaguacaucauuauauaugcuacguguaauacacacauguauuacacauacagagauauguguacauagacauauaucuauucauauguguaguuuuuaaugugcucuuuuguggcuugauuuuuaaaaaauuuuuuauuuccauagguuuugggggaacaggugguauuugguuacgugaguaaguucuuuagugaugauuugugagauuuuggggcacccaucucccaggcaguauacacugaacccaauuuguagucuuucaucccucaccccuucucacccuuucccccgaguccgcaaaauccacugugucauccuuaugccuuugcauccucauagcuuagcucccacucaucagugagaacauacgauguuuguuuuccauuccugaguuacuucacuuagaaaaauaaucuccaauccccuccagguuacugcaaaugccauuaauucauuccuucuuacuagguguaaaaagauggugccaaaauacauacacaccacaguuucuuuauccacucguugacugauggacauuuggguugguuccaccuuuuugcauuugcaaauugugcugcuauaaacaugagugugaaaguuuuuguacaaugacuuccuuuccucuggguagauacccaguagugggacugcuggaucaaaugguaguucuacuuuuaguucuuugaggaaucuccacacugcuuuccauagugguuguacuaguuuacauucccaccagcagugcagauguguuccguuuucacugcauccacgccaacaucuauuauuguuugauuuuuuugauuaugaccauucuugcagaaguaaagugguaucacagugugguuuugauuugcauuucccugaucauuagugaugcugagcauuuuuucauauguuuguuggccauuucuauauauucuuuugagaacucucuauucauguccuuagccuacuuucugaugggauuguuuguuuucuucuugcuaauuuguuugaguucacuguaguuucuggauauucagacguguaguuuuuaaugugcucuuguauggcuugauuuuuuucacuuagcaauaugucauggaccucacucaaugccagcacuuacagauauagcucauucuuguucauugcugcaugguauuuuccaaucucuguguggcauacauuauuuaaccuugguuuuucugauggacauuuaggcuuucuacaguguuucccuguuagaaaccacacagaaaguauuuuauguacaacuuugugcacaggaaacaauaauugaggcugaaggagagcaugaagccaaagagaggaugggauucaggauagagaacagacaccagcuuuguauauuaccuguugacaaaaaugugaagcuuaaagugugaugguuugauaccacuucacacuuacuagcauggcuauuauuaaaaaacaaaaaacaagaguuggugaggauguggaaaaauuggaacucuugugcauugcuggugagaagguacaauggugcugcugcuauggaaaaugguauaaugguuccacaaaaaauuaagcacagaguugccacaugguccagccauuccacuuuuggauauauaccccaaagaaauuaaaucagagaacugaacaaacauguguacaccuauguucauagcaggauuguucacauagccaaaagguagagaacaacucagauuuccauugacagaugagcagcuacacaaaauauggaauacaguggaauauuauuuagccuuaaaaaggaaggauaguuucauaccugcuacaacauggaugaacccugaagaugacaagcuaagugaaauaugucugccacaaaaggacaaauacuuguauguauugguacuuguaugaggucccuggaguagucaaauccauacagacagaaaguguaacaauaguuaccaggguuaggggagagggagggaguuacuguuuaauggguacagaguuucaguuuggaaagucaaaaaaguucugcagaauaauaguaguuauggucgaacaacaauaugagcauacuuaaugucacugaaugguacaguggaaaaugguuaaagugguaaauguuauguuaggugcauuucaccacaauuuccuuuuaaaaguuuaaugguuuguuugggcccugauaugguuaggcuuucuguccccacccaaaucucaucuugaauuguaauccucagguguugugggagagacuggugggaggugauuggaucaugggggcaguuccccccaccaugcuguugucaggauaaugagugaguucucgugagauuugaugguuuuauguguuugguaguuccccucuugcccacuucucucuccugccaccuugugaagaaggugccuguuuccccuuagcuuccaccaugauuguaaguuuccugaggccuccccagccaugcagaacugugaguuaauuaaacuucuuuccuuuguaaauuacccagucuuggguauuucuuuauagcagugugauaacagacuaauacagggcccaucccaauguuccugcaucaaaagagcugucuccaagaaggagcuccaaaagaguucuaucaaaauaacugcaugcaaauacagacccuggccucaagccaggucccacucuaaugggauggagggggaaaggguggguaaacaaaucaucagugaaaaugaaaaugcaaagauaaugaagguuggugccaggaaguaugggcuuuucugaaauccagagggcaggugaacugaugugccucuuauucucuauaauuucauguauguuaaaaauauuauauucauuuuuuaaaauacaucuuuuaaaaccagaaauuaccaugaaacuucauucaggaagucuagaaugcuuaaguucccagcuguuuagauuuuaugauccaguuuuuaaaaauuuaauggggagacaaauauaggauugacaacuuuuuauuuuguuaaguaacgacguuaaaaaaaaucaccaucugcuuucaauauaauuucauaaaagaauguguauuuuauguuaaaaaaugagcuugggcauaaaaguaguucuuuccgagaaacagcaguuggcaauccuucccagugaguaugcagacaccaccacugucuucauuucccauaucuugccauagaccaguaaaaacucugcaggcuggcacuggucaggauucuugagucugggacugcuuccugagcccauauuccucucugcaaaccuggagucauuuucaaucuugguucaaaugcccccgcacccacccugcccugugccccagccacucucucauacugucaggacagugaccagcauggcuucacugcccauccuauauuccccccaucacaggugagcaccuccagcccuucucccagaccaagugagcacugacuucccagggagacucugaauuacccccuacuaagaagacucugaauuuuacccaccagaacacuccucaauuacaccccacuagggagacugauuuucacgcccccgccgggaagacuccugaacugcaccucaccaggaaauauuuaccugguugugcacguuucucuacacugccagcgugguguauauuucucuccccuaaacuacagcauucauucuccguggaccuggcuuauugcaaggaauagugccuggcacauaguuuucaauaaagauguuaaugcgugaauaaauuaaauaaugaaugaauaaaacucauucuaaaguaagccuaagaaaauguacccuccccccaaccagccccggcaaaaugaaacuugaaugacugccaacuugcagucacauagcaggugggugucagagcugaugggaacccaggucaccagauucucagaucagggcuuuugccauaaaggaggcugccaucugucaucccccaauaagaaagggacaucuccaacagaucaacucagagccagcaucacacauacccucaaggccaucacuccugaucaucaaagcuaucauuucuuugguaauuccuauguccaggucccagcacuagcaccuguagguauuaucucauuuaauccuuaacacuacuaagaaagauauuauacuagcccacuuuuuaauagauuuuuauuuugaaacacuucaagacacagaaaauuggcaaaaauaguacaauuuuuguauauccuucacccagauuccccaaaugucuuuaucucauuugcuuucuuuacccuuccuucccucucucucuuuugcucuuuugcucucccucucuaccuacagacaugcacacaaauauauccccacauacacauuguuuucugaacuguuuuagaguaaggcaaagccacgaugccccuguaccucuucacuguguauucccuaaaaaucagaacauuaacacugacauaaaacauauuaucuaauccacagaccuucaaauuucaccaagcguccuauaaagcccuugagagcuaaagaaaagaacacaaacucgcgugguccgggauccgauccagcauuacgcgaacauccaguuuuuguaucucuuuaguuuccuuuaauguggaacaguucuuccaugaccuugacauuuuucuuggaguacaggccaauuauuuuguagacaucacucaguuuagguuugucaaauguuuccucauaauuagguucagguuguacauuuugggcaggaauaucacagaaacgaugucagguccuucauucuucaaaccagagccacagcuguguguuugucccgauuucacgauguuacuuuugaucacuugauucagguagugucugcuauauuucuucaauguaaaauuguaauucccccuuugaaauuaguaagaacuuuguggggagauaugucaggacuauguaaauuccuucuacauuuucaaucuacuauaagaaacacuauuccuucuuuuucacuuauuuauauuaauuuugacgcucaauuauuacagcucugaccaguaguugccuggcucugugucuuuuaccacaucuccaugagugugucagcucucccuuacuuucuggucaaaauuuuuccaggcucauuuguacugucucugcccuaacccuagaauuaaccauaucacccugcuaccuuuuaguggagaaguuauuuaagaaaaaaaucagggugguagguuuacuacugagacaucauugccucuaggcuaucuuagcagacugcuacauuaauacaugcauuuauauuucuagaacucucucuguguguauauauguguucauacugauaccucaaauuccaacccaacaccacaggacuaauucuagccuucuauaccuuuccauauguguaacucccuucacugauugagaggaaaaaauggcucccauuacuuauaauacauuuacauauuucuucaaucuugaauauaaaucauuucagaacugcuaauccacaucacuugaaaaaacaaacccuacuacaguagccauauauuuuucuuuuacaguuguuuccucuuauuagacuggugguacauggccaaaauacagagcccaaaaguuacuuggggagcugcccccaacuuucagcauggcuuuuuauccauuugaaauacggcugcuuucguuuguuucuguuuuuauuccacauuaggcuucgucucuagcccaugauguuuuuaguuugaaauauugacaagauuauuaaugucaaaagcauauaaacagauauacucagagaaaucuaacuuucugucuccugucuccuucccauccucccauccuuucaacccuggucccaacaaccccaucaguaaucaaucucauuagauucuaacucaccuuuccuauauuucuuuuuuacuaaacuacacagaucuguguauguuuucuuauuuuacuuuuuuacuuuuuuuaauuuuuaauuuuuguggguacauaguagguauauaugcaugggguacaaagacauuuugauacaggcaugcaauguguaaaaaucacaucaggauaaaugguguguccaucaccucaagcauuuauccuuuguuacaaacaauccaauuauacucuuuuaguuaauucuaaauuacaauuaaauuauuauugacuauagacacccuauuguguuagcaaauacuaggucucauucauucuuuccaacuauuuuuuuauagccauuaaccauccccacugccccuacuacccuucccaguuucugguaaccauccuccuucuaucuccaugcguucaauuguuuaauuuugaguucccaugaauaagcaagaacaugaaaaguuugucuuuccgugccgggcuuauuucacuuaacacaauggccuccaguuccauccauguuguugcaaaugacaggaucucacucuucuuauggcugaauagugcgccauuguguagauguaccauguuuucuuuauucauucaucuguugguggacacuuagguugcuuccaaaucuuggcuacugcagauaaaguuauuuuacuuucuuuaauaugaaacaguggcauaauaaagauguccuuuuaacagcucuguuuagguacaauuuucauaucauaaauuuacucacuauagguguacagucugaugagauuuaagaaagcauagagugugcaacucucaccagcauuacaccaagaacuguccucaugcucaccugccuucagucccuacucccacccacagaugcucuuccgcucuuugccuuugucauguacuaguguauccugggauacaccccaugccaguucauagaaaccauccucuuucuuuuucacaguugcauaguauccacugugccauguacuaugcauuaugcaccagcacuuauucaaccaccccacuguguuuggacauucagguuguucccaauauuuuggaauugcaaguaaugcugcaguggauaaccuuguggguggggauguucauacuuuugagguauaucuucaagggugaauucccagaagugggauuucugggucaaaauguaaauguauaagcaguuaugauagauauugcugauaugguuugaauaucuguccccuccaaaucucauguugaaauaugguccccaaguugcaguuggggccugaugggaguuauuggggucauugggggggaucccucaaaaaaggcuuggucucucccuucaguaacgaagucacagaagagcuggcuguuaaaagguacaugacaccuccuccucuuucucuugcucccucucucaccaucggacacuccagguccccuucccuuccaccaugauuaaaaguuuccugaggucuuaccagaagcagaugcugacaccaugcuuccuguacagccugcagaacugugagccaaaacaaaccucuuuucuuuauaaauuacccagccuuagguauuccuuuauagcaaugcaaaacagacgaguacaaucgccacacuucccuugaaaagggcuaagcccauuugcagucccccagcaaugugugggauugcuugucucuucacagccuugcuuuuucauguuugccaaucugacagauuaaaaaugacagcucaaagccauuuucauuucucuaauuaugagugauguugaacaucuuuucguuuguuuaaaggacauuuguauauccuugaugugaauuaucuuucaugucuugugcccauuuuuucuaucaaguaccccuuccucaaugauaacagcucuuuacauaucagggauauuaacccuuuacuucugauauaugcugcaaauaccuucuccuacaaagucauuugcauuuugacugugcuuaucauggacuuuuguaaucaaacuugucaaucuuuucuuuaacuacaucuggauuuugagucauuguuagaaaaccuuuucuuacauccauguuacagaaaagcucacccauguuuucuucuaguguuuuuuuuuuuuuuuuucugagaugggguguucacucugucacccaggccggaguacaguggcacgaucacgguucacugcagccucgaccuccccaggcucaggugauccucccaccuuaguuuuuguauuuuuaguagagacaggguuuugccauguugcccaggcuagucucgaacuccugggcucaagcaauccaccugccuuggccccccaaagugcaaggauuacaggcaugagccacugugcccagccacuucuaguacuuuuaugauuucaccuuuuauauuuagaucucaauccauuuggaguuuuucuuguguauacuggaacuuaugcauuaauuuuaucuucuuccaaaggcugccuggucaucccggaacaauguauugaaaagguaaucucugcuccagugauuugagauaccaccuuugucauauacuaaauuuccauaugaacuuggggucuauuucaagacuuucuauucaauucuacugcuauuuugaauauucaugcaucaauuucaccauacuguuuuaauuauagaggcuuuauaguucauuuuaauguuugguagagcuauuccucccaguaguucuuaauuugcaggguuaucgugguuacugcauguuugucuuuucauaugaacuuaaguaucaguuguguagcuccauaaaaaaacuuacugauacuuucucugggauuauguuaaauucauaaauuaacuugggacaaacuuuuuuaugauguuaaaucaauccauccaaaaucaagggaugucuuucuauuuguucaagacuacuuucacaucuuucagaagagcuuaaaaauguuucuuaucaaggcuuugcccauaucuuucuaaguuuauuccuaaguaucuucuuuguugcuauugcguccucaaacugguuauuuaugugguucuuauuuauguacaagaaaguuaauaaguucuauauguuaaauuuuuccugcuaccauaaugauuuuauuguuuaauuuacuuuuaucauugauucucuaggguuaucccaguauacuaucauaucaugugcaaacugagauaguucugguucuucuuuucuaauauucaugccaguaacugauuuaucuuaccuaauugcuaauaccuccaguacaauugugggauaguagcagagauaaugaauauccuugccuugauccuggucuuuaaguggaaaugccucuaguguuuucccaucaacaagcauccugacuuuaggauucaaauauuuuuucagguuaaaaaagcaucuauuuauuccuauuuucuucaaugauauaucaggaaugcauauugaauuuuuucaaaggguuuucaguauuuauggagauaaucauuauguuuuuccuuagauaccuuaauauaguacacuaauagauuuccucauguugaaccaaccuugcauuccugggaaaaagacaccauuuggucauggugcauugauuucuuauugcgguauugguuaguuuacgaauaauuuguuuagcacuuuuacuucaauauuuauaaguuuauaagugauauuguucuguaauuucauuuugguacuugccuuuucagauucaggugucaauguaguacuuacuuucaagaaagacuuagaaaacauucauuuauuuucgauucucuaaacaauuaauaaagaaugaagaauaucuggucuuugaaaguuuggaccaggugugguggcucacaucuguaauaccagcacuuugggaagccaagacagauggaccguuugagccccggugcucaagaccagccugggcaacauggugaauccgucucuauaaaaaauauaaaaauuagccaacugugguggcacacaccuguauucccaacuacuugagaggcugaggugggaggauggcuugagccugggagauggaggcugcagugagccguuauuacaccccugcacuucaggaugauagaggggggcccggucucaaaaaaaaaaaaaaaaaaaaaaaagucuagugacauuugggguaguuccuucaggauuuuuucuagaucuuuuauggaaauugguuuauuuaagcuuuaagcuuccuauaccaaauugauacuguuuucauauuuuuaauagaggucuacaaaauaaucucauaauuuuuuuuuuuugagauguaguuucgcucuugucacccaggccggagugcaauggugugaucucagcucacugccucccgaguucaagcaauucuccugccucagccucccaaguagcugggauuacaggaacgugacaccaugcucagcuaauuuuuguauuuuuaguagagacacgguuuuaccacguuggccacgcugaucucgaacuccugaccucaggugauccacccgccucagccucccaaagugcugggauuacagaugugagccaccgcacccggccuaaucucauaauuuuuaaaaaugucuucuaugucaaugguuaugucucuuuugucauuuauuucauauauuugugcuuucucuccauuuuuuaugcuagcaaggguuucauucauuuguuaauguuuuaaaaacccauauuuagggauugcuaaucaggucuacuguucuuucauucucuaucuuacuauuuucugcuuuuauccuuacuauuauguuucuugugcuuucuuuugguuuaccuuguguuucuuuaccuagcuuuugggguaagaacuuaguucacuuauuugcauuuuuguguuuuuauuaauaaaagcauuuagggauaugaauuuccuuccaaucacugcuuuaaauauaucucauacauucugguagguaguguuuucauuaugauuauuuuuuaauuuuuaauuugcuuuccccauuucauccaagaguuaauagguuguuuuucauuuccagaugauaggguauuuucaucuuuuuguuaauaauguccaguuuuagugcaccgugguuagaaaguauuguuuauaauauuucuaccuuauagaacuuacugaaauuuucuuugugagcuaauauauaacuguuuguaaaugcuccauguauaccugagaagaaaguauauucuauauuauuguggcauaaauguauacauaaagauaucuauaucuccauaauaccuaucuucuugauuccauuguuauuuuuuuccacuucaucugccuugugcugaaugugguauguuaaauuuucccauuauuagugguuuucucugcauuuccugguuucuuuugcaguaucugcuuuauaaaggugguuccuguguuauuucaugcauagauauucgugacugauauauaacucuuuugaauuguuauuagcagccauuuuucugaguguagucauugagcaccugcugugggcaaggcagaacccauaucaucauuuguccuuucauguauuuggaagcaaugaccacagaggggcacagagaugcuucgccuuggucaugaagacacccugggauguugguacugguguuccucacuuagggcaccaauugugccaauaaguauacaugaauccugggcuguucccugguucacacagccagcauccuggacagcuccuccacggccacugccaagcaaccugcuguggcugagaauggaugcuuccaauccaaucguguuuugaaaagauuaacagaacagaaaaccaaggaaaucccugagguuguggcuucuugguaccauguuguguucagcugaauuauggcagacuuuuuauaaaggaggcugaggagggcuucauucuccagaacagcuacagggagcucucugcagcuuggcuacuccgcaagugcccuucucccucuagcucuuuacggaacccccacccuacccauucagggugagaguuccuucugcaggaacaaggcagagaggcauccucucugggcauagaaagcauuuuggaaccaaagcccucagcccuuggcuaagagucaaggcaggauguaaaugcaaagagaaucaguuagacuucauugauuagugaaccugggguuaaucagcgggcugggggagggguguggcuuaguucaacaccauuaacacaugcucccuuccugccccaacacagagccgaagaugucagguagaauuugccagccuaauuacaaaugcugagccuucauuugguaggcaauuaauagucacuagaaauauaaaucagggcagagacaaacgggggauaacuguugacaaacccuuuaaaagagcauuuuaaaaauaguggcagagauagagcaugguggggagaaauagugagggauauuuccuauggcccuacacucugcaccaguucuggcagcccugagcacagagagaggaacaaaagcuauacagaaaagagaacggaccuccuuguucuuuuaaguguucaagccuuuuccucaggagggacuucucaggaagagaggcaggucaaugugugggaggggcuuuggcaugugagcgggacuuugauguauugaaugaggccucagugcuugggaaguggcucaguguguaggaggagccuccacgcguggggaggggguucagugugugggaggagccuccguguguggagaggagccucugugucggaagagccuccgccugagggagggggcucaguguauggggaggaggcgcaguguguggggaggagccucaaugugugggaggagccucuguguguggcaaggggcucagugugugggaagagccucuguguguagggaggagccuuggcgugugggcagggcuuugacauguuagaggccucaguaugugggaggguaaucaaugugugggacuguguguggggagggguacugguauaugggcaggguuuugauguguugaaggaggccucaaugugugggaggggcuucagugugugggaggagucucaguguaugggaggggccucgguauggggagaguuuugaugcacuggaggucucaguaugugggaggggucucaauaugggagggacuugugugugggagaggccucagugugugggaggggcuucagugugugugggggggccucagggugugggaggggccucugugugagugggacuugugugugugagaagggccucagugugugggagaguccucuguguugggggagaggcauugguauguggacagggcuuugaugugcugaaggaagccucagugugugggagauaccucaaugugugggagaggcuucagcaugugggaggagccugcguguugggaaggggacuuagugugugggaggggacucgguguguggguggugccucacuguguggggaggagccuuggcaugggggaggagauuugauguguuacaggggccucaguaugugggaagagccucggugugugggaggagccuccaugggugggaggggccucagugugugggaggggccucugugggaaggagccuugguggguaggaggggccuugugaggggagggggcauggucuauugcccagccagccccaggcaccccguuaugcagaugcucagcaaugugguuuccuccuccucuuccugggcacauuuuuaaacuguauuuuccagccucuccgcaaucuaguggggccuugugacucacuucugcccagugggaaguggcauaaaugaugcaugccacuuccaggccugguccacaacaaucucuccuguggacacuggucacagggccugcccaagauggcacagccagggguggccugaccauugcuacaauucacauugucauugcuuuacuauacugccucccaauucaucuauucuugcaaaaaugucuugauuaaauaugcuauggaaggauccagaguagaaacccgugagugcuccuaugcccucagcaucugucuaucccaauggcuaacccagggcaaccaggaaaaagugcgaacgagcuguagaaucagaagcaguuggagcuggagcgagugucuagacucaaagagcagcuggaguuuagcauguguaggccccugacuccgaggccuaaggauacccuaugggcucaguacagaacucuuccagaacauaaaggcauuguucccuuggaaaaggucccucccucuguacagacaccaaaguggaaggaguuagcagccuacaucucccucaagcaccccagucacccagggcuucugguuaccacagagcucagaaugccuugaguguggguucuucuucccuucaguuucaccuucacgcugcuccuccugcucggacagaaagauccagcugcagugacaagugcaucucacuuuaagagaguccuuguugcaaaacucugaucugacaaaaugcagcaggggcagcucaucacauugcaaaaggauuacauuguuuuaacaugaaucaagagguaucuauccccgcuauaccccaauuaccgaagaggaggaaucugaggucagaauagcccaagugaggugcauaccuccaaggucagguggugggagcugcagcagcuccaggcugcccucccuggggggagcugcuuugcugacccacuucagaguuugcuuagagaugaucuggggaaaugugagggaccaccgacaagaucaaugaccaugaaaauagcuuauuugugaagucacaguguaaaucggcaggaaagagccuuucugaaacccacauggcuucaggcaaagccugucaguccaggaccugcaaauaccugggggcugaaaggacaagggcaccugcucugcucagcugaggacugcccagaggggaggggagaagccucggccagggacagggcuuugcacuaaggcaguguuugauggacuaacgguuugaucccaggggauaccccgcuucaagcggcugggguggcugcaggauuuggaccugggguuuaacagugcaguugccugcuccuccccagccugcagccccccacgcaauuccugcacuauuuggaaaggcugggauuccgcacuuuaauucugcuuauggcuuaauacaacacauagagcauuuggcggggugccuuucugcugaagguaugaauguuuuaauggaauuguguuaucaugcgagcguguggccaacuguucaaacaagauacucuggcuuucuugaagaguuaagcagguuauagcagaacagaaaacagaagaauaguaauuccaauaucagacauuuguggauggaaaaauaucuuuauuauguuauugacaugcaucugucuccaucacauauucuauggcauuaaaacugccagccgcaccguggccagaugucaacgacccugucuauuguccuucccagaguguccacugggacaagaggcaacaccuggacaccugaaaagugccaacauccaagugugugcuugggcacaugggccagagugccugacccucccacuccuguacuuuccuguccuacacaccugcagacacgcacauacacacacacacacgcacacacacaccaggauguaccaagauaacuuaugacauuuuuuuucuauguuucuaauuuucuaaauuaguuucaaacauaguuuauaaaagaacugcucccuaauccuggggaaaggcaugaugggacauccggaugucaggccaaucucuucugccuuagacacacagcagggaaaaaccaucccagacccacaagcugccugccugacgaggacagacagggcaccucugccucgccugggccguggggcaccaaugaugcccagcuucuccugccucccuagaagcagcucuaacuccucccaauucccaggccccccagggccaccugccuccugcucguccacggccucucgugacuggaggaagcugagcucugcagaacugggucucagguucuuuaugcagucgcccuaaaugcggcucucguggcgcccccucagaagugguccccccagccucugcuccuggucugugacgaggcaaugugcucucagcucccgaaucguggcuucaccccuucuggaaucuuccagucaugccagagcuguuucgguuaccucuucucucauccaaggcacuugcaaacagugacuuuuugaaaaagggccuuguguauuuuuauguucccaagauuuauagaaauaauuaagaaauuugauuacaauuccauuguggcuguuuacuuggagaacaaaccuuuuuucgugaacgcuuccucacucugacuaaugcacuugaguuucuuuuuauuuuuaaagcauaaauuuuccuuguugauagugacuauguauagcgguugcagcuggggcuguuuguacuaaguuucuaaucuaauaaguucugcagaagaauaauacaaccauuuucccggccugacagagcugcuccuucaggggauauaaggcccagagagcuugcuuugcacugcucccugaucagcuguuuuuccucagggagagggaggugggaggugaggaguggaggggcucucguguggacugauuagagggcuugacagucacaaugacaaggaaagguacccagguaucuugaaggguaggggugggggaaccuuggugucaaagguaacccaugguaaaggcugggccccucugaguuccacuagguuuuguugguaccugcuggguccuguugagucccuguggguccccuggguuccacugggccuuuuuggguucugcuaaguucugcugggguccaguccacugagccauguugaguuuuuguaggaaggaaagucaacugucaccuuccuccuugcaccucccaacccccagucaagccagggaccauguaaagaaggcuagaaagaaauaauuaaaaaaaaaaauuaagcucugggcugggcacgguggcucacgccuguaaucucagcacuuugggaggcugagguggguggaucaccugaggucaggaauuaagagaccagccuggccaacauggaaaaaccccaucucuacuaaaaauacaaaauuagccuggugugguggcacgugccuguaaucccagcuacuugagaugcugagguaggagaaucgcuugaacccuggaggcagagguugcagugagccaagaucacacuguuauacuccagccuggaugacuagagugaaaaucagucuuaaaaaaaaaaauuaaacuguguguucccacaguuccacaaaaauuuaagaagggagccagcguucguggagccucagucacggccaggcccugcaccccgcucugccuucuguucauuucagcucacaacuccgccucagggggauuaucgugcccaguuuaggaugaugugccugaggccagagaacugggaagcuguaaagcugggaugcaaacauagacauagugacccucaagaggacagagggcagccaaaggcucuuucugucucuccugaggaaggcgcagcugaagagacaggagggacgcagcgucuggcugcucuugcuucggagccucaccccugcgccucccgcacagccuguccccagccacgcuccagcacgggauggauggacacagccagcccauccuccccgaggcaccaggaagggaucuaauuuuagcuccgagagucuaaaauugcuggugcagaacaucauuaaacacuuggcugcucccaaaccuuggggauagcagacggagagucugcaaagacccaccaugagaggagaucgugcauuugcgucacugccccucacgccucacccuccagggccccggggaugccagccaucacgggcaugguccuagcaagcaaauguccuucuuucugcugaguccaguguccuccugucuccccagggaaagccuggcaagaaugaaaacaucaggcuggcugagaggcucagcugcccagugagaccguuguuuaaagaucacagagcauccccaggcugggcaucccucaucagaugugugugcagaaauucaggcucucugugcucauuaagucgcuccaugcccugcccccuuuggugaccaccaugaucauuccaaggccugucaugcuguuguucaugcuccgcauaccuucaccucccuagaagcucuccuggauuaagaagucauuggggaccaggcacaguggcucaugccuguaaucccggcacuuugggaggccgaggugggcagaucacuugagcucaggaguccaagagcagucuggccaacacggugaaacccugucucuacuaaaaauacaaaaauuagcugggcgugguggcaggcaccuguaaucccagcuacucaggaggcugaggcaggagaaucgcuugagcccaggaggcagagguugcggugaggcaagauagcgccacugcacuccagccugggcaacagcgagacuccaucucaaaaaaaaaaagagaagucacaggacaagaucuccaccuccacuugauucaaccugaaccugucccgugacaaugaaaagcaaaaugcugaaugauggggcugagugagagaaaaggaaaaauggaacagggaugggaaacuacccaaauauuaaucagcagaugaauggauaaacaaaaugugguccaguacaauagacaauuauuccaccacgaagaggaacuaagcacugacaugugcgacaacacagacaaaccucagaaacugcaugaggagugaaggaagccagucaacaaggucacauauuauaugauuccauuucuaugaaacauccagaacaggcaaauccauggagacagaaggcagcugagugccugccaggagcuguaggagggggaccagggagggacugccugagccguggguacaggcuuucacuuugggaagaugaaagcacauuggaauuagguagcagugacugcgcaacaucguggacgugcuaaaugccacugaauuguauacuuuaaaauggguaauuuuauguuaugugaauuucaucucaguuuuuuaaaauuuaagggauggauuugauugggggcaggggagaauaauucauagaaaagagucccuuaagagcagaaacuauuucaguccaauaaauacuuguugaccacuuggucuguguuggcccugagauacugggggaggcagaaguggaaacaaauaaucguaauaggagguaacauuugagcagggcuggaaagagaaagaguucaccaggugaacaaggggcagggaaaagggagagguuaaaggcauucugugcaggggaacagcuugagcaaagccagaguccuaaaugugugcagccaugucuccaaaccaaggcaauugcacauacucugaacagcucacugcugauggaaaugauagauguggguccaaccuuucuugaacuggccacuggacaaauggaacaaggaacaagcugcauuuuccucacguuccaggagaacagguugaaaacauuuuucaaaagugaaguagucaauaaaggaaagcucugaagggaagaccaggagaaacugaacaaauccaccauuaaaaggggagauuuuuagggcacuuuucucaguauaggucaaacugaaacuaaaaucaggaaaaauaaggaaaauuugaauaacaugauuaacaaacuugauucgacaaacacuuagaacauggcacccacaaaauggaaaacauuccauguuccauauuugcuggaaccaauacugggucucaaaaaauuucaaaaccgcuagcaucauauuguccaaauaacaaugaagugaacuacagaccaaaacuuaaauuagaaaucaguuaacaaaaagaucccagaaaaaacccuauauguuuggaaauuaagaaauauguuuuagacuuggaaccaacccaaaugaucaucaaugauagacuggauaaagaaaauguggcacauauacaccauggaauacuacgcagccauauaaaacaaugaguucauguccuuuccagggacauggaugaagcuggaagccaucauucucagcaaauuaacacagaaacagaaaaccaaacacugcauguucucacucagaagugggaguugaacaaugagaacacauggacacagggaggggacuaccacauacuggggccugucgggguuggagggcaaggggagggagagcauuaggacaaauaccuaaugcaugcagggcuuaaaaccuagaugauggguugacgggugcagcaaaccaccauggaacauguauaccuauguaacaaaucugcacauucugcacaugaaucccagaacuuaaaguaaaauuaaaaaaaaaaaaaaagaaacccauuuuauacaauucaaaacagaaaucauaauggagguuaaaaaacauugcgaacugaaggauaaucaaacuacuacauguuaaaacacauggaacauacgcuaaaacauauuuagaaaggaauuguucauuuaaauguucauauagaaaagagggaaagcuaaaauuaaugaaccaaugcuccugcuuaagaaauuagaagaaggaaaguagaauaaauucaaagaauagaaaguaggaaaacagcauaaaaacggaauucacaaaacaggaaacaaaucuaaaauagauacaaacagcaaagucaaaaguugguucuuugaaaagaacaauacaguugacaaaauucugauuaaaaaggauaauauugggagugaaaagaacauaaccagagaagcuucaaauauuaaaaaauuauugagaggauauaugacuauaucaugacaauaaguuagaagcuuaggccaggcacaguggcucaugccuguaauuccaacacuuugagaaguugaagagagcagaucacuugagcccagcucaaguccagucaggaguucgagaccagccuggccaacauggugaaaccacuucucuacugaaaauacaaaaaucagcugagugugguggugcaugccuguagucucagcuacucaggaggcugaggcaggagacucacuugaacuugggaggcagagauugcagugaacugagaucugagauugcacuacugcacuccagccuggcaugagcaagacuccauucaacaaaaaaaaagucuaaaugaaauugacaaauuauuaaaaaaacuuaucuaaaccaucuuaagaaaauauaaaaaccugaauauucuuguaaacacacaaaaaagaagcaguagauaaaaauuaccagguccagaugaugguaccacuuaaauaguucuaauuaaauauucagguaacaauccaaaucaucaucuuacacaaauuauuccacagcauaauuauuccauggccucaaacucauguuugacauuaagucugacaagaauaucaugagaaaagaaauauagaagccauuauaaaucaugaacauagacgcaaaacuccuaaacaaaaucuuagaaaaccaaauccaguaaugucuaaaaauaauaaaccaugaacaaguuggguuuauccuaggauuacaguuagauuaauauuagaaaauaacuauaauucauaauguuaacagauuauaggagaaaaaguauaugauuauucuuacuagugacauuaaaagcauucaauaauauuaaacauccaguugugauuuuaaaauucuuagcaaacuaaaauagaagaaaccuuccuugaucuaauaaagaguuuauacuauaccaaccaacaaauaaaaccccuacagcaaauauuacuauuaaccaugaaacacuagaagaaucuccuuuagaaucagacaugaggcaagaguuccugcuauuaauauuucuacucaacuagaaguuguacuaggacuucuaguucuauucuuguucucuguccuagaacuucaaguuuauuucuuguucuugcauuacugugcagaucagaacuuccaguacaauugcuggaugcaguagcucacgccuguaaucccagcacuuuaggaggccgagguggguggaucaccugaggucaggaguuccaggccagccuggccaacauggugaaacucugucucuacuaaaaauacaaaaaguuagcugggugugguggugcacgccuguaaucccagcuacuagggagggugagaugggagaacugcuugaaccugggaggcagagguugcagcgagccgagaucgugccauugcacuccagccugggcaacagagcaagacucugucucaaaaaacaaacaaacaaacaaacaaaaagaacuucuaauacaauagaagucuaguacaacagaaguucuaaucugcucaguaaugcaagaauaagaaauaaaaucucuaaggguugagaaugaagaaagaacucucaauauucauugagugugaauuaucuacauagaauucaaagaaucuagaggcaaaguauuaaaagauuccaccaaagugccuaacauaaggucaacauacaaaaaauaaauuaauuuauauacaauagcaacaaacagaaaauauacuuuuuaaaauaacacauaauugcaauuuaaaagcuaaaguuuauaagaauaaauuauuaguguuuaaccuaagauagaucuucuguucaaagauagaaaacucagcuggguacaguggcucacaccuguaaucccaggacuuugggaggauuguuugaagccagaaauuugagaccagucugggcaacauagugagacccugucucuaccaaaaagguaaaaauuagcuggguaugguggcacaugccuguaguccuagcuacucgggaggcugaggugggaggaucacuugaggcuaggaauucgaggcugcagugagcuaugauuaccccacugcauuccagacugggugacagagcaagacucugucucuaaaauuaauuaauuaauuaauuaaccaauuaauuuaaaaaagaagacucaauauccuaaauaggucaauucucaccaaacugacagauuuaauguaauuccaaucaaaaucuccccauaggaauuugaggauuuugacaagauuaucuuccguaauguucaugaaacagcaaaggccaagaauaggugaaaugcagaacauauauauagugguaggagggagaggagaaugugaucaaccaccugugaagacuuauuuccaagcuacagugaacuacagcaacugaacugauggugugcugagacaagaauagacaaacugacgacuacagugauggcauaaggggcccagaaacagaucuacgcacaggcagcuacuugacauaagacaggaaucaucuauggacagacuugacauaugcacaucacuggggaaaggaugacucauccaaugcaugggacaccucuuuccaacacggaaaaaaaggagaauuuuccuacacaaaaugaauuuuagauagauuaaaacuuggaugugaaagccaaaccaaacuccuaaacuauuuagaagauaauauuuauggauuaggauaaagauuuaguaaacaagaacaagaagcacuaacauaaaaaauaaaauuaaauuaaacugcauuguccgggcacgguggcucauaccuguaaucccagcacuuugggaggccgaggcagguggaucaccugaggucaggaguuugagaacagucuggccaacauggugaaaccccaucucuacuaaaaauacaaaaauuagcugggcgggguggcggguaccuguaaucucagauacucagcaggcugagguaagagaaucacuugaacccagaagguggagguuucagugagccaagauugcaccacugcgcuccagcuugggcaacagagugagacuccaucucaauuuaaaaaaaaaaaaaaacugcaucaaaacuaagaauuucuacccaccaagacaccauuaggaacacuuucuuaaaaguaucaaaaugaagaaaacaguuguaaugcauagagcaaacucaagaucagggucuagaaaauauuaagaaucccugcaaaucaaucaauaacuaaaagacagacaauccaauagcaaggaaaagaaugggcaauucacagaagaaacccaaauggccaauaacccucuaugagaagaagcucagccucacuguagcaaggaaaguagaaaugaagacaaagucugugaugggaaugugaagaaaugggaaccaucacacacuccacuuguaguugggaccauaaaucaauacaaacaucuuggacagcaaugauaaucgcugaagguauagguacucuaccacccaacaguuccacuuuuaggaauaugagaguauccaaguaggccggacgcgguggcucacgccuguaaucccagcacuuugggaggcugaggcaggcagaucacgcagucaggagauugagaccauccuggcuaacauggugaaacccugucucuacuaaaaauacaaaaaauuagcugggcaugguggugggcaccuguagucccagcuacucgggaggcugaggcaggagaauggccugaacccaggaggaggagcuugcagugagccgagaucaugccacugcacucuagccugggcgacagagcgagaccccaucucaaaaaaaaaaagagaguauccaaguaaacacacccccccgcuuagagagacacuagcauauaaauguuaaugcaauaaaauucuauacagcaguuaaaauaagugaacuagaaauauauguaugucuuguuaugauauacauauguaagauacauaauaccuauuacauacacacaccccuaucucucucuaucaucucucuguaaggaucuaacacuuaagaacaauguugcaagagaauauuggauggucucauauaaacuuuuaaaaucugcaaaacaaugccauguauuguuaauaaauacauaaauaugugauaaaaguauugcaaauacuuuggaaugaaaauauguggccaggcgugguggcucacgccuguaauccuggcacuuugggaggacgagacggguggaucaccugaggucagcaguucgaaaccagacugagcaauauggugaaaccccguaucuacuaaaaauacuaaaauuagucaggcaugguggugcgugccuguagucucagcuacuggggaggcugagacaggagaauugcuugaaccugcgaggcagaaguugcagugagccgagaucgcacuacugcacuccagccugggugacagagugagacuccgucuccaaaaaaaagaaaagaaaagaagcaugagggugaaaaacacuaucacuggggccagagggaaggaaauuagaucaagauuauguguauacauuauguuuucuuucuuuuuaagaaaucaaauuaaauggggcaaaggguaagauuugaucaagaaagcuaagugguggguaaacagcuguacauuacauuauucucuaugcuugucuguagguaucaucuuaugaaguaauuaauaaugcauuucaaaugaagaucuccaaccacucauuucuauguugacaacauucauccauccugggaugauuuugcaaucuagccauuugaagugauuuggccaguuucaauguaguuuuucuuuucaaaagcagaucguuuuuucuaggcagugaugucuacuuuauuacugucgugcuuucaacauuuuucagcuacauuuuauuuaagaagcuuuuccaaacacuuucucauaaagaaaagugacaauuccgaaagggacaaagggacgagcauucuaaugcaggauacuccugcaaagagcaauacuuuaacagaugauguuaccauugaaauaggaaacaaagagggcauaaauauuugucugcaucauucucuugguguuccaaugaucacacugccccaaacacacccacacacaauuagacagggcucuucucuuaguucgauuaaucauccuuuaugaaggugaaacaaaccuuacuggcugaaacgcugcaaaaacaaggaacaaauaauuugaauuuucaaaugaucuguccauuucuguuucucccuggcuuucaaagcugcaaauauaaauucagcauuuccugugagaucugaccagaugcccaauuccgcacaugacaggaugggccaguccuaggcacgggcauagaccccaagacacuggcugcuguguguugcaggggugccacagcuuuggaauaaagcgccaaguggagugaggggugccagcccaaacacgggccacgcuggcauccagccaccugcccaucaaaccccuagcuuucucuagaauccuuggauuaaauaaauauguggcaaaggguugcuggcaaaaaugauaauaaauucaacucaauucccaccacaaacuggcaaacuccuucaacgacccaauucagucugucugccucaacuuccaaauagcugguaauggggcccacuggggccugugggauccuggaggcucuuagucaauauugcaugccuuguuauuugccaaaacuucugagauaaaauauaggauggacuugacuucuacacuagagucagaaugagaagaaacguggggagcgaggaguggggaagccucuaaaucuauacacccuccuccccaaaccucagcuaacugcuauccuggcauugugauggcaucugggaagagcucagcauucucucacccauucaaccaacauuuuugagcacauaguaggugcuagcauaucugugcuagaaacugcagcuacagcaaggaauaaaaagauaugcucucuauaacacaaaauguacagucuaaagggaaaacgagugcaccaguaauuaggguagagcuugauaaggaugugacaggugcuaagagcauauagugggaauuccugcacaggcacugucccucccuggccugcuccccgcacccuccccaauccuucgaccauguugcuuugggucccgcagaggaucauugacauacuguucaccguuguccaccugcuuucaggucaggccucagaugaaaccugccauuccccaaggaccccaucucucuaggacucccaaaaugccaucuuuucucccauaccccaaguauugcagagccuagagcuaaauugauguccuccuuguucccuguuaccaauuccaaaguauuucuccugcuuccuccaucaaaaccccaguucccuggaagccggugccauuccauaucacugccgucccucgcuucccaucacugccaucuguggacuccuggccgugcugccugcucuguucugccaggccugggucacucucuuccucuccagguccaccccugccacuauucuggaugaccucaacauccauaugaugacccacccaccccccggccucccgcuccuuggucuccccccauccagugaccuuuccccccaccccagccuggccacccacaccuccagccaccaauaacagcaccaccucugaaaccaccacugcaaaccucuucucggaccagcaucuguggcucuaggucuuuggcaccaggacuaucacccagucauucucgggcugagcaggacuuccaaccacaugguuuauucacuccccaucauuccuguucagccucacucuucuccucagcaugguuucagggacuauuguuacacaaucuugaaggcagagaggcccauccagccucccuuagugccucacagguccuccugccuccccgcuugcugccuacaaucuauuuuccauggcaggagagaucuggaacugccaaaacguucaaaacuaaaccucuggugugaacauaaaauggcauagccauuuuggaaaacagcuuggcagcuccucaaaagaucagccacggagucaccacauggcucagcaauuccaccccuaugucuauacccaagggaagggaaggcacauauccagaagcucauacaggaagauucucagaaacauuauuuguauuagccaaaaggaggaggcaaccuaaauguccaucaacugaggagcugauaaaugaaauacggucccuccagaccacaaaauauuacucagccauagaaaggaacaaaguacuuacugauaagugcuaaaauaugaauaaaccuugaaaacauuaccauaaguuuaaaaagccaguugcaagagaccacccauuguaugauucuuuuuauauaaaauguccacaauacaucagucuaauagaaacagaaaguagauuugugguugcccugggcuggaggggcuggggggaaaagggagugccugcugauggguacaggguuuccuuuggggaugaugaaaacugauuaggguucuaagacacacuguggcaaugguugcacaacucuguaaauauauuaaaaaccaucaaauuguacucuuugaauuguauuauaugaggauuauguccaacuguggaacucccuugguuaaaaccuucgaauggcguccacugcaccaaaaauaaaauccuagcucccuaccaugaccuauaagaccauacauggucuugccccagccaacuguugggaccugacagcucccugcuuucuccugcacccaccauacuccagaagcccuggccuucuuucuauuccucuaacacaucaagaaacgccccugcccaauggccuucuacauguuccuccugccagggcuguccuucccucuaaucuuugcagggcuaguuucuucaucuccuucaaguuugaguucagauauucucaggcgagaggaucugacguugccgacacagagagacacacacaguaagcuuggcguugcacaccuugcccuguuuucuucauugcuauuguacuauuggagccaaucagauucauugcuugccccuuacugccuuuccccaguggcugucagcucugagaaugagacccuugcccguccuucaccacuccacccuuggugcccggauggaaugggcccuuauauuaguccguuuuugugcuauugauaaagacauacccaagacugggcaauuuacaaaagaaagagguuuauuggacuuacaguuccauguggcuggggaggccucacaaucaugacagaaggugaaaggcaaggaagagcaagucaugucuuacauggaugguagcaggcaaagagagaacuugugcagggaaacucuuguuuuuaaaaccauccaaucuccugagacucauucacuaucaugagaacagcacaggaaagacccguacccauaauucaaucaccucccaagacaugugggaauugugggaguuccaauucaagaugagauuuggguggggacacagccaaaccauaucagcccucaauggagauuugcugcaugagugaaggaaacagaucacagaaggcuuccuggguggcgugacugugaagcugagcacuagaggaugagcaggagcuaacugugcaggguggagaaggagggcugcaggaagagagaacagagaccugaaagcccauaggaaaagggcacagagagaugaaaggaauguggggaaagaggcuagagccagcaugagugcugccuugugaacaaauucaggaguuuggaucuuguuugagagcagaggaaaggcacuaaaagguuuuaaguauuggaaugacauacacagaauugagguuuauagaaugaaguagaggagggcaagagagggagcaaggagaagaggaagaagccuuugcagcaauacaggaaagagaucauggaacccugaacucagaugggcuuaagaaggacagagagaaagaagugacuuccagguaucagagguacagucaacacaaguggugaaugacuggaccaacugacugauuggagcagggaggagaacucaaauggaugguaccauauacugagaaagagaacccaagagaaacgcaugucaggggagagaggaaaacaguguggggaauccaaggggaaguggucaguagucaaaugggguuacuguucugaaacuuagugguacuaccugggcuguagacagagaacugugugucaucauugaaacaaaauccauaaaaauagaugaaauuucccaaagaaaguuuuuaaaguaaggaaaacggaggccuuggacugaaucuugagcaucacaaauauagaagggaugagcauaggaaugggaggucacaaagagaagagagaagguggucagggaguuggaaggaaagccaggaagcaugguacuccagagggccuagggaagagucuguuucaagaaaaaaaaacggggcucagaguguccaaucaaugcugccgagauagucaaagaaacgaggacugagaaacguccgauggcaaccaggaggucguuggugggggccaggugacaagguaaagacagccacuuuggacaauuucaggacauuuggggagggacagggggaguaaagcugaagauauagaaaggauauaugauagggagaguuaagucauuaauaauaacagcuuuuauuuuuuugagauggaguugcccagacuggagugcaauggcaugaucucagcucacugcaaccucuuccucccagguucaaaugauucuccugccucagccucccaaguaccugggauuagagguacccaucaccaugcccggcuaauuuuuguauuuuaguagagaugggguuuugccaugcuggccaggcuggucucaaacuccuggccucaagugaucugccuaccucagccuccucccaaagugcuaggauuacaguugugagccacugcacccagccacagcuaaguuuuuuacugaaaguguacuaugugccaggaaccauucuaaucuuuauggaacaauacuaugaaguaggcacggaggggcaaggcgauccucuacauuuguccagaaggccaggggugguagcucaugccuguaauucccagcacuuugggaggccaaggcaggaggaucacuugaggucaggaguuugggaacagccugugcaacacagcaagaccccaucucuacaaaaaaaauuuuuuuuaauuagccagguaugauccugugcaacuguaggccuagcuacuugcgagacugaggugggaggauugcucgagcccaggaguucaaggcugcagugagcuaugauugugucauugcacuucagccugggugacagagcaagacccugucucaaaaacaaaaacaagaacgaaaacaaaacugaagaugaagaggaaaaaauggugggauccagagcucagggagguggagaacggaaggcacacagggaagucgguagccuguggggcaugggugaggacagucugauuuccugucuucuguuugggcuggagaaguagaaagugagaucacuggcugacagggagaagggaaggugaccggacuugaggucuguguuaccagaguuuaaauuccagcuguucugguuuguauguuuuucuacucacauugaaaaguaagcauacugaaaaugcccaucacuuugaaguuuugcaaucaaauaaggucaaaauucuccugaacucuagcucacccuggugaugaaaggcagcccaucuuaggcccaaaccauuuaaagccuauuaaaaacagaacugcccuacuccugagaccccacuauuuccuuuaaaaaaagaaaacaacuuaagagccauauaauuaaaaaaaaaauaguacguaacacuucauacauagaaagauguguguucuguauuuauaaagcacaaaguuuaaauaaaagaagacccauuaccccacccccaccucaccccaacuuaggaacuagaaucguccacauuaagccacuguggguauuucuuugagccccacucuuagcaagccuaacccaaagggaaaccuccuuccugaucuuugugcauaaaauucccaucauuuuuaagaaucuaguuuuaccagaugugcaugaauccaaagauagauugcucaguuuuccuccaaaauuuuacuaugaaaacuaucaaacauacagaaaaucugaaagcauuuuacagaggaaacccuuguuuccaccaccuggauucuauaauuaacaucuugcuauauuugcucuaucucguaacuauccauccagccauccuuuugugcauucaucgauccauuuuauuuuuugaugcauuucagaguaaauugccaacaucaguacaagucuaaaggcauaucauuagcuagaguucaauauuuguuugcaguuuguuuguuugaaguaaauuuuacagagugaaaugcauggaucucaaaugcaucaugggacacaucugacaaaugcgccucacugugcaauccaacaucugucaagauacaggcauuguacucacucaagaaaguuacuuuaugucuuuucccaguaaauugcagacaccaucacccacaacagaggaagccaugguuaggaucauuuuguaccaccaauuacuuuugccuaaucuagaaguugauauaaaugaaacauauaacauguacucuuguuucuggcuucuuuuacucugcaugacauuuuugagauucauccauguguguggcauguauccaaaacguguuuugguuuucuuuuuuugagacagagucucgcucugucacccaggcuggagugcaguggugcaaucucggcucacugcaagcuccgccuuccggguucacgccauucuccugccucagccucccgaguagcugggacuacaggcgcccaccaccacgccuggcuaaucuuuuguauuuuuaguagagaugggguuucacuguguuagucaggauggucucgaucuccugaccucgugauccgcccuccucggccucccaaagugcugggauuacaggugugagccaccgcgcccggcccccaaaauguguuucucuuuauugcagggcagcauucuguuguacaaaaauaccuccacuuguccacucaccuguugguagaccccugaguugcuuucuguuuucagugacuaugaguaaaacugccaagaacauucucauacaagucuuuuugugaacauauguuuucauuucucuugguagauguccaagagaggaauugcugggucaugcaauagauguauauuuaguuuaagaaacugccagguacuuuuccaaauuguucguaccaucuacauccccaucaauaauguaugaagcuuccuguuguuccacaaccuugccagcuuaugguauccucagucuuuuaaaauuuucaccaguaggguggguguguuauaucucauucugguuucaguuuccauuugccugugcuacagacuuuugauagcuaccuuuuaucagauuaagaaugggcucuucuaucccuaacuugcuaaaaaauuuuuuuuuguuuuuuguuucuuuguuucugcuuuuuuuuuuuuuuuuuugagacagagucucacucugucacccaggcuggagugcaguggagcgaucucagcucacugcaagcucugccucccggguucacgccauucugcugccucagucuccccagucgcugggacuacaggugccugccaccacgcccggcuaauuuuuuuuguauuuuuaguagagaugggguuucaccguguuagccaggauggucucgaucuccugaccuugugaacugcccaccucagccucccaaagugcugggauuacaggcgugagucaccgcgcccggccaaaaguuuuuauuauuaauuuuuguguuaaguguugucaaauacuuuuuucugcauaaaaauucuuucugaucccugauuuucuugggaacagagaggugauugggaauuuuuguucugaaagcccgucucuuacaguuucugcuggccuauaacccacuggugacaguaagaggagcaagccagggugaguauggcggugguaguggaggacuuagcaagaaaggaauagggcuagcagugaagacaagacugucuaaacuguucaaaguaugagcccauccgggucaucugaaauaaugaaugaucugcuugccauaaaauuaaaugucguccccaaaacagucaaaaggacagaaguuacacaugcuacagauacuucugaaaucgucuuggucuugguaugaagaaugcucaaucaggauuagcaaagcugcaggcaacuggccaaaaaauuccuuacccuauuuuguauucaccagggcguguggcucagcuucuugcaaacaagguaggagcccuagaauaucugugaauagucagugcaggucagagggagcucauuuugaagggaauucaguucagacaucaccucccugaugagaagcccucucuggcccucagaggccagcuggucgccugucucucugaucccacaugucucucucacuguccugccuacauuacuuuaacuuucaccauucauguaucuaucugcuuccaccacuaggcuggggguuccuugaagauagagacccucuccuauuuaucuuuuuuuuuuuuuuuugagguggaguuuucauucuuguugcccaggcugcagugcaguggggcgaucucagcucacugcaaucuccgucucccagguucaagcgauucuccugccucagccucccaaguaccugggaucacacgugccaccacaucuggcuauuuuuuuuuuguauuuuuuguagagacauguuggccaugucucuauuaaacaugucuccauguuggccaggcuggucucaaacuccugaccucaggugauccucccaucucggcaucccaaagugcugagauuacagcugugagccaccgcgccugcucuauuuaucuuuauaccuccuuuuuggcacagagcuagcucuagaagagaugccccauaaauguggaacugaaugaaugaagaaaugcauuagaaaucagcaucacccacacccaggcacgugcacagcaaacgcagggagaugugucauuuggagcugggguaccccaggcuguggaaccaugaggcauagagaaggggacuucuaacagaggggcggccuugcucaagaccucauggcucacuggcugcaguggcucacgccaguaaucccagcacuuugggaggcugagguaggaggaucacuugagcucaagaauucaagaccagccugaacaacauggugugaccucuucccuaaaaaaauuaaaaauuaaccaggcaugguggcacccaccuguggucccagccacucaggaggcugaggugggaggaucucuuggaaaaaaaaaaaaaaagaccucaugccucauggcucguuaaugacaggucaggccuagauauuggccuccuuauuuccagcucaaggcuucuccguguccugcucugugggcgccacucuuuucccugcccaaucccccccccaacggugcccucacagaggcugggaucucgaccucccucccacaggcucccuccgagacagcaaaagggacagguaggcagggaugggcgcugcccggcaugacgaggcuuugagugucucacuuuugggaaaggcucauucugcccuguccccuuccccccgaggccaccuuccugccuguccacagugaugcugccuccuccggcccacagccccccacaccccugcugccccggcacaggcuucccagggaccucucugccaccauccuguuccgugccucuguagccucucacucacuggcacugauguucagccguguaccuuuuacucauccuggcuggagaagggcccaguguggacagacugcaaacuggucaggggauguucugcccacaggacaggagagauauuuaaugaaggaugugcacacgcagaggcugcaggcuccaugcuggcacccacaagcccggcuggaguggggaggggcucugcagggaaacagaccugcucuccccacagccaaaccauggacucccugaggagcugagaggaagaauaucaccuuuuaacuccuggacaguaaagauuuggaguccaauaaacccaaagagacugcccacaagcccuugaccagucuccuuucccaagagcuuccagccuccgggcuggugugggggacaggagggcaucccggaacucgggugggugucacaugccuggaaccccaccaucagcaccccuucccuucaggcaagcguacucucuucauccaguccucuuuagagcaaguaucacacgcacaggacagauuacacauaaauucauuauugccuuagugugagucaauuucucagauccucuccugccagaaagggauguggacagcagugaaagaucuaagugcccagagaugggaagugauggcgggguuggaaaggggacagaggaggaggccuggagagcugaagauaaaccccaucgaccucacaaaggaaaaagagaggaaaucuaagacaggcucauucacugaugcaccccucauuuaucaaugacuccaggaucuuaauagcaccuuuuccugcuaucaaaugcaaaccucaacaccuacagacgggagucucggguggggguuaccuccagggucaaucuguucaucuucugacucuagaaaggguaccccuuaacuauaaaguggguggaucccagcaucucccuguauuuugaucugcugucuccuacuaggacuucucuaaguaccugccacaaacccacccuaacuguacagugaugcuccagagaaaacaauggcuugccacaggcacucggaaauuccagggcccugcucauccaucccacuguccccagguacacacaggacacccagugccccaaagggagauggcugugcccacaucacagaggaagccaggagcagaaucguggccggagcccaggccuaguggcuccugguuccuuuggucuuuguuuggugucaccaugcagccuucucaggggccacauccagccuuuuaacagcauguccacugucauucaugaaaugcucccaagaccuagaaugcgucccugucaugcaagggacccacgguggaagaaagacaaagagggucaagaacuugcaguggcccucaugucagaggcagcccuagggcagcugcaauguccccgcccaccagaucaccucccacuggcugucugcugugagaaagagcaggugggagguugccggucacucgccucaucuuuucccucccgccugggcucuggaccuuucuccuugcauacucugcuuguccccgucgguuuguguuauuucuucaggaggucuccgacagugaagcaggaaacagagccuccuucugagugcagguacgcagggaggcagggaagcaagccauuucuuuggaagcuaaggcaguuuggaaaccacuccuuuucccccucaaauaacgcuugcaaaugagaacuucaguuuggacagcaggugugugccuuuuacacagugaccucaaauguuuccaauccaauguuuaauuuuuuuccuuauaccaaaugacaaaagaucaccgugcuccugauacagauguucuguuuuacaaggcaaccaaguuuccuaaguaguagggacucugucuuucucaugaauaccaaaucuuuccauuaaaggucuaauuuuuuuugcauuccaaacacugcaagagacagaagaggguucaagacauucauuaugcaucucucacaaugcuucccauggcagaagucugacaaaccaccgcaauucaauauccucgcaucccaccuaacuugcuucaagugucuaugaaaugaccucgaggcucuggcguuuucugcugcugaugcaguaugcagauuuuacaaacaagauuuagcuucacagcugguuuucagaacagcuuagagucaaagauucaaaauacagaacacagcaaaacgguucuuaucaaaaugucaaaaucgauuuugccagaaaaccucggccuggaacaucugugaaagguuagggucgagcaccacucccucugguucauacagaugccaaauuaaucagggcaaaugaaacacgacauggccacaugaggcucugggguucuccccgagccugcccacccucucuuccagggggaaagagucucgggcugggagggacucagaggcgccuccugggagguggagaagccugcugggaauugagcaaaaucgagcaaugcgcacccuccccuucucccugaggaggcacuugacagccucagagcaggggcuggacaucucugcccuuggcaaccucccuguuuucucagcauggcucagagauggccucaacacaggaggaggaagaaaacagaauggcccccaaaaucccaaugaaagccucuggucacauucucucagcagguaccaucaucugucaaaaaagcuggagggggagcccaagguugggggcuucaaagucuccauuugccuucccuggagggcugagucuagacaugagagacuuauauggaagggggagcuuuaagccacucuaaggagaacagaaacguggaagguacuggagauguaggagcuacugcuucgagucuuggcaaagagcugagacaaagggcuccaaggccuuacccaggauucuucccauggcggaggcugugaucgcaucaucuaucugcaucaucuccugcacggugugggcugaugcugaggucagagcuaaugacugauucuaauuuuuucacuucagacagaaucauaacacuauucaaaccuaauacauuuauugcugugauccucaaccgggcaguauuaaaacuugcgaaagugacuuugcaaauuaccaaacagucaccaagcuaaugaagcaggacuuuuaaagugacugagaaauaauuccuauauuauaaagacagcaaucugugaagggagauuugguuuuaaaaaaacacauuauaacguauaauggaaaauguuaaucuguggugaauccaaucagagcuggcugaagagaaaaacauaaggaaagugaaaauacaaacggaguaugcacacucgaacccacuggaaggaaacuuccugggaaggaggcucccuccagggccucccaauggucaccaggagcaccagcagccugccauguccuccguccucgacugggagacacaccccaaagccauuuccucuggaggaggcucuaagaagcacugggggucccugucugcccugaugccugggaaaagcccuugggcauagcgaggaauuggcugugccgucaagacacucaggguugcagggcuuagaugcugugccaagaaaaagcagcucccgucucggaggauggcuauauucauucagagaccuggcuccaggcaguggaaggcagggacacaacaggagcugguggggucaccaggggaaccccagacacagacacccaagggccaggcagccucgcugggcaauccaggguugcccgcugcaaagaggggccgaggaaggaaagggaacugggggccccaggccugcccagaugcuaaugaagaaucacgcaucaguuaauuaggcucgggugcuacauuucagaggaagcccucuccaucaugaaaacacuuuggaaggugccacaucaaagcacaguguagaagaaagccagggagccaggcgcgaacgccagcgcuggccaagggagaggaggcccauguuucuuguuagcauuugacagcaagcaccgugugcuacuuagugaaccaaauccuccuuuaugcaaaguguuuuucucauucuuggcccaaugguuucaacgggugcuccccccaacagauuucaaauccuauuauacaguaaacaucuguggcauuaauuuucgcccuguaaacaaaugcaggcagcugcagcagaucauuugaugagucaaucaauauaugagcagcacucugcgccugccuucuuuacucgagcaaaaugaaacggugcuuucugaguccgucugcggcaccagccaguagugacaacaucagagggaaaauacacuucccacuuuuaugucugaccaggagccaggucauuucccucgaagcauccggaaggcacggccacgacccaagcacacaggguuccacguccugcgcguccuucugcacaucccaauacuugguccuaaacaugccgagaguuacaucuuugcauuggguggagcagugguucucggugaggggugauucugcccuucaagggaacugggcaaagccuggagacacacuugguugucgggggugcuauuggcaucuaguggguggaaaccagggaugcuguucaacaugcuuccaugcccaggauggcccuaacaacgaagaauuauccagccuggaauguccauaacaccugcauggagaggccuggguguagaggcauuggugucucugaggaaaagcaucuccccuccccaucugcuugcccccgcucugauggaggaagcagggguuucgucugaggaugcccuguggcuuucugacuuccuccaguuggagaagcauuuccauuccuguuuccuuaaucacacccagucaggugcaaugggccugugcccaccugccgguccaggccaaccugcaaagcucagccaaagccccccaagugagcaagugagauugcagcuggggaggcaaagggcgaugcggguccaggcacucugaccacaccugccucacuccuuacggacagugggcagcacgcagagccuuugaagaggcaucacugagggacucuccuccagggaggccgcugggcgaccgaacagcagcggcugcugcucccuguuggaguugaacgucuccgaggcucaguuuuccuguuugaguccugggcaguccuuccccagcagugaaggaaaugagacgaagccuccccuggcaguacaagcccccagguacggcaaggaaggcagggcugccaggauucgugaaucguuaucaggaguuuuauuugccauaaacaugcugcuccccacaggcacacauuugucuucaacgucuucccggcauccccuuacccugggcaccgucggcaccucuggcccagcucugaccugcuggccgccgcccaggccggaguuauuccgggaacauggcuggaccugcccaucccccagcacucagggacggccgugcuuggagagcugagcacccaguggcucguuuccuguucucagugugugucggggacuagcuaaaaacucgcaucgccaacauuccgccuucauggaaaucagcucacuggaucccccagcagccccaggagguggcaugauuaucccaggcccaaaggugaagcaccugacccgcggccacacggccguuacgaaaccagacuaccagccugagccgaagcuggcauuccuacagcaaggggcuggagagggacacacauuuuuuucugcuacauuugauggcagcagaggggcagaaaaugagcaaagucccuugcgugagagucucgccgaagcccaccugcagggucagaaccuuccgugaaccacggugcccugccagaaagucuuucuccugcucagaagcaaaaggcccaugugcucagaagcaaaaacccuguccuucagggaggagcaccccucccaagcgcagaagggagacaucugggacucccaauucccugcggggaaagccgcccucuccacucaguggcaguuuagcuggggaauggcaaguagggacuuguacccacccccagagaagccccuacgccccgacaccccaaucccugggcagcuggaagggaguggaugauuguggaaacaccaggcccccguaccucgggaaugugcccacagggcaggaagccccacuccacuggacacacgcaccccugacagcugccagcaaggccuucucugugcuccauccugagcaggugcccaggaccuggugauaagccagcccaggcucugaccuaccucagagaccacaacugagcugggagaagcaagugaacagacagcccaauggugaggcaggccagagaguaauguugcccacuggcagucagugcucugcaggcaccccccagucugcuggagagagguggucacagcccacauggugcccucugccaccacacuuagugccccagugguccccugaugggggagggaggagcuagagccaaaggaagggcacacugggcuccugggcacuuggacugaaugggccggcuggccacauccaacugcaaugggagggccuuggugcucacucagaagguggcaacguggggacuggacccacuccccccauagguaaagacaccccgguggcaagucagcaggauggggauucagaacaaaagcagaccccuggcucuuuccaaaagcccagcacagggagaagaaggagcauggcggggagcguggcggggggggaggggguggauucguguguuugggguauguccauggugcauauuugagugugugguguguauguguguggguaguguauguuugagugugugguguguguguggggggcauacauuucacuguguaguauguguaugcaugugcuugguguauguuugugugugugcaugguguaugugugaguguguggugugugugugcaugauguaugagugugugucuacauggugcauaugugagcaugugugugcaugugugcaugguguacauuugugucguguguguaugcauuguguauuuuuagugugugugcgugugugugguguauguuugagugugugcaugguguaugaguguguguuugugugcauacgugcaugguguaugagugugugguguaugugugauguauguuugaguguguacauggugcauauuucuaugcaugcaugugugcaugguguaugagugugugugugcaugguauaugaguuugugugugugcaugguguaugagugugugugugcaugguauauguuugaguuugugugugugcaugguguaugagugugugugugcaugguauaugaguuugugugugugcaugguguaugaaugugugugugcaugguauauguuugaguuugugugugugcaugguauaugaguuugugugugugcaugguguaugagugugugugugcaugguauauguuugaguuugugugugugcaugguguaugaaugugugugugcauggugcauauuugaguauguguauuugugguguauguuugagugugugugugauguaugagugugugugugcauggugcauauuucagugcgugugugugauguauguuuguguuugcgugugcauaguguauguuugagugugugagugugcaugcaugguguauauuugaguguguuugugugugcaugguauaugaaugugugugcaugauguauauuugggguguuuuuuuuuuuuuuuugagacggagucucgcucuguuacccaggcuggagugcaguggcacgaucucggcucacugcaagcuccaccucccggguucacgccauucuccugccucagccucccaaguagcugggacuauaggugcucaccaccacacccagcuaauuuuguuuuuguauuuuuaguagagacgggguuucaccauguuagccaggauggucucaaucucuugaccuugugaucugcccaccucggccucccaaagugcuggaauuacaggcgugagccaucaugccuggcugugugguauauauuugaguguguguuugugugugugcaugcuguacaugaguguguuuuugugugcaugugugugauauacauuugagugugugugcaaaguguaugagugugugugcauggugcauguuugagugcgugugugcgugcuguaacuuucugugugugugcacggcauauguuugaaugugugaugugugugaacaugguguauauuugagugugugauguguauguguaugcacggcauauguuugagugucuguguacauguugugucuuuguguuugugugugcaugguauauguguguguggugugugugcacaugguguauauuugugugguauauaugugugcaugaugcucaagugugugugugugcaugguuuauguuugaguguguguuugugugugugcaauacgccaaacccuucucucccuacccccucugacugcccacaucaaccccuacacagccggucccagggaagcagugaggacccagccccaggggacagguccuggcaaccugaugguugguguucaaggaggaggagccggcaggacguggccggggucaaggaaggccauggugaugaguguccugcugggcggcaguguccaccagcacagaauucaccuaacugguucucagcaaagcaccgaaacagauauucccagacuuuccccgacaggacucuugaugggaagcauuacugcccuucuuaauugaaagauaaccuuccuacacauucuuaucucuucacuucuuucauacgugcuucuucccccuccaggauauguggaaauuaacuucucauaucccaaggcucugguugaucuacauaagccaagagggagacuggcucaugagcaggcaccggguucaggggcugccaagcuccugcugcgagggguguugcaagcaggauugcaggcccacggcaauuucuggaauaagcagcugcccagggcggggaagcaccaugacugcccauccccaggggagauccucggcccggccuuuacaaucaucccauuuuaaaaaaaagauccaauuaaagcacugggcauagugccacgcacguaguaaguguucaguaaauagaagcuaucauucaugcaugccaccaccuagacgguugagauuaucucugcuacauagacaagaaggccaaagcucagggacauaaagaaacugacccaggucacaggucauagagggcagcacagggauuugaacccaggauuacguuuuuuaaaaccccguacccaagauccccucagcccacuccacauuucgcugaagggcagccucuuccccucugcaaugggaggcuucaugcuugcagccuagaagccacaggcacugugcuuucgggagacacggaugacugcaaucgucccggccccucugugcucacagacucauggguuacuacagcucuaugcaaucagacuggaguccagcuccugcagugaccccaggguuccggacacuaagcugucauuuuccugugucuuugccuucccuacacagacagagacgagggaaggcuaggaagggcuuuacuugggcccagcuccagcucauucccaagucacccuccuuccaagcccaguggcuucucugguacuucccgucucgauuuccauuuucucucugaaguuacagagcagguucugcuccuccuguauuaaaagcccaauuuucccugcacuauuaaacaaauuucuucaaagauagaaccucacauugaauuaaacccuuuuuugaagucuuuaguaguuuccauaaauacaauagaugaauaagcuggcagcccacuaaaaccauuauuuaaugcaagauaaagaggcacguggaaucccacauaagccgcagaggagcggugcggaaagaugcucucccucccgggccugggaaggugacaggagcucagaggcggcaucuccaccccuugggguuaauacuuccaagagauccaugauggcuuugagaagggcccuggauagaggacucagucugccccucguccccugaaagaucuuggccacgucauugaaccucacucccuuacuucccccagagcagagugaggcaccgaaagggacccaauucuagaagaaagcgaauccaggucaaggccagcucagccucccaaccgcugcagagcuugagagguuacucggccuuccugucugcauuuguaacaugggaagaaaaagcaagugcugccucaccagguaguuguggaggacaaaugaccagcuuaaaguugaauucuuaggguuguucaaauuauagggaacauucucaauggcucuacuuuaaacaauaaaguacucuuuggagaagacccauuagccaaaaugacgucaaucaauacuaguuugggaugcuuauagagauuaccagacaggacugguagaaggaagcaaauacauuugacacaguuuuuaguaauuauucugaguggugugaccugacaauugcaaguccuaauaucuguauaaacaagucucguaacgaguucugaaaaugagaguaaguccucacaacacugaagccacaaacuacaccgacaaggcaaaucuucuaauccugccuaguguuauauauaucgguccugauagcaugagggguugaauugugucccccaaaauucauauguucaggcccuuacccucaguggccucagugugacuguguggagauagggauuuggagauguaauuaagguuaaaugaggucagauagggucuguauccaauagaauugguggccuuagaacgaaaagagacucucucuuucgcucugucucuugcugucucucacacacucauacacacaaacacacacucauacacacaaacacacacauacacacacacacacacuuagaaaaggccaucugaggacauagcaagaaggcagucguccacaagccagaaagagagcccucaccagaaccuggccaugcuggcacccugaucucagacuuccagccuccagaacauaagaaaauaaaugucuguuguuuaagccacccagucugugguauuuuguuacggcagccugacuuaagacagaugcaauuaaaauugcauaccuagauucaaaaagugguguaucucaaacaacagagaaguaaaaauguccuuguguuugaugacacacagaguggcuuuguggaugacaacacgcacaggaagaacuugaauagaaacuauuucacagaauuaaaggauggggaaaaaagccauauuucuacaaauacuuuaguguauagacauaugacuuuauaugcguucauacaaugaaauuaguacacuuaguauaaguugacauuuaacuacuuuaucugaaucccuaaaagucaacauuuucagguagaccauaaauacuuuuaucccaucacuaggaaagggaguguuugcuauauagcugaguaguucugcaaugaccucacuguaaaagguaagaagaugguaugacacaauacccagggcauccugaauccuuugggagaagaaccucaguguuaguuggagguuggaagguauuggaaggagcuccuggcggaaggagauccugcacugcccgaaagaauaaucugaccagaaaagcaggcugcacccagagaugggagaaagccaauggguggcacuuaggaguuugucugggugugcaaaaugucauuaauuuugguuucauacaucuuacuccaaacaacauugacucuggaacauuccaaagugucucaaggaagguuuuugcuucuugcagugacuaauacuugaggauaagauucauuuuccaaauacauaauaucugaugagaauggaggcugcuaccuguauaccauggauggcuguuagcccaggauucugagggcugggcucacuccucacacucacucccuggagugugccugagucucggcccaccccgccuugcugcugacgaccccaccuuccaccaugggagcugcaccccgugguuuucucugcucaguuuucuaccuguuccuucuccucauggucccuggaggggccugcacuuaguccagcagccugucuucccucuggggucaccuggagggagagaagucuagauccagguuccccaaugugaaccuuagacuggagaaacugagacagcucaggcaugaaaaugccaaauuagaaucaauguguguggcccaaaagcaccaugaaagccaauggguccagccucucguguuucagggaaggcaccugucuuagucuguuuguguugcuuaaaaggaauagcuaaggcuggguaauuuauaaaggaaagagguucauuuggcucacaguucugcaggcuguacaggaagcauggcuccagcauuugcuucuggugagggccucaggcugcucccauucaugaugaaugcuaaagggagccagcauggcaagagaggaagccaggaagagaaggaaugugccaggcucuuuuaaacaaccagcuccuggaggaacuuucacaggaauuaacagagcaagaacucacucauuaccgcaaggaugacaccaagccauucaugaaggauccaccccgugacacaaacaucucccauuaggucccaccuccagcauuaggaucccauuguaacagguuuaggaguacaaacauccaaacuagagcagcaccuucugcccacagaggggacaucaccugcccaucaucacagaccuggaggccgagcugggugguagucuccccaucauugcaguucguggaccacugcuuucaaauagucucaucacaacuggguuccagcacagaggaaaaaaggaccuuuccugcuacagggagugaaugguacuggcugcuuagcagaguugaaagaaagcagagaggcugcuggaaacuggaagguucuuuaagguucagggacacccucuuuggccauucauucugcccacagccugggagggugcuggcaguagagcagggcucuccaagacugcagaggaacaucugggcacucaccccaacaaaguaacagaagggguaccaggaagagcuggauccaagcagcuuagcaagggcccuucccagcacagaggaagcuagcgugaggugggagcagccaagacaucaggaaaaaagcaggggaagucagaggacccaacucugccauggcucgcugugugucccuaacugaggcccuucucuaccacaagccccugguuuuguucugcaaaaguaggagcaugaaaugagaugauccauaaguuccauucccgucugaugaccagucaauaggccuucggagucauguaaccauugccugucucucauccuucugccagcuggcagguuccagaaggauacuuaaaagaaccuaccaggaucugauuauaauuagaguaauaaaauauucauaaucucaauaauagcuaauauuuacccagcacuugcugcgugccagacuccagaguaggugcaugguaggacugaucucauuugaaaaguaacgcugagugugcugaugcugacgacugcucauuagccacaccuagagccagcccuggggaaucccugcaccuagugugcccuucuaugucuuuuccccucugccaaggccauuuccugggcaccagcauccaauaucuuccaugggcgaucuggagacguuagccaugacaaggggauaaugacuggugagugcuguccaccagugguccauauuuuaacagagaaugagaccucaaauuaaagagauaacauucuccaggaaaagaaaucagacauuagaaagcuauaguaagaaagguguuugggggacaggagcaggacccugacaugccacugugagaacagaugccuucugaagccggucacaccuggcaagucaggaagagcccaggggguaucaccuuuucaccuuugcaagguucuaugacucuugauuucuggaacuggcugcaagagguuagaagguaugaccaaccaaaggccucacaaccuggacagcaccauauacagagggagcuacccuuuggccugcagaggggccgaguccagcugaagagccacaaaaauuaauauuuaauugaaaaguuauuuccugcauaaacauccccgaagguucacagaacagucaugcuacuucaucuucugucgguagacagaaaggaagaaaagguagcagagaguggggaugguucaacuuuaagguacauuuuuaauuaaaagaaaaagaucagagcugugaugcggcaucauaaagcagauaauuuuacagcuggauggucucccucugauguacuugaaaaccauuuucaagcgacauaaaguuuaacauaccgguacaucugccuacccacuagauucuacauggaauuuaaaauuuaauuauauuaaagcuuuguuacagugugcauugcaagcaugcuaaccaaguggaaccuuuaacaaaaucuccacagauagcuuuuuuuuucuuuuaaacucaguuuuguagaacccagggcugaguuugacaaacaguagaugaugcuguccacaguguuuacugcuuacauaacaaaacacuugagacccaguugcuuauucuccugggugaauucucacaaguccaucuucucauugccuucucacugcuaaagcagaaaagcagucaaagaaaucaagcagugagagagcuggaguugaccccuuugaaguccuauaagggcuugggggagggguggaggggagcuacuuacucuggagacagucucuucacuauuaauguuaugugcaaauuaaaguaccacuuucucaggggaaaaaaaaguugccauguuaaucuauucaucacagguugcauguuuucugcaauuaaaaaugcagccagucucuauaggaagacaaaauuccacacaaaccuggcuccccaucacagaaguacaagguugggcuugagaagcuggacuguggaucaagcagcccugguucgaauccuggcucugcuaccaccuagcuaccucccuaugacaccuagcugugcauuugugagcaaaguacuucaccucucugagccuguucuacagaauggagauaauaauaggaccuaauucaaacaagauuguugaaaaaguaaagaagauaauguacauaaagcauuuaggcacagaguaaacacucaauaaaugguaacuaaucuuuauugucauucuugauauauuuuuaaaugccaaugcuacacuguggcugaaugagccagccacuuucccugauggacuaaaauaaaaaggcucacgcccggccagcaaaccugcacaauuugagucacgaagcauugcgaacugcugcucagggagaaaacagaagagaagcucaucuuuucauugucccauuuauccguccauccacccaacaaccauccgcugagcccacaacuauggaggacacaagacuacaaaagacacacacuaccuagucgccaaggaauaugucauccaaugaaucaggcagacaagcagcaaggcugcagacagacaggaggaaagggaaaacuguguggaaaaguucugugaagggugugaagugggcaaugucacagaggcucugagaauccagacuuuccagggaggggcucuuaaacugcgagcuuaauaagcaaacaugccccuggaaaaaggaggaggggcaaagcagaaucgcugcugggcacccaccacagccucggagaggguuuucugaaggucuagaggcaccagcauagaaagaucuuugagauauauuuauauaucuauauauaaaauauuuauauaccauagauuuauaauauuuauaauauaaauauauauuauauaauuuuauaaauauaaauauaaauauauuuauauuaugaauauaauuuuauaauuauaaauauaaauauauauuuauauuaugaauauaauuuuauaaauauuauaaauauaauuuucuaaauauuuuauauauuuauauauauuuauauuuauauauuuguuuauuuauauuuauaaaaauauauuuuguuuauuuuauaaauaaauauaaauaauaaauaaauauaaauaaacaaauaauaaauauaaauauauauuuauaaauauaaauuuauauaaaauuauauauauauauauauauuuuuuugagacagagucuugcucugucacccaggcuggaguacaguggugccauguuggcucacuauaaccucugccuccuggguucaagcaauucuccugccucagccuacugaguagcugggauuacaggcacacaccacaaaacccagcuaauuuuuguauuuuuaguagucacaggguuucaccauguuggccagacuggucucaaacuccugacaucaaaugauccgccugccuuggucucccaaagugcugggauuacaggugugagccaccaugcccagcagaucuucaguauauuuuuaaguaaguaaaaaaaggugagcuagauacaaaacaagauaccaguuuuuaaaaauguuggcauguauguguuuuaucucuacagagaaaugaugcccacaacaucaucaaaagacguguaugccugugggaggcgggaugggagaaaacauggaaaagacaaucuuucacuuuuuauuaugcauuucuguagaguuugaauuuuucaaaauuagcaucgacuguuuucuaauuauccauaaaaaugcauauuuaaaucuugugauucuuuuuagucaucauauuuaauuucugaaacguaauauuaaaggagggcauuuaaaugccaaugcuacacuguggcaggguauuucuaugucacuaaucgaggauaugagcuaaaagguauucaugcuacaaagaugggccaagcacuguggcucacaccuagaaucccagcacuuugggaggccaaggcgggaggauugcuugagcucaggaguuagagaugagaccagccuggacaacauagugagacuccauuucuacaaaaaauuuuaaaaauuagcugggcgugguggugcgcaccaguggucccagcuacuuggguggcugaugugggaggaucacuugugcccaggaggucaaggcugcagugagccaugauugugccacugcacuccagccugggcaacagagcaagacucugucucucaaaaaaauaaauaaauaaaauaaaauguacugagucccuaugacaaacugggcaugauucuaugcuccagggagcauggcagugaaccagcauccacauaccugcccgauauuccagcagggaagacacagcagcccccagauggccgggcaguggagaggagggagauggagagaagggauguggggacagggguccuguucuuuguaggguggcugaguugagccuccuugagaaggugacauuugaggcauugccugaaggaaacgagggagggagccucaggauaucaggggaaagggcauaccaaguagaggaagcaggaagugccaaagcuccgaggcaggagugcaggguucaagcuucagcuggagcagagcaggccagcaggagaugcuugugcgagagagggagccaugugacauuguuuggcacagguacagacaaaguagugugcagaaucucuggguagcaccagggccuggagcgggggaucguacauuuaaaauaagaccaguuagcacagguaccuguuuuucuccagccacacugggcugcuggacguaaggucuguugggcugaggucacaaaaguggcaagagccagacccagcagggucuucuagacuuugaguagaacaggagcuggugggggucuuucagcgauucggugaugaaugucaaaaagaaauccuaaaagagggcucuaccaacaguucaggagaaaggugagggugggauagacucuagugaaagcagugaagguuucgaauaaguugauggcuucuguaucuauuuugaagguggagccacaaguuugcugauggauuaaaggagggaagagaagaaaaaauacaauaaacgaugacucccaggcaccggggcagguuagaguugccauuuucugagacaggaaagauuaggguagcagcuugguaagaggugaugaaucaacagcuuguucagacgcuuaaguccgagauaucugacacucagguggauagaugcaucugaaggccaggggaaagccagggcuagaauuacacauuugaggucaucagcauguaaaaagugugcaaagcuaagaggucaccagggagcauuuggguagagaaacggagaagaugaugaccgaacccugggcgcuccagccuuaagggguuagcaggacaaagaaggagcagucucugaggaaggagccagccaggacagagcgguuucacgaggaagaggcagccagucaugucaaaugccacucaucgaccaguaagaugagaacagauacucaacuauugcacuuggcagccuuaacaagagcuuuucccacagaguaaaggcaaaagccagacagcuuaagagugaacuggaggggaguaaccagaaaaaaugaauaagacaaugugguacaucuaagcuguugugcugcagacagaaggagagagacaggcaguagcaauaagaaaggcuuuuuuuuuucaagauagggaauacuacagauagauaggguaugaacaauaggaacgcugauaggaaucauccaauagacaggaaacaucuaagguugaaggagggagagggaauaauugcagagugaugcccuugaguaaaagagaaggaaugugaucuggcacacaaggaaaggggugguugcagccaggacaaacaggucauccacagaacuggaaggaaggcugccgugugggugcagacacagaggggugggcagccaugcugcugggagcaugcagaaauucccuucugauuuguuccauucccccagagaaauaagaagcagggccaaaagcugagaguguggaggaggaagaggagcugucugaaagaggagaccacaugauauuguuuggcacagguauggacagaguaguguguggaaucuuauagcaccagggccugggguagggaucauacauuuaaaauaagaccaguuagcacagguaccuguuuuucuccagccacacugggcugcgagauauaagccuucagaaaguaaaaaguuggcuuugaacaggcaugggguauagccagguaaguaccauagagguguauuggauuuggcacaagcaagaaaucaucuuuuauuggguuaagcaacugagauuuccagguugguuuguaacagcacagaguguuacuuaaugucgcugguacuccuggguuuugaaaggaucucuguguggauauuaaaaaccaucaugaauuacgacagauagagagucagaaagagacagcgauccaggugcuaaaaucuucaaggaaugagggagagcaaaucaggcaaucuguaauaauugcaaugagaaaaggcaacaggugguagaagcuugaaggcaugaggcucaaagcagcaggaggguuuucagggaagaugaaaugagauggaugacaauggccugggagugaaaaagaggugggaggaagaugccuacauggccuccagguccugcagcaccaagaguguaagaggucuccaaacugcuuuccacaggggcugaacuaauuugcaucccuaccagcaguguauaauuguucccuucucuccacagccucaccagcaucuguuauuauuuuacuuuuuauuuuauuuauuuauuuugagacggaguuucucucuuguugcccaggcuggagugcaguggcacaaucucaacucacugcaaccucugccucccagguucaagcaauucuccugccucagccuccuaaguagcugggauuacagacacccaccaccccgcuuggcuaauuuuuuguauuuuuaguagagacaggguuucaccaugauggccgggcuggucucaaacuccugaccucaggugauccgccugccccggccucccaaagugcugggauuagagauaugagccacugcacuuggccuuauuugacuuuuuaauaaucacccuucugauuggugugagguaggaucucacugugguuuugauuuguaucucucugaugauucauuaggaugagcauuuuuccauguguuuuggccacuuguauguuuucuuuugagaagugucucaucaugucgcuugcccauuuuuaaugagguuauuuguuuucugcuuguugaucuguugaaguucauuauggauucuggauauuagaccucuguuggaugcauccuuugcaaauauuuucucccacucuguagauucucuguuuacucuguugacagagcuaccauucucauuauugguagcuaguaaucccaugaacauauaauugcaugugucuuuuugauagaaugauuuauuuucuucugggcauauacccaguaaugggauuacuagcuaccauguguucacaauagcaaagacauggagucagccuagguguccaucaaugguagauuagauaaagaaaaugugggccaggcaugguggcucaguccuauaaucccaacacuuuggaaggccaagguggaaggaucacuugagcccaggaguuuguaaucagccuggacaacauagugagaccugucucuaaaauaauaauaauaauaauaauuuguuuaauuagccaggaaugguggcacaggccuguaguuucagcuacuugggaggcugagguggaggauugcuggagcccaagaagucaaggcugaagugagccaugauugcaccacugcacuccagccugggugacagagcaagacccugucucagaacauauaaaaauaaauaaaaauaaaagcaaauaugguacauauacacaauagaauacuaugcagccauaaaauagaaugaaaucauguccuuuggagcaacauggaugcagguggaggucauaauccuaugugaauuaaugcaggaacagaaaaccaaaucccauaugaucuuacuuaaaagugggagcuaaacauuggguacucauggacauagaaaugggaacaguugacgcugcagacuaccuggggggagucagggagggagguguggguggaaaaacuaccuguugggcacuaugcucaccaccuggguggugggauccauacccaaaccucagcaucacacaauacacccauguaacaaacaugcacacauacccucgguaucuaaaucaagaguugacauuauuuuaaaaaacuuauuucauaguaaaacuguuaccaaauaaucuaugacucuaucauuguacuaauaauaaaacaaaaagugugagagagaaaacauccaccauuugagagggccacaugggaguaguaaccucaggaaaggacacaguucagcuagagcuaacagaguucucccacucucucaccacagaacuccuuuauagcccugaaaaucacggaggacgucugcugcuaccuaugaugggaggacaaggauuggauuuaccuucccaccuuacacaacuuuucucaaaggacaaacuauaugaaacaagacuuuucacauauugacagugcaggacagugauaccugacagaaacaucaauggaauuaacgguggcucucugagaagcucaauaaaauugauaaaccucuagaaaaacugauaagggaaaaaaaagaagacacaaauuauuaauauaagggaugagagggaguacauucuacaguuauugcagacauuaaguagguaauaaggaaauauugugaauaauuuuacggcaaugaauuugauaacuuaaauagacaaauccuuaaaagacacgaaguacuaagauuauucauaaagacuuagauagccuaaauagaccuuuaccuauuaaaauuaaauguacaguuaaaaaguugugcacaaagaaaauuccaggcccagauaacugguauuucacugaugaaugcuaccaaacaauuauauauaaccaauucaacacaaaccuuuccagaauauaggagcggaagaaacauuucacuccuaauuuucuaaaucuagcauuaccccgauauaaaaccagacuaagauguuauaaggaaagaaaguuacagaaaaauaucccucaaacacauauguuaaaauauuuaaaagauaugaacaaauaaaauccagcuauauauaaaaauaauaauguaacauaggcugauaaaauguagguuuaacauuugaaaaucaauuaagguaauuuacccuauuaacaaacuaaaagacaaaaaucauaugaucacgucaauagguacagaagaacuauucaacaaaauccaacauccauucaugaaaaaaacucacagcagaaaucucaguaagguuuuuagucuagcugauaguauugugccaaugucaauuuccugguuuugauaauacucuauagcuauauaauacguuauuauugggggaaguuggauaaaaggcaugcagaaucuauuuuuuugcccagggugguugcaaauucccagguucaagcaauccaccagccucagccucccaaagugcugggauuacaggcaggagccaccaacccuggccucacagagaaccucuuuguucuauuuucacuucuugagagucuauaauuauguaaaauuaaaagucaauucccccauccugggaaacauagugagacccugucuuuacaaaaaauacaaaaaucagccgagcauggugauacacaccuguaguccuagcuacccaggaggcugaagugggaggaucguuugagcccaggaguucaaggcugcagugagcuaugaucacacaccacugcacuccagccugggcaagagaacaagacucuguugaaggagaagggaaggaggaaggggaccuuaauauuauuaagaugucaauucuccccaaauucaccuauacauucaaagcaauccuaauuaaaauccuaucaggcuuguugcagaaauugauaagcugauguuaaaauuucuaaaauguauauggaaaugaaaaaugacuuagaaaagccaaaauaauugugaaaaugaacaaaauuggagugugugugcguguguguguguguguguguguguaacagagucacucugucacccaggcuggaguacagugguucgaucucggcucacugcaaccucccucccagguucaggcgauucuccugccucagucuccugaguagcugggacuacaggcaugugccaccaugccggcuaauuuuuguauuuuuaguagaggugggguuucaccauguuggccaggcuggucucaaacuccucaccacaggugauccacccgccucggccucccuaagugcugggauuacaagcgugagccaccaagcccggcccaaaauuggaauauguacaccccugauuugaauacauguuguaaagcuauauuaauaaaguaugauauuggcauaaguagagacauacggaaaaaugaaacaggauagaaaguuuaggaaaagacucacacauacauggugaauugguuuucagugaaggggccaaggcaauucaauggaaaaagaauaaucauuucaacaaauagugcaggaauaaucagguagccacagcaagaaaaaaaaaaaaaaaagaaaagacgauccuugacccucaucucacaccacacauaaaaacuaacuugaaacuaugauagaccugacuauaagagguaacuacuaaacuucuuguaaaccuaggagaaaaucuuaaugaucuuggauuugacaaggauuucuuccuuuauuaacuucuuaaauaugaugccaaaagcaugaaccaugaaaaaauagucaacaaauuuuacuucaccgaaauuuaaaaccuuuucucuucaaaugacgcuguuauaaaaaugaaaaggcggccgggcgcaguggcucgcaccuguaauccuggcacuuugggaggccgagguggguggaucacgaggucaagagaucgagaccauccucgccaacauggugaaaccccgucucuacuaaaaauacaaaaauuagccaggcaugauggcgcgugccuguagucccaguuacuuaggaggcugaggcaggagaaucgcuugaacccgggaggcagagguugcagugagccgagaucgugccacugcacuccagccuggugacagaguaagaauccgucucaaaaaaaaaaaagaaaagaaaaggcaaggaacaaacucagaaaauaucuguaaaauauauauccaacaaagaauucauaucuaaaauaugcaaagaacuuuuacaacucaguaauaggaauacauuccaauuuuuuaaagaggcaaaagauuggaauauguacuucauugcagaagagagauauauggauagcaaacagacaaacaguuggagagauuaucagcucuugagaacagauauaugggaagaguguguuuauaggacugucagcaucauccgucauuagagaugcguccacacauacacuagauuagcuaaaaauuuuuaaauaaguaaauaaacugaccaccccaggguuagcaagaaugugaagcaaagggaacucucacauacacugcuggaagaaaaguaaaaugacacaaaaaucacauaggaaaauacuuugaugguuucauauaaaguucaauauacuucccauacaacccaaccacuccacauuuagguauuuauccaagauaaauaaagguauaugcucaaagauguguacauguaauuuugcuuguaauagccaaaaaguagaaaauaaucuaugcacgaacaagugaauagauagcaaaaauguggcauaucuauaaaacggaauacuacucagcaauaaacaaggcaugaauuuuugauacacacaauauguaugaaccucaaaauaacuaugcugauuauaagaagguagauuugacugggcauggugccucacaccuguaauccgagcacuuugggaggcuaagguggguggaucacuugaugucaggaguucaagaccauccuggccaacauggugaaaccccgucucuacuaaaaauacaaaaauuagccaggcauagugacgcacgugccuguagucccagcuacuuggggggcugaggcgggagaauggcuugaaccugggagguggagguuucagugagccaagaucgcaccauugcacuccagccugggugacagaguaaaacuccaucucacacacacacacacacacacacacacacacacacaaaagaagguagaucuaaaagaacaacuauugucugauaucauacuuauaaaaugcuagaaaacgcauacuaauccauagugacagaaaacagguaagugguugucuagagaugggagagggacagaagggaugaguuacacaaggcacaaggaaacuuuuagggugaugaauguguuacuaucuugaucgugguagugguuucaugaauauauacagaugucaaaacucaucaaauuguacacucuaaauacaguuuauuuacaucaauuacaucuugauaaaacuauaaaugaacaaauuaagcacuauuaaugucuccauuucacagauacaaaagcugaggcaaaaaggaauuaaguguauugccuggaguaagaaccucacacagcuaagauuccagcgcagaacuucugacaccugggauaagacucuuggucacaaaacgcucccccuccccucaguggugacagaacaugguacuauucuaaagcagugaguccuggagacagagcagacccagaggaaaaggagagagagacagcaaccuggcuugaguguucucgguaaccuuucucgggaaggcucaaguccugucuuggucuguaacaaggucugauggaaagaacccaggcuuucuaugagguuggugcaaaaguaaucacaguuuacaccaaccuaauagaagccagauggacccaaauucauggcaaguccuuccacauaccagcugugggagccugggcaagugaccuuauagucuucuucuuuaaaaauggggcuaggcugggcgugguggcucaugccuguaaucccagcacuuugggaagccgagguggguggaucacuugaggucaggaguucaagaucagccuguccaacauagugagguggucucuaccaaaaauacaaaaauuagcugggcauaaugaaacaugccuguaaucccagcuacucgggaggcugaacaggagaaucacuugaaccugggaggcagagguugcagugagcugagaucgaaccacugcacuucagccuggccaacagagcaagaccuugucucaaaaaaaaaaaaaaaaaaaaaaaaaaaggagggggagcuaaucgggugugguggcacacgccuguaaucccagcuacuugggaggcugaggcaggagaaucacuugaacccaggaggcagagacugcagugagcugagaucgugccacugcacuccagccugggugacagcaagacuucaucuuaaaaaaaaaaaaaaauagggcuaauccuuucuacuuuguagggcuucuguaaaaguuagaaauaagguaacccaaauuccuuaccauggcuaaaaggccugacaugaucugacuuuucuuagcccaucucacaccgaauccuccaaaccaacagcccugaccacucaacccuguuucuguugcuaccucagggccuuugcacaagcucuuggauuugccaaggaugcuuucuaacaccugcuaucucacaccuacuguuccuuaagguguuagcuaaaugucaccucagcagggaggccuucccuggccacccguguuggggaaccccaagaccauccccagguuuggugagucacugaaaggacucacaggacccagcacaugguuguacucauggugaagacuuauuauagcaaaaggagacagaaaaaugagccaagggaagggcacaugggcgagguagggggaaaccgggcacaggcuucaaggcuacucucccaggggagucacaccggacgcacuugauuccucuagcaacagggugugauacacucacaaagugcugucugccagggaagcucaucagagacucggcacccagggcucugcugggggucauguaggcauccucugcuuagcacauaccaaaauuccacaccccaagaaggaaagccagugcucggcauaaacggcaugguuuguacaagcaguuuaggcacugugagccgcucuaauccuuuagugaagguuuuaugucagaauagagaacgguuuaccaaucaaguuccuggacaccagccaagagccaaaguugcaagaggccuuccuaaggauaggccugagggcuuucugaggacaaccaacaggccugcuagguuagcgguuuccugcaugucacccuugaugaggcuagguccucuugccuguuuccugugccgguucuaucacacuuggaauuaauagucaagcauuaacuguuuguuaacaucuguccccuucuacauucuaagcuuccuauggacaagcaucgugccugcuuggcacggagucaguuuaauaaaucugcacugggugaaugaaugacggaugcagggugaaugaaugcgaagaggcuggcaaggugaccggcacauaucaacaccagcagguggcaguuccacucccauuaacugccugagucuugagacuccuugagggcccuagggaaauauuuuuagcgaugagugaagaaagucaggauuguaacagugcagaugaagagacagccuggaaacuuugagacaacauggucagaaguccaagcaagaggaguaaaggugacuucaaggagggugagcaaggucccugggugcaacgguugaagacuucccaucguagauccuaaaggaacggcuuccggcuagcaaaaaaaaaaaaaaaaaaaaaaagccccucuggccuucccuucaccccuggagccacaagcacccagaaaaagcugaacaaucagagaauuccccugggguugcauagugcccagcugcucggcuagccccacgucugcgggcucagcccccugucucccaggccccaugcugccugacccuacaaagaaguggcaguccuggacccggcacaguggcucaugccuguaaucccagcgcuuugggaggcugagguggguggaucaugaggucaggagaucaagaccauccuggcuaacacagugaaaccccaucucuacuaaaaauacaaaaauuagcugggcaugguggcgggcgccuguagucccaguuacucgggaggcugaggcaggagaauggcaugaacccgggaggcagagcuugcagugagccgagaucacgccacugcacuccagccugggugacagagcgagacuccuucucaaaaaaacauaaaaaagaaauggcaguccugagcagcgacagaaaagcaugggcagacagaugcaugagguuccaaauagguguugcaagcuaugcauugguuggaucuucagcuacuaggaaaaacaaaauguuaaaagcauaguaaguucuaaagauuauucauuauuuuaauacaaccagaugcugcaugaucaauaggaacccuuguauuuuuaaugugaaucauuauuuaaaauaugucacugcccaaucaauacaaaaguuaaaacucaucaauauuuaaauuuuuccaauugauaucuuaucauucuauccaggaaagagccuggcagaucacaaaauccauuauuuaaucuuuugagauugcagaguucagaauuaaacacccuugugucauuagcugccuggaaagaggcuugcagcagauugaauuagggaggggguagaaggcacggauggggaaagcugaaucagggccguuccaucugaggugaagacaggcaggcauuuguuagguuugcgggacugcugggugacaugguucagcuguguccccacccaaaucucaucuugaauuguaguucccaucauuccccaguguugugggagggacccagugggagauaccugaaucaugggggcagcuucccccauacuguucucaugguagugaaaaagucucauggaaucugaugguuuuauacgugguuuccccuuucacuuggcucucauucucucucuuaccucauucucucucuucaccuucugccaugacugugaguuugaggccuccccagccauguggaacugucaguucauuaaaaccucaaaccucuuuuucuuuauaaauuacccagucucaggccugucucuaucagcagcauaaagauggacuaacacacugggcguuggggcuuugaggcuuuggggaggagagauggaaaggagggaccccuggaaccucugucccgugauuucacuucaggucaaagcccaaauuccucagguugggugauguaugaggcccucaggggccuguucccucaaccuucagccccucucacccuacaugcugcuccugcugaaccgccagcccccagucgccccggggccagcucuccuuccucuagccucugcaauccuguuucccaccugaaaugcccuugucccuccuccaccuucccacuggcuggugaguuccuacuccuccuuggggccucugcuuauuugucccuuacuccaggaaguguuuccguaggugccuauggauggguaagcaacugccauguuuuaugccacccaucauggucucugggcugaccuugaacacacggucuguuuggcucuauugcaaucacuccgaacuuucacauugcaggaacugguccuaucuacuucugucuccccaucacccagcauggcaucugggacacaggaggggcucaaccaacaccugaugaauggaugaaugagggagugagugaaugaaugaaugaauacagucugcucccuuagauccauuugaacuucuagugucccccaggcugacguggaggagggugaccuggaggaagggcagccccauucaaguggucagagauugauucccaugcuuggcucagcgugcccuccuccaucuuaacacgguguagaugcagaggcguugcuuccuggaacucuacucagggagcagggacaacagauggggacuuuccacuucuuacaaaucagauauucaaucugaugacagaaaccaggcucggagcucccugggugcucacagcuaggaggacagagcagagacggcacuuagaguggauuuaagggcacugggaaaacuucccccgacaaaaucuccucccuuccccuuccugacucccacuucucuaggcuuccacgaauaaaaugguauuuaucuagugcuuaaaaucuuuguucuuuaagaguucaccacuaaauugcagaaaacuuggggagggcgacguuaaaucuucucagcuaacaaguucauucgucccaugcacaccuacuaagccaucuccugcugucagcgccgugcuucgccguggggacucaagaacgagacccaugacccuaaacuucaaggaaucugcuuaacguuuccugacggcagagccagaaagaucagucagcaaauccauugggcaucccccaucuggaauauaaaguauugaucagcacaucaguccugacuucaaggacuuuauagucaagcgaggggcagauagaggauaagcgucuagggcacgaguucccauugcagaagggccauccacauggcgcaugacauuccuggcaaagaaggaaugacguacucugauugcaaauguggagaaaagcaucagaaaggagguaacauuugauccaggccucgaaggcgggauagaauauucuagcagggaauuugcuuccacaacgggagggacagugugugugcagggaggaugcugcacccgucgguagcaccuacggugggaacgcaacaggggacaggugucugggagggaggagauucgucccaggagagggaaaagagcacagaacacagaagagggccccagccagaacagcuuguugccaagggcagaccugagacgcugcuucagucucucccacucaguagagucacucacugggacccagugacaaaugcggagaaugacaaggcacccagcaggcuaccuggaaacaccacuauagcugcgaggugagacaucugugcccccaagcccaacccaccucuggccaagacgcauuccugcagcugagaagcuguggggugacauucucaugggaacguccagcccaaguucacucccuugggucaaccccaugagacacuuuccccgugaagcccacagccaccuccccuggcugcccuuggacuuggaugcaaccccacagaccucucccucugcaaggccuugguucucacugugcccucaaagggacuuggcagugaaugggucaggcuguggaggaaaauaccacaaaggagaauugaggggcugugggggugacaacagggcucuccaaacaagucaagggccagaacaggcauccccaaugaaggaaucgggagugagggcagugaccagggcucagaggggccaagguacuacccaggcugggugcccagggcuuauccaaagcagagggacugccacaugugccugggugaaggcgagcggugagaaagagccuggcacacucacacaagggcagagagcagguguggagagggcaggggcacgcagcagacguggcaccuacuauaggaugaaugguguccccaaauauguuagagucccaccccaguaccugugaaugggacauugagaaauagggucuucgcggaugaucaagacaagacgagaucauuaggguggcccuauuccaagaugacuggcauccuuauggagagggagaauuggacacggaggcagacacauucaaagggaagaugacaugaagacacgagaaagagacagccaccgacaggccaaggaacaccugaggguaccagaagcuagguaugaaacagagcuuccuucucaagccaaagagggaaacaggcuucuggccuccagaaccaugaggcaagaaaugguuauuguugaagcuacccagauguggaaacuugucaggucagcuccuggaaacucacguggugcccaaccaucaugcuggcuggcaagauggcccggagccccacgugugugcagggcuugcagaccacguuuggaucuugaguuucaucccagaagagcugggaguccuccagggcuucgacaggaaugugacaugggcagacacacuuuuacagagcgccuugacuucuagagggagaauggcuggggauggguauaaaagggagaccagugagggccacugugaugucugcaagacagaagagcauccaggcaggugugauggagggagagaggagacucgggcgacaccaagcuucuggcuucagcagcagggaggcugcggagugaagaugggcaugggaggcgcaggguggggcggccuugcacuccagcaucagacguggagccacacucagcaacaacagcccugaggaaggaagcccugagcuuccaucagccuuaccugcagacacuuuccugagagcugacuuggcuaggaaauaagcccuguugcagaggggaaguuaugcucagacggcaugcugguggacagaacggcacccgaagugccugccugcucugcugcuuguuacaugccaucccucaggggcacguguccucccgucuguccacugcacuuucagggaccauccauucaaauauccccuaaagugcucugaucgccaggcacccccuacgaauaugcacacuccuuacauuucacuccgugagcugucuccauuucuuccuccagaccuggagcucuuagggguggggguggcuucucacucaucccuggggugcacguggcugugcaaauauaaucuggcaugucccaauaaagcucaaggcgggggcaagaggaagacagggaugacagggacaguggggacagguuaauaugcuucuaaaagaagaacagggcaaggguggaaggaggaagaaguccuguuuagggacagggagggcgagaggagcgugcacaguaccaccagcuuccccucggacacucacagagcccagaacacuccauggccuuucccggaaacagccucaagcccaucccugcucugcaggccggcauucccaagggccuuuccuaugcccugagggaugaggagccagggggagugacugacaagccauaggagccccaaggagaaggugacaucagagagaggaagagggucaaaggcagugcccuccccuagaacccagccucucacccugccagaugcccauaagacucaggacacagagucacucccaaagagccacguggcaccccccucgcggcucucccugcuccacuguggguccccagccaggccucagcaccaacagccaagucuagggaaugcucuggagggcugccagaacucgccgugccagcucccgucucgggcuguguacccuaccucagcaggcacaguggaagagcagaacccugccuuguucuuuccagagacccccugggcacugaggugaucugaccuccccauagcccaucagugccuacugaauuaucugagaaaagugcaguaauggucaguuaucacagcucuccuguuaugugugccuccaugcacuucacccaugaccgcaagaguucuccaguucuuuugugacugaccauuucugugggaaaguguguggcuguucucuagcaaccagaacauucccuucacuggaacaucucacuuaugaccacauuagaguuugauuugauccaucuuauccacccauuguguaucggaaauuguaacuuauuuuuuaugacugucuauagcacccaucagaaugcccuacugggaucccacggggccuuucaauuacacacauagcucauguucuuucaguuacacacauagcucauguuccuuuccauuuaaacccaguccucggccagcccuggcaaaaagccagggucacuugguggccagaaaugcacacagagcucugcuucaugccauauucgauccuccagguaaugugguugaugcagcuucucuuggaagauuuuauuuuccuccauuuguggccaccaggccccuaggaggcaguacagaggcuagauaccacuggcagaauugcuggcucuucuuaguugccacaagugagagcacuucugcaaaacaacccuggcccugacaucucugcugaaggccgacucucuuugaaagauaacuuuaugaaaugauuaaugauaccuuaaucacaaguguggcucugagauuuuaauuccaucccugauaacaucagagauguagcagacaaugaaaacuguaucaccucaaagcaggcagugcgauuaaaccucuugacccauagggaggauccuugaaucaucauccaguugggucuuuccuacuccacaaagggaggcagcaaggccugagcaugggcuuugggaucugugguggggagagccuaagauccccccugcguuaucccuaccucuugggcuccauacccuggugcagucccuuggcccccaaaugugggcagaaugugagcuuugcuucucaccaacagaacggcaaaggcaaugggauaguacuucugugauuuguucacauacggccagcaggaacguccaucuugcuagcaggcucucucuccccugcuggcucugaugaagcaagcagccaccuugaagggcccacauguccaggaacuaaagguggucuccacccacagccagcacggaacugaggccccuguccaacaaccugugaggaauugaacccugccaggccuaugugagcuuggacaccaguccugccuuagccaagccuuccuaugagaccguagccucaacugacacuuugacugcagcuucaugagggacauugaagcagagaacacagcuaagccaggccuggguuccugacccucagaaacugugagauaaggaucauguguuguguuaugccacucagugugggguaauuuguuacagaggaacagauaacuaacaccaaguuagacagaucugaguucugguccucauuccuccauuugccaucugugugaucuugagccaguuacucagccucgguuuccucaucuguagaauggugauaauaauuauaccuaucucggggugguuguaaggauuaaaugugacaguuggucgaaagguucucaugaggguuccuugggggaguucagcccuaacuuggcccacagguauccauggugacaaacuaacuucucugcugugcaucagaaugguacuagcuaugcaccauccucagaaggacugagaaaaggccacgcacaucauuuucuguacggcuuaauucucuuaugaaaccccaggugagaaagucugcaaggaagucucccauuaacagcagcugaauccuuuguuacuguuguauuguuauaucagaugcccugauucuccaaagguagaaauucagucuugucuagucuggcaucaagaggccucuccuaagcccucuuccucauccugcccacucuacccaccaauuagcccagaagagagaucgcagaguaacuuaauaacaacaggauuucuugccaauaacaagcauucuucuguauguuuucggcucagggguucuuccauguuaacuauccagaacuccgauuuggcaggacagaaauaaaaaugaugccccccgcuguucacugcuguccuuuccagggauuauauuaguuucggcaagaggagggguauggggagguuaggagcccugugguuugugucucucauguuuaauacaauacucauguugaccucuugaggauucuccaacacccucugcacugguguucaucuggguucgggcuuagacaacagcuggacagaaaggugggguuucagcagugccgcaguggcucuugauugguuuuggggagagacugcaccaaaggagucguuuuaaugaaacagaucaagugcuagcaagucuucagagaacacagaaagcauuuaauccuuuaauuucugaaaucugaacugacaucagggguccuuggagagcucugugaauuaaggcgauuccugcucuccagaccccaggcugcaugugaacugcacggguauccgggaaauacaggaguuacuggcuuagcaaauuauuucucaucccacacaaagauaaacucuguucauuacacaugccgcacgcuacucuucagcauaaaaaucagcuucugaagucagcucgucuucugacaaacacagcuuguuauacaaauggguuuguauucggagccucucaauggcaagguucccguuguguuucccucccuuccaucaaggucuccugccucagucccugacacacaaaugguucuggugccaccaaaccauauuccccacucaggguguggaguguauguuugcaaaagcaaacaggcugcuauucaucuagcgcaccgggacacacauuuuuuaacaauaaaaaauuucaaacgauguguagagacacagucauaaacauuucugacuccaaaaaccaccuuuugaguagaaucaaaagcaucaaagcucagacaaacuucucugcugugcgucagaaugguacuagccaacagccaucccacucuugugggaugccaacagccuggggaacacaugaagaccccaacucuccaaaaaaaaauuuuuuuuuuaauuagccaggcauggugauguacuccuguggucccagcuacucaggaggcugaagugagagacucacuugagcccaggagaucgagguugcagugagccaagacugcaccacugcacuccagccuggguggcagagcaagacccugucucaaaaaaaaaaaaaaaaaaaaggaugccaagaaucugcagucccacucugaccccugccacuccuguacucccaacucuagagucccuccaucaggcaaugcccucaggugacaagaagaacaguggcuggaucuagaaacuauuuucccagcaaucagagcuggcuguacccaucaauagagacaaccacaggcaugaggauuugagcgacggaugcucugagacccaaaccgcccacaugagucagccuguccuccaggcuuggagguaaugaagccuuuguaagccaacaccucggcugaaaaugcugauuaaauuagucagccaaaagccuagugggucccgaaagggcugggacacagaacagaggaguucuguaggaagaauaaaaagccaggagaguuaaaagggcugccugagugggcaggccugguagggacagcaggaugaccacagcagaacgggaauuggcuggaagaagcgagagaguccgccauccccagggagcaggaauuagaaacacaaaggaggaggagcugguggcugagugaagaccaauuauggcugagauaugcugauuuuuagacacucccuuaacuggucuuuaaggaguugcauaagccagcgccagaggccguccucugcucaacacuggaaggcaguaggcaguggugugcuagagucacccgugcccacuaggggggagccaguuauuaaacguucaggguuuugagccaguuagguuauuuaaucacugguaacuggaagucauccauggcaggagugguuaccccauggaaacugguaagugcuaggacauagcaacccuucuccccaccacugagcauucaccagcacacgggccacaggugcucauuacucuccaggcugccaugcacuucuugcuucaucaauugaguucuauguguacugagaaucagcucuguuuauccccaaacgugcugugcuggcuguacucuuuauuguaauuacauaaaaaauauagaaaauagugaaaugugaguauaaaaagaaagauaggccaggugugguggcucacaccuguaaucccggcacuuugggaggcugaggcgggcggaucaccugaggucaggaguucaagaccagccuggccaacauggcgaaaccccaucuguacuaaaaauacaaaaauuagcuggguaugguggcgggcgccuguaaucccagcuacuugggaggcugaggcaggaggagaucacuugaaccugggagguggaggaugcagugagccgagacugugccacugcacuccagccugggcaacaagagcaaaacucugucaaaaaaaaaaguaguuauuucuaugaaaacuaaguuggccgggcgcaguggcucaagccuguaaucccagcacuuugggaggccgaggcggguggaucacgaggucaggagaucgagaccauccuggcuaacacggugaaaccccgucucuacuaaaaauacaaaaaaaaaaauuagccaggcgugguggcaggcgccuguagucccagcuacucgggaggcugaggcagaagaauggcgugaacccggaaggcggagcuugcagugagccgagaucgugccacugcacuccagccugggagacagagagagacuccauaaaaaaaaaaaaaagaaagaaagaaaagaaaacuaagucaaauacuuagcaagacucaaagugaguugcuuaaggaaugcuaugaaauuaaaguggguggauucagcuguaaaauauugggggggaugguucauaaaacucuagaaggauucuauucucugauugcuucaccaguguguccauaaguugccccuccauguugaagaaaucuaaaugagaaguuguaggcaaggucuuacaaggugaucugugaaaagagacagaacucacccacaaacagcaggccacacuaaggaaaaccaagaaaaccuugcccugccucgaaagauugguaaguccauacucacuuauagguuuuaaguuaaauuuuuaacuuauguaccuacaaguacaauucccuacuuuaagugauuuuuuaaaauuaacugauuaaugacucaaccuagcugagucaguggugaagaacuggagguuacccgucaagagauggugguugaaggcaugggguagaaggcaaggaggaaagacagggaaaacccauaaaguuaauaaggagagaggcuugcagacucaggagggcaugaggguugauguuacaugaggggucaucuuaugugagggguaaaauguuaugugucaaucuaacugggccacgaaguauuuggauauuggccaaacaugauucuggauguguggaugagggugcuucuaaaugagauuaacauuugaaucagcagagugaguaaagaagguugcccuccucaugugcccauccaaucagcuggagaccugaauagaacaaauaaaagcaaaagcugccccucccaugagugagaagaugcccuccugcuugacugccuugcauggggacgugagucuuuucuggccucugaagucagacuaaacuugacucuuucugggucucaagccugcugguuuucagacuggaacaacaccaucagcucuccugggucucaggcuuucagauucagacuggaacaacaucaucagcucuccugggucucaggcuuucagauucagacuggaacaacaucaucagcucuccugggucucaggcuuucagauucagacuggaacaacaucaucagcucuccugguucuuagauuuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucacacuggaacaccaccaucagcucuccugggucucagguuuucggacucagacuggaacaccaccaucagcucuccugggucucagguuuuuggacucacacuggaacaccaccaucagcucuccugggucuccaccuugcugacugcagauuuugggauuauuuggccuccauaaucacaggagccaauuucuuauaaaaaaucucuuugccuaugucaagcuuguccaacccacagcccacaggccacaugcagcccaggacggcuuugaaugcagcccaacacaaauucauaaacuuucuuaaaacauuaugaguuuuuuugugauucucuuuuuuuuguuuuuucuggcuuaucaacuaguguuagacuauuuuauguguggcccaagacaguucuucuucuuccaguguggcccagggaagccaaaagauuggacacccguggucuauguauauguauguacacacacacauacacacacacacagaggcacacguugguucuguuucuccagagaacccugacuaauacaggguacccugggucacagcaguggugccuucccucccacugcugccacugggucugggugucugaggcccccacuagacauaacucugagggcagcagcucagggccuuggcacauguuaggugcucugcagaaucaacagaagaggacuuugacaaaaggucaaugaaccuacaaggucaaaucucaccaaaguccaaggagagaggauggggggugggcccugcgugcagcaggcucguggguuacagcaguggugggaggggcugugaagagggaaggccagcccugaagaauccgaaacaguggcuugccgaugauguaaagaaagaccaauacggccacaaagccaagguuuccuguguguauuucaccaucugacccucccaguagccuuggaccaaaggacggagaaguaaaaccucacucaccaaagugacuucauuucugccaggcacuuggaugcaagaagcacucacuccuuucuaucuguuacauuuuugaagcacaaaauauauugcuaaagugagagaauaucauuaaagguuaauuaugggaaacuuaaagguuauuuuugcauaucucaccucuuggacaaaagccgcuuccucauuaccauguuagaauauaaauuaaucuauaaagcauuuaaaaugccacaaacucuuuaacucucuuaugaugugaaaugccaugaauaaauaggcacugcccuggucugccuguugggggaggucuugcccgagacccuccuuccucccucuccauuccuagacacugaccgggagccacucuggccccuagauccuucucuccagaccaagggaaucaaguaaagaugaccccucuccaagggggccgcaucuggcuucuccaccugagugucucugccguccaccccacuuggucagaauggccacacaggcacguggccaagcaaacauacgggaaggccaacccaagcccacauggcagugaccagcccacggccaaccacgauccucuggccccagggugcugucuagguccuggggccucuuguugauccagccucugucuguggcuucugacagaaaaggaugauucuggccuuaauaaaguuagacuggguuucacugaauaauuuaucugcacacauugcauuucagaaaguugcugcuucucgugcugaugccacacuuucugaggguaaacugagagccccacaugcaaaggccggaagagauggaaccagaguaccugaaaagcagacgugaggcugccgggaaagguuuccaccaauggggugaaggaagcagcaugagaaaaugcaucaacgcauucaacagggcagccccaaaaagcaagaagccugagcccaaagcagccccaccuccgcgcaaggaagugagaucuggaaaguggaagaaacaaacaaauggcccgugggaucaaagcaccaccuccugaucuuugaugucagagaggcagacagagggccugggagacccagggccccugagacacacaagccagaagggacaauucagcagcguguaacuguaacccugcccuuguguucaauggcaagucugagcgggaggcugcuggccccagaaugugcuccuacaaagggagagggacacacagcgggagggaggaggccucaaggcuuauccaaaguagccaacauccgcugggugucugucagaguggggagcuagacccuuaagggaagagcguuccaucuggagucagaucuggggcugguguucggcucggccauggucagccauggaaccuugggcagcucauuuagugcuucauccucugucuguaaaauggggaaaaucaucucaaucuuaaccacuuauagugaagaaaaacaugguggaauggccaagcucuuugaggaaucaaggaaaacuaauggaaauauggguguuauuaaaauuacccacaggaauugugagggauacaaagaaaaaaguccauccaugucucuaagggucauacaguccaauguccuaaaaguaagagaauggguuugaaggaagcccaaugugagaggugaccaaagaggacagcccagcagccagcagcucuacgcagcgguccugcaacaaaugcacgugccacuggacaaaugcaccggcgacccacacagccuccccuacaaaggcuccagauaagggguuaauaagauaccaacacccccuucuggacagagagagacccauacacucagaaacagagauacgugacagccauagugacgguggccacucauaggcugcuuccuagagccacucccuuuccacacaguagcucaguucaucuuacagcagcccugggaguucagucuucgguuuuuuuuuuuuuuuuuuuuuuuuuuuggagauggagucuugcccggucgcccaggcuggagugcaguaaugcaaucucagcuuacugcaaccugcaccucccggguucaagugauucuccugcuucagccuccugaguagcugggacuacaggcaugugccaccacgccuggcuaauuuuuuguauuuuuaguagagaugugguuucaccguguuagccaggauggucuugaucuccugaccucgugaucugcccaccucauccucccaaagugcugggauuacaggugugaaccaccccaaccagccauaaacccauuuuacaggagcuccgagaggugaagcaaccuguccacuguucaucagccgucauguguccaacaccauucucugaacucacagauggcagaguuaagaugggugcaagccugucuguccccagagcccaugcucuuaauauuggauuagacagcgugcucaggaagguucucagagguuuucuucucaauagaaauuucuauaaaaccagggaugaugaagccagggcaaugguagguaugggagggcagaaucauguaccccucuccccagauguccauguccuaauccccgaaaccuguggcuauguuagauuaugugguaaaggggaaguaaguuggcaaguugaauuaagacugcuaaucagcugaucuugagauggggagaugauuucagauuacccagcugggcucaauguaaucacaaggucauuagaaguagaagggggacucaggagaggaggucagagaaagagagccagagagaugcuccguggcuggcucucaagaugggggaagggacccagagccaaagaaugcaggcggccucuagccgcuggaagaggugaagagauggauucuccucccagagcuuccagaaggagcgcagcccuucugacaccuuaauuucagcucagugagaccugggucacacgucuaacauacagaacuguaagacaaugcguuccagucauuuuaagcaauuaaguucucagugguuuguuacauagaggagaggacacuacaguuaagggggcacauuugggaaucgaggucgcacagagucccuaaacugggaggcccugggggcugcuuucugcugacauagaaagaggaccgaccaaagggaucacgggugaacccgaggagcagcgccaucccucugagaucagaggacaagccaccuuccuugaaaaggcaggaauccgacccagcuucuaagaacacucauucaucugccucuaagugagcagcagcugucuguaaagaugacgcuguccucccagguugcugauuaaauauuacaggaggagcacucacucucccccguagcagggcugaauaauucaucgcagauucauuuaaaugaagcagcagaaggcaaggagcugaacugggucagacuggcccggccugcucgggcaauucagcuauuaggucauuuuaaaacaaaagggaagagcuguugcgaggauuaaucaucagcuccucaacucuccugaagcacaguggcuaaaaaucauugcaaaucgaugucuauuaagcugccucagaacauucuagcccuucaggaaaagaaacuuaaaaaaaaaggggggaaggggggugcugaaaauucuaauggguugggauaaaggguuacauggcccagaaaaugugcugugcuucuuguuaacaggaugcccccagcagcuacuggaagagagugaaugggugggauccagauuucagaagcaaauuaagccaucaccuggagcccaggaacacgauccaggaaggaacaggaugaaucacuugaaacucagauaaauugaaugcagaaacaccucaggccaccucgggcucauuuccagaaagacccaugcucacuucccggcucaccauaggcagcagagccacugaggccaaaucugcccccauaagaaaccaaacagaagauguggggcuaagcccaccccaucaggucaagcuaaucccacgaugggcuucagaccccgagugcuccucagcagcguccccucugaaucaucccaucuagacacuggguacuuucugggaaggaaagugcugagguacagaacaaggacccccaguccucaaacacuaaggagucagcuuucucacucaggccaaugggaggacgauucaucugcccguuuuuacugugacaucuugaucgguggucuguggagccauaagcacagaaugucucuuugcagauugcacagggauggcagauggauuucaacacaagugcuaucucugaucaaugagucgugucugucugaaacgagagcuguguuaggagggauucugagggugcacccagcucacagaagauuguaccauggguagugaugucugcucugggcaucaauggaucaugcauauucaccaucccugaauccaauucagccauuguaaggagaaggaaacugagccccagaaaggcaagaaugcuuugcccagugccacccagagagugcguauugaugccaugaugaacucccaguuuguggccuguucuuccuacacuuugccccucuuaucagugcuuucguguaaugcauagugcggcagcagcaucugagggagcccccaaugacuccugcuccuggaagccacacccuuuugggucagcuccccuugacaggagcuggacuuaaugucucacuucuaagaaacagauggcagcaaaaugaaaggaugucacuugugagauuuauuuucaaaaagacucuggcuuuugucuugcucacccucucguagucucuugcuaacucacucugauaaagcaagcugcccuguuggagaggcccauguggcaggaacugagggcagccucuggccaacagcuagaaaggaguucagcccucagcucaacagcccacaaggaacugaauccucccacaaugcaugagugagcuugggaguggauccugccucagucgaguguucaacugaggcugcagccccagcaacacuuugacugcagccccgagagaaaccuugagaccuggcuaaguuguccuggauuccugacugacagacagggcaaaaugauacauaaguguuauuuuaagccacuaaguuuugaggcaauuagguaacuauaaaauuagcgcaauagguaacuaauacgauugucaauaaauauuuguuggaugaauaaauaaauaaguuugggcucuuagcuuggcuucccaugcagcauuugacucucuuaaccaccaucuccuauuuaaaaugcucuucuuucuugaaugcugugauguggacucuuugaguuuucuccccuauuuccucucugaaccuuuuucaccccaaggauuguugaaucguuucugguagucgaggaugaugugagaguucaggccguccuucugcacaaccacaaaagcagaagugaggaagaacugggcugugugcguacagagcccagggccaucugggucugcgguuuggaacagauuccuggggagaucaucaucaugaauacaccaaugacacuaagcccuaaguucuuaacacgcuucacucauguacuccucacaacaauauguacuaucauuacucccauuauacagaugcgaaaacugaggcacggugagaagguaauuuucugcuacuaaauggaagagcugggcuucauauacagagcccggcucuugaccaccaagcgcuucgguaggaauuaucuucacugaauucuugccaucaauauuuggggcucgcuaacucccucaugcagggcucuguccugugcaccauaggacgguuuccagcaucaacagccucuaccccagaugccagcagcuuggccccucccauggugaccaccaaaaaugucuccagacauugucaaaugucccauggggacugagcgagggggugguugugucucugguugagaggcacccuucucaaguguaggaagaagucagcaggcagaugauuccagugacccaucagggugaccuuguaaacacuuccauuuauggucccauuagcuugaugggugcagugggacaaacaggcuuucaacagacagacaugggcuggagucccugcuuggaaaggcccucuagccucgcagugcccaucuagacacucacuaaaugggggcuaggcugugcccuggaggacagcccugcagcucagggagcagaucugggagagacagcucugccuggcugagccccggccaggcucccacagagcgugcacaaaaaaggcaucccagcagcacccgccccuccgggagguggcuccugcagggauucucggcuuuugucccaucuucuugcauuccauggccuccagagucuucucaucauuuaugucaacgccaccaauuaaucugcucucuguguggcuuaagaaugagaaaagcccaagcauugucucucccgacccuaucagggcaugccguuccccaccaaaguucacgguuuucugauugaaauucacccguacaaaugcugcugugcuguuuuucccaacgaaaucaauugaauccaauugaucuuggccccauuuugcauuccucccacagcugugugugugggcgcgcacacacacacacacacacacacaugcacacacacauacacaugcacacacaccaggcucuccugcgugugccgucugggaacuucucucuaguuaucucagauaugugugacuugucuuuccaauuagaucaggggccauguuuuccacugccuuuguaaccccacagugccuacuacaaaccuaugcacgcagcaggcacucaauaauggcuuguugacuaacgcuagacauuauggaauugcauuucgaggcccccucuccccaccccaccugccaucugacaucccugaugacacgagcugucccuggcgguuuccacgacaucuccccagaggcugccacuccagucugcacauuacugauagcaucucauccuccaaauaacaagaccacuaucucaagccagaucuaauccuggugccucccugagucacaccagaaagucaagauauuaagccaucugcuuguuggaagccacuuuccaagccaauuagggauaauuuuaggagagcagguucaugagaugcaacaucaaaugcucuccucugaaaugaaggccuaccguaggaucaacuuccucagagcaaacaaguuucacuggaaaauuauaaugaacacuuggugaagcagagaaacgcgguuccacggggcuauaaauacucccaagcgcuccacuacucgggggcgguuaaaaauuauuuuaaagcgcuaagaaagacaccgaaguugaaaaaagcacucaaaugugaaaaagaaagagcugggcucuggucccaacuucuguaccuaauuagcugaagugaccuuggguaagucacauaauuucugggucucaguuuccucauccgugaguggagggaaguggccggacaggagaaagaaaacugaaugugagauguggcuuacucuggaucuuucuuucucccuccaucucccucccucucuuuugcucccucuucuuccucuauuuccuccucauccuccucuuucgucuccuccuccuccuccuucuucuccuucuuucuuucucucucucucucucucccuuccucccucccucaguguauccccaggcauuaccuacuuugcagguuguuaaaaggauugagaucccagaucugaaggguuuugcaaguuguaagcagccuguaagauacucagaaacuucucaccaccacucugugggucugugaucuaagcaguuuuacaaauuaacauaaaccaggucuaaaagaaauaagauaacuagaaaacacagauaaaaacugaaacuguaguuaacccuugacuaagagcauuaguggauaggaaaucauuucauacaccuccuaaaacucuggggaaacccuuuuuuuuuuuugagacauggucucacucugucacccaggcuggaguacggugcgugaucucggcucacugcagccuuaaccuccugggcucaggugauccucccacuucagccucucgaguagcugggaccacaggugcaccaccaugcccagcuaauuuuuguauuuuuguagagacgguggucucacuauauuacccaggcuggucucaaacuccugggcucaagugaucugcccacuucagucucccaaagugcugagauuacaggugugagccauugugucuggccccaaaguuauuuuaaaaucaacuuugaggcauaugcaccuuaucauuccuucccugggauguaugaacuaauguuaauaauaaacuguguuccaauuccugagaagacaacaaacagcucaaagcaacagcccagugcucaguggaacggaggaaaaggccgcagauccgccucugccuccgagccaccccaccgugggccugucaugcccuucaugggaaguucccagcagaucuggggaauucuccuaacugauggcaaugugacuucugcgaauucagauaccuuuccagaugauaagcccgaacuuucuggcaggggguaaacucacaaagcaaugaccuuaacuugguaaauuaauuccaaaacacaauuguuuucaaucuucauuuaaaaucagccuuuguuaaucuagauuuaaugacauaagaaauggaaauucccuuaauaaaauaaguuaugaauauuuaucaucccauuuuaccugaaaauugaauaauucaucaauuaacuuuacuauuaauuauuuaaugcaaaauuaauaaacugcaaaacucauacauauccuugcagacccucuggcacuggguaaagaaauuaagcaccagagaaauggcguaacuagagauauucccagacacacacugaugggauagaugggguuaaggcuggaauuuuucuagaaggagcagaaccaaaucacuuacucauaaagugaagggagagauuuuuuuucucaccuuggaauucuguaucacagcuaaaaaagaauucaaaguuuggcaauuauaucuaagaauaauuccccccaugcagucucuccauuauccgucaccaucaucaucaucaauaacaguuuucucacauguaaaugggcccgugaugugaagcugccacagccagcacgaccccuugucccuggagaccacuuucucuccugaagccucaguugacagucugauuggaaggggaggggcugagcacacagagaugggagugggagaaaguuuaaaaggagcacagugcuaggggacacugggacaggugggucugacaucagccaaaucugagcagcuggcauucaaggggaaccaaagcuuggugcuuggagccucuggggauccaguucccccagagcuccucuggcucuccacacucagaaggucagacuccacggcgucuuugcugacagcagcuaacaggacaaggauaagucaaaaauuuucccagagacuucuuacaagagaacagugaccaacacaggaagcuguguguguguguguguguguguauguguauugaguauuuaugcauguguguacauguauguauauguguguguuucugugcugcaugcaugcauuguguugaauauuuguuuugugugcauguauguaguuguguguauguguguuguguguacacguguguaguuguguuguguguacauguguguaguugugugugcauguguguuguguguauauguguguaguuguaugcauauguguguuguguguacguguguaguuauguguguuguguguacauguguguaguuguguauguguguuguguguacaucuguguaguguguacaucuguguaguuguguguguuguaugcauauguaguguguacauguguguaguguguuguguucauguguguacuuguguguugugugugcguguguguaguuguauguacgugugugcuguauguguguaguuguguguaugugugagugcgcguguaguuguguguuguguguacauguguguaguuguguguguguguauguguguuguguguacauguguguaguugugugugcauguguguaguuguauguauaugugcguuguauguacguguaguuauguguguugugugugcauguguguaauguauuguguguacaugugugguguguacaugugugucauguauacauauguguaguuguaucuguugugugcauguguguaguugcguguacauguguuguguugugugugcguguguguaguugugugugcguguguguaguuguguacauguguguuguguguacauguguguaguuguguuguguguauguguguaguguguacauguguguaguuguguguuguguguacguguguaguguguaucuguguuguguguacguguguaguguguguuguguacauguguguaguugugugugcauguguguaguguguguaggugugugugcugugugugugcguguguaguuguguguacguguguaguuguguauauauguguguguugugugugcauguguguaguuguguguauaugugccucucagacagacggugccucaguccucccauccguaaaauggaaucuacauuggcaugugagcacucccggguucuuucuacuuucacccuuggacuuccaguucauuguccaucccuagggcaaccaggcaaggguguuaauaauagcuacucagguagguacccuguucaaggguaccccccaccccgcugggaacccccacugcaccccgcagccccucuggaaggcagcccaaccucccccaccccaugcacuagaggggcagccucucccugcacuugacccuuguagcacuccccaaaguugcaauucuuauaaaugaucugucuuggucaccaccacuaugucccaaugcccagcacaaugccuggcacacaggaagcagucggaagguauucaccgaguaaagagaagagugggugccaaccaacaacuaaagaaggugacaguucggugucacgcagcucaggaauaaaagggcucgcucauaacccagggagaagaugacacccauuccccaaacagagcacggucaacccccagcaucagaagggcagcaucgcccaacacuggugaacugaauuaauuagagcgagcccaugacacuggagguggaagggccguggauuuucagugugaaaauauguggaaauagcacauuucacggugcaggcugugcuccuggggagaagcaaaagugucucaucuguuuucccuccuccauccuugcgcauacauuuguucuuuccauaauuucaucaccugccuagacgucguucuccagaccugacagugggcugacuucucugaucccucggccuaggcaccagcugccauucuacaugcaaauucaauuccaucgcagguaaaggccaaaauaaaaaacucagauccugaauuccuacagaucaucccgguggagagagugaugggaagucacaacgccagccaccaaugcuucagugagcuccccuguccucagcagagcaggacccuccccucccggacguggcugccccguccuggacucucgcucccucuuccccaccagagucaccucaaacuaaacagcuuaauuaacaauaaauucccugccaggugaggucaggaguagccaguauagaauaauuaauuuuuucuucgaggagaaaauuuccucuacccaaaaaauuucaacucgcuaagacacauaacgaagaaaaauuuucccagagacuucuuacaagagaacagugaccaauacaggaagcuguguguguguguguguguguguguguguguguguguguguguguguuguguauuuaugcauguguguacauguauguauauguauguguauuucugugcugcaugcaugcauuauguguugaauauuugcuugugcauguguguuguguguacauguguguaguuguguguauaugugcauguauaugcuccgugucuguauugccugggcacaugcauauguguguaugugccuacauguguacauguguauauguguuugugcugugugcacacauguauuguguguuacaaauuuguucaugcauaugugucauguguacauguguaguuguguaucuaugugcacguguaugguucuaugugccacagcacgcacauaugugucuacaugugugcuguguguguaugugcauacauguguguaagcucacacacacaacgcaaagcaaaagcucaagugaaagugggauaugcagcagaguuggagaaccagaaaagauuuccuuccuuuguuuuugguuuauuuuuaauuuuuuuagaaagcuccauaaugaaggacuguggaaaaucuaagaauagcaaagacaguaauaccuccuagccaaacagcacagggggagaaucuccagcccagaacccccagaugaucuggugauuacucauuacacagaaacuuaugaauugcaaaaaguccuuuauuccaagaacucgccuuccuaucucauaaugccacaaggcccgcaggccaacucccuuucccuuuccaugggcagcgaguaacaauuuauuagaucagaauugauccagaggaaacaccacagaugccaauccacgcccgugacagaaauaccaggcaguccuaauucuccaaaccaaggagacagggcugaagaugcuaagaauaaacugcggggccugcggggcgccagaaacaaaacaaaaugaccaucgauggacacggacagggcaugcaaauacuuaucgaucagugugggcacagugccagggggcuuuuccauucucggaaguauucacugccagguguccugcuuagagaugcuggcaagggucacccugggcgggcagucuccuguuggggugucagagcaccccaacgugcaucacaggcacccuggcacgaagccucugccgcgaaggcuuuugucccaguaaaauccaaagaagacacaugcagaaccauguaaaaauaaaagccaucgagaucccacuguuaggggacaugcacagcauaguggauggcccuggccguccccaagaucccugaaauucugcucagggagaggccacaccacgccccugugccaaugccaggaaaggcucuaaacuaagaauggugcauuaagaagguggacaggaggccagcgccggggcuuggugugggucgggcugcgcaccuggggccucacacacaagaagcaugugugcaugucagcagcaggauuucccagcccugagcagcugcgcacuuagaaaccuccaaacugcacuuugaggcauuucuuucugcagacugaaaaagacuuggaaaaagagaaaaaagcaagagagugaaacagcaaguuaacuugagagugagcaggaaacgaagaggagagagaggaagaaugagaaaacaaggggagugggucccacucggcacgacucugggcaaaggccagugaggaagaaacagggcucacagggaggacuaagcaucgcucaucuucaccagugacaguaaaggaaugaaaacuaauauaaauccacaaaggaaaagccaaaggggaacagagacgaguguggauaagagacgccaacacauuccggagagacgggaagcagaugcaggguugguaacugacacagcugaaucuaggaagcaaaaacccaagugccgugcaggggaccccaggaacaacacgcuaacccgccugccaagccccuagaagacucgugaauuggaagcaguaggugccacggaaggcagaaguuaggaauggggugggaagcagagggagcucacacaucuguauagggggcaauagacccucccggggucccacgucuacacugagcagacaggcaaccacccccuggccucugccccagcgggagacacauugauucucugaagagguggagucuggaaagacuccgaacucggaaacagcagaagagaggcaagaaacacaggcuauaaacugggagaauuaagugauagcucucauacccaaugcugacauucccagccccucgcccugcuuggcucccagaccaccagcagccaggccagcucaaacuaggcagcacaucgaccaguccuucucaggagaacccggaugguuccagagaaaaaauguagagaugcugaaccucagaguuaccaacagaaagcuggcucccuccauuaaccagccccucccccagguaaggaagagccaggcaguggacacaguaagaaagcuaaauccucaguuagcaucugaggaagccggaagaugaugucuaaaauugacaaaucaagaaacagcagagucaacauauuuagaaaucuggagguaaauaucagaaccaaaagaccagagagcagccgccccugggaaacaggauugagcuguacugcagaggcugcuaucuuuucuuacaaguuuuuuagggccauuugacauacuaaacuauguacacguauaauuuuuauaaaaauaaaagaagggagggccggacgcacugacucaugccuguaaucccagcacuuugggaggccgaggcgggcagaucacuugaggccaugaguucgagagcagccuggccaacagggugaaaccccaucucuacuaaaaauacaaaaauuagccaggagugguggcaggcaccuguaaucccagcuacucaggaggcugagaggcaggagaaccacuugaaccugggagguggagguugcagugagccgagaucacacgauugcacuccagccuggcugauggcgagacuccauaucaaaauuuuuuuaaaaagcauggggguggcggggugggcaggagccacaggucguagcugucuaacccagggaggaaucagagacacaaacaucaacacuucccucuuggcuccuccaggacaccgggaacuugcacuccuggccccaagaagugaggaggggugggauggaggccaacccucagcucuugugccagggacaugagcccuggacuggugcugccauuucaacagguggcuaagcccacugaagucacaugaggcucacauguccucugaucaggagcccaguguaugugacaauaccccaccaggccaucagugcccccgccacggccaacuuccuagacacggaggggaugugaggaguggccuccguggguugccccugcuuugacaugugguauucugggauuaacuaggauaaagauaacuggaaucuggggcagaccuauuuccaugcagagacuggggacuucccuaccacugucgagacaccgccagacacuccaucaggauacaggccacagcucauuccccacccccggaaacaaaugaaaacuacgugacagguacccugcgaggaaguccucgggcaggaggcucccugggaacucugacagauguggcacccgccaacucccucacccugcaguugcccuuuggccaacaauggccuuggccaaggauuugugauacauuacaaaaaugcugacacgcaccuaacgugacacgucucuguguuaauuugaagugcguucccgguucagugcauaaugcaaagguuaccacguggaaaccacugcugacccaguuuccuuuuuccugcauaguuccaaagugcagaguccuaaaaugcucuaaaucuaaaacugcccuuccgaacucuggccaccaacagcacccccugcacaugcacacacacgcaugcgcacgcacgcgcacgugcacacacacacacacacacacaauucguccaccccagccaauccugcccagcugaauaccugaggaagagcuacagaggcaacuccaggaauuuuuuuuuaauuguaguaaaauauagguaacauaaaauguaccacuuucaccauuuuuaaguguaaguucaguggcauuaagcacauucacauugcucugccaccaucaucacugccacccaucuuccccagcugaaacgcuguacccauuaaacacuaacuccccauuucucccucccuccaccccagcccuuggaaaccaccaucuacuuuccaucuccagagcugacuauucuagaucccucagucagcacaucacacaauguguggcucuuugcgucuggcuuauuucacugaguauaacgucuucaagcuucauccagguugcagcaggugucagaauugcauuucuuuucagcucugggaauuuuuaaaugguuuuugcaauucuauuccagucacucgagcagccuuaccaggaauaggggcuuccuuagaaaaguccucugucugucccaaagagcagaugccuuaaaggugaccaacaggucacugccaggggucuuacaauggggcugaacaaagacaaaccccacugcaccaggaccagccuggggccugauaacacugacuuucuaggcagaggccucagcucauaggcuggcaccaugccgggaccccaagggcugucuaggacaaagaaccccauggauggcaggcacuggcacuccugccuccugggcaaacuugcugcugugcaaugcauccacacucuguccgcccccaacuccaccccaucaaagcccuggccucccugcacacaggcugugaagagauaaaagggacagcaugaccuuguccuuggggaacccgccaccccacuggggaagaaagacucacucaugacagcugaauuggcaaacaaccgacaacaaagcacgugcagcuacgggagcaggaagggaagagggcucgcccugaguuggugaguuuggggaaggcucccaggaagaggcagaccagauuggacaugagggcauucgaggugagggcaaugccaagugaaggccaaagugggggacaagaaagauauucagagagcagccagcagcuccccaguuguagcaguaccuagaggugggaugucaaggaaaauaaacggaaaaggguggguugagacagaagaauggccuuaacgacaucacuggagagucaaccucagcucccaggaaguaucugaggcucccaaguagaauaacgauggaaucaaagcaauauuucaggcaaaccaauggggaggaggaguucgacuuagagaaggaaaccuaguaggagauauuucaauacuccaagcguaacaguggcagugaggacacagcugaaccugggggaaaacauacgaaaaugaggaugugaauuacagucggaaacacugacggaguugguggcuaaugagaugcaggggacaaaggagaaaaaggagccaccuggaguccaaguuguaugcucuggcaucuccacaaacgagguggcucuucuagaaccagggaagucagaagauggaaagcagagugggagucagggaaggaggggagaagauggcgagcuggagaucauaauacgucaugcaggugccggggagacagagucggauguggggaaugauccacagagacuugacggugagaccauggugucggggaguccugggagccccacaagggagaaugugggaagaaagagcagaggaucacaguuugauguccaccaccaucagggcggggaaagaucugggcauuugaagccggaauggacggauggggucaggaaaccaggaggaggagaguggaagcucucucugagccacuggagucuuuuugaaacucagggcucacuuuucuccuccuuuccuucuagacccccuccuucuacugggcuguuuuauugcuuauugaccaaaaggcauuuaguguucaucauaggaaaauucuauuaugagacccuuagugcuuccauguggaggugcuaucuauaucaaucuaauuaauuaauuagauaaucaacagccuuuuccagccucuuucuaacggguauaaacaggauuccugggaaggacaugcucuuacuucaaucuugagcuuuguguguuccuggcuuccagggaagguugcguauuucccaggggagcaggaauaaaugauugggauugcucaguuuugcagcugucugccuguccugggcucagcccgguucccugcccucuggugaaagggaccugcuccccugcaguggugugccacucuuccacacugccugugacuggggggcuaacuccaauucagagggcaguguagaacacccuucuggcuggcacguaugagccacgcuuacugacaaagggaaccuuugccuggagccugguucuccuaguugguuuggaauucacggcagugagaggcggagaggaauagaggagcuauugacgggcucccugggaaccuucacaggcacaaaagcaaaggguaugggcuuugcagugagaucauacuggguucaaguuccaguucuagcacggacucaccaugcagucccaggagggcacguaccuuccauaccuggcagagcugccagaaggguuucaaagcacagcauccagcccaugggcggugugagagaacacagugcuggcucaaccggacaauccugggacuagaaauacccgaaaaacugaaguggagaaaaccaggucccuuccuucacaacacucaggcucaccuuucuaugucacuuuuguucauuuuauggauauuucuugagggucugggagguguccacacuguucuaggagcugggggugccccaugaacaagccccacuaaaaaucccucuccucuucgugcuaacacuuuggagugggucaaguaaugaauacauaaauuaggcaaggcaacugcgacagacacagugugucagaaggcgaugagugcuccagagaaacguaaaacaagaaaggaggaaagggggcuggcugggugggggugggggugagacuaaacugcauggccagggacaccuccccgagaaagggacacccagucaaggccugcaggaggagcugggagaacauucuagacagaggacacucuucuuuccaagauucucaauucaccuggcaggguggggagcaugaaguucccuggggucuccaaaugguauuauuaucacacugagcacacagcaagugccaaaaaaacacguuccgcagggugauuuuucaaaccggaggucccaguugcugagaguacaauacgggcuguuugaacguucagcauucagcucuguugcgauaccgcggcugcccccaggguccccagcccugggagccuccguguagcacaccucauuauuaaacaggugagcuggggcucccggggccuucucuguaauuagggcaguaucugagcaaggacuauauuuauaacccccagccagcagcaagccacagagacaagcagggggccccucugcagcuucuauaccaacaucuauaugugaacugauuacaacaauuaauuuaauagggauuccuccacacaaacaauguaucauuuuauuaggaaacucuauaaaugucaguggugcaauucauuuuuauuaauuuucuaaaaugaaauuagcaguggcggcggcagcagcaaacagaaguuguauugccuucucauucagcagaguauuggugucauuaauuccuuaauaccaggaggccaguuuguaugaacucagcaguuaacugcaccaauuaauuucaauacuagagaugggguggggguggggauccaaacacaacucaacaacuaauuuaggaagguccuugaacaaccacagcaaguuuugcuucuccugggacaagaagcuuucaaguguaaacauggaguggauauuauaauacuaauaggaaaccuuccgucuucacccucugccuuuaggaaagaaauucguccuuccaaacccagagaaauccuggcagacgccugucgaagucaaagcauccagcagguuggggacugccccacagauaagaggcacagugacaccugugcauggacagacccgacggcaugggaagcagaaucagaaacgugaccacauucaauccucaucgugacccagcaagggugggaucaacagcaacuccauuuucuauaugaagaagaaaaaccagggcuuuuaaaggagcuaagaugaccuuuucacagucgcaaagccacugagugacggagccaggacucaaacccggacuugaccacaucugaaacccaccuuccuucuucugccaggcacacacccugugccucgggguggggucucuuggcucuauguauauuccagaaagucaugcgagucaggcaugacccugagugacauccccuucucaauuguaacccaaauuccaaaggcugaaacucgagguaaaaccgcugccuugaaauguucuacuguucugccgucaaaggguggcugaaacccagcacgggucugcguaucugaaaucagaugucuggcccaggacgcauuccagagaagcucccucucuggcuaaggaggagcucuucucuuuccacuuagauucaaggaguguuucagcggagagugaagggcgcaaggagaggcuggcggcugcuugagauaagggccacccuuggaagucaggaaaugguccagaggcagaaaucagauaagccuccuucucccccagaaaacuaggccaguggcccucaaaguacagucccagaccagccacauccuacugccugggagcuuguuagaaauaacacauguucaggcccccugcaccgcaccugcugaaucagaaacccuaggguggggcccgcauuuuaaugagcccucagcugauucugaugccugcucaaguuugagaaugauguccuccaagaagaugccgcagaagaaaggggaaaugagcaugucaggcucucuaguuuaacauggccguauucaccaaauagugcacuguauucccauccucuccaccgcccaccccugcccccacucuguggagggauguccuucccagccccauucuuacugggcuuggccaggggacuugcuuuggccaguggauucaucagcaggcaugacauaugaugccacaucugagcaggaguuucaacugcaccugcaucaacugccuugggcuuguaagccucugcccuccucugggagacgccaacuucccaggcagagggggcuuccucagccuaggucccacagcaaaaugaugcacacagcagaccugaccucaacccaaagccacaggcagcccacagacccaugagcagaaaauaaagauuuguuguuuaaagucacuaagcuugcaggucguuucuuacacagaauuaucacagcaaaagcugacugauauaaauuauuugauuuuauagcaaaggaaaaaccaugguuccagcaggcugagguuuuggggacuccugcggacagacucuccucccauucucaggccagaggugaaccauucagagccaccuggggaagggagccucaauaacuaaccuuccuuccacaaugcccucuagccuccuucaaaggggaggauugugcccucaccuaaaagaugcuaaccaguaaauaucucagccuaauaaugugguauuuuaaaauaccuucuagaaggaauaaacauucccaaggaugaccuuucccaugacucaggaaggaugaacaggucaagcugaugggccacgggcacagaggacacacucaacccuucccugguccuaacaaaccuggggacucuggggcuucuguccaacgugaaaccaacuggacauuccaccacuucaguucaagccugcaguccaggcauccuguguaaaccacacuccagcuaccaccccgccagcuaauaaacaccuggguccugucacugcuaacagaaaacuuacggcaauuggaagagaguggccauguauuuccgaagcucuagauuguaacauuccaaaaauaaaaaccuagaguuggggaggaccaaaagaggcugccuuuuaaaaucaacccuaagucccaacaucaccguucacaagaugguaacaucacuggugcuggcggaacgcaggucagcuauauuuucacuaauucccucuauucccaaguggugagagaagcuaaguguuugcggcaguuagcagguucaaggacauuuacugcauaauaaacugcgagcuuagccauugcuucugauuuggggggaucucuuuaccaccaaucaagaacuugacuuucaguuuguagacaaguugagauaaaagugggcaguuaagcugguuucucuuuuuucaaagcacguuucuagagaacacuaguggcaggcgagcaauuucccaaaauaaacuuccccugaggcuccugccugugaagccuuccaagcacccggcugaaggaugcagccgucagguuaaaaguuccaacuggcggauggcacuugcacucuuuuuaauccaucugaucguauucacugccacagucuuaugucaaugaaugagaccucagugucgaaagccauccagcacaacauggcauuuucaacucguugcccaugaauucacuggccaaaucagguaaucaaugcaaaucaauccacuuaugguacacauuugaaaaacugcaagaucugggacauuaccuugucuuaggggaggugguuagccauucuucguguuucucaaauguuauuaaauaagcugcaauuuccugaaacagaagaauaaaaagauaauaacaacaauuagcucacauuggauccugagagguaagaaaguuuuugcuguuucccagcugcuguuuucauuugcgagccuggaacuccaucccugcuagagaaauacucgacuuggacucuguuucuauuuugauuuuuuaaggccuuuccauucaaccugucacacgguaguaaucaaagcacugggccucaaaagaugagucgguggcaaggacaaaaauauuucucuguggcaggaagacaucagacaccauuucagauucuaaaugucauuaauuuagggagggaaaaacacaugccaacaacaacaauucuccacgaugcgagaccauaauuggaaaguuucguccuuuucugaagcuggacgaaucuuucaucucugucacaagagacgucgcauucucucagcuucauccccaacccccugagccaaaaucacacaaagauuaaaaagaaaagacacgauaaagccauauuccagagaggaaacggggagaaauaaguuaaccuuucccacuacugauaacuuaaaucuagugagcggcacauccaaaagaagagcaacgucagcagaguuuaagguaaagaugaggaaaaugugggcaucugaaggcaaauuaaauauuuauaaacacaacaacaucacugcagauagaauuacugauuuauuaauaauuuccauaaaaagccagugagugacaucaacauaagucauugcuccagcucgaggcaugauauggcccauuacuuccaccuccgaaaggaucugcuaacaugaaauuggcagggauuguaaguuaaauuaaggcuggacuaguacaugucucccuugaucuuggugaugcuacaacacgcagcuccugcccugacuaucaggaaaauucagaggggaggccuccaccucagcucucucugcagccgggguuccuagagggcuccugggaagguagcagccccucugccuggaggcgagcagccucuuucagcugggacauaauggaguugacaccagugaccagagaugcuaaacuuggccuugagaaggaagagaagcccgguaagcagagcaggugagaguagaaaaugccccugaugccaugcaguccaaacaccacaggccaagaguggagaucaaggccugacaucccauggagccggccaccacaaggcagccagugauugggaacugagagcccaagccaccucuguccggaagccuggaccugacaaagaaccugggaagcagaagccuauagcaaaaauagaguugcuucacugugcaaguuucuaucacugacugcagcugaagaaaucauaaauaagcagcugaucaaccagcacauuguucucucaucccugagccuuuuuacguguuauuuccucuccuuagaaaaaucuuucccugaggucucacuguagauagauccuuccucuggcuggcccucccuaacuauucaugauggcgucaguuaucccuacugcuugccuggguggcacuggcaccuucccccaguuggcaggauuuaucacucugcauucuaauugcuuguuuacucagauaacaucccccacuguagcaugagaaggauaaggaacacguuaucgcugacacauccccuggacuuaacaguguccugaggcacauaggaagcaccugauaaguguuuguuagacagauggccggauggaugggaugggaugggaugggaugggaugggaugggaugggaugggaugggauggggcuaggaaaaacgugcauggcagaaguaaauaugcaugcacacgugagugagagagugugugugugucacugaagauaguugacacaggagcuuaaaagcagcaaaaugcagcaguuccugacuaaaacuuugccaauuauuuaauuaacucuaugucacuguaggaaggcaaaauaguaacacacuuaagagcacaugcauuggaagcaaacaaugcccuggcuuuggguaccagcacggccucuuauuagcugucucauuuugagcacauuaccuaaucugucuagaccaguuuccuaugaaacugggagacuaucagcucacgaggcaguucuaaggaaugaucauucuaaauacacuggcuggcagaggacaagccccaaacaauagcuaccaugaaucguuauaagaucuacguggugugagccaccugucuagcagcccgaugaguucacagguaccaaaaugguccaggucagaggcugccaccacugcuggauuaaucaucaucugucaccuccaccaccccggacagcaccacgugcccacgccugcagacaaugaaugguaacaucggaaugaccguucagaguuguugguuugucaauugguucucauuuggcuucacaaaaccagagcacacugcggcuggagucaguacguggauuuacuaagccacuugucacgugcaucagcuuaucuaccugaacuucaggagaucugguauccagaggaauaggcugugccagcuggaacccccugauccaugccccugcucaggaccaugcugagagaagugacccuuaguggcccaggggaugggaggugcaguggaucccaaccucuaaacaugugauuuguuccaaaacccuggacauccaaagaagacuuucaugggcauccuucagccaacgcucaccccagccugacagggcuuccuacugcuauggcccgccgaaggggaaaaacuccuggcacuacuuacugccuucuguguuuacucuacaaacacuuacugagcaucuacuguauaccagaaagggaacaggaccacuuugaagcgugcaguuaaagagcucacagucgagcgauggguacaggcaagucaacaugauaguguguguaagugcuguuacggggucaccucuguggccaaacuuagcaggggucacgucauguuuaaugagcuucucucaagcaagcagaggucccaggaaaucacgcugauguaagaacuaccuacaucacccgccacucccuccuccaccccaaagguaaauuuugcuucucccaauccaggacaccucccacacagagccccucugagagaagccuuuccgaggaagcugaugcacaggcccaggcucccaucucuguugugcucagguuggcugggccccaaagauggacucacccgccaucgacugucccaugcugcugcaugaaccuggcuggguggagcaugucugaguuacccguauaaugccaggccccuguugcccagccuucccagcccauggcccuuccccaggccacccccucaccagaugggcagaccacaggugagcccgcccugcaaaagcucaggaacucguuuggggagauucgcuaaagaacgaaaaccacacaaaguauuuggugcuaaauggcauggagccauguaaaagccauccaaauucagagugauuguggggagaaggacuucaccaucugugucauugcuuccaucaaugucaccaaugcuaaggugguggagguacugcccuaggacuuaugugggaccaucucguuuaaucuucauaacaaacuaugaaauaggaaccauggccacuuuacagguguggaaacugaggcacagagugguuaagugacuugccuaaggucacauggccaguaccuguagaaccagaacccaaacccaugcagaauggcuccaaggcucacauucugcaccacugcucugaauuucagaagggacagccacagugugcuuggaugagugaggaacugaacuuuucccagcccaggcugacagcucccugcuccccacugacccagggucacuucccagccccaccucccuucaguggaccaggaggaguccagacugaaucuccuucagggggauucucuccuuccagcaggaucaagcuuauugccaccccaaaagccuaguucaacucauaagauccucgacuucagugauaggcaaaauuccuugucuccauggagcccuuugcuuaaaacaucauaggaagcagggaaaaagcaacacacagagcgggagaugcucccgccgacgaggggaaggaguugugaaaagaaagguuuuuagcucaauugucuggccucucucucuucccccagagguccacaaaccuaggacccuaaaggcggcagaugaaaacacaggucuggucuaucucucuugacagaggaaaaaaaccgagguauagaacagaaaagcacuuguccaagcucagcauguucauggcggagccaggccaggacuccucacucuccgggcgugcauguuccuuccccugcacuugcagccccucaaacacaagucuggcuugaaagauucauaggaggcuggggcaaaagcauggccaaaggaagugaaaacaggugcucaaacaaaaacacagacacaugcacacaguagcaucgcucacaguagccaagagguggaccuaccccaaguaucugcagauggaugaaugaagaaacaaaaugugucacagacguacaacggcauguuauucagccauagaaaggaaugagguucuaauaccggcuacuacaugaaugaacacugaaaacaugaugcugaguggaagaggccaggcauggaaggcccuguguugcauggugccauuuauaugaaauaucuagaauaggcaaauucauagagacagcauggagauuagugguugccaaggguugggggaagagggugauggggaguuauggcugaugggugucggguuuccuucuggggugaugaaaaugucuggagcuagaugguugcacauccucaugaauguacuaaugaccacugaugguaaauuuuauguuaugugucuuuuaccacaauaaaaauaaaaagaagaaggaggcaucaacauccagccagauguggcauuagggggaaggaaauuccagccauccaacccacgcagacagccccugagcccuaaggaccacgugugugcgugcccggcggccuccccagugcccuggcucccuuagcuuccuccuccucccggauccuaaauaccacaucgaugcugagaagaaugacucgacugucaagaugaagaaauuugcugcaggcuccaaagcaaagacuguccagcuugcagauuuuaaauguuuaguuuguccuuuggacguucaaguagaaaaacggccgccaagguauggcgucuaugugcugcaggggcuuuggagaacaaacuggcagggucccagacaggccccucuguaucuguucagcagauacaguuuggugccugcagaccagggaggcaggugggcccuuccccaaggccccaaacaagacacaucaggaagggaggccugggcaggacuggggacugcgaugcugcaccuggugucacugccuggucacacaccgugcugccaugcauccaucuccaccacccagaggcaauggucacccaccauccaguccccaagcugauggguuuugauagaggacugcaaagcccaugucaggagccagccagcugggagccagcagggcuggagggucacggcagaggcugccccaugggggcuggcaggugagcaugcauugcugugccaaccugacuccugcccuucacgccucagcgcccaugugccagcucugcccacauaaccugucagguccuguucaucgcccagccccucccaggggagucucccuugcugucucccuccacagugcacugcagcuucuggaacguucucagcaauggcugcacugcucagacuuucucuugcuagcucuauguggguggugguucucccuuccugguuuuucagucuucagggagggugugugucucaguccgucugucacuguagagccccguacaguuccugugucugaagaugacugcugacacagcagagcugaaggagagauugugaaguucucuuccaaaggaugucaccucaagagcccaugccugaggcucccaugcacaaagguccaguugccaucgaggcucgggcccuacgugagaggucacacagcacuguuccucuaagugccccucauucaggaggcagcucuggccaaucugugagugccagaguugcacuguccaauggaaauagaaccugagccacaacacaaggcacgugugucauuuuaaaauuucuagaagcaauaccuaaugcaugcagggcuuaaauccuagaugacggguugaugggugcagcaagccaccauggcacauguauaccuacguaacaaaccugcacguucugcacauggaucucagaacuuaaaaguaaaauauaaaaagauuuuuaaaauuucuagaagcuacauuuuaaaagguaaaagagaagaaaauuuaauaauauuuuauacuuuaacccaauauauccaagagaguaugauuuuacuaauuuuuuaaaaaguagucacaagcuaucucauacucuuuucccuacuaagucccuguguguuucccacggacagccagccccucuagcugggcucagccgugucucaggugcuugaugccacacauggccgccguacuggauggccagcucuagaugcagacaucacaggaacccgcaaacacauaugccuccuggagccaacggcagccaccccgcugcacccuccgcgucccacaugugaaggaagcuguuccauagcacacgcuucaaggagagcagggcccccugccccccucgguccaccucugaggugacgagccguguccccuccaguguguggggaggcucccgucugugcagggagggcuacgcaauucucagaggggcuggauucaccucaacuucucagccccggcucucucugcugcccccacucccuccccagaaggagcuaugcacugcaggcugugcuuugucucaaccccauagaaggguccagcccagagagaucagccuccccucccacagcuuccccuggagcagcccuuagaaaaagcagagucccccauaggucucucagacaguccguccuccaucugucuucaagauacaggcucaaugucagggagggagaaaggucuuuagugcucacuguaacaaauuaaacaaaaaacaacaaauguauauauguguguacauauauuuauauauauauauguauuuauacaaauaucuccugaguucaacuaauaaaaaucucucuauagucuauacagucucagauauauuuugcacauagaaacauggauuuucaaccaaaguauaauuucuuaaagcuugguuuuuaugagaguucugcauaaggguuuuaucuguaagggaccaaagcugaggagggggaauaaagggaaaaaaaaaaagccaaggcuccccuagcagcuggccccagcaucugcuagagccacaaaaugcaauuauauuacucccaaacgagaaguaaaaauaucuuguuuccaauccucuugguuuuaagacucauacuuaauguccucuggguauuucaguggugccagaucucuguguuauguacuuuauuagggaugugugaaugucauauuaaugacuucuaaccaauauguuuacggugaaagcaaguuuucccagaauccaccacucgcugcacuugacaaaaaauaauuggccuuaauuuaaauaaauaaauaaccaggcccugcccucucccaguggcaucuuccccaccggcuuucuccagggcaccugugcaugaagccgacgggcccucccccaugauaaauaguccaacccagguccaacagggcagggcucccgucugaacauuccugucccuguccacugauguacuucccaagcacccagcuggccaagccaacacccugcacaggauaucccggaccccccacccacaggucuaaaccaacauccccaaucuugcuuucaaaaugaccaacucuugccaucaacuguuagcauauagaaaaauggguuauauuuuuuuuauuugcauggaaugcaacguagcucuacucugacaguuuaugaaaguggcagugguuaagacuguaaggauccaagggugucuggaggacugucuacaaaaugguaacuagcaauucagaauaaauuccuaacagccuggacuucugaaaugaagccuggccccacuggcugucuguuauugagacauaguaaagcauucuuaugacuaucaaauuaccaaucagugaagaaacaaugagccaccacagaaacauccacagccagagucaguaaagaagcaauucacccggucuuucauucauuuaucuacucauugguucaaccauucgaugaauuauugagcaccuacaauaugccaggcacuaugaaaggcccuaacaauacaaagacacaugaguaacggcccugggaaauacagcugggaagacagauggggugcaggauccagggcuaucacauucaagugcaaaacagacaaggagugccaaauuagcagcacggacgauguguccauacugagaagagaaggaaggguugugucaaggagcuaacauuucaacugggucuugacgagugaguagguugcccagcagacaaguggucaagguaucagggaagggaaagagcauaagugaaagcaggaaaaugggaguagcaaauguguucagggaaaucugaguaauauaaaguaaugagaguccgcaggacaaggaauagaaaggcagaacucaaagccagguggagggggaggcaccaaacuguggaggaauucaaugccaggcaauggaguuuuaucccgaagaaccaggggaaggcuuuuaaguagaugggagccacacaaagagcugugcuaucuaucuaucuaucuaucuaucuaucuaucuaucuaucuaucuaucuauuucgagaugcagucuugcuccgucaccugggcuggaaggcagcggcaugaucuuggcucacugcaaccucugccucauagguucaagagauucuccugcuucagccuccugaguagcugggauuacagguaccuaccacaauguccagcuaauuuuuguauuuuuaguagagaugggguuucaccauguuugucaggcuggccucaaacuccugaccucaagagauccacccaccucagccucccaaagugcugggguuacaggccugagccaccacggcuggcuagcugugcuuuuuagaaacaucacucuggugguggccugguagagaagaggccgcugauuggagaccaugauuacagcccaggauagaggcaauaggauccugcacuaaggccaugggaguggggaaaauggaacaaagcugaauguuuucaaaagcaagguaaauggggcuugaaaccaaauggcuggggaaaugagaggcagugaggacaucucagaagcaaaggucacaaauuggcggcccaaggacugacuccacccagagaugugccugcuugguccacacagucuucuucccauuuggcuuaucugccaauguuuaaagauugaaggucagggauuuccagcuucucuugaaaaauaaagucuggcaaccccaggcccacaugcugcacagcaaccacugcuuggcgcugagaagcugcuguccauuuggaugggccugagagcuccagaggaccaccaccucaaccugcuggcuuucuccacugucauggccggcuuggauuuguaggcccuugaccuuggggccccuacucugauauuuauggcauuggaaacugggugcacuguaagaccaugaaccaauauaggcaauccagaaagaaauagauuuuaaaacagugcaaugcuaaccagaacacucauugccccuuaauacagugacauguacugaugaagccagauccaagacugccccaacuucuauuuugauauuguuccagucgucaguuuauuauuaucucugaguuccaauuucacccuucuuuguccuucuuugugauacugaagcuggacccuguacauauuucuccuuugcuggcauagcagaaugugaagcuucgucaauagacagcaacgacgugaaccugcaagaugacaguggcaaagacacaucccuugcagaccucuuaccaucaucauuauuauuauaaucaucacuauuauucagaguggaguccaguggccaugaagaugagcuccagcuguacccucaggagacagucccuccacuggcaggcugcuuuagaccagcucuguucuaauugacauccgcaagugacaaugagccacuucuacagaccacuuccagcccaggcccuuuggcaggcagcuuguuccuuugguagccaugcacucuuugaagaggucugaauuuuggccaaugucaggaagggucuucuaguccuuauuugauuuguugucugcuuuuccucagccuagagauagcagcugcugcuuuaccccugauauuuuggaaacacuuagaauucucuuuuaucuccauuaguaaucaaccacccuucuacuagcuagaaagucuuuauauauuaaauuuucuguucaaauaaccaaacaugcuucugucuccugagaggauccugacugauauaagaauaauccaccagccuggccaacauggugaaaccccaucucuauuaaaaauacaaaaauuagccuggcauggugguggucaccuguaaucccagcuauuugggaggcugaggcaggagaaucgcuugaaccuggaaggcagagguugcagugagccaagaucgugccauuacacuccagccugagugacagagcaaaacucugucucaaauaauaauaauaauaauaaauccacagugcugaagauguuuacaaucucacugauguguaauccuagaaaacacacuaaaagguagagggagaaugaaaaaauaccugaaagagaagcagcauguauuugggaggagauaucaaauugccguauugaggucuuuauagcaaguuuccuagaugccagccagaucauaguuugaaaggcacuggaggaauauauguccuaccuuuuaguuugugagaagaccugaauccaccuauuuugagagauuaaaaaaacauuucuuuuagaauagaaaaaguuaauccaucucccuuugguuguaugauuugggggaagucacaugauagcucugugccucaguuuccucuaaugugugccaugaaucuauagguauuacuucauuuacuacaauuguguuaucccauauuucagggauuaaaaccuauuuucaaucagcaucauggagauauaauuuacauacaauaaaauguaccccauuuuaaauguaaaguccaguagauguuaacacauaaauguauuauguaucuaucaccauauucaagauguaaaacaauuuccaggaccauguaaggauaauuuacucuauacggaauuuuacacugacagacuguucccccuuucggcacucaagagaucccauuccauugucuucuagcuugcaugauuucugaugagaagucugcaaaaauucuuaucuuugucuauaauuugucuuuuuccccucuucuagcugaguuuaagauuuuuucuugcugggcacuguggcucaugccuguaauuccagcacuuugggaggccgaggugggaggaucgcuugagguuaggaguuugagaccaaccuggccaacauggugaaacccauuucuacuuaaaaaaaaaaaaaauuagccaggcgugauggugugugccuguaauuccagcuacuugggaggcugaggcacaagaaucgcuugaaccugggagguggagguugcagugagccaagacugaccacugcacuccagccuggaugacagagugagauucugucuuuaaaaaagaaaaaaaaaaucuuuaucacuaauuugaagaaaucugaucauacugugugugccauucugugguuucuuuguauuuaccuugcuugggguguguugagcuucucaggucagugaguuuauagcuuuugucaaguuuggaaaacugucagcaauuauaucuuuaacuaaagagcauuaggcuuuaggcuuuacucuggcaguuauuuaaguuacuuguggaucagccugacccucucaaggcuuauuuuuaaucucuguaaaggugggucuacagcacguuuuacuccagaaauguuguuacccuacuauuauugcuucuuccuuccggagucucuacugaaugucccaaauauucaaggacagcuccccagucgggcuggucagaaugcaaauaccuccgaguccuguaugagcucugugaauuuuauagccccuaugugcacuuuguccaguuuugugggguuucaccucacucaucaaugguuuaguagucaacagaacaucccaggagagccauaaaaguuucuagagcacuuucuuugccaggccuucuccuguaugauauucugcccugcaaauucuagauguaucaaccucuccaaacucugauaucugucuccucagcucaacaagaucacuguacucuucuuggaauaccucccugaagauacagucuugaaaugccuccaugcagaaauacaaagugauuguaugguuuacagucuucucuuagcaaccacaguccuacucugacgaucaucuaauagcugaaaauauuuauuucacagguuuuauccaguuuuaucauuguuuguagcaagaggaugaaucuaguccuaguuauuccaucacagccaguggcaaaagucucaucauaaauuuuuagacuuuuauuuuauucuuugagaggucagcaaucuuucaaugaaggacauagccagccuaaagaaacaggguuaaaacuuugagggugucauuguugucucagagacaggcuaucguaagcccguagagauacagauuuucucaaauaacaaaaagugagagggagagagagugucugaagacgacucaauaccgauucugccuuccuuaacaccaacccuccuucaccucuacccccagaugaagaugcagacuugcugaucugaagguucaguucaagaaucagaagagccuaaaagagcacagauuguuguuauaaguccuuccagaacagugauauaaaccugaauauaaaacagaaguaguguugcaagaauuuggcuucuucuucaaccuuggcaggauucuaugugcguagaaagugucacugacagccacacacugccaacucccauuaagaacuaaggacaagggauaagcuaugcaaaaauaugcugcauccacuuggucuuuguguagccacgucccuuugagauaaauucugaauccauggcuaaauaaaucaggaauuuauaucagaguguguguaugugugugugugugugugcacgcaagcucuucccacccauaaauaaccccacccacaaugcugaaaagcuccacuaacaccucugcuuuagaacauuaaccaauacagcccuuuggaaaugggucguaagucauucaaagaagucagaaaaggcuuucaugguagcagacaacagcucuggugccuacaggaacacagcagaagugggcauuuugccucgcuccaggcccuuccagccuccaaguacagcagagccaccuaacuccgagcaaccacguuuccuugcagaaaaacaccgaugcucauccuaacccuucccccaacacaaacccaauaaaacuaauaaaaacagaagccagccaucuuaaaauuaacacauccaagauacaagcagaaaccauugaucaaaaccuccuaucuucccucacagcugacagcuccagagaagcccuaacacccauaauggaaucccauuaucuacaaaagaaacucguuccagagaagagucacaaagagagaaucaaaggaggcuggcaaacggggagacuccaccacuccccucugcucccauacaagggguacaacacucaagcagagagagccauuagaacugcagcaacggggaggcacuuuccacgaguuacaaaacugagaaugaaaucaaggcagaguccagugggaaaggagggugugagagccugcuucuuuccaucugugcaaaagcaaaacagaagcuucuuucauacagggagaaaauaggauccaaaaaaaaaaaaaaaaaaaaccuuuccuuaaauuccagaacugccugcauuuggaaaacacagggauuucagccaaaguagggagcaaguaagauucauuagcaaaugccucaaauccuuaauucacacuucaaacaaacaagguaauuguguagcuaacagagugugacuugauuauaggccacugguggccauuaauagaugaaagguguuuggauuucaauaguguuugaauuucauaaccugccuucauaagacaaguucagauuagucaccaccuuuauuugcuaacaccugugaucaugaaucccacaugacaaacaagcaacccagcuuugagcauuuggaauugaagaguaaacaggaggagaauucaugaauuuuacagagguaauuguucuacccugcuuugaagaggaguagaggucggucucagaagaccuuaacauaugcaugaacacagcccuccuagcugacacaugacucagaagacccgcugcuauguugccacugcuugggaaagcagaaugggacugggcuccaacacucacauauuauuaaucaaucacgccagugccccauucccaaagacaugagccuggguccacgugaggacuuaguucaaacuaaaauugguggaugugucaaaaaaacugaccacugauaagucuauaucagucuucccuuuaaccagaugggcccuauccuuagaaccucagauuuuauuagaaagaaaagaagagauaucuuauuccucuucucuugcucguuaauguuaucaaggaguaagaugaaagauaaggagcgcaaaagcucauauugugucaccugaagagcagcaugggcugcagggaaaaaacacaaucaaauauaucuuccugaaaaccuugugauucagcgaugcaauaaugucaaagccauaaaaagggagcuugcuuuucaaaggguuacaacagagcaauagcaagaggaggaggacuaaauuuuuuuuccaguccugugaaaaagaaagagguuccaauaaaacgaggcccuucuuguccaacgugaugacagucuacaaagucagucccagcagaucugcagccagcaacacucccaggagaggaacccugaugcauuauccuuauccucaucuuuaaaguuccacuaauucccuggagaucugggucaagcauuaaagggaacauaagccauagugaaaaccuaggucuucucuccaauaagcuuaugaucuacgaagaccaggcaccuaaguuagggucuaaaaucacugagauugggccgggcguggugguuuacaccuauaaucccagcacuuugggaggccgagguguguggaucgccugagaucaggaguucaagaccagccuggccaacaugacgaaaccccgucucuacuaaaaauacaaaaauuagccgggcgugguggcacacaccuguaaucccaacuacucggaaggcugaggcacaagaaucacuugaacuccggagguggagguuucaguaagcagagagagugccacugcacuccagccuggaugacagagcaagacuccgucucaaaaaaaaaaaaaaaaaaucacugagauugaaagugcaccacgggaagucaaagaagagccaggucaacacaggcuggagaagucagaauaaggaaccaaaaugugacagcagggaaggaagagcacagggccgggaagggagcgaugggcugcuguccuuggugcugaaccaacgcugugcuccagggcagcaauuugacuucugcaguuugugguaaccagugaguccugaaaccaauuuaaaguggaaauugguauuguuuuaaucaaauggaacggaguggaguggaaaguaucaaagugcaccauagguaacauuguuuccugaaacuucuguccagauauuaucaucauaaaugaauauauguauauguguucuggguuauaacaugaacuaacauuucugacgacuugcuaaggacauagcuuuggcaaaccauugcucuagggcccaguuucuucuuucuacccuuggacacugaagacucccgaccacuuuuugcaggaauuaugaccaaaguugugaccaagaaucagcgguaggagagaacacaagauguaaaucaagagaaauacagaauaagaaccacaaagagauugugaagggagagcugggaauagguuguuauuguuuucacuuaacaguuaccaaaacuguuuggauauuuuuccugaaaaguugaaguaggaggcaugucuccagcucuacuuccagcuccacagggguuucaagaagaacaugacugcaugccagcucaccagagcccucacauggaaggcaacacugucugcuaaagggugucugucccuucauccuugguccucacacccaaugaaaggcuuuaauguguguuaaaggcucuaacuguaaacugggaauaaugaucguuccuaugugagaagguaguuaugagaauuaaaugagcuaauuuauguaaaguacuuaaaacagggccuggaauccagugaaugcuauaaaaggguuaacuauuccuaccauuucacuuggauauaaguugagauggaaaauguaaagauucccuggcacauagccauuaaaaacauuaaugaagaacuuaaugcuuacacuaacaacauugaggagaaaaagcaagauacaacacuauauaacaguauuaucucaaauauguuuuuaaagaguucauaaaaguauuggaagcaaauucacuaaaacauuaacagcaguuggauuuggguaggaggccuuagauaaauuucuuuucugcauauuuucuucuauuuuccuauuuuucuacaauuaguauguguuuuuauaauuaggaaauccuauacuucaaagacaguaacucaaagucaaaauggcuuuaaucuugaaaugugccauuuugcaagacaagcaauaaaacugaauacaggaaugagggaagcagcgugcuucauuugcacagccauacagauaagccaccacuuagcaggagugugggauuucugacuuucugaucuuucugucauuucacaacugccaaaauggggaauuuacccaaacuugugauugacuuccaaccccaggaggguaaaguaacagagauuaccuucaaaaacccaggacacagaaacaccagggcagauccuccugcccacuccucaaucagacaggcagcagucaguaccagcaaaccuuuuaagcccuuacuauguguugagcacugaguuuccaauaacaucucauuuaaucuuccugguaacucugugauagagguguugucuuugucuccauuuuacagaucaggaaauagaauuuuaagaguuaagaaacguuacuauuccauccuuauacuccccuucaaagcaaacuuccuuugcagaguguuuauauugccugccuccaaguucucuccuuccauucucucccaagcccauuccuaucagauuuuuaccuccacuauuccaucaagacaacuguugucaaggucaucaaugauuuccacauugccaaagcccauggcaaauucuuaaucuuaauuuuacuugcccuaccagcaucuuuugauaacccucucuccucauugaaacgucaucuucacuuagccucuaacaagcucacucucucuugaccuucugcuuucucuggcuguugcuucucaguuuccuuugcugguucuuccucaucccccuguccucuaaacaucagauugccccaaaucuccccugggccuuguucaccaucuccacucccuccccagucaucucacccagacucagaacuuuaaacgucaucucugcacugacuaccccaaaauuuauguuuucagccuaaacuucucccucugaacuccaggcuccuauauccagcugccuauuaaacaauuccauccaaauaucuucuaggaucuuaaacuuuacaugcuucacacaugaaccuaccaucacacccacacucacaccccuucuuucuguagcuuccccccaccucaguagaugacagcaccacccugccagugacucuggccagacaucugagacugauccuuguccccuuuccuuuggaaacauuagaagcaaaucuguucacucuaccuucaaaauauggccaaaauccaacacuucucccaucuuaauugcugccgccuugguucaagcuaccagcaccuccucccaucuagaugacugcaucugccuuuuggaucucccugccuacacucuugcuucuucacacuagucagggggacccuuuaaaggagugcccaucucacccagacucaaagccaagguccucccaaugaccuaucuguccugcaugaucuggccccaggauuccucugaucuacuccuuccacucagccacacaguccccuugcuacucccugaacagacagcaggcuccugccccagggcuucugcaccugcaucccuugugccuagaagaaacucuucccucagaauccuacucgguucacucccucacuuccucugggucacagcucaaauggucccuucuggguaaggccucccuaaccacccugugaaauagcaacauccccugacacacugccuggcccuccaccccacuuucuuuuuucuccacagucgauaguccugccugacguucugcaguguacucugcaucuugcuauacuauuuguugaaugccuuucucuaguccucacuggaaugcagagauuuuucuccauuuugaucacugcuauaucuccaaucccuagaacagcacccagauuucauaaauauugaaugaagaaaugaauggauaaaugaaugaaugagcaaguaaaucuguucaaggucgcacaauaaaugcuggugccagguuucagauuugggaugcgugccuccggagcccacacaccucgcauccauacuccccugccucuggcugcccagacauguugccugacaaccucaaaagucagaaauagccaaccagcacacagccagggaggaagaugguauaagcccccauguggcuaauggaaccaaguaucugaaauaagauguuugaauuggaaaacugaggacauauugccaugacaguaaaaccacgugucguucagcucagcugggauaggucagcauugagaguggucauagggcugauuuccauguagagcgggguacccacaaagccccacaaagcacagaacaagcauuugcccuugauuccaagaaggcucaggagaugcaaugcagaaaagccaguacgaguccaucuucaccacuggggaaaucacccaaaacccugauccuaccagcagagccaaccucugcuucaucccucaaagacagcuuggacaaacaccuccguccucuuugcucauuuggauaauggccccccaggcaggaggacacggguauuuucagcacauuauggcccaaauccuuuguuuuaauuggucccaggcauuuccacuuuuagagccuccuucacuuacuugguuuaaagagucaaucucugaaugauccaauaggagcccagagaguagauaagauagugagacuaaucuauaacauuuguguuuaaugguuagauauuaauuggcuuuuuaaaaagugcguaaaucgguccauuuuuagucuuucuaaucuguugguucucauuaaugaaggagcaauauucaucaacagcucugcacuacacaucaccuuguaaaacuauaguccguuuauuuuuaaaaaauagauuuaucacgauuugaaauauagaaagucauuaaaauaauaauuaaaaacacaacuacaagcacaauaaaaguuucaugauaauaaacuacauuuuaauguauauuaauuccccuaaugauuuacuccauacaucuuacagggugaaaucaaugucuguaccaaaaaaaauucaauuaaauucuauucacuguaucuuucaagugagucuauuguuugcuuuugucaccuaucaggccauuugucaguuguucuagcucaagauuacaaauagaggggacauggccccaucaaggucagaagaaacacguccaaauccuccccaauccaccuuuaccaucuccugugcauuugucacugaugaccuuguuugaggagaggaggaggagggggaggcucgcuccaguccauacuccuaagcaagccaucagucugcgggcucugacuggcacacucucucucaugcucagccagccugugggccuccaagcaagccccugcaaagagcaagcucagacugucccucuuuaaacuuccucuugccccaaaacacacaccaagucagcgccucucuuccaaagcucacuuccccucaguguucagagccagaaaaagcacaucugcuuuccaguccccugcaccaaagcaagucuuugccuugccugagugauuuuucuagacuuaacacucacacacaaucuccaugcugagaaaacacugcuggcgacaguuugacaagcuggagggcugccugguggaggcgacugggaggacucccucucugguccccucccuauaacccacccugcccagagaugccucggaaccagcaggaagaccuggguucagggccaggccugggucugaguugcaaccugggaucgucggcucaaccacucccuuugcuggugaccacuagggggcaacaggcaucaccgugaugagagagaaggucgugcucaaaagguugugcaaagccagaggagcuuucgacuuuggaaggaaaagaaaucacugcagagccucauucuaucgcugcgggaagacaacagcgaccaccaguaucacgcccauuuuucaagugaggaaaaacaaguaacugaaugaaaaaugauuuacuacgggacccaacaugaauuaguguccaagcugaaauaaacccagauguggcugcugcauauucaggcuccuucaugaauucccgugaaaguccagaaagugcaguacaauauccacgccuccuuucuggccccuccguagcugcgaugucggggcgccuaugaagcccuuuugagcccgcccccaucugaugcugcuguucucugugugggcagaggaaaggagaggccagugcagccccugaggcuggcggcuccggacacuucgggccccgccucucagaaaagcccguccugcuccagagagcaaagggugcauccuuccgagggagcugcggcucaccggaggccccgcacauccccagcggaggagggcgagaggacgugaaccagaggccgcggcaaggaguagcaggcgcagagcucucauuaaccaagauggccucacgcuggugccgggcuuuauaagucucagcugcacaaugcuuuuuaaaauauaggugcaauuugggccugugguuaauacuguuuaauuuuauuuuguacugcguaauauuuucccaaguuaggcccaggguaagucuggagucucagcuccaaacuuugcugauuuggcaaauggauccaguuagcagccacacacaagcccucgcuaccagcuccucugccaguccccuguucccacuccacucucagaggccacagcacccccagagccugcuguccaggcucucuuguuccucuccccucacgggcaccccacuacccacagcccacccuacggagaggcagacagacccuguggucccugggaccagauggcccaaacgguccgcugacaaaagaccugucccguuggcugacccuuggcucaauucguguguuuauucucccagcaacuacugauugccccguugccccgugccaggcccccugcaucccauuuucaguuuggaaaauaugaucacugugaucccgauggaaggaggugaggcuccaaaaaaaggaauugcauuuucuaauucugguuccaccacuuacaagcugugugacccugggcaagucaguuaacaucucugagucucauauuuguccuuggagggucucugggagggcuaggugagacgaagcaacaaccaccuucugcauagcauguggcaugcaguagguacucacuaaaugacaacggccucuucguggugaaggaugacaaucuuucccaguugccuuuggguuaagggaacaaucauaaaauaaagacauggccggaaaugggaaaacacuccuaggauaccgggggcccagcagggucaagggcauggcaggaggugucugaaacuugccuuuccugcucgccagcucugcggaggccaggccugcguccagcuuggccauuccucccaccgucccuggguucucgagcaagcgagugaacaaagagagggagcaacuuagaggagagugucuuccugcuccacugucaauuaucugcacaaaaacaugcugauauaucugcuuggccaaagcacccgguaagugcuagcauguaauaagaaagagaaagaagauuuucacgcccagcaugcuaagaaauaagaaaaugacucauagucccagggcagccuuucgaguggcuggcagggccccugccacugagagaggcccuggcaggcuaauugggagcugggagcugaauuggccggauguucaguagccaugaauuuuucugaaucccaauaaagugccuuuuacuuuauuuguccagauuauuuauaaauggauuuuucaauaaaaaacagagcucgggaugcaugauggauuuucucuggcaccucacacagggcacguucauccccaucguggucugccuggcccaacagcacaugccuugaucaggccguccucucuuugggccauagauuggcuuucaauaauuucucagaagcccguggguagucaccaaauuuaaacucauguccguaaaacucaaauucaacucaauaagcguuuauugauaucccacgacauacaagauauuaagcucagugcugugcuggagagaggcgguggaagaggaaauccaagcaucuuaagcgucuugccauuuagaaaagaacguacuuguguacaaaacugagcacaacacaaugagccuggagaaaggcuaaagcgaccacaccgcugcaugaauacgagggcagaugucuuuugcuuucaaguaggauauuuugggcugcaaaauuacagaaaauccaaccuaaauuaccuuaaagaagaaggaaaauguaccaucucaugucacaagaagucuggagguaggguugaugucagcuggguuccuucucucggcucaaccaugcuaugaccuugggcuggacccacauggcugcaaggugaccauagcggccucccauaaccaucacauuuuccaaaguccagaagacagaaaucauacacccuuuuuuaagagccaggaaauuguccuagaagugccuagccaucucacuggcaauaacugaguuacaggccgccccuaaaccaaucacugaccaugaugggcuuagacggaucuagguuuauccccugggacuggagagggcccuggcaucuccccaagaauuuggccacugacaccugaacacagucaagguccugucggcaagaaauaagacgggaaugcuauuggggaaaccaucaaaaguugcccuugccugguaaaacugauccucucagaagauguucuggguuaaaauagacaaauagacacacaauaaaugcgaggaacuuaucuaccuuguucuuugccguaugccuugcaaggaacaugguucccagcaugcagcagauacucaaauauuuguugaaugaaugaauccuggaauuaaaccaagaggcugguugggaacagagucaagaucauucaaaucccccucagaucucagagaagcagaagaagaagaagaagaauucagcaaguaagaaccuaauugguugcauugaagccuguuuaaagaaagacaaugcuuaaagacagggaacuuccuaaggaguuaaaggaguccuauuugucuagcacuguccagggaagagagacccugaguacaagggacaggaacuucccagccccgggagaggccuucgucccuaggaagcagagauaacucuuccaccuuuuccaugccauagauuuaccagcccuaccaacaaccucccugcccuuccaauucccaacacuccagccaacuucugaugagacagugcuauggguaagggggugccccguguggggacuggggcauuccaagcacagggaaggugucuaccuuucaccacaucuuaauaacaugacacccaguuuaugugcccauccagcaggagucaacugcuuacauauuagaugcugcuuccaggcugagagucagcgauaacaaauguccugccuugaucuaaucaagccaauguaaaauagcaaauacagucaccuggguaaaggacaaugccauguuccucuaaacugagccuaugaugcuucccagaugacaauuuagcccagaaaggaaguaaaacuuuccuucccuuggcuuuaccuauuauucaggaaaaguccaggcccugaacauggggcuaacacagccauuugggaagcugaccgucccgugucgcagauguuguuagcaucaggacuucugaaagaaugcaacuguuuacuuaacagacaaauggacauuuaauauuuaagguuuucucuuuaagcaaggagucagcuucaacuucaugcacuuugcagccugaugcaaguucuaccaaauccauccagaacaugggaaagaggggaagcauuucauuuucagagguuacugaugcucugugucgaaaauguaagcacguuuaucuugaaagcaguaaaaucugaucuauagauuuucuuagaucuuucuaagucaguguugaccagggaccagaaaaaucugucucaacuucuuuaaaugacacacccuguuuaucaaucaaaagugugugugccuugucccacacuguagaucccgggguggugcauagccagcccaccugagaugagacacugagggugggaaggcccuaagcaugggccaaggccaacagcuacagccccaggagccagggaugccccugugaugcuguugcccugggagaagaagagggaaccacuagaaaggagacgauuuguagagcaucaaagggccagagagaaaagaccccucggagaggauggucucagagaagaggggcugaacuggaagcaagcaauuaggacauaaacagguaugaggucaagcucaaguggccccagaucccaggcucagccccucccaguugccagucaguucugguguaagcaccagcaggucucauuucuccgccuugugcuugcucagggugccugaggcucagcugcugccagcaagcgccaauggcacagucaaguuuaagccagugcugcguucuucuccauuucacacccagucuuaagacugcuuuacucuuucacaauguaagggaauagauaaacaugccuuaaaggccacuugcucuuugacagaagaaaacuauuuuaccagguugaaagaaaaaucauuauuucccugacuggucuuuucugcagucagauauuuugaccuagggcuuccaccuauccacggacccaucucccuuuucuggauucuuccaaucagcugacauggacuccaacaaggugcagcugucuccucucucuucccuccuauggccaugaaauaagcacccccaccugcuccagguagaaucccuccagcugcgcccuggaucccaucuccuguccccuccuccaggaccucacuccuaaagcgggcuuucuucugcauaguugcccagucaaaauuaguuucucuuccuuucuuccuccagcccucucuccuuccuccauucccauccccauucuuuuucgucuccucuauauucacuacaaaacuucccgcuggccacucugaaccucuaggucaccaaauccaaugacgccauucucuuaucucagcuucucaguggccaggcccucugggaaaccucaugggcuguccaucuuccugcaacaacugguucccccuucuccucugccccaucaccaucuccuccuccuuccccugcccucuaagugccugagcccugccagauguuguugaugacuuacaaacucaggucucaagccuagguccuucugggagcuccuggcccaggaucugcuagccuauguggccuccccauuuggcuguauaaagagcaucccacauguaacgugugcaacagagauuuuuuuauuugccuccucaaaccuguuuuuccccaggcuuugccuucucgguagaugacacugcuggugaccuagguacugaagcugaaaaccuacaaacucuguugguucuaacucugagggacauccccaagcuguccucuucucuucuucuccccucccagauccucaucuaaguggcugccaugucuugccuagauggcagcaggagucacccaaccagcuccuagaccaacaggaccucagaauacauccauggacuccucuguccuccuacagcccccaccaugccccgaaugggacuccugccaccucccccacccuccaguaccagcaugcucugcaaucucuggacuccagcccccacuuccuucagucccgggacaugcuucagucuuucccaucuguuugcuguagccguucucuucacccaaaauccuccuuuccuggcccuccacuggccaccuuccucucuuccuucccaucucagcuuaaacugcugccuccucagggacuacccccucccuccccaaccaucacccuccucccagcacuucuuccucugcagcacuucccaccagggaaauucgcuuuaucuauuuacugacugcuauggacugaauuguauuuccccaaaauuaauagguugaagccccaacccccaaugcuaugguauuuggaggugagaucuucagaagcuaauuaauaugagacaagucaugaagguagguguccucaugauuauauuaauggcuucauaaggagagagggagggagggagagagugagagagagagaacaagaggaagaaaagaacaagaacaagaggaaggagcaggaggaggagcaggaggaaaggggagaaagaagaggaggaggaggagaagaagaaggaagaggaggaggagggaagaagagaaggaggaggaggagaagaagaaggaggaggagggaaggagagaaggaggagaagaaggaggaggaggaggaggagaaggugaaggcaaaggcucccaccauaugagaaggcagccaccuggcagccaggccagagccaucaucaggaaucgaaucugccagugccuuaaucuuggacuucccagccuccagaacuguuagaaaucaaugucuucuguuaaagccacccagucuaugguauuuuguuacagcagccugagcagacuaguacaugaauuuauuuuucucucucccccaacaaaauaugaacuucaggaggcagaaaauguccccaacuuauucaccacuguguucccagcaucccuggcaggaugcuaaucgcacaaccagugccugaaaaagugugguuguugaauuugcucccacuuuguagguacaacuugcugauuuuuauaagaagaaaaugucuaauaaucuaaguccaaaugcaaaugguagguccagggaagguauuucagaucuaaaauagcuuuaagaccaaaagcagagggcagagcaggggaggcuacaggggaggagauauagccauaauucuucagaagaaaucuuucaagaguuggaaaguucugucuagaagguagucugccccugccuccaaucugcaaugcagcuaaacuaguguuucccgaggugugcuccguggaacauucucuccagagaugcccugcuaagauaaagggcagggaggugcgguggugucguggucaaacggguaagcaaagcgcugcagaugacaccucccucugggaagcugcgccucagcacacugacgggucugagagguguugcggaagagucgucccugucuuuccacuaggaauucuaggccggauuugaccugauguuagggggugaagaaagugggagcaaauucaacaaccacauuuuuucgggcacugguuauccgaucagcauccugccagagaugcugggaacacaauggugaguaagucggcgacguuuucugccuccugcaguuuauauuuuguuagggaagugagaaaaaugaauccguguuccccaaaaagauauguugaaguccuaaccccuguacccacgcaugugcccuuauuuggaaauaggagcuuugcgaugucaucuaguuaagaugaagucauaacggaguaggaugggccccaauccaaugugauugacgucucugcaagaaggccacgugaaaacagagacgcacagguugggggaggccgcgugaagauggagcagggacgggagugaagcagcugcaggcagugaauagcagacgcuaggaggggcgaggaaggauccgccuggagccccagcggaagccuggcccugccgguaccuggacuuggaggucgggccucgggaacuaugagagggugcauuucuguuggguaaagccacccaauuuaugggacuucauggcugaggcagacggcaguaaacgaacgcccugcaacccuccgucuucugcagcccccacacccgggcccacggcuccccaccccacagcuccuuagcgcggcugcucgguggagccugugccuguccguguaagcccucagccccuuucuccacaccucuccccggcgcccagccauugugcaaccuucuuggcaccggccgcucgagacucacccccgggcugggcagcccauucccugucacucauucuguguuuugauccugccucauucuaucuucuucuugcucacuuuuuacacuaaaaacuuuuacauuagcugacuguaaucuauguuuccuuauaauuuacccuaaauauauaacucaugacacaauauuaucuaugucucaggaaucuaaacccauucuagacaaagguggaauauaaaucaauauauauacuuuaaaaauauaaugggaccgccgggggcggugacucacgucuguaaucccagcacuuugggaggccauggcggguggaucgccugaggucaggaguucgagaccagccuggucaacauggcaaaaccccgucucuacuaaaaauacaaaaauuagccgugcgugguggcgggcgccuauaaucccagcuacucgggaggcugaggcaggagaaucacuugaacccgguaggcggagguugcagugagccaaaaucgugccacuucacuccagccuggaugaaagaacaaaacucggucucaaaaaaauaaaauuuaauauaauaggaccucauacaccgucaaauuaaagcccucugcucacucuucauggccuuuggcaccaaacaccagccccaagggaguccugcucuucuucccagcucccuccucugccagcgccacccccugcucugcugccacugccccuacuccagccucucucuccacccuggcacugccccuucuccccgccaccccacccccuccucugccgccaccaccccaccaaacccacccugcucucccugccucagggccuuugcacagcugguuuccgccgcugacagugaauaucugccuguuccucccuggccugucugcugagcuccugcucaaaaucuggccuggucuugaccucuccaaaaggccuuccccaacacuugguacucaaccgagccccucucauccacacacccuccaccaggugugacauucagaauguuuaacaacuggucuggcacagacgccgcuacucagaaugaugcaggccagcgcagcaugggcacuggaagcucgggugacacccgcucgccagcagccacagagguauuucaacggauuagcaacugugcgcgcuggcgaccagcaggacgguggacacguauuuguggaguuguacagggcaccccucaagggugagcggcucugcucugcuccgggcaggaccgggucucagugccuggcaucgccccuggcguggaggggggagcuugguuaacauuugucaaaccgaaccaaacucuuuugggcaaagacaaaauacagagaccgaggauuuucccagacugucacaucuccucagcgagccaaauaaaaccuguuccuggacagucuguuugcucagauggugagucugucagauuucacagcuucagcgaccucaugaagcucugaccugaaaauaaauugagagggaauaaaaaaagaaggaggaagaacaagagaaaaugaucugcuccuccugaggccgcucuuuuggcaagcacgcuccagucgguuccaaaaaaacaaagggaaaucuucguuaugucagaaaaaccgacauaaaucgccagcaacuccgcuuuccuggcaacgcuuuccgugcuccugggaaauuggaacccaauucuugaacaauuucaaugcagaagccuugucuuauguuauacaagaggccucaaaacuuuccgcaaucggaagagaaugucugcugcuccagguggggcaaaaagucaagggacaggaagccgcagggccgugagcaccucaggggcgccugcacuggcagcucugggcuugugcuuuucccaaggggucuaagacacguguacaggcagaaaagcaaccacccuaaggggaccccgccuaugugaagcaaaugacugaacugucacagacugaacugugucccccgcaaaauguguauguugaagcccuaacucccagcaucucggcaugugacuggauuuggagacggcagucuuuaaagaggugacuaaguuaaaaugaggcuaucagugugggcccugauccaauaugacugguguccucacaagaagaggagaugaggacacagagagacaucagggagccgugugcacagcggaaacgccaugugaggacagggcaagaagacaccgucugcaggccaaggagagaggccucgggagagcccaacccuauugaugucuugagcuuagacuucugggcuccagggcugugagucaguugguuucugcuguuuacguccuguuuguggugcuuuguuauggcagccacagcauacucauaccacccccuaggaaaggauuuugccagucuuaagguccccaucaugcaaauuacccacuuaagacucacaggccuguagguuaugcacauaaaaguuacgccagaagucccaagggaucuggggccuggucuaggggcagcuguggcggcugcccaggcugggguuggugacuugggcugaaaccuggguuccucagcacaucugccguguggucugagccuuagauugcuccucucuaaacaaggguaauaacagcaucugauucucagcauuuugugagauuuagauccuauuauaucuuuaaagcacuaagcauaagugcccaacacaauaaaaaguucaauaaauaccaccauuucuauucuauuuucaacacaccugauucccugauugcuucaggcauaaauaguacaaaguuccccuaagaagaaaagaggucauccuucgaacaaggcuuaagaaacaaggguaccacgacggugaucauaucauaagcuuuuguucauuuuuuuuguuuuguuuugagacagggucuugcugugucgcccaggcuggagugcaguggcaugaucauaguucacugcagccucgaccuccugugcucaagcgauccuccugccccagccucccaaguagcugggacuacaggugugcaucguugugcccagcuaauuuuuaaaaaucuuuuguagagauggggucccgguauaucguccaggcuggccucaaacuucugggaucaagugauccuccugccuuggccucccaaagugcugagauuauaggcgugagccaccaugccccgccaagauuucuuaaacuccucuaacuuccccagauuuguuacccccaccucuuccacccaccaccuccuugacaaaauuauuuuaaugaaccauucuugagucucugaggucaguaaggaagcaggaacuucaaagaaguccuucucccaaaccugucuagagagauagaaacaucugggaaugagaggagcagcagcagccugggaugggaaaggaaggcacugggggaucccaaggagccuggugaggauggaaaggagagcccaggaacccggaugguggcccagacguugcacccuccaggaccucagaugagccaaacguguagcuugccagcccacgaacucaggucuguggguuuuucacuagagucuagaauuuggccuacagagccacagaaauggccugaaaacacccaacaggaaagaaagagagagagaguguguguguguauguguguguguguauguguguguguacaccauucuuuagacuagcuuuagucacuggaaguugucugauuucucagaaauauuuuucauccuucuauggcaccaggauaacagcuagaaugugcuaguuuaaggaaaggagcagauuuuaauaaguccuggccucuauguucagacccuagaacuuuggcaaaucugcccauccagacgucaccucugacaaaggggagcccggccuucaguggauucugugccuggaacuccaacaccccacagaggcacccccuccucccuacucauuaaacaucacuuguucauucuuugcuuauucauucauuccauggacaucuacugggcaucacucugcaccaagaaacuacaucagcaccugccccggccuuucaagcagucgcaccaacucagagcaaugaguugcgucugguuucuaccagcccagaagcaaggaugccaggugacgacuccacaggcaggaaagugguccacgaacaaagugcuuggaugucuuuuuccacuuuuucucuuaaaaagagacagaaaugagaaaaccgucucccaucucugaccaaggaauacauccugaguguaaaacaaaucugcacggcaaggaacucucucagccccagggggaauggggguggccaucggaguccgcaggagaaucguguccuggacauucuagaugcgucgugaugcggggugcuggggaaaggguccugagcagcccacagccccaaugucuggcagggccauagccaucuggugugaggggaaagagaggaaggggccggucuccguccugccuggacauuaccccagggaauaucagccaggauugugcucuguguccccucccugccucuggaacagaaauuugcucuuacuccccaccacacauucugcaacaccaaaauggccuggccuggccuggcuuggugucaggaucuggggguccagagaagggggcauccucagauaggaagucuccuuaccagcuguggcuccaaaaguugguggaccaucccagcucagaagggaaggcuguauggccaaagcggaggucuccuaacuggaucaacagcaaaccgugacuauaucugggccaggggacuugcuaugccacaaccucaucuguauuucaacccagauguugucaggacuaacugucuaagaggcucaaagaaaggccucacauaaguguaaacgaaaugccagcuccguggaccacuucaccuggaugccuccagcccgaugacaggcucucagccugucggggucagacuaguccauugggcagcuggacaucuucccaggcaccuaggaggccccugacauuuggccuuuucucugggaaaaauggaaugcagccgcaacagacugugacuugaacugcagcaagggccaccccgccgcccugagaaucagccaagccugcugccugccacacggagggccauaaaauccacccuagucccugcuuaaauaccuguauaguugauuuuuuaaaaacccuguucuggcugcgacgcaggugcuucgaaagauccaucccagggcugcuccugugcacacugcaggacccaggggaaccgggacgggagcucgccgcgcacaugugucuccaagcugagaaacccaaaggcaaaacuggagauaggauucaucuuccaaacaggugaauucccaaaaggaccuuggauugcaaacacauagaaaggagcccagacccccaucucaggccugguggagaagagcagagggccaggggcucggucucucucacuuuccuccccacccgagagaagggccuggcccuaagccaugcaggugggaagugccuggcccuaugccaugcagacaggaggagaagaggucauggucuagggaagaaccagugaaccaugagugcgggggaugcugacacugggguucauaaccaagagucuucugaggggugucccagcggaaccacccagagaugagacgaucggcucucauggccccuauagcuuugggagggaaagacaccaucuaucugugucuggucaccugucaaaacuccuuugaaagaucacaagcuucgguacuuucccagcagugcaggccccaucucccaaggcuccuggcacccaccccccaccaccaacucaucucuccuuuccaagggugggcucugggagucccucgggggucugccuccccauccccugacucugagcuccucccuugaggagggagacuaagucacccucucuguuuuucccagcaccaaagacaugacacuccauaaacauggguuaaauucauccaucaaugaauccucacagcuggcauucuguaccauuugucuuaugucacuguuuuaacagaguacauuuuuuauuuuuuaaaauaaaaagagauggagaggaaauuacuccaaaacgccucucaggugaucccacaaggccucagccugaugggucagcucaugagcccccuucccaccugggggcugcaucuucucguggcagguucaguuacuugagggguuaaaaauaaauuauugaaaauauaaauuuaaauauucaaaaccaccaaggaaacaucaaaagaggccauaaaacugugcaugugugugaaaugcgauuuucuuggcugacuccagaugaggacugagccuaaagcuguguaacccacaucaccugagcugucacuccuagccucuggccccggggaccagcucuguguccuucugauuauaaguucaucucccacccauaucgaguguagugagaaucccaggccccacaugagucgugcagagaagagcaaaaggcacaggaucuucaggugagaggaagacacagcccuccuugugcagaggaaggggcaggugacucgcuguaacucagaggacuccccagagggguaccucugaccagcccuccuugugcagaggaaggggcaggggacucgcuguaacucagagggcucugcagaagggcaccucugaccaaaauuugcugagcccugaaguacuucaucaagacucauggcagggaggggagaacguggccugggcccccagugugccugggcagguaaacuccgggauagaaaauagugagcaaacggacuggggcccacuggcgggagacagagggccucccacugugaugcugccgcagccuccugauaagggccaagccacccaggugaagguaucacaggacacucaggugacccaccucgaggccaggucuccauccaggccacugucacuucccauggcauccggcacagaagggacacagugaaugcuugcugaugaaaucaauaagaauagguaacaacagucuaacacguguauuguguguuagaguucagggagucucuuuuguguguucuuucaucuguuccugaggacagcccccuuuccuugcaggaagaacuggggacucagggaugcuaagucaggcuggagccacugagagguagagccaaaccaacccaggacuuggaggugcugugcacagaugcucaacacugcuguaaagggaaggcucugguucuuaauucuggggcuuuccuuaauuuaguaagagcuaccaguuaauacuaugugcuggucacacauucucauuaaucuccuaacaacugaacaagcuaggugcuauuacuaucugauaugguuuggaucugugucuccacccaaauuucaugucaaauuguuaucccugguguuagagguggggucugguaggaggugacuggaucauggggguaggguucucgugaauggguuaguggcauccccucggugcugcucuugugacagcgagugaguuucgcaagaucugguuguuuaaaguguguggcaccuccccacucucucucuugcuccugccccagccacggaagaccagccuacuuccccuucaucuucugcuaugauuguaaguuuccugaggccuccccagaagcugagcagaugccggcacuaugcuuccuguccagccugccaaacugugagccaauuaaacuucuuguauuuauaaauuaccagucuaggguauuucuuuaaagcagugcgagaguggacucauauaccaucccauacugcagaugagaacacugaaggccagaggcugcucucccgggucacagagccggaagugguguccguguaacucaaguguggcacagcccgacuccaaggucacgcuacugccuguuccccucagucgcucucugccaggaggcaucccuucugaaaacucuccuguacgacccccucaccaccggcaugcacagccccaccagggcuuguccaguuguucaagcaacugcaggucaggcucagcccaucuuuaagaggagagaacuugcugcugaacccccauuagcugcuuccacugagccaugcaaaaaugaaagagaaaaauagagaaucaaaaaaaggcgaagaugugcaugaugugcaccagcaggaaugaagccugaauucacccaucagugcuucucaagcucagaaagacccaggaggcugcuucucgucauagaaacccagacaugcagaggcggccuggccucucuucuccuuccuuccuugugggggaggacaugagcuguccccaaggagaguuguccaugggccagcagggaagccaccacuccccacaucccagcuaaacuuaggguaagaacagccccugcuggucucccagcaggaaaucaagugggcaggcccaggggaccccuguuugugcaacccaaguuccagugguaauuaagucagaggcugggcuggcagugaggacgauggucugugcuaaguggugacaggguuacccacagggaccccccagcccaggacacaugugcagcagaggcagcaggagcagcaaguccccaaaaugggcaagggcaggccaggauggguaaggcuaacagaggaggagacagcgccagggauacugcuuuaagggcugucucccaccaggaagacuccagauuccacgcagcauucauucacucauucauucacagagacaugcugagcaaccaaccaccaggucccaggcccugcuaugggcgcuggggacacaguaaaaccuaaaaauuccuuucuaugggagugagagggagccaggcagauaccuggggaagggcauugcaggcaagaccagcaagggcaaaggcccugcuucgagaaguggccaagaugccuguguccccagaguggagugagggaggaaggggaaggggaugggcucagaggggcccuggcgggugggggugcagauccugucacagugaggacuucagcaucuauccugagugagaagggggcccugaaaggcuuugagcaaagacgugccaugaucugacgcucauucuaacaaggccucuuggguggccacguggagaagguucuagagcaagggcgcagaggcaggagugaugcaggagaccagagagggggcugccacgcucccgcaucacaccucgccgcgagaagacagcggaacuaaugauggugggcauagagcuucgaugaagcucugcugugaaggaaaaacuagaaacagaacuggagggaagugagucgcgaugggagcauacgcagacacugaugggaaagaaccaggaaggaaggaaaagaagcugccaccgcaggagagggaagggacgcugcggcggcaaacacuuggaacuggccaaagggacagggucaaguucaugagugaagaguugcccuuggcaaggagcaugaggguccaucccuccagccgcccccacgagcucccuccuccccugcauggcuguguccgcucuuucccauucccucagcagaguggccgggcgaggcuggcagggggaagccagggcagugucaguguuguucugacugccccugucuccucugcucugggcgauggaaagcaggucagcagcugcgaggagugcggggaggggagcaggguggaggagggauaagaggggacggcccggcccaagagaccagagagccagacagggauggauugacagcacggaggagggucgagggacagcacggaggagaaucagacagagccaagggggcacuugaugcuggugcugggaacugaaggccagucaggcugcugggcaggugugggcacagcucaggaggagaaccagguacugggcgggugugggcacagcccaagaggagaaccagguaugaguagagcuggacgagccacgcaccuggucaugugagcgaggggaaaggggcccgaugcagaaggcacgugggcgaggagggaccuguggaaucugagcugagucggggagggugugagaccaggaauggcuggggcagcacaaagacaccgagggucccuggauucugguguugaggcguggcuggacuguagacacugggaggagugggcagagaaggccagguagucugaaugggcuucuggaaccugagaugguaaagcaggaagccacagagaacagacccagggccuagggaugagucgcugaacaaggaggucuuuagaggggagaaagcccaggaacugagaaaccaaggugucgucggagagaacgacacgaaacaccacaacacaggagagggcuggacaagaacccgccagcgaccaucagggagcaaaaaagaauggccccagggcccaaggguggccccacaagcagcaguggggcgugaagcagccgaagaugcagacucaaggacaaggggggacagugaacuagaaguggcccuggggaccaaggauacccacccccccgccccaugccaaggcccaguaacacucaggccgagaggagaacacagccuccacuugaaagggcugaagggcagcaguguccccacggcagagccagagccccugagcggaagaagggggaggcugcggagagggggcuuugcuaagugcagcagguucccaaggaaacacagaauguuccaggagcuggggugggagggucaggagagggggcguacagagcccuacaggaacuggaguccaggggcaaggguagacugggacaccacagagcaccaucuuggguuuaacgggaccaccuauucgaaugaauacaauccagagggagcagccucugucacaggcugguccugagucuguccuggcaaacagggaugagucuguccuggcaaacagggaugagucuguccuggcagggauguuuccucagaagggacagucuaucaaagcaccaacagcaacugagcccccaagugcaucagcaaccucggacacccaggcugggggcaccugaagcagcucaagaccuggcaaucaggacccacuggaagaccccacucacagcgcuggguagcgggaggccaaagggccaagaggaaccagaggucuccguccgugcagccccaccugcccaccccacgcagcuccaggauguagcgaagagugggucuggaagugucugccugggaaggagucugcaguagcgguagguaaucucccuacugccuucucuuggggcugaacggucacugugucaccggagaagccugcgucagcugccgucugccucugcacguggccaucucccaaacagcucacugcguucugaaugaacucagaaauugccugccucaauucugagauuuucagcucauaagcacugggagagaacguucagacccgaggugcuguaucaaccuuccgcuaagcacuccuggcaacauauucaaugucgacauuguucaccgugucuccagaucaccagagggacgugggcaccuugccgcagcgccucaccaaucacgaccaaaacauaaaggggcugacuuaggggccagggccucguuccacaugcaaacucaaauuacaccccggaaagaggcagcacagucauucucccugugccugggaacacacaguacagagggccgggcuuccagcgcugcucccugcaguggggccucaagacgaauggccagcgcuccugugcacggcucccauaaauaccccagugugauguucccauuucuccuucccagaguccccucuucuccgccugccucacccugacaaggacuagaaacucguggaggccaaggcccccuggggcuccuuccccuccccaccauacucucuccuccacccacccuacccccaccauugccuccacaaauuggagucccucaccuaagaaauagacaaugaacucuucuaccuuggugauaaaccuacaaagacauguucaaauagccugguacugccgagacagauaucucaacugggcacugccaggugacguuugcagaagucugaagucuaccccgugacuucagcccuagacuccacacccccgcgauguguuugaugcagccaaggccuguuugagagucuucaucugaacccacacccggucgggacccagaguggcaaugagcagccagagugugggcccugcaccccagggacucagcuucaggcuucuccgcccuggccccggagcagacagaugccgucucuggaguagcucagggugcaggcagcuuauuaucuacagacucucuuccugccccaucuccccaggaaggcaagacaaggaggcugugguccuacccccagcccuucaccaccauggaggaccagggugcaggccgggaacagccgccugaguccuccguggcccugccggucacuuccccggccucaccuccuuccacguccucucuccaccagcuccugccucgcagucucccggcugaccuucaaacacucccagugcaaucccgccccaaggacaccgcgcuugcaguccccuccugggaacgucuuugcccagaugucccugggauucccuucccccgcuggaccccauucccuccuucacuuucccacugggcucgugacauuuacuccucacugaggaucccccgaugcccuccucccaccagaacaucagcuccuugaaggcagagacucugggcugcuuuaaccaccacauccuaguguccaggacagugccugacacacacuaagucaugggaugaauaaacacuuagaaaagcaucugaacuuaauagcugcuguuucuuuaaaaccaagagagccaggcauguaaucucuugcacuuugggaucccagcacuuugggaggccaaggcggguggauccaccugaggucaagaguucgagaccagccuagccaccaugaugaaaccucaucucuaguaaaaauacaaaaauuagcugggugugguggugggccccuauaaucccagcuacucaggaggcugagucagaagaaucgcuugcacccgggaggcagagguugcaguuaguagagauugugccacuauacuccagccugggcaacagagcgagacuccaucucaaaacaaaaaaacaaacaaacaaaaaaccccaacaaucaagagacacaaaaugaagauggaaugcaacaauaugcauagcaggaucgaucacacuuucccagaauagaggauguacgugaaggugggagacaggugagcuggcaggcccugcacccccuggccuugacgcugcccccucccuggguguuccuaaggaacaucuuggcuucuggcucacugccuuucugacugggcaguuuccucuaugcuuuguccauauugguccccgccggaucuucagcuuaggcugagaccccagaaccagccuguaguucguacaugaacccccagacuugaaacaagcugagcucgcaguccggagaauggcugaugcuggguccucaaguuaacuagcugacguucagcagcauuuuccucauguaccguaucagggaacuacuuguuaaaaugaagccacgcauuguacuuuccuaagucggccugagucuggggagauuuggccugucuguaaguuuaauuuuaaacuaauuccuaaagcuggaggagauuugcaacacagguugacggcucaucuuagagucucagaaguccugugaacguucucagaugcacuuggggaaggccucgucacaaagcucugcuucaaguggucauuccuucugaggaacacacagacugugucugcacacaccugcagguccuuacaccugagugcggugcaagcugcagcucccaagcgacaaaggaagccgcucacuucggacucaagaccagcugagaagagaaugaaaggaaggcaagacuguugcaagggaaggcucagggacaggugguggugggcgugcucaggacacucccagaggaacgcuggaucucuuacagagcucaaaugggaugacugcucacucggcaggugcugcagaaucucuccgggcaaaggcugagauuagggcccagcuggcguagccacaccaaagccaacagcagacgcuccccucuccugagaagacccauuccugaaacuuuuaauuuacuaauuccaucaaaaauuaaacuuuuaauuguacuuuguuuuucaaauggcucccacugugacucucuagguaguauuugucucacucugguaguuaccuggacuuuccaauuguggugguuuauuuuaccuuggagugacucuuuuuccccuuuuuuccacgcucuacaauuucuccuugucacaauuauuaauagguucuguuccuaaagccauaauauucaaaugaucuuaauaaagcacagcucuagggccagccagccagcaaaagagaaaaucuugauccccacaaguccaggaagccuccacccuccccgcugaaauccuccaugaccaccccccuccccucgccuggccagacaggcugcaccauuaugaccaagggcuuccucugcucucagaaugacucagccuagacuucaccaacuggcuaaacagggaaucagcuaggggguagggugagagauguccuaaaaucucuucuuugucaaugaauacuagaaaaagucaccuggugauagaagcuucaggguuuauacagaacccaccccaagucacagagcucuguugcugggaaggcauucagccuggguggaugacauccaggcauauccccugcucggaugacgcuccaccaccaucaccacccaccaaguggagaagcugcacuuaucagcuucaaucucuaauccuaguaaccuccaaaaaaaaaaaaaaaagagagagagagagagagaaagccaaagccaaccaaugagcaggaggaaaugaggccgcaaagagcuucgagacaugcaaccacuuuggagacacuggccaguuaaagggcaacuucuagggucacucagagccucaggacaccuggcaagaaaagagaaugaaagggaggaagcugaagaaggguggggacaggaauggagaagagagaaagaaagguaagcggaagagaggagggacaauggagaaauguaaaucuacuugacagccagagaccuuauccuucagguccugcgugugccaguuccuccaucuggaauucccuuauccccuccugcaucuagagaaugcagaguccugauuuaagacugugcugaaguguaaccuugucuguggaguacccuccuucucaccgaagggagaaaaucuauccuccugaaccuuuagucaggacaagauguuauacugcaguaacaauaacaauugacccuaacaguucaguggcuucaacaaaaagccacuuguucacaccacacauccccugcauguugugggggaggagacuccacuccauguagucacucagggauccaggcugcuggagccuccaccucagcacaagcagcccugauuacugagucaggagaagggcacauagcaaaccacacaugucacuucugcucacccugcaugagccaaagucaguuguacaaccacuccuaacuucaaagggggcagggaggaagaguuccaccaugggcacccaggaggaaaaacagaaauaucaacucucagugcuaaggcuaucucccaugucuacuccggcagcaguugugauggucacugcuccauggcagcauuucacauuagguuuuauaguuucuccuuuuaacaagcuggaagaaaagcucuacuaucuguacuugcauuuuuacagauaagaaaaaucaaggcucaaagaauuuaaacauauuuauugaggucagcauuuaagaacaugaguccaaaacucacacucuugccccuaaaccacacacauuccuaaguggaguuagucacuuucuccucucucccacugucucucccacugaaccaugagaucuucaagggaaaaacagggccuuguucaccuggccagcagaguuaggcacuaagaaaugucugcagagugagcacaucagcugcauccgggauggaacacagacggcagccccaggcugcugcagcccuugccagugagcaccauggagcccugccaauuucagccacaagaaccacggacagcucccauguggcacucccucccucuggaagccuccggcagcugggagacccuuugggaguucucugggacuugggaggcucugguauccuggccuccugcuguuccagguccaaccaagccagccagaaaaaugugggagguugucaacaaaugcccuccaaguuuuuaucagugugggcuuaacuacauuggcuacuagcuuauuaaauaaaguaaauuaggucucaauuauuugccugcacaccaggcaggaaaaaugaaauuuucaauuuaaacauaauauugcuauuaauaugcagaggcagaucugagaucagacuuucugugcacuucuacugagagaggucagagaagagggagauucucaugaagggguccccucccaaccaaggcacccacuggagaaucccaggcccuuucagaagagcuggguuuuggaugccuggaaaagcaguuugggaaggaacagcagaaccuaaaccaugcgucuguuuuauuuucuucagugcaucacugccaaaugcccuuauuaacauuaccuuuccauaucaaaacaucuaaaucgggcacauucgaggccucugcauuugcauuuuuuaauggaaagagagaacuaguaucgaggaaggaugugcuuaacuccaagcccguaucagccacacaauccaacaacagaugcuagaggacgucuucaagaggagacuuuuaaaaucuacucaugugguguuauuugggcuuaaucagcacaaugugcucuaaaagccaauuucauaucuggaaucaaaagaaccaggauucaguaccgauagucaccuucuagggccuccccuuccagaaacccuucuugcuaagggcaucuacaauaaggauguaacggcucuaauggaauaaaaauaaucuuucaaauguagauauauauaaaguuuaaagaguuugagguuggccugcugggggguacaaauuaaugacuagucagacaugcagucucagguauuggggguauuuggugccggauggugaccagcuguuugcuauuucagcugaggacagaaugaacaggaaagaugcuuccaacuacagcaggagggggccagacgggcagguguggcuagcaacagcaaugcccuuccaggagagguuggucucaucccuggaggccaagucacaguggauaaggagcaagcuuuuggguucugccaccuuucgcugggugaccaccaccaaguuaucuuuuaaacacuuugaacugcuuugcgucuaaaacguggggaugauauuagugcuggcuucucgggguccuuaggaggauuuuaaaagagaagcacauaaaacauuagcuuaguucuggcccaugauuaaaaacaggauagacucauuugcgcaguguucagguacaagcuauacuucaccagacucucuuacaggagucucaacaauugaagagauuuauucacuggguuuaugaagaggcugcuuccaaagaaacauaggaagcccauagaaacaaguaugaguuuuuauuuugggggauuuuuuuuuuuaaucaaaauggcgggauguuaauggggagaggaggcacugcuggcagacaggaaugggaaagaaaaccacaggcgggaagaggagggagugggggagaggacgugagggggaaagaugcgccaggcaggggggcaggaggacugcacgcaggguaaguucccuccccaaagcaagggaagagcugaugccuccucggaaggucgcccagagaggggagggacaggcuuccugucucuggcucauucaggcuccaaaugccaggucuccaaggucggagaggacgucuccuguuucagcgccaccacagaaucugcccgcuagaggccccaucacccaucugcuaaucacgcaugugccuuccuagccucagaugcuuauggcccugcugaaggccugguguuugugccaucgguuacaugcagaggggcaugaucugggucccaguggcacugcccugcuuucccgggguccccaguggcacggcucugcguccucggcguccccagcaguacugcugugaguccccaggguccccagcggcacugcucugaguccccgggguccccagcggcacugcucugcgucucucugggucucccccauucccgucuagucugggugagacccuuggccagucccaaccgugugugaacaggcccagcagcuguggccacaggguccaugacacuggggcgccugcucugcagccccagccaugcgcugugcaugcaugugugugcauaugugacacccacgugccuucugcagagacauccaggagaaauucccacugaaggggauggcggcagcaucucccguagaucacugcuccugaccuccgcuggcagcccuaauggcccucuggaggauccagguaauacagucacccuccccuagaccuauauccuccaaauguucccagugaggaaugugagcuccugcauccagaaccacccucuccccuggcugccuggcccccugcggagaucacaugcaucucuaauuucucuguguuccggcaacucggggauuuagagcuggaagagaaaccagugcgugagcagucucacaaaagcucuagccugagggcccgaguauuugcuaaaugcaaagccugccaaacugcacccccaaggcccuaauguucucccgugagccacccaccgaagacgaaaacagcuucccuggaaccaaccuucaggagccacugcuaauaaaggcaggcguuucuuacguucuacugaaaaacgucaccauauaaggaagaugaccaaccaaagaggacaggaagggugggucugagaaagagucgaagccauucugcaacgggguaaauguuuuccgccgagccucuggaugagaauuuugauggcucacauuucccggacacuagcuggaaaacaagcccugugcuuuuaagcacccgacaucaugcaccaucuccuuuuaacaccaaauagcuguagguggacagcacuauuacugaccccaccugacggagcaggcacgugcacacacacacacacagagacaugcacacacucaagugcacacacagaaagguaaggcagacaagccuaauuaaccuaagaaaaucuaaccccagguugcugccagaaauggacuuugagaaugcagcucagggugagcguagggugggggaaagaggagggccccugccucugagugaggccccgaugcacccaccauccuaugaaagcaagccugcccagaggccugugccagcggccuuggcagucaaauguucccuaaguggccaccugucccguccugccaggcuccacagcugggcagaccuuccacaagugagaaagcuggggcugcguguccaugccccagagcacacugcagcacacccaggccagugaagaaacuuggggggugguuugguugauuucauuuuguuuucuugaggcaaccacacauugaagacucucagaaacaccugcuuucuaccuuauuacagugaccucugguggucaagaaucagauauugcacagccaaauuagaauuaaauagcuuaauuucaagcaacucuagguaacaaacgccuagagguccuuuaagagguucugagaagagcagaagagaaggaacugugagucgggagcugcugccagcccuacugaagggaggagacuggcugucaccugacccugagcaaaacccgcuagggcuucucagaugaugcuuccagagcaaaugcgaaaggccuccgcgcuccaaccuggggcggcaucucggcugcugcucccccucccccgaccagcugguggcaucucaaugccaggcuuagagggcacgggcucagggagguuuuuagcaaaagcuuucccccugccaggggaccugccaugagcucagggggaggaaggguuucuggaaggcuugcgaucucagcgccaccaccagcccugcuccagcugcuccagggcugaacagggagaggcagggaaacugggcuccuuuccccccacuggaaucacaagucccagccaagagaagaaggucggccaggaacaagaggaagaaacagcguuucugcccacacuccaugguacacuggguacccaggcuauggugccagggcagcccagggaagggggacgaggaggcaagagaagcagcaucugcuuugggagucauucuggagacugaaaggaaagauaaaaucccaggggccaugaucaauauccccuuagcccuaagccagggcagcagaagucagaggcuggaggaggggaauucuccuguggaaaacaaagcugaacaggguauccuggaacaaaccuuagcacaagcaagcaccucuaucacccuauccccaaggacacucucaagacauucuagacagaugcuuuaaacccuaaaaacucuccagggacaagcauccaacaaccucaacccauucuaggagcuucuagaagcuuccagaucagagcauucagacguuaaccccugcacacauuauugccaccacuuggucuguccauaguguggaggcuucagucaaauccccaaacacuaaugacagauccucccaagguaucgagauagucuaggccuugcuguuuugaauaugaagacagacugguucgcucuccugauauucuuuggaauucaaaacggauguagaauaucaauaucgucucaauuuuccuuuaucuacgaggagacgucagcaaaccuuucugccaaggauuguacaaggaucauuaaaaggaaaauguccaugguaauugugccuuuaugcguauuucuucacuccaauauucuauaacauaauaauguuucacauuucuacagaacugucuuuucagcauguuuucgcauuaugcuuaauuucguaagaguuucucagccccacauaacgacacaguucaaugcaaaaucagauauaaaucuagcuuaagagacucucaacaggaauuucacuuaaaacuguaaauguuaaaagauucugccucugauuuauguucuguuguguguguguguuucaaacagugagcuuccccagcccucuuagacaauagaugcuggcaaagccacagcagccacagcccaggccucgcaggucugacuggacuggcucugagccccucugcagaggaagccgagaaggggacagagggcaacccuucgguagaagcuccagcuccggggccguguggggccucguguagaaaaugaaccaaggguggcugacaccgucgcccgcacuggcuuggggccaacuuuuagggagucauuuugcagcuuuaucucauuucccugcuccuccaaaaugccagggcagcauaagggcccuccgccuccugcgcccacacgcaccugucuuaaaaaacagagggagggccaggcaccauggcucaugccuguaaucccagcacuuugggaggcugaggcgggcagaucaugaggucaagagaucgagaccauccuggccaacauggugaaacccagucucuacuaaaaacaaagauuagcuggguaugguggugcacaucuguggucccagcuacucgagaggcugaggcaggggaaucgcuucaaccagggaggcagaggcugcagugagccaagaucgcgccauugcacacgccagccuggaccgcagagugagacucugucuuuaaaaaaaaaaaaaaaaagagggagauccauggccaaggcagaaaguccuaggucaggguuuuauucuguauuguaccuggcuguggucaugaccuugcacaugucaaggugaaaagaugaccccugacucccugcuuacggguacaccugggagacgggcaagcugacagugccaagagcucauuugggaagaagcaggcugaugccuucaggugcugugaacugugaauucuugauggaauuaaugaauccagaggaggcauucauccauugucuaagcacauuuaagacaauuuuaaaauguggauuauuuacauacuaggcucuaaugacuccgaagcaaccauuacaguccgucacguaaagccauauccaagcaaucugauugcaccggaucacacgcaugccguguuuagacaacuuacaguacacaaauuauuuacaucgugaaaacaucucuguagcccuggcauuacgcuaucaagagacaacacagcagcagauuaaauugaaauaugcuggcagcuuuugaaacuuucgacuuuauuccaaaaugcuaaaagccaaaaaaaaaaaaaaaucacaguuagcgugucuaaaauuucacuugaaagguggggcuguggugaguugccacccaaaaaaagaaaagucgccacuuugcaauuguaaaauccauuuauuuaaagaagauugaaguauccaagccuucugauagcacuuaacauauuuuaaaauaugcacugcaaagcucuaaaaguuccugaauuccuccauaaaaaaaaaaaaauguuuugccacuucuaauggacuccaaccaacuccaagcagaaucuguaggguacacgcccccagaaaaaaggcaauugaaaugacuugucuauaucuuuccaggaaaguaaauuauauguaagucuguacucacacucccacuccccuauagguuacccauuuuccucccacacuccacagcccacagaaaugaagagaaaauuaucaaguggguuuaggugcuuggauaccuaauugcaacaaaucuaagcgccucaucuuucugccuuuuagaacuuugguuucagacuuuaaagcgauucccauuagccacaugccaauuagcuucgagcauuucacagaauagaacgccccuugagauaaaucgccccacauaccuacacgucuuccaaauaucuccauuuguuuuucaauaucucacuaaaaugagggaggcucuuggacaaugguucagaugugaaaggaagcgcuauuaauuuuaauucagaguccucaaaccaagguaucagaaaggaccccagacuuaauuaaggacaacacaagucucucuaauccaaagaaugcuccauuucuguccccugugcuucaagaauuacaaggguugccugggcauuuuguagcuuugcaagggaagcaaagcuuuguauaacuagguuugaugaugaugauaguaaaaaagaagggaggaggaggaggaggaagaaaagugggaagguggcagccaugacgccacacuccaacaguauauuaaauggcguaauucacacagaaguauauaaagcauaaaguaaaagucacauugcucaguaacccuguuccagcaaauuaccaccagaagugguuugcuaugacccuuggcauauagaaacaucuuuguuauuuauuuauuuuauuuuauuuuuuauuuuugagacagagucuugcucugucacccaggcuggagugcaguggcaggaucucggcucacugcaaccuccaccucccagguugaaacaauucuccugccucagucuccugaguagcugggauuacaggcgccugccacuaugaccggcuaauuuuuguauuuuugguagagacaggguuucaccauguuggccauacuggucucgaacuccugaccucaagugaucugcccaccucggccucccaaagugcugggauuacaggcgugagccaccacgcccagccuuuguuauuuauauaaauggguacauacaauaucuguauuguuauaaaaacuaauguuucaaaagaaauaugaacaaacugugaacucuaaugaaugauauuccuaccuguugaaauauuugggagaaaguguauugauguguacaaccuuccugaaaugaaucaaaauaucaagauggauggaugaaaacagaagggugaauauugauaaggcagguaaaaugaaaugcuagccacaggcgcuacuugguggguuuauggguuucauugcaaaacucuuucaauuuuguuauauuuuugaaauacguuugaaaucuuuaaauugaaauggcagaaaaacuaauuuuuucacuuaauauauggcauugaucucuguauccuuuuuaaccacuacacaagauuccauuuuaugggugcaccaugauguccccacugguggacauuuagguuacuuugcaaugacaaacaaugccacaaugaauaugcauguaaauaugccuuugaaugcucaugaucacauuuuuauaggaaaaauuucuaaauaugaauuugacuuaaagaaaaucaacacuuugacuuuuaauauauaauaauaacagcaacacccacugcacauuuacucugugcagacacuccuguaagcacuuuucauguauuguaaacuccucacgagaacuucauuaaguaggcacuaacguagccucauuuuauaguugaggaaacugaggccucgagagguuaaguaacuugcccaaggucuuacagcuggaaaauagcaauuucacuccgaagccaguaauuuuaaccauuguguuuaaaauauggcaaaaaaaaaaaaaauaaagaucaaaccaauauauauauuccuaguaacagugugugucaguuacuguuucccaaagcugcauuuuuuuuuuuuugauauggagucucgcucuguugcccaggcuggagugcaguggugcgaucuuggcucacugcaagcuccgccucccggguucaugccauucuacugccucagccuccugaguagcuaggauuacaggcaccugccaccaugcccggcuaguuuuuauauuuuuaguagagacaggguuucaccguguuagccaggauagucucgaucuccugaccucaugauccgccugccucggccuuccaaagugcugggauuacaggcgugagccaccgcgcccggccuguuuuuaaauuuaucuaaaacuuaacgaaaacacuguccauuuuucgaaguagcauaaagcccaaugcgaagaacccagcagagagagaaagcagcacagauuggggcugggcagggaacaaaugccucguugauuccagccggagcacagggaaaggccaacgugccaccucaagugggauccucucccugcuccuccgccugccucucugccucacgcaccccuccugguucugcagugaugcuggcagguaaacaugccuaugaaacucucaaacuucuguuuuuaaacucuguaaaucccaacccauccucccagaagcauucaugcaaucucaagcauucuaccuccguuuuucuuuaucagacagcugcaaguagaaagaacuaaacaaaugagcaaguguaucgucucucuuuccaucaucuacucaauuaguucaaguaaaucuuuagacaaugcuugauguguccguaggauauuaucaucaacaaacucaaaagguucuuuuguuuuacuaucuaagacauuauaaaugaucccauuauaaaaccgaugaagaagucuuccuauagcaggcuguaguaccagccccgaacuuccaaggccucacugaaacacagccuccacgcaauuaaccccgaagacaagaaagccacagccacgaagagagaccucugcaaauagcagggcaccugccuggcugaagcucacagcagaacaaaacaguagugauaccuaauaauauggcugcauuauuguugcuguggcaacaaaaauacuguaauugauagagccaacucgcuuagcagaaacguaacaaacuaugcccgaaaauagguuuggaagaagagcugaaagagaaauaaaaacagaguaacuucagauaacaagccaaucaccucagauguuagcggaauggaaaaagcacaaaccuugaacccaaaaggccuaguuuccaaucaugacuucauaacugacucacugcaugacaucagcauguaacuuaaccuuucugaaugcuagucgucucuguuguggaauuaggaucguaaguccuacuucauaggugauaauaaagcugaauaugaaacuaggugaggucccuggcugaucgcacccucuccauaauggcagcuguuagcacuaugauaauaaucguggugggcucgccaacuaguauucauuuagcaguuuucacguagaacugagaauccaucauguguucacacauucucucuucuucucuauuucucagugaugaugaugaugauuauggaagacuucaagcuuuccaaaaccuauagaggauaaucuaauaaaaaccugcgugccaaccaaucguauuuucugucauaaaaauucacuagauauccuccaauuuauuuuuuagaaauaaaaaagaauuacagauauaacugcagcuacucuguaccugcccaucucauucuccucccucccucucagaggcagcugcuaucuuccauuuaguuuuuauuuacuauauacguaggcguccauaaacaacaaauauuuuuuacguuuuaagcuuauauaaaugguaccgugcuguacauuucuuuuugcaacuuguuuuuuuccccacugaauuuugaucuuuauacauauauacacacagccuuagcuuauucauuucaacugcuauauacuauuucauuauauaagaauacugcaauuuauuugccccuucuacuacugaugaacuuuaaauuguuuccgaauuucuauuaguguaaacguuguuaacacagaacauucuugcucaugucucuguacacagauacaaggcugucuguagaguagcaguucuccaaauauggucugcagacccuucgggcauccuuaagagauccuuuugggagacagagaggucagaaccauuuuuguaaaacaccaagaauugauuugccuuuuucacuguauuggcauuugcacugcuggagcaaaagcaaccguggguaaaacugcuggggccucaccacaaaucaagguaguagcaaccaacuguacugguaaucacauauucuucauugccaugugcuuacagaaaaacacacacacaugcacacacgcuuugccaguuuuacuuuagaauuccuuaaugaagcaaucaaaauaagauuuuuuuuuuuuugagaccgaguuucgcucuuguugcccaggcuggagugcaauggcgcaaucucggcucacugcaaccucugccuuccagguucaaaugauucuccugccucagccucccaaguagcugagauuacaggcgcgugccaccacacccggcuuauuuuuugcauuuaguagagaugggguuuuaccauguugaugagguggucucaaacuccugaccucaggugauccaccugccucagccucccaaagugcuggaauuacagguaugagccaccgccuccagccaaaaaugacagcuuuuauucuuuagguuggugcaaaaguaacuguggucuuuaccaucacuucuaaugugcuuuuaaaacacuucugcugcaaucuaaaguaugaugguugucuugaagaaaagcauuugugugacugaguuacaagcuaaaugagcaacuuuuuucauggaaugccaauuuuuauuuuaaaaaaaacaacugauuuuuuuuaaaacuaugguucuuuagaugcagguauuuggcagggcuucugccucuggccaagauggaguaagaaggacuagagguccucuccugcuuaaaauaacuaaaaaacgacaacauuuaugaaacaucaguucucuagauaucagacaucugggagugaagaacggcgaggucagccccgggacugccccagcuuucuugcuauagaguuuccaaaccauggcacaggagggcauccuaagucgagcaaucuuccugaguugagaaggaacuaagaauguaagaaggccaaggcagccagaggucacagggcagaguguuggaaaaagacacacagagaacuccagagcugugcagaggcugcuucaaguagucaaauagacauggaucagugcacguguaugaggaaacuaucucaggccuuguaacaccuuuuaacaggauuaaaaacaacaaucggcugggcacguggcucacgccgguaaucucaacacuuugggaggccgaggcggguggaucacaaggucagguguucaagaccagcccggccaagauggugaaagcccccucugcuaaaaauacaaaaauuaacuggcugugguggugggcaccuguaaucccagcuacuugggaggcugaggcagagaauugcucaaaccugggagguggagguugcagugagccaagaucgcaccacugcacuccagccugggcaacagagcgagacucugucucaaacaaacaaauaaacaaaacaacaaucacugucacucacacuuggaccagaaauagugccuguuuccgcuaacaagaguaaaaucuucauaauauauggggcauaggggagaguacucaguagaguuuuaccucaguaguggguaaaaaaaaucagcccugaacucaaugauguucuguacccaccuaaaaaagcauaaaagcgaaaugugaaaggguuaaacuaauuccaaauaauguaaccacauuccagaacaaugcucaagaauauuuauaagaauaggcugggcacgguggcucaugccuguaaucccagcacuuugggaggccaaaggggguggaucacuuggggucaggcguuugagaccagccuggccaacaugguaaaaccccgucucuacugaaaauacaaaaauuagccagacaugguggcauacaccugugaucccagcuacucaggaggcugaggcaggagaaucgcuugaacccgggaggcggagguugcagugagccgagaucaccgccacagcacuccagccugggcaacagagugagacucuguaucaaaaaaaaaaaaaaaaaaaaaagaauauuuacaagaauaaacauguacacaguacccaauaugauaaauucauaaugucuggaaucaaagacaaaauucccaggcauacaaagaagcaggaaaauaugauucauaauaagaagaaaaaucaaucacaaccaaaccagaaauuauacacugauaaaauuaguggguaugaagauuaaacauuaaaaagagauaugggagaauuaaacagauccaaguaaaacuucuaaagaugcaaacugcagugaaaaccuaagaugcagucugaggugaaaaacacacuggguguaauuaacagacaauuagacaccacuaaagaaaauauuagugaacugaaagacaggaaaugaaacaggaaaaagaaaaaacugaauagaguaucugcaacaacuuuaagcagucuaauauauguaaaaguucccuaugcagaagaugggacagaaacaaauagaaaaacuaacagccaaaauuuuccaaauuugauaaaacuauaaauccacauauccaaguagcucaacgagccccaagcaccagaaacauaagaaaacuacaccacggcacaucauaaucaucuugauuaacuccagugauaaagaaaaaauccuaaaagcagccacaggaaauggaugcauuguacagagaaaaacaaagauaugaauaacugcagacuucucaucagaaauuaugcuagcaagccagaagacauagagaaacuucuuuaaagugcuaagagaaaaaacaaaaacuaucaaccuagaauucuuuauccauugaaaauaucuuucaaaaacaaaagugaaauacuuuuuuauagauacaaaaacugaaagaauucaugaccagcagacaugcacuacaagaaauauuaaagcaacucauucaggcagaagggaaaaaaauagcagauggaaaucuggaucuacacaaagaaaugaagagcacuggaaaugguagagauguggguauauauaaagacuuuuuauuccuuaaaucuauuaaaaagauaaacaacuacuuaaagcaaaauaauaaaucacaggguuuauaacaaaucuauaaguaaaagguaugagaagaauuuaaaaaaagauggggaggaagaaaugaaauuauacuauaauaagguucuuauacuauacaugaagugguauaacaucaccugaaaguggacuaugauaagucaaagauggacgcuaaaaacucuaaaacaagcaguaaaauaacaaagauuuauagauaagccagccaacaaaagagauaaaauggaaugauaaaaaaauguucaguuaauccaaaagaaggcagaaaaagagaaaaggggccgggugcaguggcucacgccuauaaucccagcacucugggaggccgaggcagguggauuucuugagaucaggaguucaaggccagccuggucaaauggugaaacccugucucuacuaaaaaugcaaaaauuagcuagacaugguggugggugccuguaauaccagcuacucaggaggcugagggaggaaaauuucuugaacccaggagauacagguugcagugagccaagaucaugccacugcacuucagcccaggcaacagagcaggacuccaucucaaaaauaaauaaauaaauaaauaaauaagagaaaagggggacaaacaacagauggggaaacagaaaacaaauagaaacuuaaccauauugauaauugcauuaaauauaaguggucuaacuacuucaaauaaaagacagagauuggcugggcguggugacucaugccuauaaucccagcacuucaggaggccaaggugggcagaucacaaggucaggagaucaacaccauccuggcuaacacagugaaaccccgucucuacuaaaaaauacaaaaaaauuagcugggcaugguggcacgcgccuguagucccagcuacucuggaggcucaggcaggggaaucacuugaacccgggaggcggagguugcagugaaccaagauugcaccacugcacuccagccugggugacagagugagagucugucucaagaaaaaaaagacagagacugcaagacugcauuaaacagcaagaccaaacuauauguuaucuacagaagcccacuuuaaaugaaaagacaaaaauaaguuaaaacuaaaagaauggaagaagauauaccauugcaacacuaauaaaaagaaauuugcaauggcuauguuaauaucacaaaaagcagauuucagaacaaaaaauacuacuacagauaaaaagagucauuucauaauagagaaguuaauuauagagaaguuaauuagucaugaggacauaacagucacaaauguuuaugaaacaacagagcuucaacauauaugaagcaaaaacugauagaaauacaagaagaaauagacaaaucuacaacuguaauuagagauuuccguaucccucccuuaauaaucaauaaaacaaguaaacauaaaacauuaaggaaucccagcacuuugggaggccaaggcagguggaucacgaggucaggagaucaagaccauccuggcuaacaacggugaaacccugucucuacuaaaaaaaaaaaaaaaaaaaaaaaaaauuagcugggcaugguggcgagcgccuguagucccagcuacucgggaggcugaggcaggagaauggcgugaacccgggaggcggagcuugcagugugccgagauugcaccacugcacuccagccugggcaacagagcaaggauccaucucaaaaaaaaaaaaacauuaaggauguagaagacuugaacaacaccaucaaccaacuugaccuaguugacauuuguagaacauucuaacagcaauauacacauucuuuucacaugcacacagaauguuuaccaacauauauucugagccauaauaugucucaauaaauuuaaaagaauuaaaugaauucacaaaaaaaggaauucauuuaucaguauauucucugacuacaauggaauuaaauuagaaauuauuaauaauaacagacagguauugggcagacuaucacuucaacugaccauauuuguugccaaugauaaaaugugaguuuuuaaguaagaauuagaauugggaaaaacuugugcucaccauugugaacuugacaacuugcaaaauguaaagacuuuucugaggacuuugguacugauaauaacaaagccauuuugggguggggguuauuguauaauaaaacgugucaacauguggaagaucugcauaacucagggaaccaauauuuucaaaacaacugcugugacaaaaugccaggauaaaagaucuuuccaagauccacauuaaaauauauccccuugaaaaaaggauaggccaauggauuuuaauguaacuguauacaaaaaaauauacuauuuuugucuuuuuauuuaaggugggcuucugcggacagcauauaucagauucugcgcugcaacuaacaucuaagaaaguaccgcuuguaggguuuugauauaguaacaaagagaaauauucacaauucucugaaauggcuauuaaaauacuacuuccuuuucuaauuaugcaucuguguaaagcuaaauuucuucauuuguuucaacauaccaaaacagacugaaggcagaagcagauaugagaauccaauugucuuucauuaagccaaacauuaaagaaauuugcaaaaauguuaaacauuacccuucucacuaaauuuuguuuuguuuuuggaaaguauaguuauuuuucauuaaacaauauguuauuuauguuaacauaaaaugaguuuauuacuguaauuuuaauaaguuugcauauuuuaauaauuucucaguuuuaauuucuaaugcaguaaauaguauagcuguaauucaugagcagaagcucuuuggguuccucaauaacuuuuaggaguguaagagagguccugagaccaaaaaguucaagaaacauuguucuagagaaguugaguugcucauagucuaugcaaaaaagagagagagagagagagauuucuugauauuugcaaacucacuggaagauuccaagcuaaagaauagccuguucaaugcagcugaccaguagagcccuugauuuuuuuuuuuuuuuuuuuuuuuuuugagacagagucucacucugucacccaggcacugaucucagcucacugcaagcucugccuccuggguucgcaccauucuccugccucagccucccaaguagcugggacuacaggcacccgccaccacgcccagcuaauuuuuuuguauauuuaguagagacgggguuucacuguguuaaccaggauggucucgaucuccugaccuugugauccacccgccucagccucccaaagugcugggauuacaggcgugagccagcgugcccagccgagcccuugauuuuauagugacaaaaauaauggugcucauaagagcaaugaaggcucacaugcauuacgcccauauucaggcaccauacucaaacuauaauccuuguuacccucuaacaacccuaaagaauaaacaugauuuacauauuacggauaaggaaacugaggcucauagggguuaaguuaguuguccuagaggguaagggaaucaggauuugaaucuagaccucauuccaaaucaauaacacuuuccacuuucaaaugucucugaaauugugccauaucacucucugucuuuuuacucugcuauauuuuccuucuuaguacuuaucugacaacaugucgcauuuuuguacaauauacaauuugcguauugucucucugcuccauuagaauauaaacaccaugagugcagagauuuuugccuauccaccuaccucugacaguccaaacacuuacugagcacgugcaaaggacaggcaaaaagaaauacucuaaagcagggcuguggggucagaaaaugacucacaauaauaccaaggauccucuguucaacagguugggcaugugaauggacagugcuccagggaggccagaguggggcauggcagccaagaguuaugaugaucagagaaacaucaggagaaaggauaaccaugaaagcaggucucggauucauggacggcagcaagaaggagaacaugcaggaaaucaaaucauaguuucagagggcaaccagggaccucaugaagacaccugugcuagagacagccucagaaguuggagaaaccaagaggcugaguauauucagcaguuucauuggcucaugcugugauuucuggcuuuagguccacucugaccaccagcucuaccacgcagagacucacugacacuaauaucugugcuccgcaauuaagacaaugaaaugccugacagcucuuucuuuuucuccuuggcuuaguuucugccauaaacuugggcccagaaaagugucagggagaaauauacuaaagaauauuucaggcaguggcacacgccuguaaucccagcacuuugggaggcugagguggguggauccccugaauucaggaguucgagaccagccugaccaacauggugaaaccccgucucuacuaaaaauacaaaaguuagcuaggcaugguggcacaugccuguagucccagcuacucgggaggcugaggcagcagaauugcuugaaccugggaggcagagguugcagugagccaagauugcaccauugcacuccagccugggcaacagagugaagcuccgucucaaaaaaaaaaaaagaaaagaaaaagaaaaagaaauaauaucucugguuggcaguaaaagaacaucuaagcauuacuacugaagggaacaaauaaaaagucuaagggucuuuguauccaugcccaaccuucauaacucuggaagacagauggcugcaucccacauuaaagacuugcuagaaucucccuccacgcccacugucagacuaaaucuaucccacauuuuucagcuuugcaugaggggucgugccaauuuucccccucuguguaucagcacagauauccccgccaugcuuccgucuuuugaacucucacucagauguccuuuaggccagguucaaacacuaccagccagggcgucaccgcaucugccaccaaaaacaccaagcugauggaguacccugaaaauguggacccaagugaagauugagauuuaaagaacagauaagaaagaaaaugugaucuggcauauauugaucucuaggucauugaaauauauaacuaagguucaacuugucccuucccccaggucucgugggccucccaggagucguguuuucaggcuucgaccuuaauugcagauauuuaaaugcagugcaagcauugcuauugauccucaaagcagccuuuuaaugcugauauucaugaugcuaucauggaucucagcagcuagugagugauguguguauccaaauacaaaccgaagacauuucuuuuuuuucuacuuuaucuccagaggcgagaaagauaacguuguaucacugacccuucuucaacuguuuucccacccucuucucaagccaucuaagaaggauggaggagcccugaagcacagacuucaaccaugguucacaugaaucccagggaaggaguccagcccaggccugacucugccacgucucaagaaaagccaccaccauaaagauaagacauuuuugggaaggaacauuaaaguagccagaaaaaggucaugccggaaaagguaaaaacagcuacuggccggacacaguggcucaugucuguaaucccaccacuuugggaggccgagguggguggaucaugaggucaggggaucgagaccauccuggccaacauaugaaaucccgucucuacuaaaaauagaaaaauuagcuggaugugguggcacgugcuuguagucccagcuacuugggaggcugaggcacaagaaucgcuugaaccugggaggcggcgguugcagugagcugagaucgcgccacugcacuccagccuggugaaagauuccgucucaaaaaaaaaaaaaaaaaaaagcagccacccauccucccagcccuuaguuucugggucuaaaguuagagaaauguuccucacgguccuuaucuuccuguuauuggaaagcccccaugaaggucucuaaaaccuuuugaaacuaaucuuauagucuuaguuuauaucagaauucuggcaaggggagccacagguagcaggaaauccagaccugcucuccugagucauuucccuucucccaccggggcugccacucccacaauacauucugaaucacacaugaggccgugccacggaugacucccccccuggacauauaggaauaucaugaugaagucagaauucucacagggccugagcagcaauccacuacccaggcuccgcaggccucacugcugccugccucacgccucgcucuuugugcugccaccagcuucaucccuugcaggucccuugcugggauaaacaucucacuuccaccuucaugggccugcucuccugcucuuggccaaaucuuuuuguuucuuuuuuuuuuuuuuaaggcagggucucgcucuguugcccagguuugagugcagugguacaaucacaacucacugcagccuccaucuuccgggcucaagcaauccuccugccucagccucccaaguaccugggaccacaggcauccgccaucacacucagcuaacuuuuguauuuucuguagagacagggucuugccauguuguugcccaggcuggucucuaacuccuaggcucaagcaaucugcucaccucagccucccgaaguguugagauuacaggcaugagcaauuuuacccagacucuuggccaaauauuaauuacuccuuagauuuagcucagacauuacuucucccggaagccuucucaaaccacaaugccccucuucccccacuccauccccaaagcugguaaguaguagucaccugugugcugcucacaucucucccaccucgccagucuaguucauugaaaucagcaguuugccuccccccacacccuugagagcaccuuaaugggagagggaaugucugaauuauucagcuuucucuccccggcaucuggcccagugccuggcacagaguugcacucaaaucccuguugaauguagcuacauccacccuccucuaccucccccaccccaguaaggccagaggggcuggcgagauggaccccagaaauagguggucucuugcaaaccauauauccuaugguuccuuccaaggcccugcagccuuuucaucugagaaaccccagccauuugccugugcgcccugaugaugggaccacccuuccucucugcaguacaacuucauggccagggcccccaggcugccagagccagcucucagguccugcagccucggcucccacaggggaaaaaucauugcauucagaucagcuaccgcggcaauaggucaggcuuccagaagccucccccaaacgcugauuaaugggcaagagcagcucuugcgcaucucauuacgcacauagcugcaaugaaaccaucuuugcuuuacaguuuugugcaggacauaaaagugggaaauaucccagccuucagagggaacaagccaugaauacugaagcagccccagguuauuaauccagcaccauuagucuuagggagucaccccagcacugacccccuagaaggaaauuucucuugcuguccauuucucauuucaaauuauccauacagccaccauacauaccaccugugaauuauuugauauuuuggagaggaaaguaaacaauauaaaaaaucagcagaacuuaggggaucauaaauucuuagcaaguuauuuucggagugaggaaagcugauucauauggcacuuuacuucccaagacuaauuuaguuugcuuuuuuccuuauuaauaggagguaagcacccugcaaagaucacauuuucauucuuggcagcaccugucgaggggaucccaggcccacagcccauguuugaagguucaucccagaaaggugucgauggagcagacacggcccuagaaacacaucgggugaacaauaacuucaaaaacacuggaacagauacacacagaugcuuuuguucuuaaaggccagcaucacacugcuagugcagacugauugcagacugaagaaccaaaaguauccuauuuacccuauuuauuccuuuaggaagacauacuaaaauacagacagcaggccagccccuaucuugcauuuuccccauuuuauauuuacccaaacuaaugaggucucacugucgcuguuuuccuggugguuuuuuuaagguaucucuuuaucucugguguucaguaguuucacccugaugugcccacacauggauuuuugcuuuuauuuauuccaccugcaauuccauguucauuuucaguaggaaggcuuacgucugucuuuauuccuccagccguauugcuuucaagcaugccucccuccuguugucucugucuucuccucugagaugcccauuagauaugugcuggaccuucaugugcacauuuuccgccuuuacuucccuaaaccacaguucgguggaucucaucaggaccaucuuaugcuuaacuauuuguuucuuucuuucuuucuuucuuuuuuuuuuuuuuuuugagacagagucucgcucugucccccaggcugcagugccguggcgcaaucuuggcucacugcaagcuccaccccgccagauucaagcaauucuccugccucagccuccugaguagcugggauuacaggcgccugccaccaugcccggcuaauuuuugaauuuuuaguagagacaggguuucaccauguuggucaggcuggucucaaacuccugaccucaagugaucugcccaccucagccucccaaagugcuaggauuacaggcgugagccaccacaccuggccuuaacuaacucauucuuuagcaaauaugucuauucuuuuguuuauccccaucuauuagaaggguuuuggcaucuuguuuuguuuucauugcaauuauuacauguuuuauuucuagaauaacugauucuuuuuuuaaaaaaaaccacuuguuucaucccauuaucuccuauucaagucuuauggauuuuauuucuugucucuucaaacauuuuacacauaucugaucuaucuaacagccuucucagauugcucuguugucuauaguuucugaaacauaaauucuccuuucacagcauuuguggauuaucucccgugguggucaauuugcuagucugcuuuguaauuuuugccuaagggcuuaucuacauugggagucccccaguuuuuccccugggaaucucaugugugccuuguguugaggaaucaucccccauaacaaguuuuacgcuuacaucugacacagcuuuaaggguaccacuaauucgggaccaaauuuuauguuagguucucagcucggaguuucugcccacauugauagugcaggauuuggucucauaucuauauacagcuuaggcuugguaucccucguucuugaaggaaacucuuagaagcuacggcuugggggacugggguauaccguguuccugagccaaugggaagaauuuuucuauuuuuugaugacagaaaagacagucccuucuuguucccaguuuuguacaagaaacuugguuccagcucccuggggccugugaaaccucagcccuuaagggguuuacuguggaaacuccaguaaggccacucgacuugcacucuaaauuucauccuggcuuccggcaccuggaaaucucccaaccucaccuuugaauucagcuauguuuuuguugcuauuauaacuaauccaacauuucuauggguuuagagugagagaacagagauucccacauaugcauaguuggcaucuugacuggaaguuccacuggagcuccuccuucccccagacucagggaaucauacucuugcccaauauucuccaagaacacguuaagcccuagacauagguaacccuccuucaaaucccugaagcauauggccaaccaauacccugcaaucagauggaggugaggcgcuggcaacagaagucagccccagcaagugggcuacacuaccucucuaggauuucagaaggugccaaggcaauuuugccuggacauuccaaaacccuggaaaccaagaacugaccaaauuugccuuuuuuuaaaagagaggcuucuuuaugucauccuagacuaauuagaaggccaauccaagaggaaaccucacuccucauagccucuugauugcacagcuagccccuaccacuggcccacccaauacccacggcagagucauccuguggccuuuccacucaccucaacagccagccagccaaagucuggagggaagggaucauaaagaguccuucccccagcaucaaagguacccugcugggaaugcauaaguggcugagggaggaaaggaagggggugacugccugugagccagagaagcagagaccaucuuuucuucaaucucaaacuaaaucucaaggguaagugcuaaacaauugccaacacacucucugccagccacucccaggugcaucugucccaucccacaacuaguacuggaggggagucacgcucgggagaccugcugggaagcagagcuuugccccugaccagcugcguggccuugggcaggucacuuugcuuacccucccugagucucugggacaaaugcaagggcuguugcauaggcuuguccuaccgaauaaaccacucacugaacggcgguggcuguugcacuguuaauaaugaucuuccagugcucaaaccccagaaagaaaugcccccugcugggucucugucucccucuacuuuacagggaagcagaauacaggcuuuucuaaaaguuaaauauucaaaaacaucuucucauugcuuuccuacucaaaaugagugggggauuuuaaauauagcuuuauuaagguacagcugacacacaaggaacugcacauauuugaggugugcaacacuaaguuuugacacaugcgcaugccugggaaacugucaccgcaaucaagacagugacacauccacccucauccaaugucccuccugcccgugcucacuguccagugguuuugauuauaauuuaaaaaucgaauaagaaagaagggaagagaaguguaagagagacaaagcaagaaagcaggagagcguguguuugaugcugcauuucagccuggagagacagagggaaaaucagaaaaagacgaugcacaugaagggagcagacagacaaagagagaagcugagcgaugagggcacaucugugcauucccccggggcugguggaggcacccacuguuuccaguggcuccagacucccgguucaggugcaggcuccagcccagcagagaccccgcaccuuccuacuccaucgcaccgccccauuuuucacugccgaggcccugccggagcacaauucaucacggccacguucagaagccacccauguaaaugcagagugauuccacuuggcaagggcuugauugcccugaagggaguuucucaaaacaucucugacaccugcaguuguauggccagcugugucagccauggagcccccgggcagguccccagacucacuccucgccuccagcacgaagaauggucaaaagcagggugcaccgaggccgggguggcccacaccccugcaggaugcacaagcacugccuaagccugggauggagaagaagugcucuucuagcccaaggacaggugagggcugccugguggcccaguggggacaaucaggggaucaccugccucuguacaacacccuggugagaguaagccccagcuccggucccuccaggguagaacaacuccagccacuuccuguggcauuggggucagcccuggucccucuccagcucugucucugaucaugguccuuccccaugucaucaucuugccccauaucgcagcucaaggcuaagcccacaauuugcagcccccucugcccccagcacugaaucagaggcaggagagccuccuacaggagcccucagaggggcaugagcccucagccuacaguaggggguggucagaaaucauuugucaauuuaucuguuuguugccuauacaguccugcgucccauaaugacaaggacacauucugagaaaugugucauuaggcgaucuugucauugugugaacaucauaguguacuuacacaaagugcauacuuacacaaaccuagaggggauagccuccuacccucccaggcuagacucauccagccuauggcuccugggcuacaaaccugugcagcauguugcuauacugaauacuguaggcaacuguuacacaugguaaguauguguguaucuaaacauaucuaaacauagaaaagauauaguaaaaauauagcguuagcaucuuaugggaccacugugguauaugcaaucaguuguugaccaaaacaucguaauaugccauauaacuguauauauuuuggaaucuacuuuuagcccuaauuggcuccaauucauacuccugaacagaauugccuguuauaaaagauggaaaguucuucugcagguaauauugacacaaaugugccaucacggcccuccuggagaaacaggcagcccagccaugccagcauuggcuucaggcaauccccagugagccccugaaugagaaaccaucaaugcuugccacucugaggguggagcccaacuuauuucuggaaucacaaacaccacacaugggaaagaggagaaaggagagcuguuggcuuccaagacuucaucgcaaaacacugcuuccaugagagcuggagucggagcaggugccggggagcugggcggggcuguggcaggcacaggcacagggacacaggugaacucacuuucuccaggaaacagucacauuuccgggucaaaggcaaaggucaaaaggcucacagugugucuguguucuuguuuuccaucucgaugaacauuuuuaccaaguuugcucagcagcagaacaaacagacccuggcuuucaguuucaucaucuguguagcugaucuccuguccucuaacgauucuaaagcauuucuggcagugaaccacuuucccccugggaaggaaagggucgcuggugccccaauccuggguucugcuaaagggccccuccacgacuucacuguucauuucagagcuuugugaccccugccccaccaccaggagcugcccucaccagugugucuccucuccacauggaggaucaugcugaauuuacacacacagccugaaaucccauccccaacccaaucucucacucuuuuggaaggucuugguagucaacgagcauacuguuguucaaaggaaccuauuucuagguguccccgacacaaccuuauggaaacuguucaaguugacaguaaagaagaccuuugcagaggcugcccagcccaacccuuaacaugcuggucagagaacccgaguguccgcgaguucaggggaagacuaagagacugaguuaaagaagcugugagaagcagaaagucauggcucugaggcauuucgcggaacccaggcaccgcuccacucccgggccagggccaccuugucaugguagcaccaaaggcaugcgggcauccaccccgcccaccaaggcccucuugccaggauggaggugcacagaaccagggaaggaacaggcacccugcagccaggaggguguccucgggucucuucgggccccucugcagacgggccuucucuaacauguuucuguccacagugcccuccccgcugcugaucagagauaacagaaacggagcaccaggucaggcuagccagacaggcuuuucuaggccagaagcuuuaauggcuggaaagggaaaggaugagcauuaaaaccaagaaaugacuccaggaaugguuccgaccccaacaacgggaaauagacuccccgagcauaaacaugcucugugguuaccagggcuacaugacaggaaggagagcggugcugauuccgguuaucgagaacaccuuguuggcacuuggaauggcaucucuaaaagcagcccuucucuccaagcuccuuguugcuagucuaguauaauuggcaguguaaacuuggcaaggagaagcgggagagaggauuuggaaggauggggaauguuuguaaaauggccauagaguucuccauauggggaaaaagaguccuacacaaaucuccccaccuguucuuucuggggguaaagaugauggcaaaauggugucucuccucaaggcaagccugcuggagacaaaagacauucaaccccuacaucauaagcacugcgagccaccaguagguccgugucccucacuaucugugucuucauucacugccuccaugacuucuuucuuguuaaacccauuugagaccauaaaaaugccuguuugauggagucacuuucugacccaggagucgagagaggaguccuaagcccccgcuccauccauccccagagugaccugaaccuccacaaaggagacuccugagaccaucuguuaaaaagcccuggcauuagccaggcguggugccgcacaccuguggucccagguacccaggaggcugaggcgggaggauggcuugagcccuuggaggucaaggcugcagcgagccaagaucgcaccacugugcuacagccugggugacagugaaaccaugucucagaaaaaaaaaaacaaaaaaccuuggaaggcauggcccauggccuggaggagcaggcccucaacacucacagaaaguaccagguuguacccaauuccacaccaaccaacgcauuuuggagaaauagccagugagccccuuacucuccacuucugcugggggcaacgugaaccguguaugagaaaacaggcaggggucaggcuugggcaccacccacaccaacccauguuucuggggcacuuggucauucaguccugaacagguuugucuguaagacaccaacaagaauguggcgaucccaggaaaggaagcagaagaaaaagaggacugaugcauacaaaugagacagggccaugauaacacgcaccucuuccuuaccucuccacuccucauuuaaagacuagaaagacaucagacaguguuuccauuuccuacaaacacuuaaagccucaaguuugaaaccuacacauaguagguacuuaaauacucgcugacggagcaccugaaccucuguggucacaagcaaggcauuuauauuuagcaaagaacgaagaaguucauuagcaaauccuccuuguguuuaugucuguaugaguaugugaguucacaaaaucauauuguuucagagcuugaagagacuacagaaaccaucucuuucagauucaucuuuuaaucaauggguacaaaauaagguaaugaaaauaaagaccagaaaggggaagcaacuuaagcaagaucacacagcaaggcccaucagagccagcaucacaaggcauguguggcaacuuccagucuggggccuguuucauucuucuguagcaccaggagguccugagaaaugaaacaacugggacucggggccuaccuagcaacuuccaggaccacaguauuccucuucugugugagagcugucgaagacucccaguggugggguguaagaagugggcaccuguguacaggucccaggacauggccagggaaauacuuaccagaaaaagagacagaaaggugaguaggcagggagggagucuggagaaggaaaucccuguuauuagguuaccuugauugcuuuuucuccugucucggcuacuaacagaauacagagaggcaaugaaucuuuuuuuucuuuuccuuuuuuuuuucuucuuuugagacaggcucgcucugucacucaggcuggagugcaguggugcaaucucagcucacugcaaccuccaaccuccuggguucaagugauucuccugucucagccucccauguagcugggauuacaggugucugccaccacgcaaggcuaauuuuuuguauuguugguagagaugggguuuccccauguuagccaggcuggucuugaaucccugaccucaagugaucuaccugccuuggcuuccccaagugcugggauuacaggcaugagccaccacgcccagcaugaaucauuuuuaauucaggaaauuaaggguuauguuuacuggagauuuuuuaggauauaggaaauacaaaauucuguaaaauuaauuuccccuuccuguuacccauugugguccauucauucacccauucgacagcugagcaccuacuguuugcagagcauuugaaagguuauaaaaaugaaccacaugcugcccuugccucccugcaucuagugacauaggacaugcacacaaugaggcaaaauucaccaagagaacauguggauaagacaggacgcguacccagccacugaaaggaaccaacuguugacacauacaccaacucagacggcucucacgggugucaggcugagggaaagaagccagccugcaucugacauucucaaaaagaccaacccaugguggcagagcagagaugagugauuucgggggguuaggauggggcaggguguggcugcaugacaugguuuggcucugugucccacccaaaucucaugucaaacuguaauccccaauguuggaggaagagccugggggaggugacugaaucauaggggaggauucccucuugcuguucucaugauagugaguucucaggagauccggcuguuugaaggugugcagcaccugucccuucacccucuuccuccugcuccagccaugcaggacaugccugcuuccccuucgccuucugccaugauuguaaguuuccugaggccuccucagccaugcaggacaugccugcuuccccuuugccuuccgccacgauccuaaguuuccugaggccuccccagccacgcuuccuguacagccugcagaaaugugagccaauuaaaccuuuuuucuauauaaauugcccagucucagguaguucuuuauagcaaugcgaaaacagacgaauacacugcaggaugugguggagcugcccugucccuuacuuguggcagugcuaacauggguuaaaagucauggaacggcacagccccaaaaacgucaauuuaacuguaagaucauuuuuaaaauaaaauuuuuuaaacugaaaaaaaugucaacacuaugugcauucagaggagaggcaggcugggcaggcuaaguuuagcugcagccucaccggaagacaucugaccagacccugaagacacacaggaccuggacagggggaagagcagaacauuccagaaaaugugaaccgugaggguggacagugggaacaugccacagacacuggaagcggugagucugucuggcucagugaggaauagagucaggggagcaggggacaacguaggaaauccggucauuagcgccucccacucaacugaucccacucgguccaacaacacagucaccauggagggaggcccaugcagcucaccaggacagcaggugagaagaaccucuuugaggacuggaggucuugaaaauuccaagacauccguccauccagcaaaccagggcagcacagggaauggaaacuuacaaaucccuagcaucuguucugagaaagaauucuauccuguaauuuucaaaauuucuugacuuggaauaauaggaucagaggcucucagaguuggaggacaauguacagaucauuuagcuugugguuuuugagucagggaaugugaaagaagcucuuccuccaaaaaaagacacacagagccccaauuauacaaacaacuccaggcauucaucagaaacccacugaugccaccacccgcucccccacccggcccccgacaugcugcagggucugagaggguccacagaccccgaaagguagcucagaauguguaaccucuagacuggcccccucggcugagucccaccucuuacgaggagccuggucaugauacccgagaggagaggcuuccuuuuugaaaccaagccaagcguuggguuaugagaaacaauuccagacuccguguuaagggaccaagcucgcacgcuguuuugcugccuuaaaacagaagcucggccauugcucccuauacuugggcugggcuuuaguuacagaaaggccucagucccugcagccauucgccucaccaugcccugucuaauggggcaggcuggggcagggagcaaaaaggaguucaccuuuguagugggcgcugggauccccaggaagaaggagccagucuccagcuuguucacgguugaccaacucuccaacccccucaggacuccugggcuguuuauagccucacaccccaaacacaaacuguuguuugcagcuuuugcagggccuaacccaaggcucggcuucaacucagguuucccuaugugcagacaucgagcagguaagagaccggccugccucuggaugggguuugaagaacaagagccagacaggguaccccaaacccaggcuguggcuucugccacggcugagggcacccucugaggcacacagcccugcccaggcgcugccccagccagccgguccccuuggcagagcaagcccuucagaaccgcacucgacagguucccuaucucccacauggacuggucuauuuuaagaacuguauuuuuaggacaagcaaaugugcugggcuuccauguuccaagaucacggccuugccucuggcagcagguccacugccaagcuccuugucucugacuuuggaggaggcucucagcuggcugcuugucguugggguugaagaagaggagucacaaggaagccgagcauuaugggauaguuugaggccuugaggaguggaggcaagacaggaagggaaguuccgccagcucccagaaguugagaauugcaaaaguauccuugcccuccucaccaagaacacaauguagaaccagcagaucacagaggggcuuguccacaccaggggggcggugaguccagcacuccaaaguucaacuccuggcuccaucccugacuccaccucugccaccugcagccaggaacagugcacagcugagccacacucugcuuaccuaagcacugaggacggccaggccugaucuuagcagaauggcucuggcuuccggguugagaaaagacucaagaaggacaaaggggccaggugugguggcucacgccuguaaucccagcacuuugagagacugaaguggguggaucacuugagaccaggaguucaagaccagccuggucaacauggcgaaaccccaucuguacuaaaaauacaaaaauuagccgggcauggugguacacuucuguaaucccuacucaggaggcuaaggcaugagaaucucgaaccugggaggcagagguugcagugagauaacaccgugccacugcacuccagccugagcaacaggcuggcgagacucuaucucaaaaaaaaaaaaaaaaaaaaaaagaagaagggcaaaggcagggccuggagaaugguagaagggucugcaacuuccccagcgagaagugcuggcacggaggaggugcggcacaaggcaaugagggacgaguguguuuugaagucacggccacaggguuuguugaaggucuggacguguggagacgagagaggggacucagggaugaucccaaggcuuuuggcccaagacacuagcaggaugaaguuggcauuacugggaagcagcagccagaucagauguggggagagauuacagacacucagguucuauacccgagacaaguggagguucccgagaagcagcuggacggugaguugggagcucagacgggaaguccagcccgcaggcacauggcgggaagcuacauuuagagaugugagucugcacacaaguggcagacagggaauccaaggacagagcccaggagcaagacagaauucagaguggggggaaacugaggaagagaaagggcagccccaguggugagaggaaaggaagccagugugagguggcacgaagggaaggaagugcgucacagagaggggcaaucagccacgucacaggcugccgacaggcaagggcgaggacugagaagcgcccacagcacucagcccuguggacggcucuccaagagucugccugcaaaugagaaagagaggagggggccuggcuuggaggagggagaggucuagagagggucuuuaagaugggagaaaucguggcauguuuguaugcugacgggaagauccagggaggagagaaagaccggugccagaaacccaggaggcaggaccaagagcagcaguggacagagccagggccucacagggaccagaaagaaaguggcagaucuggcaggaggagcuggaggaaguucuccuucaauuaucucuaccuggcaaggucaacagcuaagagagagggcgggaggaguguugggggcuugagagagggugaagguacuuaagagucaccuuggagaaugggaagcguggacggggaccaccagcaccugaccgggcaguaucaugggcccacaugagguuaaaaacuugaaccgugacaucagcacacccgcaggugucucuccggcugcacagguauggacaaggggcaaggcaagggcuggguuuccccagcauugugguuucccccagugagcaugaugaacugagacagggccagaaagucugaggauugggaaggggcccccugagcacugggggcuuguagucucaggggcaucaggggaaauuggaggaguggggcggagagacauguuggaugugguauuugaagagugggauguuuguaaucucggaauuuggagguaucggaacuacugggaauggcaaggucacagccagcauauauuaaugagcggcucugccugccagccucugagcuggcacugcggacacaccagugacaggugggcagaguuucucgccuuguagagguuacacuguagugggggacguggaccaaaaaggaaaggaacaaauaauaaaauagcuagaaacugugauaaacgucaugaaggaaguagacagggaugaagcugggaacugggacggggauuuuugacacggaugcucugggaccaccucuagaagagugaugccagagcugggucuggaaugaggagagggcccccccgccauguucauggcauggggggaaggucaagguagguccuccgcaucuucagaguggauaggagggcgaagggucucagagggcgcuagaaagaugggaaugggcaugccggcagggcugagggucuagaagcuuauucuaggggcacugaggagcauuggaaggguuuuuuaaaguaguuacaauccaggcagggcacaguagcucaugcauguaaucccagcaucauuugaacccaagaggcagagguugcagugagccgagaucacagcauugcccuccagucucggcgaaaagagcgagacucugucucaaaaaaacaauuaaaaaauaaagcaguuacaauccaaacuggaacacugaaucacccuucaacccaaugcgaagaccagccaccaagucugcaguggcuuccuucugcagagaccaugccaagacagaagccaguaagcagagcucccacgcacgacagugcuugccaaaccaguaggcgucugucgggaccgcuguggggauguuugggguuggaacauucauuugccccagagaucagggcuggacagcggcagccacccucaccagcaccugcaccugggcacagguguucccagggcucagugcucagcugcugcugguuagggcaccugcuuaggucccaggugccugauaagagcauuucccaucgcuugcuccacuccagaggguucugcugaaauggaaggaaggugauggggaagcugaguacaagaaacuguuaguaagaaaucuuacuacucagaaacgggcacaaaggaaggcuggggcuggggguggcagugaggguggguguggagagccaaccauacaagcuaucacguaaacagcaccuauucggugccaggccccaugcuaugagccuucuguguggugucucauggacucucaguaucuucucuauguuauggauaaugaaacgucacccagcuggucaguaguggguccgagauuugaacucaggucuuuccaccuccaaagucuauuugucaaacagccaagauaacaaaaaauaaggaaggacgcagacuguguucagaaagcgucuccuggcauccucaggacugacaugaccugggagugaccagagaaggcucuggaggaugugacgccacagcccguggcccaaagucacugagcacagcugagcucaaccaagcaagggccagagagagcccagaggccugagcacuggacgccgagugagggggcggcccaggagccggcccugggguccugguccucguucugacacucccugaccaugagcucagucaaguccucugucuucucuggacugaagcuuccccaagcuccaggaagcccuccucgcagcaguguccugcaggccaugguuccugguaagacccaaggacgucuguccuggggacaaauccaaauccagaagaaacaaaccaaccaaccccuggcaagugccugagccugguaaccaaaaggggcugguaaauccucagcagccagcuccuuccacacuggccggcaccuggacagcgccaacaccuccaagggauggugcuccaaucccugccaaggcccagagcucaaauggggagcucccugaggaaagccuuuuggaccaagcuagagcccaagcacgaggaccgcagggaaagcagccccaugcugcagugacagagggcucagcacuggcuaccugaacccagagcccugggcacaaagcaggaccaaacccacagcuccccauguccaagcugccuuagaggcucugcacggaccaacucaucagcagugcacgucaagcugggaggcaagguugggagugcagcccggaccggggcucugggggacagaagcagcagggcucacacucgcccccgagcuuccuggagcugcagguguccgugaugccgcagugugaugcuugccccuuucugaggcugcggugguccuucuucaagggcuacggcaacacagggcaccuggcagcaaaacaggccuggcagcccuggcagugcagaugcaucagaugcaaaagugaagagggggccggacagggacacugcagcacagagaggcccaggcaggcaagggcuuuccuuggccacugagcuggaccuggguccuggaaccacacugccccaggaggacacagacccggguuuccugccuucccacccacgaugccgccucuggggaaucucugucccugccuccacccucaaguccuggcagccauccuaguccuagccccccagaaaccucccagcagccuccagcacucacaacucugccacauuggagcugacagccccaggaguuccugguccgagccugccuuguucugaggaguaaacggggcccagaaagggaagggacauggccaaggccccugcuguccccuccccagcccugagcuccugagagugagggcugaggguacugcucuccccagguccuggcagcauggcugggcauggccgcugacccuccgugaggggcgggaagaugcuggaggcucccaaggacuccuggcccaggagaugcuccuuccccauuggaagccagcaggaggccucgaagucuguuuauuucccuuaguuccuucucuaacacuaaaacauuaaaccauaacauuuauccuuaggucacuuaaggcauagaaauuagguuaaauauuucauucacuaaauagcucagaugguuguggauuccaccauaaguaagcagaaaguucauucauuuugcacuuaugcaauaauauaaaauaaucaucucaaaugaauauuuuacaguuugcauuuauuagcaauccauucccuuucagagcuacucguaaggggucccaacgccuuaugaaauuuaaacaaucaagaugaagccacuaaccugugaaaguucuauucaucuaguguagacagccagguuacaacaugcgccccaggccccuggcacggugcucuguggagggugcucgaggcucagccaccuugccggccccugagccuccccuccucuggggaccuuccgcuaagaccagcacgucuucucaugccccacacagagccaagcuccuuccuagccugccuggauucuccuaccuggaauccccuguccacaucaauuaaagcaacaaacaagccacgaaaccugucauccagcaugcucuuugugccggcaaugugucugccucuccccacuccaccgucaaggccguucgugccuuuagugaccacuccagcuccuauuucucugcuuucucuaauugcagcaagcacuguuucucugcauuguguacccgugcuuaccugauaugcccuguaugguucucuaagaaccuccucugaguccaccugaggcccagacggaaaaccgagcuccaccucccuuccacgacccacggugcccaggacagugcuggccaugaagucagcccuccaccaccucccugcacuugaaaccuguuucccagagaaacacgcaggcuggggugggacucccaucuuccuuccaggucucuccuccccucccacuggaugaggacagggcaccaacacgggccucccuuuccacgcagggcucugucacucaauuguauggaacgcuguuucccgggucucacaagcucuaggggcuuuguagguggauacaguuuacaaccauugagugccuacugugugccgggccucuggagagguggggcugauggaaugcucccuggccucucuucuggaggaguggaugacccggcccagaagucgguagaaaagcacagggucggaaagcacuggaagaggcagaagcgacgccccgggagccccacaggggguccuuucagaaggagcucaccuccgcagcacugacagggcccggccaccccucggcagucugggucaagcaccaggucaccugaggaugggaggaguuugggauuggaggaggcgaguaagggcugaagcaggagguaaacugagccccggucaggaggaccacgccagguaucccaagggucugaacuacuuccugugggaagugggaauucgcuugggguucucgaggcgagggaaggaccugggugugacauucuguugccccacaaggcuggcucauaggggucacuuccucgggguggcccacaggcucuggcguacagcugccuguguccuuagcaaggguucccauuuucgggucccucacuuccaagucuccucuaucuggccucagcuuuaguuaagugaugauuauaugugugcuuccacgcuccaagcugcugugacaauguggaccccucuccuggucgaugcuccccacgugagauccuaugugaucaguuccuugccgcagccagcagcagagcaccucucuucucagagguagcauggugcccaccaaacaaccacgagccaucauccauccccuuggcccugacuaccaggacaccuguggccaaacugaaagcccauuccguaacauuauuaauaccguauccaaaaauucuuauuuuuuuuuuuuuuuuuuacuaccaucugacauucuuguuaagaaagugaauuuugugcuaggcucucacaaauccuuccugaaagaaagcagaaugucaaccagaguaaauaaguaaguccuccaaccgggaaaaaaagaacucuagaaaucauacaaggucuccacugguugaugucaugaagagguuaagggggaaaucauagaauguuagugugggaacaaggggaaaaggaagcuuagggcucagauggagagaggcuccagcccucagaggcucuggguuggggugagcugugaccggucagguggggacaguccuccgggaaggaugaauggagcucacagcuaauaggugccccagggaugauucauggggcucagugcuuuggagaaggucauuuccaucucagcccaccucaacuggguucuccagcuggccuuagagaugggugaauuucuucucagcucuaucauuuuccugauaauuaacaagcuaauauucugaacccaggccuuggggugauucugaaaacaguacaggguugggcugcuuggguuuuuuucccaucaaauaaacaaugaauggaauaaaucuggccacccaccauuccauagaauuucuaggacuaauccacaauccaguaaaauaccaccucuuauuuucuucuuucugcuuuuauguacuuuauaaauuuuccguaauaagcauauauuaguuuuuaauggggaaaaguaaacucuauucuuaaaaaucucucugccuaccagaucuuaccauccaggauuuuaaggauagaguugggagaaucugaagauaucccauugcccagggaaagacuagaauuaaaucuggaaaauuuccaaacccaaauacuaugggcaggucuacgaagcccuucccauuuuccuccacaucuagcuaaacccagagacacugugacuggcacagaccccacccugcuucuccauccuuccaaaugcuccacacccaaugcuaccuucccuguccucucuguucuuccaacaccaaaauccgccaacagacccugcccuggucuaucccacaccaacuccguacagccagaucuggggcagcaaucccuccacugaggggccaccccuccagacccuguugagccacuuggauucugcaaauggcuguauguguuucagugccgcauccauuugguacucaaguacacaggacucaaaguagcucuagccagaaacaacuuuuccccuuuucucuucuuuguguccuucuggacuggggucccucccucgaggaagccuucccaagccauccuagacuggagggaauaccuacguacguaggaaauaccuauguauucccuuuguaucccauacuuccuuguguaccacuuuuugucauugccuagauauuaaucaagcuuucccccauacccagaagauagauggugaaggcaaagacaggcccaucucacccacgagcacauccucagcaccugccacagaggcccacagugaucagaaaguauuucuugaaagggaaaagcaagaagaaaaagaaggcagaaggaagggagggaaaggcagggggagaaauuaauacaugaauucacagauggauugauaaacuauuuuucccaaagaacugaaccuggacuccugggagguuccaaagggauguagcccuccucauuuuaccaggagucuuugcauggccacucagaaccagcuggauuuuagcaaauggagugccugucuggaaaaccggccagagugucacuugauggcccaaaagccagcuuccaagguggguggcuaagaauuucccaggugagaucaaguagauguggcaaauagucacaguugguccaccuaggugaaggguagacagguggcauuguaaucaucuugcagcuucucuguagguuuacaacuuuuucaaacuaaaaaacuuugaggccggacauggugguucauaccuguaaucccagcacuuuggaaggccaaggcaggcagaucacuugaggucaggaguuugagaccagccuggccaacauagugaaaccccgucucuacuaaaaacacaaaaaaaaauuagccgggugugauggcaugugccuguaaucccagcuauucaggaggcugaggcaugagaauuguuugaaccugggaggcagaaguuacagugagcugagaucgugccauugcacucuagccugggugacagaaagagacuccaucuccaaaucaauaaauaaauaaauacaauuuaaaaauaggaaacauugaaaaaauugaaaaaguauaauguuggaaaucaggauagugguugucuuugaggaggaugggggauaaggaugaaggggaucuucugaggugcuggcaugauauaaucuugaauuaagugguuuucauacuuucauucauggaucggcauauuuccauuuaguagacuuuuuuguauauaugcuuuauuucacaacaaacagacuugaaauuagaaagaaaaaaagcaagcagaacacauaguucugaaggcuccgugggauuaugagaacauucuagcaauaaaaugggacuaccugagcucugcccagcugauuggccaagccccagcucaaccuuccagaagccaacccagagcagcugccuccucuucauaacccacuuucagguuccagacccagguucuuuggcugggauccuagcugccucaugcaaaagucuaaaugcaauugaaaugcaauggauaucaaagcccuguuuuugagggaaaaaaaagaaaagaaaaaacaauaacacuggccucccugcuccuuggcaauuauucucucuucaaauagacaauuuuucaccauuaacuggaugacggaacuuucguuuauaaggugauccaccuagaaaauaauauuguguccaccauaauucccauuuccuaagcauguugggcaauuuuuuauuucaaggaaagcuggggaaaucauguuccauaaccaaacgcguucuugugcugaaaucaucucagaacagcuuacaguuuaaaguggaauuacaccuucgagaggcacagcacaaccugacccuuucggggaguuaauuuucaaaacaaaaauaacaaugaugaauaaucucuugucugacauguguuggcaggccuugacccaccucucacaacuccuauuaccuccuagggcauaaaccagauacuuccguaaacuuggagauuuccuguuauucucaucccuggccuaugauaacauggguuuuuucuugcugguauaugaaaaucauuacucuuucuaauggaaacaauaacuucugaacaaaguaccucuguggccucccaugaucaccaaccuaccugcaugagugauuccuuaaaaccagacacccaggagagauuaucuuuuuuaguuuugcugcuccagaccauaauaauaaaguccaggagcucccucgcucuaggcauguacugguaagugcugggauuccaucagcaccucccuaagccgacgugucgaauuccacguguucucacguggaccaucuacuaacauagccaucuaugcuacagggaucauucccugccuggcaccccugcugccaccaaacaugauucugggccacauuacucuacauugacagagcagaaucaaagcauacaaauccauuuccauacuaaccucugcaaaaugcaauucagauauaacaaaucuauguuauucugaaggcacacccagaaacugcgguaguggugguggggcagguaucacuguucuaaauauuucuggccccuucuccuuuaguuagaccagugguuugcaaccaggggcaauuuugcccccagauuggcaaugccuagaaacauuucuuguugucacaacugagcaaggggugcuccuggcaucuggugcgcacaggccaggcaugcagcuaaacacccugcaaugcacaggacaagucuuaaaauaaagaauugcccagaccagaaugugaauagugccaagguucagaaacccugaguccgagcacagcaauuuaccaugcucuuuaccauguuccuucaaggaguccucauggcuucuuugcgcuguccucugugcugaaaugcuggccauuacagguuuggggagcgcuuagggagaagcuguggccuccaggagccuguucagcaucgucaagagugagucauggcaaaccggcacguucccucuuuugauagaaccugcauuuccauagacggcagugccucuggauuucagcaaggcagccagcaaaggccaucauguuaucccuguaaauuugaugaaggcacaugggcuagaugguaguacaaucaaggagaugcacugucgguugaguaacugaacuagcaaaggauggagcgauaugauagauccaagucaccccacaaguaugugccacggccuuugcccucagcccugucuugucggucauuucuaucaauggcuuaaaugaagucauagaaaguauucuuauuagaccccgugaauaacaacacugagaaggaugcugauauucuggugggccaacacacaauuuaaacagaccucaauggguuuaugauagaauaaaccagcuacacagcaauaauaggcagccuuagacuucuucauggcuuucaaagcacuuucccacugcgcuguuuuaugugaucaccaucaccagucuguaaugcaggugggucuccugacucccguaucccacagugcugggggcaaguauaggacacugcaccucgguucaaaacaugggguuuuuacuccugauugggguacagaacaggggagaaucuauuuggaaaaggguuuuaguccgggugcgguggcuaacacuuguaaucucagcacuugagaggcugaggcagguggaucacaaggucuggaguucgagaccagccugaccaacauggugaaaccccaucucuacuaaaaauacaaaaauuuauccaggcguggugguaggcgccuguaaucucagcuacucaggaugcugaggcaggagaauugcuugaaccugggaggcggagguugcagugagcugagauagcgccauugcacuccagccugggcgacagagggagaauccgucucaaaaaaaaaaaaaaaaagaagaagaagaagaagaaagaaagaaaaaggguuguaauuaagugcaaacgcagaaggcauuagcuugguugcauuaaucaaggauaaugucaagaagaaggaagguggcacagccguuccucucugcucugaucagaagccacguuggugaugcaguguuuaguugucauuaccacauauaaaaucagugcuguaaacaagggcucacucccaaaaggaugacaaagguggugaagaccagcauccuuugaagaagacgugaaauccgggacaugugcuuguuggagacauccuagggagaccacacuggcugucgucaauaucagaaacgcccucauggaugagaugaauucauggaauucucugugguuccaggggacagaagcaggacugauaauguauauucaaggugaauaauuuacacucagcagaaacaagaacuugcugaccauuuauacuauugcagaaauagcaggucagcgugcaaaguggugagcuccucagcucugaaaauauucaagugcaggguggagcuaagagaugggauucagagguaggguuacuaacggugucauuuguucacuugacaaauacguagagagcauuguccugggaccuggagagacagcagugaacacaaagacaaacuccuauccuccuggaguuuauagaguuggugauuaugaaauggugagaagugcucugaaaauggaguuuagagaguuggugguuuugaaguggugagaagugcuuugaaaacaugggauuuucacgaugauuaagaacuccccagcaaauuuucucccaucaccauuacuccgauacucauggccuuaaaacuaaagaaauuaaaaauauaacgacaauuauaaauauguaagugacaacugaaagaaaggguaggguuuuuccuaucggugugggaacuggguuucuuaaaugaguaauuagugagucaaauauaagauaaucugagagcaaugggaccugucaccucuaaagccccuuucugcucaaagacacugggauucuauaaaaacaugucuguggcuucccacaaagucucucucucugaaacaaaucugaccacuuuaaaacauaaggugcccauuagaagucaccagaagcucauuagacaaaaagaugagcaggaauugggggaggucaacagguaagggugggaauguggaagaaugaaccugaaaggaaacauaugugguaaacaagucagaagcacccaaagucagagccaagagaggccacaucaugcagaaccuuggacuuccacgggccaaggcaccugcucccucucaggauaggagccccauaagcugaccugcuccacaggcuguggggagacagccagacuguuccacugcuuguuuuccaggccccgcuccauaagacaugcuccccaccucgcuccuguccugccucuucaacuucccauccuaagcagagccauuuuaaaccuacuccccugcccuguggccuucaaaagacaaagguagcuagcaagacaguggcugacgcaggggcugguuccccauauuuuagagaugcccccaaacaagaggaaagucuuggguagaaauggugagaaguuccuggggaagacaagcaugaguggguccuccccacgcagggggcugcaggaccgggaagugaaagaggcgccagcuccagggugagcaggcugcaaggaagccagcuuucgguggcccagcuccccacuccaucuugcccuggacacacaucucccauccugucccuagagcgaggaccacagaagagcagaagcaccagccccucacccagcaccagcugguaccagggcccagacaacgcagacagucuaucacaguggaaccuggcagcaggguggccccugaacacucgauucucuuucuccaccccuugguugggggacuugcaauagaggcuggcagcucucagaaaagaaccugucagggucagguuggccagggcacuacagggaggaaaaagcagacugaaaucagggaaugaucaagaccagauuuuaucaccaacguauucuccucacuccccacccccaauucucuagaacucaccagaaagagcacaagugagggugcaggcccugccccuggccuagaccuguaugacccuccaaggcagcuauggcucacagggaaaaauaaccaaacauccaaggaguacaaccgcucuaagaaaaaagacccggccggguacgguauaauccuagcacuuugggaggcugggguaggcagaucacucgagcccaguaguucgagaccagccuaggcaacaugggaaagccccgucucuacaaaaacacaaaaauuagccaggcaugcuggcaugcaccuguauucccaacuacuugggagacugagauaggaggaucacccgagccugacaggcagagguugcagugagccaagauggcaccaccgcacuccagccugggcaacagagugagacucugucucauaaauaaauaaauaaaugcuccccgaggccucuccagaagccaagugaugagcaccaugcuuguacagccugccaaaccaugagccaauucaaccccuuuucuuuauaaauuacccagucucaggcauuucuuuaucucagugcaagaacaacguaacacaaagacaaacccuauguuuauaucaggaagcagaauuaagaggcaaaccagaacaagaauucaaaauaagcagauauccucaaagagaucagggaagacacugggaacacagagugggaagaggcagucauaggaagaagccacuggaaacgcuggcuauagaaacauaauugcuuuguuuugugggcacagaguuucaguuugggaaaaugaaaaacuucuggagacuaugauggcugcacaaaagugagaauguacuuaaugccauugaacugugcacuaaaaaaaguuuaaaaugguaaauuuuauguuauguguauuuuacaauacaaaaaagguagaaagaaaugaauaaaugaauauuuaaauaaugucauaaauguaaagauccuaacacugcuuuugaacauagauguccaauaaaagguagcuuuaugaaaagaaacaugauagguaaaauaaaacuacaguauaauuauugauuaauuuugcaaauauuuauugagcauccaccgcaugucagacgccacagcaagaugccagggauauguuacaggacaaaagagacaaaaagugcugccuccguggcucuuacguuuggcaagagagacgaaacgcaaggugcaccagacggugcuauggagaaggcaaagugcauggggaguggauucucaaagaaaccuugagggcaggucucccuggggacaggcuugggagucugggcucccucuggugacugaggagcacagggauaaaagcagaucuugguggcagagggacaugugacgcagagggaguggcauggcaugugcggagagcacgcagagcuccagggcucccucuggacucagaugaggggaagaagccugcuggaggugcagacuuauucuaucuuauuccuagaagaaagcgcucagagaugggcggaucaccugaggucagaccagccuggccaacauguugaaacucugucucuacuaaaaauacaaaaaaaaauuagcuggauguggcggcacgcaccuguagucccagcuacucgggaggcugagguaggagaaucacuugaacccagaaggcagagguugcagugaaccaagaccgugccacugcgcuccagccugggugacagagcgagacuccaucucaaaacaaaacaaaaaaaggcacucaguacacagccaaagaauaauuuagugagguuaagaucacaacagggagcuuaccagaaugcaucaaaaaaaagauaaagagauggaaaaaaaauuuguaauaaaugaaaggaggcugggcacgguggcucacaccuuuaaucccagcacacugggaggccaaggagggcggaucaccugaggucaggaguucaagaccagccuggccauggugaaaccccgucccuacuaaaaauacaaaaaacuagccaggcgugguggugcacgccuguaaucccagcuacuccagaggcuaaggcaggagaaucgcuugaacccgggagguggagguugcagugagccaagaucgagccacugcacuccagccugggcaacaaaagcgaaacucugucucaaaaaaaaaaaaaaaaagaaagaaaagaaaggaaauauggaaaacagaagacgaccugucaacauccaugucacaggagacccaggaggacagaaacaugaauggaggaaucuguaugaagaacuaauaaccaagaauuucccagaauuagagagauguguaaaaaccugaaauugagaggcugcccgaagagccaaaggacagguaagauagggagagacgcgacaugcuuccgaaaggaacuaacacaagaagaugucaugauccugaaaagauaugcaccucggaauuuggccucaaaaaaugcagaguaacaucugacagggcugcaaaaagaaauagauaaaucaguagguuugguuggagacuuuaacgcauccccucacaaacugauggcucgcacacacacacacacaaagcaaaaaacaaagaugaaggaauuuauuaggguuuaacuaauaaauacacggaaaauucguccaacagagaaugcacauccuuuuugaguacguguagaacauucacaaaaaaauuaaacaugcacugagccacaagggaagcuucggugaaugccaaagaaucaucguccuaggaaccacacguaagacuguaacauaagaaugcuuacaauuaccaacaaaagguucgcuugcaaaccgacacaucuggaagcgaaaagacaucccagugauacuuguuaaaggaaaaaaucguaagggaaauuuuugaacacuuagaacacaggaaaaucacuaugugucaaaauucaugagacauagaauuccacuuucaaucauggagaaguagcucuuguuggaccaaccuuccaacauuuaaaauauauauauuuuuuaaucagaggacaauagagagagaccaaaggcaggcagaaaugggugggauuuggacaguagaaagaagggaauaagacuggguaaguuucugaggguuugugacuuuuuuucuuucuuucuuucuuucuuucuuuuuuuuuuaaauagcuuuuugccugaggcaggccccagucagugucacagagcagcuaauacucagauagaaaacugaagucuuacuuuuuguagaaucagaggagagcuuggguuaaccacagcagcuagaaaaugaaaggggaacucccuaaaaggaaagagccacagagggagaacaccaaagucugugcauaaacugccucaaucuccagcugaucucugaauuauguuugcauggaauagacuguaagcagcccaccuaaggccuaaacaccuggacagagauuucugcugcagcagagacaagacagaguuuauaguuugaacucagcgaaguaucugcuaaaacaaaaacucaauauuauucugaauagcguaacagaaucccaagucucugcaacguaucauucacaagguccagaauccagucccaaauuacaagauauaugagcagaaaaaugcaacucauacucaagagaaaaggcaaucaaucaauggacucugagaugacacaaauuuuuguaugaagaugucuguuuauucugauguuuugacgucuuggggcuuugcuaacucuagaaaggaccgcacuucccaggguuagacaauuccugcagauagcaaaugccuugccaaggaaugccccuuucaugugcaaaccaaccauucugaagcccacgccacacccgccucccuuggugagcucucacucauaccacuguuccccugcccuacuugccccagggccagguaccaggcagcaagagacagccccuucgcucagagcccaccaaaauuguuugaacuagccagucuuaugccugucuaaguugccuggccuggccuugcccuucucacagaaaccacagcaaaggcucugauccauacuucuccuugcucccuccaccucugaccacuccuggugcucucccaugugcccccguagcaggcaguaccccuuccucuuggaauuguaacaagcuuucuuuucaaaagcaaucaucucccgaucuguuagucacaccauacuugaauaauaaugauuuguauuuuaaaacgauguugaaauuggaagacaaagauuuuaggccaggugcgguggcucacgccuguaaucccagcacuuugggaggccaaggcaggcggaucacgaggucaagagauugagacaauccuggccaaaauggugaagccucgucucuacuaaaaauacaaaaauuagcugggcgugguggcgcaggucuguagucucaguuacuggggaggcugaggcaaaagaaucgcuugaacccaggaggcggagguugcagugagccaagaucaugucacugcacuacuccagccuggcgacagagugagacuccaucucaaaaaaaaaaaaaaaaaaaaaaaagaaaagaaaaaaaagauuuuaaaggaucuaaaguaaaugugcucaagugaguucccacaugcaacaaauaaugacuggcccaaaaugucaauagugcuggcaccgauaaauacugaucuaucuggaaaaaaaaagaguuugaaaaacaugaacaagccuuggugauuuauuuuuuuaaaaaaacaaaaacaugaggucaaauauccauauaauugaagucccagaagaagacaaugagaauauggcagaauaacaauuugaagaaauaauggccaaaauuuucccaaauuuguugaaaggcauagauuuucagaaucaagaagcucgggccgggugcaauggcucaugucuauaauccccagcacuuugagaggccaaggcgggaggaucacuugugcccaggaguuuuagaccagccugaccaacauggcgaaacucugucucuacagaaaauacaaaauuuaguuaggcaugguggugcacgccuguagucccagcuauucaggaggcugaggggagaggaucguuugagccugggagguggagguugcugugagccgagauugugccacugaacucuagucugggugauagagccagaccuugucucaaaaaaaaaagaaguucaaacaaaaugaacaaaacaaaacaaauaauaccuaggcacaucauggucaaagugaauaaccccaaagauaaagggagaauucugaagggagccagaaauaaaggacacguuccgcagggaauaacacaaaugcuaaagaacaccuuaucaaaaacaagaggccagaaggaagagaacagcaccuuuaaugugcugagagaaaaacacacuguccacucagaauucuacacccagugaaaaauccaccauuaaguaaggcaaaaugaagacauguuaagaaaaauaaaauauaagaaaauucaccaccagcaaaucuucccuaugaaauaaaguuaaaugaaauucuucacaccaaaggaaaaugauacaaaugggaacucugauuucaggaagaaacaaagaucuuccaaaguaugauuauaaaagauaccauuuucuucuccuacugucauaaaacacauguggcuguuuaaagcaaaaaaagaaaaaauacacuauggggcuuauagcauauauagauauaauacauauaacaaguauagcaugaagaaauuaagauauaaacaauauaguugcaagauucuuauaauuuacauaaagugauacaaauauuaacuacauguagauugugaaaaguuaagaauauacauuacauucccuagugcaaccaccaaaaaauucaaaacaugcaaagaggcaugaacaaauuaaaauuauuuuuaauacauucaauuaacccaaagagcaauuaaaaacaagugagauaaacagaaaauauaugucgacaugguaggccuaaauccaaacauaucaauaauuauauuaaauauaaauagacuaaacacuccaguuuaaaaacagagauugucagaauguaggaaaaagcaagaccaaacuauaggcugucuacaagaaacacauuuuaaauagaaagacaaagaaagcaauagauaaaaaaacauacaccauguaaaccacaaacaucagaaggcuggaaauggcuauguagcguagacuucaagacaaacaguuuaccagaaguagagacauuucauagugaaaaaugaggcaauuaaucagggaggcauuacaaucauaauugugcaugugccuaauaacagagccucaaaagacaagaagcaaaaauugacagaaauaaagagagaaauagaccuauuaucucaauuggggauuuuaguaauggugucuaaaaaaaaaaucauaaaaugccuaggaauaaauucaggaaaagaugugcaaaaucuccacacugaaaacuaaaaacauugcugaaggaaauuaaagaagaccuaaauaagagauauaccaccuuuauggacuggaagacucaguauuuuaaagaugacaguucucuccaaauaaucuauaacacuauccuaaugaaaauaccugcagguuuuuuuaauagaaauugacaagcugauucuaaauuuauaugaaaaugucaaagagguaagauagucaaaucauuuugaaaaaguaaaguuggagaacugacaucaagauuuauuauaaagcuccaauaaucaagacagugagguacugguauaaggacagacaaauagauuaguggaaaagaauagaaaccaaaauagauccacccuuaugugguuaauuaauguuuagacaaaggugccaaagcaauccaauggggaaaagaaagucuuuuuuuaacaaauggugcugaacaacuagacaucacuauggaaaauaacaauguugucuccuaccuuacaccauacauaaaaguuaaucugagauggugacaugguugggauuugugucuccacccaaauaucaugccaaauuguaauccccaguguugcaggaggggccuggugggaggugauuggaucauggcaacgcauuucccccuugcugcucucaugauagcaggugaguucucacaagaucugauuguuuaaaaguauguggcacuucccacuucacuuucuuccuccugcucuggccauguaagacgugccugcuuucccuccugccauaauugaaaguuuccugaggcauccccagccacaauuccuguacagccugcagaaccaugaaccaauuaaaccucuuuucuugauaaauuacccagucucagguauuucuuucuagcagugugaaaauggaugagcaacagaccugcauguaaaagcuagcauuauaaggcuucuagaagaaaacauaggagaauaucuucacaauaagcaaagauuucuuagagaaggcauggaaagaaauaaucagaaagggaaaaaagugauaaacuucaggcugggcacaguggcuuaugccuguaaucccagcacuuugggaggcugaggcagguagaucacuugagcccaggaguucaagucgagccuaggcaacauggcaagaccacguugcuacaaaaauaaauacaaaaauuagccggccugguggugugcaccuguaguuccagcuauucgggaggcugaggugagaggauugcuugagccccaggugucagggcugcagugaggcauaacugcaucacugcacuccagccugggugacagaguaagacuagcucaaaaauaaauaaauaaaucauaaaaaauauauuucagcaaaauguaaaauucuggucauaaagaaacaccauuauaacaauaaacaaaagccgggcacaguggcucacgccuguaaucccagcacuuugggaggccgaggcaggcggaucacuugaggccaggaguuugagaccaaccuggccaacauggcaaaaccacaucucuacuaaaaauacaaaaaaaaauagccagguauggugguggucaccuguaaucccagcuacucagaaggcugaggccggagaaucgcuucaacccaggaaggggagacugcaguaaaccgagaucacuccacugcacuccacccugggcaacagagcaagacucugucucaaaauaaaugaaugaauggauaaacaaauaaauaaaaauaaaaaugaauaagcaggccacauucuaagagaaaauauuugugaaacauauagcuaacaaagaacuguauccagaauauauaaacuacaagcccccacuaacaaaagggaaauccacgauguuuaauggacaaaagauuggagcagauaugucacaaagggagauauauggaugacuaauaaacacauggaaaauaccauuagucaucagggaaugcaaguggaaaccacaaugagaucccacuguucacccaucagaauggcugaaauuaagagucacagcacuaaauguuggugaguauggagagcaacuggaauccucauacauugcugguggaaaugguacaaccacuuuaggggaaaaaaacauccagcaguuucuuuuaaaaaaaagaaaacacagcacccaacaauucuuuccuaggcauuuacccaaaagaaauaaaaacacacauccccaaaaaagacuuguacaaaauauucacagcaguuuuauucauaauagccaaaaacuggaaaccuaccagauguccaugaaugaauggauaaacaaacuaugguacauucauacaauggaauacuacucucaauaaaaaggaaaaaaaaacuacugauacaaacuacugauacuugcaacaacacagaugaaucucaaaaaacaugcugaaugaaggaagccuugccuaaaagaggacauguuuaaagcuacguauuagguacaauauacacuccuccggucaccagugcacugaaaucucagccuucaccaaauuaauccauguaaccaaaaccacuugaaaccacuuguacccccaaaaagcuauugagauuaaaacacacacacacauauauauauaaauauauauauauauagagagagagagagagagagacagagagagagaaaguacauguuauaugaauucauaaaguucuagaauaggcaaaaauaacuaauggugaaaauaaucaaaacauugguugccuggggguaggagagcauugacuaagaagagaccagaggaacccuuuugggaugauagaaauguucugugucuuuauagaaguuuggguuacauggguagacacaucugucaaaacucaucgcacggcacacuuaagauuguguguuucacuguaggaauuuuaccuuaaaaaguaaauaaacaguucauaauaugcaugcugaaauauuuagaggcgacauguacuguuagcugugauuuacugugaaauauaucaaaccaagauggauugaugaauugauacauggaugaauaugggauaaagcaaauauagcaaauuguuaaagugauggauauaucauaucuaauucaacucuucuuuacguuugaaauuuuucaguauaauguuugggagaaagaaaaaaaauugugagacacagcuaaagcaguauuuaaaggacaauuuauaguuugcauuuaacagaaaacaagaaagauugaaaauaaaugaacuaaacacuugagcuaaagacugcuggugaccuaccaauauccacucucccauucuuccuaaauaacacacuccaauuucauuacgggcaggaaagugcugagcaaaagauugccccucccagcccgucugcagaugaaguuggccagugagauguuagcagaagggcuugggugagcuuuccagggaagccaguuaagaagcaagugagagccugaaagacccacuuguugccuggaaugcagaggucauguugcugccccacucccccauucuccuugcucugacccagcucccuuucccucuauuccuccagcccaggacucaccccccaaggucaguaaauaauggcaaaauaaauccaagaaauguuuugaaaggucuagguaauggaaauguuuaauccucucucuagucauuagcaaacaaaggaugugaccuccuagagucagaagcaguugacucuccuuucaaaguuaaacucuucccgagguagcacccccaugccagcauuccaguacaccccugccagugacgugggggaagacagcuaucuuuaaagcccggggcauccacccaaaugaagagguuuacugccucacuuaggagcaauaacagagcagauaccuugaacggugaguucucauaaaucuuguuuggggaaaaaaaacuuucaauucccacuggaaauaugcaaaacagccuccacacuguaaaucuuccuuuucaguucuaaagagauaaguuggaccuauuaaccuuccauguuauuuucaacuucauuauuugagcugacaugacaagagagcggccacggcucucucuggcagagcgcauguaaaucgcuuucucaaaggaaauuacuucucuggccugaauguuauuaaucuaaauucuccguuagucaaauuguugcccauaauaaauauggaacagguugggauacuuaucgaguguggcacuccuuguggaugccacauccgucccuaacccccuuccauggaacugucuccuuggaagaggcaggucccagauggcuccugcaucaggcuguggugguggaggugggagauggcucaccugagggcuggaaccuggcucugcucugguuuucccaaggaacuucugcccugucauguccccugccccuccugccuuaucaaaggggaaagugacuccuggccuaguggaacucuucugaaggccuccccauugggacaccaucuuucaaagaaaacuaccaggagcaggguugagucucugccucggauuggcucagucuagacucagucaguccagugcuacaaagagcaggucuccccagucccucgggcagccagccagacuguucacuggcugaugcuggggugauggguuaaacucuuuacgauaccauuuaagaugcauuugguucagcaccaaagccuuuacaaaucacacuguuuucagaaccuggagagggggaaugagguuugcucauccacaugcggcccaacccguuggacgggacuccaaguacucuucacagaaugaugcucauuuccgacaaagcaaccugaaggauggagaaagccaacugccguggcgcagggguagggggugggggggaauccaaaaggcuuuuuucugcuucuacuaggguucuuuccaggguaauuacaagaaguuuagaauccauucagggacuuguaguucauuaaaugaauuuccaucuguguauccacuaccuaagaaguaucacuuuguacaauacucggguuuuuauuguauauaagucagauuguuaauuugcagcaagcagcacugaaaggcucguuucaauagugccugauuaugcaaaaugaaaccggguuuucauuaggucugccucccgcacucccuaacacuugguggggugccgggaugcaggauggagcccugugcaguggaaggaagcccagcaccagcuuucggagcgucacggcccuucucccagcagaaucacccagcgcacccgcaccaccuccccagacugcacuggggguccccauggauucauucccacaucccaucacugcacagccaaugguggccacuaggagaacucugacacgaaaacggaacuuaggaaagauuagcuucuagauuccaagcaugucccaggucuauugauuuuauuuaagggauaauguucccagggaagagggaugggaagcagagcagcuccugcugcuggucuggugcuggagucaagcagagcuggcuaagcccuacagaguuacaggaggagaucaaagaugacagacgccggcucuugcugcggaugaugcccaccuggggaccaugaggcuggggugggcaccacacagcacaggcuggggauggagggggaaggaaggagugauggggaagaaggggaaccuggauucccgggaccaaaagcaaagcggcccuuuccucaacgaccuacaggauuuaguccugugccucccacauugcauccaauagcaacgaguaucuacagguugcaaaagacagaaagaaaaaguaagggguuuuauaaaugcauccccaucugcccacagccucacuguuuguuccggucagaacuucuuccuuccagcuaauucaccuaaaggccagaucaccugccaaaugguuuuggugguccucaaccuggacuggacacuagaaucauuugggagcucuuaaauaauagcaaugccagagccccacccagaccauuuaaaagagucuuuggccgggcgugauggcucacgccuguaaucccaacacuuugggaggccaaggcgggcagaucaccucaggucaggaguucgagaccagccuggccaacauggugaaacuccgucucuacuaaaaauacaaaauaaucagccgggcaugguggcacaugccuguagucccagcuacuugggaggcugaggcagaagaaucgcuugaaccugggaggcagagguugcagugagcuaagauugcgccacugcacuccagccugggugacagagugagacucugucucaaaaaaaaaaaacaaaacagucucugagggugggcccuggcauuaguuuuuaaaaguuacccagugaugacaauaugcagacaggacugaaaaccccuggguucaauuucaaucuuguugaagaguuuaccaaaauacccuaacucagagacacacaaaugagcaugggaagugggggcggaggggcuggggaaccuggcccuagggggucucauaugccauugggggcccaauaaacaccacaagauaugcccaagagcaaacuuguagaauauuggguccuaagucaccaaggcuuuguguccccaaaagaaaccagcaggagugcgucaucaggaaggaugggcuggaaacucaacgcccagcuccaaaccugggagguuugcucccugcauuaacucacguccacagcacccuucuaacccacuugguaccagguacagacaaccaccaggaaccaccaucuuggagccccaguacucacagaauuuuccaggaagccuccccggguuaauggggugaccagaagauggcauuucucugcaagccccagcacucgccucacagugcagguacaaccauggacgaugguugacaaaucaccuaaaaacacugucccuuccucaagauuuucccaccuuaaccucaaaucccuccagggcgggcacuggcauccgacuccuuuguaaaucguucauccucuccuaggacaaggcucugcaccuggaaagucaguucaccuggauccugacggcaaagcccacuuccccuucucugcccagugagcccuccccaaaacucccucugucacaucuugggugguauccccugccucgcaggggacagaagaccacuucacuccucuugcuaauaggagaucuaauaauugugucaaacaaccauccuuugaugcucagagcugccucgccccacuuagcaacucaaguaccugagcagggaucagauucugcuucuccuggugagagacauggcagcagacggauggagcccaaaucuggccugacucauucccccagacccuccguccucugauacccaccugcagggcaacaggggaaaggcacagaaagacggcagggagcagccagugggggcugucccgaggaaccaccuuguaaaagucuuaaagugcaaagccaguauuuccagaauguucuuccgugccugaaggaaacagguagggccggaaagaguuaaucgccgguagucagagguuagaagacgaagcuccugcccauacacagaggugcagagagcaucccaagcauaauaaaucuaugagugcagaaggccucucuccucauuuguuagucagcgaugugugaaaauguuaaugaaggaaguuauaaucuaugagaauuucacuauuaaaauguaguucacgucugaaggcuucugcucacacacagcccacuguacaucaauccuccccgugcacugcuaauaauagacguaauugccucacucugucuagccaccuucacccuggcaauucgaagauuugcuacaacuguuauuguagaaauuauuuucgugcuauuaacuuugaguuuuauuauauguguucuuaaaagaaaauaaaugcagagagauuguaaguguauaucggguccccgaugaaaguauuuuaaaaaauauaacguaaugacaaaaagcacugaaguagggugauauaaugguuccuucccuuauugaaaccuaaauuagauucugcauuguaaaagugcauaaagggguuucuucuuuucguggagaaaauuucuauucugaaaauggcagcacauugccucuugcaaagccaggcuguggagaggagcagagaucaucugucagacucagaugccagcuccucccauucacagugggcaucugacaggcccagggagcagcucucuugggcaaacccaggacgccuuuacugaggggcccccguagcuacagcugcaguucucuuccuacagccagccuggccuggcucugcaagucagccccacgcccccuacacucacagcuccaaaugggcagguuucccgggcuuguagcuuaggggacagccuuguaaucggugugggcuuccaggccugggaccuaacaggcaucuggccaggcagucaucaaacgggaugugagaacuucagccaaaacuggaagucagacccauaggcagucuacguaaaacugguguggcagauacaacgaccccuuucucugggaagcaggguccucccacaguccgaaugugugaccccagcgcccugguaauagauuacuccagacugucguccccaggaauuuggcauuggauuugaggcccugaaagucgccucuucagguagcugaccugacgcgucugaacucggugucuggcagauggacugaggagcagaacccagccaucggcagcugaggaaagacgaugcagauguacagagagggaaaacgugcagagagagucaauggccauccggccacuggcccagguccugccugaagccuacucacccaggagacauuucuuuguuguuuuuugugaguauuuucuuuuuuaagauggagucucacuguguuacccaggcagggugcaguggcgccaucucggcucacugcaaccuccgccucccagguucaagugauuccccugucuuagccuccugacuagcugggauuucagccccgcaccaccccacaccuggcuaauuuuuguauuucuguuagagacgggguucaucauguuggccaggcuggucucaaacuccuaaccccaagugaucugcccaccucagccucccaaaguguuggcuuugcaacaggcaaugugcugccauuuucagaauagaaauuuucuccaugaaaagaaagaaaccccuuuaugcacuuuuacaaugcagaaguccccggccucccaaaguacuugauguugccauccgcccacccagccuuccacccacccaucaacccacccaucccucuauccacucaccuaccaacccaucuaccuucuauccacucaucuaccaacccaucuaccuucuauccacucaucuaccaacccaucuauucacccacccacccauccaucuauccacccauccacccacccauuuauccaucuauccauucauuaauccauccaucugcccaaccacccaucccuccauccauccauccaucuauccacucauccacccaaccauuuauccacccccaacccucgauccacccacccauccacccauuuacccacccacccaaucaucaauccacccauucaucuauccaagccucuauccacccacccauucaucuaucacccacccauucauccaccuauguaugcauuaaucuauccauccauccaucaaccaucuauccaccuauccauccaaccauccaucuacccacccaacccucuauccacccacccaucccccuacccauacauucaaccauccacucacccauucauccauccuuccaucaaauaauagauccaauuauugagugccugcucuguaccagcuacugggcuacugaaguaaacaaauuaguuauagaacuugccuccaugaagcuuugugaagaagauaaauaugaaauaauacaaaagaaauuaacaugaauauauaaagacaaauugugauaaguauuacaaaggaaaagcauauaguaugacaacagauuaugacaggggugccuguagguuuaggggguugagauuuaaacugagacuuaguaagagugaugaggaaggggaagaagagggagaguaggugccacagcccugacuguuggagcgucuggagcugaaaggcagccaguauagcuggaacguaguggagggaaggcagguagaaguagagggggcuccacaggacauagacacuagcucuuucugaaaaugaauauauuuucuaagaccauggcaccaagauagaaugaguuuccaggaauguaagguuccccgcacauacucuuagauucuuucuggaauuuacauuuggacaaucugccugaggggagaguaacacaggauaaagacagcacacaggagccacaaucuggaauguucuguaaguccuggugacuguucccaauccccagaguuuuggaggaugaaucaucaagguaaguuuacaugggucagccucagaggcuccccgcuccagaaaggacuccagagucuccuagcccaauaauccucccuccacccuacucacuccuucaugggagagugacaaggaggcccacaaaccaggcccaauuguccugcauuggccugguccccaccaagcccuaugaguuugggccacugaggcaggaucgcuccugcuccccaccccuccccaccccucuacggccagcaccuucaaccagagccacuacgcacagagggcugagcgaggaucccuguggagugaagggggaggcagccaggaggggguccuaggcagcacugaggagcuuaaagccaugcucugccaacugcguggggacagggagccagaacccggggccaugcugccugugacuuuggggaagggcgcuagaucaugagacaaguacuugggacacuuaagaaguagcuaagggccucccgagggugaaauucaggcaggaaacacuuguuccaagggcugugccacccacccccauaaggagccugcugaaggcccccacucuggccccuccucccgcucuccaugucacaggcaaugagaggugccucuccaggaucugcccucauuuccaaguugaugggauucccaauugccuguggccagcaugggagagggaaaugucacuuccugggcacagcuugggagcucuguccaucaucuccagcccuaaagacuguucuccccauugcugcucuaggaggcuucugggaugacuccuaggggaucucccagacacuggccaucggcgcaccuaccagagaacacucagggagugcucuguggguuuacaguguaacuagcuggagaagcagcaugugcucuagggagaaaagcaccaggcugagagucaagaaggcccgcuuccuaacacugugcagccauccaaauguuucuuuaaaaacauagaaaaacauuuauuaucuaaugcaauuaaaaauacaucauguauuaaaugucaaaaaaauacauuaugccuguaaucccagcacuuugggaggcugaggcaggaggaucacuggagcccaggaguuuaagagaggccugggcaacauagcaagacucugccucuacaaaacaauuuaaaaauuaguggggcaugguggugugcaccuguuauccuagcuacuuggaaggcugaggcacaaagaucacuugagcccaggagucagcacugcagcaagcugugauugcaccacugcacuccagccuggcaacagagcaagauucugucucagaaauaauaauaggccaggcaugguggcucaugccuguaauuccagcacuuugggaagcugagguaggaggaucacuugaauccaggaguuuaagaccacccuaggcaacauaauagggagaacuugucuccacaaaaaaauuaaaaauuagccauguguaguggugcaugccuauggucccagcuacucagaaggcugagaugggaggaucacuugagcccaggagguuaaggcugcggugagccaugaucacacuacugcacuccggccuggguuucagagugagacccugccucaaaaaaauaaauaaaauaauaaugagaauuagagugcaaaauuguacagaguaagaaauucugcuauguaaaaauacauaaguaaaaaucuguaaauugauuaaauguggggcaauuaccaucuucuaaaguacuuuuugaauuuuucagcuuuucuucaaggagcacgugcuacuauuagaaauggccacauccuuuauuggaaauucugaaauccuaaaaguuccaggaauccaaugucuuuuucuucaacuuggcaccuuuuaguggccacauuuaaucugaacugacaucaucuauugcccuuauuggucccacuugguguauuuacgucuuacugcagaaauaucagugcguuugcucauugggggcuguucucagagccaccgagacugugccagcacguacccucaguuacuccucuggaauccagagaguucugaauucuguaacagaacugacuccaaggguuuccgaugagggaaccacacacccagugacagcaaaggaagcccaaggcucuaggcucaaucucguauccucugugacuugcuguguguauuagucuguucucacacugcuaauaaagacauacccaagacugaguaauuuauaaagaaaagagguuuaauggacucacaguuccacauggcuggggaggccucaugaucauggcggaaggcaaaggagaagcaaagucacaucucgcaugguggcaagcaaaggagugugugugcaggggaacuccccuuuucaaaaccauuagaucuccugagacuuagucacuaucaugagaagagcacaggaaagacccaccccugccaugacuugauuaccuccuaccaagucccucccaagacacaugggaauuaugggagcuacaauucaagaugagauuuggguggggacacagacaaaccaaaucacuguauaaccuaacagaagucacgucccucuagggccucaauuuccagaucugccccaugaagaaugaagaucuguaagucucucugggucugucacuccacgggcucgugacucccggugcuacuucaaugcagugcagagucccuaaaggggaucccaccccuccagcccaccuaauaccagccacuuccauccuuggcuggccagagagaggagccccgggccuaaggagggagacagaggauucuggauguccaaugguagcagaaugguaagggcccaucaggcaagacagcaccugcccucgacuccaccccgacuuguaggcccccaacaggcgagacuucagcacagcugcaggugagcaaaggacucacagcuucuccaguaagugcuccuggaggggcugucaguaagaggcacgcccuccaagggugcuucucucugaaagaaaagcucauggggguaaggucucaauagugagauuuuaaggacuugaauaacagaggaacaggugggaugggggugcguuuuucuaugucccacaauucacagcacugagacucccccgucuucaugcgcacauagugggcugagcccucaaacagcuguggagagccaggaaagcuagaugaggggacaguguugcacacgccggggguccucucccccagcuacaccaccaugagaggacagugucccgggugccggggguccucucccccagcuacgccaccaugaggcgacagugucccaagcacuggggguccucucccccagcuacaccaccaccagcucagcuucaugauuuuuaguuuucuucuaauuuuaggaugguagcagcguucuaagaacgccucuaaguguuuuagggagaugguaaugguccuacacuaaaauaauucaaccaacacuauaauuuuagugccaccaucaaaaugaaauaauggcuguuuacuauguuacaccuuucaaaugaccuucauuugaauacaaauuguggcuugaaauucuaaaagcugcucaguuccagaaggcugcaaaaugcaggaauccaacaagggcugcucuucccagagacuccuccccauaugcacacgguuuaaauggaucuuucucuggagcugcuggagacccauuuagcaccuugaugcagaauugaauggcccugacugggcaaaauaggcccaggaguuggaggaggcggcagcugccugcagagugggagagggagcagcaccuaggaagccccccugugccggagacccugugcaggagcugggagaguucaggaaacuuccuccaagggggcagggauggggcugcccugccaggccugguccaccccuccagcucuccccaaugucuuucagccacauccuagcuucccucucguuuuccuuccccugcuguccuccgcacucccuccuccagccacaccaacaacucacuaagggguacugaaccucaccucagccugucuccucugugucuuuguucagaugcccacucagccaggugcaagggagagcgagcuccccaggcuaauaccugccuguucacgaugcauccaccacacaagcauuuacugacggguguggagacagacagggaugguugucucuucuaugcucauccaguaccuccagguccaggguguccugcucagcucuguaucccaaacaccgagcaauuaauguuuguugaguugaaaugucaucucuagaugcuuccuagacucaccaauagaauacauccauccugucuaaaacaugcggucauuauuacugacuuuaauuuuuaauuuuugcaggugcauuguagauauauauauaucuauaauauauaaaauauaaaaauauaauauuaacuauauauauguauuuuuuuuagauggagucucgcucuguugcccaggcuggagugcaguggcgcaaucucagcucacugcaaccuccgacuccuggguucaagugacucuccugccucagccucucgaguagcugggauuauaggcaccugccaccacgcccagcuaauuuuugcauuuuuaauagagacagaguuucaccagguuggccaggcuggucucaaacuccugcccucgggugauccacccaccucaaccucccaaagugcugggauaacaggcgugagccaccgugccuggccugguguauacauuuaugggguacauaagauguuuugauacagccaugcagugcauaauaaucacaucacggagaaugaggaauccauccccucaagcauuuaucuuuuguguuaaaacaaucgaauuauacuuuuuuuguuauuuucaaauguacaauuaaguuauuauugacucuagccacccuguuaugcuaucgaauacuagggucuuauucauucuauuauaacuauuuuuuuuaacccauuagccaaucuccagcgcccugaccaccaccacacccccacuacccuuccuggccucugguaaccauccuucuacccucuaccuccacguguuuaacuguuuugauuguuagaucccacaaagaagugagaacaugugaagacugucuuucugugucugguuuauuucacuuaacauaaugaccuccaguuccauucaugcuguugcaaauaacaggaucucacucuuuuuuauggcugaaugguacucuguuguguauaaauaccacauacuacuggcuuguuuacacucaaaggaaaauuuuuuaaaacccagguucagcacuuuuuagauacgugacuuaggcuaagcacucaaucucucuaaaccuugguuuccauaccucuaaagcuguaauaaucacccaaucuacccagugggcugcugugaagaguaaaugacaugauaugcuuaaaaaagcuuaguccaggcugggcgcaguggcucacgccuguaaucccagcacuuugggaggccgaggcgaguggaucccaaggucaggaaaucgauaccauccuggcugacauggugaaaccucgucuguacuaaaaauacaaaaaauuagccaggugugguggcacgcacguguagucccagcuacucgggaggcugaggcuggagaauuucuugaaccugggagguggagguugcagugagccgagacugcgccacugcacuccagccugggugacagagcaacagagcaagacuccuucucaaauuaaaaaaaaaaaaaagcuuugcccaguacuuggcuccaacauaaccccacuggcaccgagugaacagaaguaugcggcaagagcuguaguuacuguugugcugggcaucggcaucuguugauggcacccagccugcccagcuuauucuccgauguccuccgcagguugcaacuuccaacagcaggacccgacccacacgaccuucucccccauccagugccccuguguauuagucuguucugacgcugcuaauaaagacagacccgagacuggauaauuuauaaaggaaagagguuuaagggacucacaguuccacauggcuagggaggccucacaaucauggugaaaggcaaaggagaagagaaggcaugucuuacauggcagcaggcaagaaaucaugugcaggggaacugcccuuuauaaaaccaucagauuuugugagacuuauucacuaucacgagaacagcaugggaaagacccguccccaugguucuauuaccucccacugagucccucccacaacaagugggaauuaugggaguuacaauucaagaugagauuuggguggggacacagcgaaaccauaucacccugugcuugcuauuugccugacaugucuggaauauucucuucccuccucugcugaugcucggcacauccauccuucacggagagcuuggcuccucccucucagaaagcccuccuggaucauccuggcccauguccuuuccuccugggcaagccacucaccuaggguccaucacagaugcucuacugcucccgagagccuggcuuucacguggaucugcucucucugaaagguagauuccauaaagauggauucugugggaucccuugucucccacgucccccuugcacaguccagcagccaacugaacucugugccugccaacacucugaaaggcaaggcacagguggaaacgccuauuucuccccuucccaucagccaccacacaauccucaccccaggcccaguuuuccaggccagaagugccagauccgucucccugccccaucucacacacacacagcaggagguccugcugaugaguucuccuugacaugcaugcagucacacuucuccggcuguuccucguccugaccuuuguggccuucuuccaagaagcccaagaaagacucagcggggccucugccuccaggcacugacuguuucguuuugucccaugaucagauugaucuuccuggaaccccaacucaauuaggucaaagucugacuccaacagcuuugcuuuaggcauccuggugccuggcucgagugagcauucaagaugcucuggucucuguccacaucgcagagugucacucagcagcggaaaggaagggaguacugacgcucgccgcggcagggaagaacagaucaugacacugagugaaagaaggcgguuaccaaaggccacauacugcacuauccuguuuacaugaaaugucuagaauaggcagauccauagagauagaaagcagauuggugguugccaagggcugggaggaaguugggggcuugggggugauagcugaggaguacaaggcuuccuuuuggggcgauuaaaauguuuuaaaauugguuguaguguggcugcacaacucugugaguauacuaaaaccacugaauuguaggcuuuacaugagugaauuguacccaucuaaagccuacaauucugucucaaugaagccguuauuaugcuccaagcaggcuccaccuccuccucuccugccacgcuccccaucagcuugaacaacugucauugcauucagccugcccaacaaaugcccauccuucaaggcccagcuccccagacucucguagcauucguucauucuugcagucaacaaacgaugaccgucccuccugggaauuccacagcaaacagcgcacagaggagcauccccaagagcccacagucugaugaaaaacaaacaauaacaacaaacaaagcagcaagccacaggacaauuugcaugcagugacgcuaaccaugccacuccgcugcuucuuaauuuuuaccgaaauuuucaggguuuacuccuguuccucuuacaaagauccugagccccgcaagagcagggacaacaugcugaacgucccuauuuuuccccaaggcucacacugauggugguggggggagacaguguggaaugcucggcuuccagcucugccaccuuccagcucuggugugacucgaggcaggccccgucaucucagcccugcagcauccucccccagaaaacagagauggcgccuccuucacgagaaggaccauggguggcagggugauuuauugauaauuuaaguuggcaggauaaucuguccaaaaauuaacuuguaucuuguaaacucgucagaagugaaggagaguuauuuuccccuuguccaaggaagauagcaagccuuauguuuauuccaacaaauacuugauauuugucagauaaauuuuuuuuauuauuagauggcaaaaggccgucuaagcccaagggaagaagacagagaaaaguauucuaaggggauguggccccaccugggccgugaucaaaggaaccugcaaaaugcaaugcgucuuugccaaacugaagccuucugagcccaguuccaaagugcuaggaaaccccagucuggaugcacagacugucuuccaggacguccgugcggcagguaagaggagucggcuuccucaaagacucccuccgagcagccucccugcccgaccaacauucacagggagcgcacaggagguuggauaagccuggaccuuccaucucccuggccucgccucacucccaacucugggacagaacugaacaccaccaucauuuacuucaaucccucagcuuguuuaagaaaaauugcuugucuacaguugcaggccaccaugcugugugccaccccauuuagaguuuauuuuacauuaaaucuccaagcuagagacccuccaguuggucugcauaaagcagaauuauugguccaaguguuuuuaaaaauagaugcaagccuagaccccaagaaacugaagggauauuaugggaauacacaacuguauuguuuuguuacuguaugaaaaauuggauucuccgacuccggguuuccccuccugcucccagguuccucccucuccuuguuccucacuggagaugcugcugcagcuccuggcacugagaacaauauauuacaaaccagagcagcccagaccgagcuccacacacugugugggcccccaguaagcuccagccugucugucugucuucagacaaaugccauucugggccaaacguuaaauaaugagaaccccacaaaaauucaaccgcagcuucaagcuggauuugaggaucacauuucacacaggcuuccacaaaaguggguccugacagaggaaguuccuuuuggcgcugagauucagaaacgugaaagccccuuccccggcugugggaagguggggcaggaggcagcacuagcuuccaccucccgccagccacuguagaagggagaugaggcgauacuuucauucgcucucagggccacaugaacagccaugggaccaagaaugccacgguccaggugagggcugagucuuuacaaggucggugucacccagcagaugacaaaaccaaagagguucagaaucguggccacugucaagauaaauuaggauaugauccagcaaucccacuucugaguauuuauccaaaacaagucauaucugaaucucaaagagauauuagcacucccgugcccacugcagcacuauucacaaaagcccaaacguggaaaccaccuaaauguccaccaacagaugcgugcauaaagggagcgugggauauacacaugguagaauauuauucagccuucaaaaagaaggagaucuugcagcaugugacaacauggaugagcccagaggacacuaugcuaugugaaagaauccagucacagaaggacaaaugcugcaugauucuccuuaugugagguaucaaaaauggucaaaccccuagaagcaaugacugcaguggugguugucaggagcuagaugggggaggaaauagggaguugauguucaacauguauaaaauuucagucaugcaagaugaguucguccuggagaucugccacacagcaucaugccuaaagauagcaacacauguuguacacuuaaaaaucuguucagacggcuaggcgugguggcucaugccuguaaucccagcacuuugggaggccgagguggauggaucaccugaggucaggaguucaagaccagccuggccaacgugacaaaaccccaucucuacuaaaaauacaaaaauuagccaggcaugguggugggugccuguaaucccagcuacuugggaggcugaggcaggagaaucacuugaaccugggaggcggggguuaccgugagccaagaucacaccgcugcacuccagccugggcaaacagagcaacacuccgucucaaaaaagggaaagggaaaaggaaaaggaaaaggaaaggaaaaaucuguuaagaggauggaguucacguuuagcauucuuaccaaaacaauaauaauaguaaaagaaacaauuagguucaggcuguguuuggagacagaaagacgucuacacugacuccacacucagccaggaagcacaggcagaauucaggcuuuggccccucuaaucagcacuucccuggccaacugccagccccuaagacagccagauaggacuucccucuuugccucaacaccauucuccuggaacauaagcucaccgagggcagggaccguguugccuggucagcacccugaugcugggaaagagcagccuggcacacggcaggcaagggaugaauaaaggcuaauugcagaaaucagcacacagaagugcuuacuaaacacagauccuuucuccagaugcaaaaaaaagaaguaaaaauucaaacaguugucgaaugucaaaucaauauuaauuuacucaaaggcaugaguaaaugucuuaacggagguuuuucugccuuuauuaaaggcaaccggccaggugugucacuaggagcacacacgggacuuucaguuacuuguuacucuucccugcaauuuacauaggcucacaaucuuagaugucauaaagccaaguucccucaccacuggggugacagggcagucacccccuucucugcacaauaaccccccugccuuagcaaaccuucccaacagggaagccccuuguugggaggaaaaugagaagcaaaggacacuucugacccaguucuccuucuggggccuucacucuacccccgccccuccuucuccaacaaugucaaauuacaaaguccugcccugcacaccucaucaagacgaucagucuccugcucacggccuguccagaacacaaggccaacccucagcaccugcccgcgaugcucuccucuccucucuccaggccagcucuggcuuuuuggggaggcugacgggccuugcugacgccaauggcagcggagccaagucacaccuggguuagcagugauaaugccauugcugagacccgggggcggccacaggcaggccuggccuuuucuucucuuuccuuuuuccuucggagagcaggaauccacaccaaucacuuaccuaauaagcauggaggauggucauggggguuuuuaucccagccacagacaccauuauccugccccaaaucagcucuaacacaacaaggaauucagagucauuaaaugccuuuuaauaaaaggccugccuguggaucuaguuuucgguuagagacuuacccagaaggcacuuuggccccugagcaacuccaaagacaacguaaaauuaguagugagggugggggugguaaaaacaaaaccaaaucaaaccggacucccccacugaggggcuugcaaacaguuugggauagcacaauuucaggauuucuauuuauucucaguccucauuaaaguggcagcagaaugacacggauacaauccgaucgucugcuauuugauuaccuuuuuauaagcgugcugccacaaagaagaaaguucaacacuccagcaaaagaggcguugcuauaaauacucccacucccagacagccacguguaauuacucaucaggaguggggagcaugaggagcgaggcccaucgugugcucuucuccagcaggaacgucucaugcucacucuguuaauuacuucaagguuucuucugugucugcuuugugcucacugacacuccuaggaccacaauggagcuggcugcugggugacagaaagccaagccccuuuggaaagaagaggggcuuccaaagcccugagaaggaaggaaggcccgaaccagagggucuucccuccaaaggccagggagugaaguuuggagccaggcugacagggccggccugguuuaggaaaggagaggcuggaaacagacacagcaguggucccugcagaggaccacagccagcaacgguccaugcagacacuaccacuggccucagggaacaccuggcuguucauucuccugagguuguugggucuguucuguucuccaucugucuccuuuugccagguuaucuucagaucuccacugagauagcacuugcuauaguagaauguccugacccaccaggacuggaugauacguccugaacaggugcucuaguagcccccugugcuucugauaugcacaucgaucacauuccuaacuauugccugcuugucucucccaucccaacaucaguucuguggagucuucagacucacgguauccuucaggccucagguggagucccuggguccugucgccacauccuuugccaggcccuuggagugacccccuccaagccgagagucccuggccuggcaagaacccccauuaccuccucaccgaugcuggucugggaccggccuccacuccuucugcugccucccacucccugccacccauuccgccuccuggaaugcugucugugagcacuccacggcuccaauacauauggaggaugcuuauggcacgucgugcaagcaaagcaggacauaaggucccguacacauuaggauuacagauacacuaaauauaugcauguggaccaaaaaaggcacagagaugcgcugaaaucacugagagugguagggaaauggaaauguuuucuuuccaugucccucaauuucuggaagauuauuauauaauuuuauaacaaaaauacauuuguaauuuaaaauagucuuacagagauggugaacaaauuagugguugacugggguuagagauccugggagggagagggugaguugaccacacaggguuggugggaggaugucuguggagauggaacaauucugcaccuugacuguggugguggugacacaaauuugcacgugugacaugaagcaacacagaacugcacaugugcacuguaucgacaucuggguccuggcugugauacugucagguaagaugaagccauugcagaaaggagaccaaggcuacaugaggcccccugaacucucuuugcaaauuccuguaauaauaauaaauaaauuucaaaauaaaaaguuuaaaauacaucuaacuauggucuacacccauugcugaggaauguggaugaaguuuaaaucguaggccuacacuggcuuugaaggccaauaaacacccauccaaccuuuauuuuguaaauaugggaagacacagagccugcaaagaaaccccaaagguaggugcccaucucacagaugaggaagcugaggcaggaaaagugcacugagcuggaacaagccugaaguccaaggccugcaugaaaaagcucaucucacugggcaccaccaguucccacuacaucaucugggcccuccucaccgccccaaagcagaugugaucauccgggggaggagccggaccagguuccagggcaagcggcaguccaacggcuggagcccaggaacccucacccaaccuagccgcucacucccccaaccuggccgccuuuacuucugcagcguuccuugccccuucuagcuccacucaggucacaggcaucccgcugccgccuccacaaaccacaaacaccaccuccuuccugcccagacuccaaguucagagcccccaaccugcauccugcucagaagcugccugauuuagcauggcucgggcugauccaacaagugcccuuugcgguagacaaggcaucugguuuagcccucacugaaaaugcccacggaggccaagcaaggaccccuauguaucucagcugccauucuugaccucuucugguccacucaccacaaccaggagcuuucuaaggcaagacuggccccucucugucccgauaaagucaaacccuuuaaaugucccucaacuuggcaagacagacuagcuccuuggagacagacacccccucgccccgugccucugcagcccaccucagcacaccuguccuccacuagcuccaugcugcagccacacuggcgacuugcagcucccuagucacaucccgcauucucuccuugaagcaccugcacauucuguucccucugaccaggauguucuucccuguaacccgccucccccaagcccccaccuccacucucucuauccgucuccuuuugccaggguaucuucagaucuccacuuagauagcacuugcuacgguagaauuuccgguagaauuuccugacccaccgggaauggaugauacguccugaacaggugcuccaguaaccccuugugcuuccgagacacacaucgaucacaauccuaacuacugccugcuugucucuccuacccuaacaucaguuccaugaggacaaggaccauaugcacugcccagcacagcaccuggcacgcaguaggcacacaguaaacauuugucauauaaaugaauuucugaugaagaagcugacgugacuuccugaggccauauacaaggcagggagcggggaggagaacucuggcgguaucuccaccgugggggcuaugaucuuuccaaccaaauaaaggacgggagaggggcaagggccauccuuccagacucuacuuccgaucuugucccagcacagaaagagcggagggcaagccacgauacaugccuugcucucucugggagauuucuagaugcuggaaaacacacccggggccacauuaagagccguuuucucggcacaccaagcggacagccgacugcuccugagggugccaucuggggcagggaggggccaacggaauucguggguuccaugaugcaggaguagaggaagcuaucuccacagcaaagggaaugagcugcugaacgcugccagcucaguuuggcaauuuaucgauguucuucgaguuaaagcauuauuacuaguuugcauauuuauaaugugcccucugguuauuaacugugauauaaugccaacugagaaaaccaagagaccucagaaauauuuacauagcagcauaauuaagacuaagagcugagucacccagggauccuaccgauuuuucuggaagagaaaaaauaggacauucugacuucacccccugcccuaagauucucccuaaaucugagccaggcagaagcccacugugccuccuccaauaucacucucagccuucagcagagaugcaugucaccaucuaugaaaugcacaauugcuuccucuccacagcagccucagcccagacuuuucaaaugcuggcugaaccacacagcacagccagagcucauggagaggagcggaugugaggcaggaacacguggccaccagccuaagcugcccuagagcccucaaccacaccaacauccccugggaauccucaaaccuaguggcugaagguccccugagauagagaaugcucucugaauggcaagcaacaaagacccucccaggacccuagcagcaauccuggagucagcccugaggccacauucgcggguggggagcugggaggugcaaagcaugggcucuauguuuuccagaggaaacgcaguuccaccccccaccccaccccaucucacucccuucaucaacccccuaugucucccucaaucuagaacuccauuuucugaaaaaauucagguggguuccaaugggcuuaacccugauuuuuugguuuuuuuguuuuugaaauggagucucacucugucacccaggcuggagugcaguggcacagucucggcucacugcaaccuccaccuccuggguucaagcaauucuccugucucagcuucccaagcagcugggacuacaggugcacaccaccacaccuggcuaccuuccguauuuuaguagagacaggguuucaccauauuggucaggcuggucucaaacuccugaccucaggugauccacccaccucggccucccaaagugcugggauuacaggcgugagccaccgugcccagucucaaccaugaauuuuuucaugaguaucuuuuacaauaaaaaagguuuuggccgggcacgguggcucaugccuguaaucccaacacuuugggaggcugaggaggauggauugccugagcuuaggaguucgagaccagccugggcaacacggugaaauccagucucuacuaaaauacaaaaaaauuaucugggcaugccagcaugugccuauaaucccagcuacuuggaaggcugaggcaggagaauugcuagaacccaggagguggagguugcagugagccgaaaucacaccacuugcacuccagccugggcaacaaagcaagacucugucucuaaaaaaaaaaaaaaagguuucaaaaguguuuagggaaaaucagcugaugaauacauaaauagaacguaucuguucaguggaauauuacucagccauaaaaaggaaugaaguucuggcacgugccacagcauaaaugaaccuggaaaacauucugcugggggaaagaagccagagacaaaaggaaaaauacuguaugguuccauuuauaugaaaugaccagaggcagcaaaucaauagagacagaaguagauguauggucguuuagggcuagggaggaugaggggguuggggugacggcuaagaagugagggguuucucuugggguaacacaaauguccuaaaauagacuggggcaaugguugcacguuuuugugaauauacuaaaagccauggaauugaauacuuaaaaugaguaaauugcgugauauguuaauuacaucguaauuuuaaaaauuaaaaaagugggaaaaauuccuguuuguccugguguggggcuugaaucugagaguggcagucucaucuaggucagccugugacaggcaccuggccagcgcgcagcccugugaagccuaacuccuucuccucucccgaugguguccccuccccauccccgagaucccccacacacucccaaagcccuagcuuguucuugaccuaggaagcugcugcgaccagucccagaaagaucccaagacagaaaaucuaguuuccacaggacacaacaagcaguaacuaaugccagacgugcggcaucgagcuugcaauaaaugucauccuguuuggcuucugaaagggucucugauaugcaguuaaugccgcauucaggcuccauccagaccucaucacggcgauaugcaaaugcagcuuuugucacaaccggcacuaacucuaauaacucccaaagcgaaaauguucucauaaaaaccaccauaaaaagucccuuauuuuauugccagcuaaguuuucuuuacuuguugucaggacuuucuccucacuguugauuagcuaacaggcggcacguccauuuuuuuuccuuuagagaaaccagggcacacaaucaccaaccuguccccucccuccaucuagagccgccuugcuucagcugcuaccagugcccagcccccucugagccaggggggcuaauaaaccacauuuaccuucccccacaggcagcugaaaugcauuaccuuuggucugcugguugcacucccuggucaaaugggaauauaaaaaccagccuuauuuauaacaacagaaugccucugcucaaguuagagcuggcugcgugcccccuacacacacacccacacacauacacacaugcacagacacaagcacacacuuaaacaugugcaugcccccaggagcacgugcccacacacaugcacacaugcacagacacacacaagcacacaaagucauacacacacacucaugcucauaccacacucacuacuuuucccgaaguggcuuucacauauuaauacaucucaccagaaauacagcccuuccgcuggcccugcuucuuccuugccagcaccaugcacccaaguaagagagggucaggcaagucucccagacaagacccucccucucuguuagcacagacucuaagucucuaccugcugcucugcgacccuuggaggagggcucaaagccccuccaacacaagacagcucuuucccagccgacccggccucuccuucccagcucucaaaaaagacacgguggaagacaguccccuacuuccauccacaaaggccuucagcugacucgucucuccauagaaaucuccugguccuccuuccagagaaucccuggcggcaucucacaagcaacauauacugagugcuuccugcaugaggccucuuggagaauccagccacuccucuaagcaccucaaagggaccaaagcaaaacagcgucugcggggauuucuuauaaaaguguacaaaggaaugaguguaucagucacguuucuacuugugacauuagccugugggggcaagagaauaagaaaauguagccuccuuaguauaaaguguccauauggaccuacagaguggcuacuaccagaaauaugcuuucuccaaccugggagagaggcagccauggcuuuuccacccaagaaacaaagacugcagugucagauaaaaggugggaccuaggcacaguucuuccaaguucuaugacauccucugagacacugcagauggaacauccagagaagccaucacguugugccccuguacaaaacagccaggacgcugcgcccuccccagguacccaggacgcugcacccuccgggggcaccgaggacacugcacuccuacaugaacacccaggacuccgcaccccuauacagacccaggacacaccacuccuacccagaccuccaggacgcugcaccccuacccaggcacccaggccccugcacuccuacaugaacacccaggacacugaaccuacccagauccucaagacacugcaccccuaccugggcacccaagguacugugcccccacccaaagcacccaggacacugcaaccaaaccagacacccaggauucuguauccuacccaggcacucaggacucuguaccccuaaccaggcacccaggauucugcaccccuaucugggcacccaggacgcugugccucacccagagcacccaggacacugggucuucugcgacaggcgccccagccuuuagcaggacccagugucccccagggcacaaagggaaggaaacugaaguggaacaagggcccuggcccuuucccauuguuagggucagggcucuuggcccauggugaggggcgucucugcucgcacggucgccaccuccaguccgcaaagcgcagcuccccgagccgcgcccagcccccaggccccgggagcgcgcccccccagccaggucagcagcccgccccaccaggucuggggaggggucggagagcggacaggugcaggcggguugaggcgccgccuugcccgaugcuuccccuggcagcucugcuuccuuuacucgggguuuuaaaggucauguucuccgucagcggaaacauucuacaugacacuucugagacagaggcuccuuuagaggcauuuaauccaagaaaggcacccccugaagaacaggguuuauaggucacggcucagacggccuauaaaucacgcuugccgcugcggggcgccaggcgggagcuugaaggccaggaaaacaggguggggcccgauuggaaagagggguggcuccagaggggcggcgcgggcaaggaggggccaaaagggauggagggcggggccagucacagggcaaggccgggauggaaagcggggggggggggggggccaggugggugggaggagccagauggggcggggcccauaaaggaaagauggguaguuccaaaggggcggggcgggugaggaggagccaaaagagauggaggcuggagccugccaaggagcugggucaaaauggaagguggagugggugaggccagagggugggaugggucaaaugaaggcggggcccuaauggacagagggguugguccagaggagaagggccacaaggaauggagaauggggucugccacagggcggggccaggguggaaggugggaaugggcagggccagacgggugaaaggggccaaaugagggcggggccccaacugaaagagggguggguccagaggagcucggcaggcaaggagggaccaaaagggauggaggguggggccagucacagggcaaggcagggauggaaagcaggggaguggguggggccagaugggugggaggagccagaugggugcgggcccaaaaagagggguggguccagaggagcucggugggcaaggacgaaaagggauggaggauggggccagccauggggcaggggcaggauaaaaggcagggaguggguggggccacguggguggguggaaccagacaggggcagguccacagaggaaagagggguggguccagaggggcggggcgggugaaacggagccaaaaaggagggguggggccaggugggaaggcuggaugugggcggggcaagauggguggaugggaccagacgagggcagguccauaaaggaaacgggauagguucugagggggcggggcuggcagggagagaggaaccaaaacggaaaggguggggcuauagaaagggugggcccggggaagaggccaaaucggagggcgggcccagagggggaguggaagggaggaggggcggggcgggguggggaggggcaggcgcucuccuccagcugccccuggccccucgccccagggaccagccucccagcaaggaccagcugaccuggggggaguaaaaugagguggguguccccgcugcacaggccggggacacagcgucaccuguugucugagaccugcgugccuugucgggguccaccauguaucuggcacucggagcacacguguguccugaauaaaucggggccccggcagaggcaugagacagaggcgugaggcccaaagcagcaggcuccaggcucuugcgcgccacggacaccgcgagggagacacguuuggggacagcccggaggcugagggggcuuggcuuugacccgacagggcaaaggacugccauaccggaagacgcuggacuggccgccggggagagaugcacagcgccuucccucccuccccaggaaaaggggcuucccugcaacaaccucugagcaaggcgcacucuggccguccucccagggacacccagccagacgccccuucuaguuuagaggcugggggcaagcccggugagaaagaaucagucuaguccucguuugcacccaguuuucaaacauucaagcugggcugguccugcgguauucauguccuuuggagaccgagaaugaaugggcuuggaucaauucaaucaauccccucaaaauguuaaaaaccuaagaaaggucacugccagugaauauuccuuucagaagccucacccuccccacccgccccaaacuccagaacuaugugucaaggaaacaugacugagagcccugggcucucacgcccccggcucagcccaggcugccacugggcccagggugaacacaggacccaagcaauggccagcaggaacgcaugguggucggcaggcagcgcaccuucuugccggcccagcacccaaggucuuaccagcaccccaauucccuacacggucacgaugguggcgccugaacugggagggacgugacgugcagagcucaucccagcaagucuguccuucaguucccgcuaggucagucccucuggccuccccaaagcccuuccuuccagcgugcuccuucugcaagcuacuuagauccucacaacagaaucccuguuuagcuuaauuuagcuagaguugguuuccacggcuuacaacaaaggaaacuuaacugcaucgcagcccaaucgcuuucuccaaaccuuccuaaauucagacaaguuagggaaaagaagagugaaaugagaauucauuccagaaacuccccuaauaagaaucacuauauacaaucuguagcuacaaaaucacuuuaagcagauguuuucacuccaggcugccuggguuuaaaacucccagcucuaccacuuaccagauguaugauauugagaaguuacacaaccucucugagccucaguguccucaccuguaaaacaggcucaucauagaacuaacugaugucaugggguuauaaaggcuaaauccuuucacauauguaaagagcuuagaacaagaccugcacaaaguaagagcucugugcuuggucacugaaaucaaauuaaaccauccacugguccuccauguaugcaucauuuccucagcacccacugcacacgcagcacugccccaggcacaaugacacaaaggcagagugggcucugcccucgagaagucgcugucuagcuggagagacagacuuguaaacacauaaauccguguccgaugugauaagacuauuccggagguaucaacagagugcugugggacauggaggaggagugauuaauuuugcuucaggcggugggggagucuuugccgaggaggugacauuugagcuggacuuugaaagacgagcucuccacagaacuaaaucuggacccagugccaagagagucagccuggaaaaucaauccagccaccgggaggaggggcagucggcccagacugccuucccaaugacucccugcccuggaggacacgcagcuccuccaaaaugggggcccacacugucccuggagcccaggccaggccucuguuucuaacuuggccucauuuucccuccaucuggcccccuccacucacgucucguuuaacugcucucugcccccaggaaaacuccucuggucucugccccuugaaagcaacuugcauuuucuuucuccaagaacaaaaaucaucauaauugcuuuuaaauuacauccuaccuuuauagaaugcuuuacagauuucaagaaaaauuaaacauagaauaacagucaaggucagagcuuaauccuaacucugccaccaacuaccuggugaccugggacugguuauuuaauuucucaugccucaauuuccucaucuguaaaauggaaucacaggguugcuauggggauacaaugaugaacaggcacgcaguguuuagagcaggaucuggugaagaguggguccucagugagugccuucauguguguccucucccacccugggucucucugcucugcccaugggaccugagugacucugugauucaugcagaaggggugcugcagaaggccagaccugaaucugaacccggcucagcucugggcuuacuaguuacuuacuagugaagugaccuuacaagagcaacguaaccucaaggaaaauggggcagucagggcugucucacagacuauggagaugauuccuaagauaaugcaugccacgcuuggcuaccuacuaugaaagacacgcucagucaacauuagcuacuuuuauuaacaauaaauacuuuccuggcaccugacuuuaugccucaucuccgugaugaggcuaugaccucuuuugcagccugaggcaaaucucacuggcacuugcggccccaccauccccugcccgggacccgguacaccgguaggcacccgggaaacacugacugacaaucugauuaccagucgcccugggccugcucugagcaaguggcuucauccagcucagcuuagugguaagcaguggugcccaaggccgccgcuuccugcaaacucccucacaguguccccguguccuaugggggaccccuccaccugccccagccucccacaggcacacauccaucucuucuucacagcgucugagcuacuggcucagagaggacuguggccacccuuuucucccagaacacacuguguacaaaucugugauuuccccuggauaucuauauaauuuuuucaauacaaacugaaccaaggaugagcauguuuucaggacucucugcagaauugcugauguuauuuuugaauugucggcagcaaggacucugccaaaauacucaaggucaagagaccagcaugguucuaggcaaucuguaccucuuaaaacagugacaaauauguuauuuaauuuuaaugagcuuuuuugcaucucaaaucuaauuacagcauuaucaaguacugcuuugaacugcagguggcuucucauuacgugugcgaagccugccacgagcauuuuucgugaauacuaauaacugcuuaauuuuacuauccgcuuaaaaaaaaauaaaaacuuucagcaacuuacaaggcugggcuuuauaaagcaucuguggagggugagccacacagcaacgcagcuuaauuaaaaaaaauaaauacuguauguggccacccuggagggugacagcucgggaagcugcagaggggugguggacuaggcugggaggagauucgcuucaugcacuucuuggaggcucuguuuuauugcaggcuuauugcgucacauucaaauuucccaauuugcuugcaguucagggagaacgguuccgucaacagauuuucugggugacggacuucaguaauaggccuggagcuggaggucccuggggaugcgcuccagaaaucuguuguguggacagguccagggagaugccuggaaauucaucagagaaccuguccgagaggagaguccagcugccucuccgccaggcugggaugaaagagcagagguggccaggggguccggggcugcggaugagacgcucugcaaucccagaauggugaaaguuuucaaaaccuguggccaugacucccugcugguggguuugugcagcgucuggaguuuguguguuguucguuuauuuugaaaacuguuaaagcugaacuuuaucuuauaccagcaggcuucccgauuugcaccuucuccagggaggggccuaggggaaagguggaugcuaaugcuagguucuccaggaaggaaagggugcacacuuaccauuuucauucagggagacucccacacagucugggaagccaugggguauguccacuccuggguuuuguucacgaaagaccacacccugucucugacugggagccccuagaaaaugcaagugacaucugaggugcaggccgaguccagugcugacaggcgggagggaacagagaggcuguucucucucugauuuccuguaggaccagcucagcuuugcuuccucacgucugauccuugccugugcccagcucagagggcacaaaagucaagcuggcucaaagcccuacucuccaccugccuguggcaggcagaauaauggcccccuaaagauguccacgucauaauccucaaaaccugugaauauacuacguuacauggugaaagggaauuaagacuguagaugugauuaaggcaacuaaucagcugaucucgagauggaaacaaucaccuuaguguacucauguacccaauggaaucacaugaguccuuacaaauggaagauaaagaagaggcagaagagagagucagagaacuaugauguucucugaaagagacuugacuugccagugcuggcuuugacgacggaggaaggggccaccaaucaagggaugcaggugaccucugaaagcuggaaaagccaaugcaacggauuaucucccagaguccagaauagaacacagcccugccaacaccuugauuuuaaaacaccgagacccaugucaaaaucaagacccaacuucugccuuuggagcugcaagauaguacauuugugucacuuuaagccaccaagucuaugguaguuugugauagcagccacagaaagugaauacgcugcuaagagcugaccuggaggcagacagcagggcccccagugucagcaucaccagucccagugcuggccacauucaggcuggggugggguaagagcauccuguaacaccucaucaguugcauccuucccccuuagaucugcggcauacaugcuucuuucccaaagagcgcaucugaagcaagccuccaucaucccucuguugaaucacaugguuucuuaggucccagccccacauccaaggcgcucugauucguggguuuugucuugaaguuugucauuuagcauaagaagggcaggccucgcagcccagcugggaagacugcagcagcucagcugggcccccaccaaggccaugcuggcccgaccgcuacuaacuaacuaaucccacccaggccucuugcuggccaugccuccucgggaugaggguggaggagccucaaacaaagccacaccucaaggcagaaagcaucccuggugucagcuugucaggcagaugcucugcucccacagucccgacagacagagggaguuaaugggccaacacugagcccuuuguuuuuauaagagaacaagugguuuaugacaaagaacaaaguuucccucuuuacgaggccauccuuggugcucccucuccaagcccauuaagccugguuaucucuuacacaacaccgccacacagguacugcugccaccgacaaguucauuuaagagaauuuauagccuaauugugcagcuguugccuucugagucaguuuuaagagauuguuacacaagcagugucauaauuuagucauguuuucaucucacaacuauacuguaauuacuguuguuaacagcaaaugguaaacaagagagugaagaggaccagccaaagagaguacucacaaaccgugcaucaagcaggggcaagggagaaaugacacuugggacccugcagagcucuccagaaagcccacaaggccccaucagccucugagguuggccaugagcuucaagcacauaguaugcaccugaguauucaccuggagggaagggggaauauuuucugccucccaaauuccuacuagaaacuagggugcugauaggagaucagggaccccaccauagugagcagccucuggcccugcuaguucaucucugcuuccauggagagcugccggggccagaaugcaauagaccuccaggugguucuggacucagggauuggggagccccaagcggugugcaugaaacugaggcgacgcucaguacguaucugaggcucugcugcagcaccugcucgagcggaagauacugaaaaacccugcaaaggacuugccggaagcugcaggaacagcccugacccuugccuccucagugcaugcuucccucccugcugcugccugaaggguuauugauuugcacaggaagacccgcgggagaaaaucccucugacagccuugacucugcugggcauggugcaggauggaggucaggccacacaguccuggcagcugaccucugccccauccaaauggcuucuugcuccacaagcaacaaaaugcccccaucagagcucaguggggcucagcuagacacguguucacuaagccccgugaacaucuuaccaggcacggagcuagggaccgggcacagcaacaucacuccagguagggccuucaggagaaaccugaucugacucaacagucacaacaauaguaguaauacugguugccaccgcacaccugacagccauccuaagcuuugaggcuuucuuguuauccccaguuuauagagaagguaaauagccuguccagggccacaaggccaggacuccacccagaucugagucaaagcccccgacuccaaaccccaaguacuauuuccuggaccuggccuuuggcuauagacaagcaggggccccucagcuugaccgugguucucacucugacccacugcagccccuagcuuccuaagggucagaugccucuggcgccagggaagaggaguggaggggugaggggagauggugagaguauagcagggugcacgcccagugcugacaucaucaucaucaccgucacuaucgucuacccccaggggagguccugugggccucuuggcaaccccugucccugcucccccaaccccccaccccagcucauccaaagccacuggccaugauuagcuggaacugauuagggaaaggucggaugcucuucagaacaggguggcuaaugaaaguggaagacucauuuccagauugccagagccgcagacaaaaauugaagguccggagacaacaaucaauaaacacgaagcucuucuaacggaggagaauaaacacuaggaagugaagcgaaaucgaaacggugaccuggaaaacaggcacaugcugagaaaggucaggguggucuugagaaggggagggcugcaccauagacgaggcugcuccccagcccgucccaggcaagcagagggaaggcggcguccaaggagguggcagggccccgccagcucagcugugcucagaaacaagugccugccugcguggcucccacuccagcugcccaggcggcggggcagggcuuucaaaggcacucgcgguccuugaggauuuagucuuaagggucgggcucccccgagcucagagccugucuccuguguggccuugagcaagagccuuaaccucugagagucuuuuaucaucucauuggcagacuccccaccacucgggcuacuauguaccaggugcaaggcugggacagagugacucuuccuauucugcaaaggaaaacucagaccucaaaaucugacaaaaucauugugugcaauuuggaggcagccuaggagauccacuuuggauaaugaaauacuggaacucgugggacaaaggggauagcacuaugguuuaugaggauaaauaagcuggagcuucccccguccacaccccaacagcucgagcaauaggagcguuacuccugcaggguaaauccccuucaaccccacaacagcuggggaacugacaucaagucugcuccagucuuuccacggggcaccuggcccuuggacgugcugucaagagccuuaaccauggccugcucaaucaucaggcgaccagccagggcgucauuuagaaagccaugaugugggaccagcuuucccagcuggcuggcuggcuggcuggcaaaagcaacacaagcuuuucaugaaauggugagaaaaaggacaagucccaaauggcacauguggcugaugguggaggucaggguucaagccacgcaggcauccuucccaggcaggggccugagcgucccuccccaaggacccaagcccucgagugccgcccucaggucagcagcacucagaagaccuggcaaccccagcccuggaauccggagccugcucagugcugaaagacugcggcuucucccacagaggcaaacccgucguuucacggacuuccaccccaucaccggcuguuuaugccagugucgugcucagccauuuuauguaggauuaugugcuguacguaccagaaagcucauaaaaaaaaaaaagaaaaaaauugaaugaacauuguuuuuaaaaggcccuuaaaaggcuauaaagugcagugacuuucauacccuuggguuuuuccaucuuauauuagagucccucaaucaaagccaacucugggcauaaggaggugacaaggagguaagaaaaguggauuccaaggucaggaagaugggaaauucaggagcaggcaggcucccugcggggccugggcuucgguccuaagccagcccuccugagcaaggcggcccugagcaaggaaggacuugcuaggugggauccagacccaggccugaagccacagccuccggguaugauggugaaaggacccccaccaaggcuaccaggggacucacgcggcgagaaagaacaaagaccaacugagaucuuggccacguucccgggguuggacccuggccccuccaaguccuuccaggucuccacauggcucacaagggccagggacaugcauggugaaaagagagagcucucgacaguuucuagaaucuguucuaggucucagacugggcucggcuccacgaauggaaucuauacugaaucccuggaagcugcaacacugauauggagagaaaacgacgggacagaugcaggacgggcuaucaggcaaacauuacaaaucauguuugcaaagaauauuuaauaacugagggaaaugcugacaauaugguaucaagugaaaaaguaagcuacaaaaaauaugaacccgauguuaugaaacaagcaaaacacacauaugcccugggguucggaaggcggcgggaaggaaacagaacccaguguccaccacgguggccucugggugaugagauccgggggaucccuguuuuccucuuaauucuuuucuuuucuguauguuccaaguucccugcaauuaauaauuguuuuuauuuuuguuuuuuauuuuuugagauggagucuugcuuugucgcccaggcuggaguacaguggcguuaucucggcucacugcuaccuccgccuccuggauucaagccauuccccugccucagccucccuaguagcugggauuacagaugcccgucaccacaccuggcuaauuuuuguauuuuuuaguagagacaggguuucgccauguuggccaggcuggucuccaacuccugaccucaagugauacaccugccucagcuucccaaagugcugggauuacaggcgugagacacaccuggccaaauaguuguuuuuacaacugaaauugauugugcuaaaauauaauacauauuuaaauaauauuuauucccaaagaaaacucuucacuauguuaucucuuuuuuuuuuuuuuuuucuuuuuuuugagacagagucucgcucugucccccaggcuggagugcaguggugcaaucuuggcucacugcaagcuccaccucccagguucacgccuuucuccugccucagccuccugaguagcugggacuacaggcacccgccaccaugccuggcuaauuuuuuuguauuuuuaguagagacaggguuucaccauguuggccaggauggucucgaucuccugaccucgugauccgcccgccucagccucccaaagugcugggauuacaggcgugagccaccgugcccggccuauguuaucccauuugaugccagaaacaucugaaccacccaguauuguuuuccuucucuacacaacugucaccauugacagaaggcacagugggaugcagacggcaggcuggcagagugggacucacugggcagaggcuggacaggugggagaugggguuuggggcugugguucaagggagcagcaggaagccaguccagacccagagacggaacgcaacaccucacccucauccagcaccucacaguucgcacggcaugucucacagucuuacugcgcuugacaguuugcaugcacccucacccuggaaccccgcaggaugacaacagaggccuuucccaggcuggggcuaaccucucucugcuccagccucagcaggaaaggggacaggcucuugggccucggacagggcccaggaaggcuccggacccuggacccacucuggggagcuauagcccgauggccgaggaggcgggagaauggucccccuagagccucccacccguggaacccaggaggagacuggggucuccugagugucugugggggcuggagcuuuauggaaauggucucuuuuuuguucuucccaauaguccugggggauaaagacgcuucuuauaacccucauuuuauggaggagaaaacggagacauuuguuccuuaaacaggaaucuguugcauccaauaugugccaggcuucucccagagacuuuccauccauuaucccacucaauccccacaauaucccugugagauauggaauaguucucaaauuuuagagaugagagagcuaaggcucagagagguuaagugacuuaccuaaagucacuuuacacaaauguaaagcuaagauucaauaccuauugaaugaaugaaggaacgaaucccaucugauccagaucccccaccuguggccuccccagcagacagaugucagacuccuguuuuaacugugaguuuuuauccuuuucgccacuggaccccauaaaaaagugggaacaaacacauuucccuccucuaggaccugucuuggguccuauggggauucuugaccccaaaucagcuauagaaagguugucugcaacucccagcccaaaaccacaaggaaaagcaaaaggaggucaacugugcagccuccuccuuccacuccaggcagaggccaggccacugccucaggucuccaugagcagcaacagcacagaugcccugcaggagcccagcucaggccucagaacacacgcuggacaccuccugcugguggccagcccaugacaggaagccccucccugggcauccgauuguagagcguccugguccuacuucuccccagugguaguugucggucauuaaugcuaugaccuguucucccugcuuugugguacaugacgggagugcuccuucguagcacugugguugauugguggggcuggggggugggggugcaugggaccaguucugcccagugagcugcaaaggagcacaaugcuucuggcugggauaccuacuaaucaguucaaggccuccaggacuccacauucucucuggcacagugaccaacaauacuccaucagccaggucucugauuggccacccaccugcagugagcauguggcaggagugagaaaacgccuucugcuguuuuaauccacugagcuauggggcugcugcuucuuauagucuauucugauaugaguuuugggaggaagccuggcacagaggcacuuggguuccuuuuccaccauucaaagucccaaagcucucagcucuggaugccaagggaauacucucacugucuguaauuuaaaaauauaacaaaagcacacacccaucaagauaagaggcugcugugauguugcaggaacugacagccuccaugggccccagacuccucuugguaauuaggccugugugcaaagcaagggcguguugagaagggugggcugggaacaugagaaggccgucccccuccuugcugccuccgcccagccagcaccauccccugccccugggcagaugagaccucugcucagccuccgugaggcaacggccagaggcugaacuaagggccagcagagagaaaggcccacagauucacccuuccuugggugucauagggccugcauggggccuggaaucaggcacacguagagcccauucuggcucugccacguuuugcuguguggcuuggcagcaugacccacgcaucugagucucagugccuuuuccugucccauggggaugcagccagcaucccggaggcuggcagugaggaccagaugagauaaugacgcagaagggccuggcgugccgagggcagaaggccuggucacugcccucccuuuugcacuuacuuguuguguggcuuuggggaugcaacguuaaugucaucuuuugaaaaaugaacuuguuggacuagguuagcucuacagugagaagauuggggcucagaaguacuaaaaaauuugcccaaggucauucagagagugagcugcagggaucugacucuggcaucuggguucuagccucuccaauccaggucuucaggagguaaggucugaagggggauuggaugggugaauuuccucgccagcagccuuucuagagcacuuuacagcuucgucagcgcucagccggaguucugugaucuuggaggaaaauauuggcucuuggaguggaagaggaaaggaaagucacagaggccaacaucgucuugcagagauucucacccacagcaugauucacggggucuauagaauggggacccccugcauaugucugcccucgagggcguucaaagcgggaucucccaugaugucagcagaaagggcugcaguuccuaugugggaucuggccccagcccuaucugcuagaaacucugaaauuccaacaguucgaggacccucacaacucccaggcaccacccuccugcccuaaccccacuucccccaggaacacucaaguaugggggcugaaauggaacaauuuagccuauuuaaauuaaucauugguucuaaagauaaagucucagaguggauuagucacaaggaccggauuagucagacuuaucucagaaaagacaggaguuugcuugaacaggucccuugccucagcagaugguccccuucucugcuuuucccuggaagauuaucccaccucucaagauacaguuaaacccuaaagugggggauaacacacaaggagacacacgucagggagcaacagcaccugccaaggcuggccucgugggaauugcucuuuuauccaucuuuguuucccuuuaauaaauuucuucgaucaccucaggccuugugguccgaggaaagcagguagaauuugggggucaaaugccuggguuugaggggagacccugccauuucugagcugaguacauggagcacuuuacuuaagcucucuaagcaucaauuuucugaacugugggaagaggauaauaaugcugagugaggauuaagccauacgccauacagcaacuguccagcauagugucuaacauagggaagauaaucaacacacaugaugccccacccuguccccaccaugccaacauuucccaaaggccaggaaagucacuugagcucucuaagugccaguuccucaucgguaaauggaggacaauaaaacucaucuuucuuaucugacaggguugcuaagaggaugaaacgagacacugaugagaaagcccucaguggaauguacaagugcugucauuucuaucuugcucuuaccuacgcauguacauaugggaagcagccgguacacagagaggagcuuagugcuaccagugagacuuccagagcuucucacuaaacucuaaaugucauccaccagguuggcugguaccucccccaaaugccuaccauauaugaagauggcagcugggggaaaggcauugcagcaagcagacuguacacagcaauucuggccuggccccacagcucuucggcuguaacacacccuugggcaacuuacuuacccacucuaagccucagucugccuaucuguaaaaugggaauaaacaugauaauuacugacaugacguuaggauuuagauucauuuauuccuuccauucaacauuguacuggagguucuagguggagaaauuaggcaagaaaaagaaacaaaagguauccauauuggaaaggaaaaaguaaaacugucucaauucacagaugagaugaucuuguauguagaaaauccugaagaauccacgaaaacucuauuagaacugauaaacaaguucaccaagguugcaggauacaagaucaacaaacaaaaaucaauugcauuuccauauauuuacaaugaaaaauucuggaaauaaaauuaagaaaauaauuccaucuguaauagcaucaaaaggauaaaauacuuaggaaaauuuaacaaaagaaaugcaaaacuuauacucugaaaacuauauauaacauuguugaaaagaauuaaagacagaccaggggugguggcucaugccuguaaucccagcacuuugggaggccgaggugguggaucacuugaggucaggaguucaagaccagccuggccaacauggugaaacaccaucucuacucaaaaaaaaaaaaaauuagucaggcauggugacacgcgccuguaaucccagcuacucaggaggcugaggugagaugagauaaucacuugaaccgagaagguggagguugcagugagccaagauugaacuacugcacuccagccugggcaaacagagugagacugucucaaacaaaaaaaaaaaaauuaaagacaauggaaauaaauggaaacacaccccauguuuuccaugggaugcauucccauauacaaauaauaaacagucuugaaacaagauuucaaacaauuuugaaaaagcgaaaagaaguuggaagacucauaguucucaauuucaaaacuuacuaccaagcuauaguaaucaugacagugugguacgggcauaaggguggacauacagaucacugcacagagauagagaguucagaaguuaacccucacacuuauggccaauugauuuacaaaaaggauaccaagauaauucaaugggggaaaauagagucuuuucaacaaauggugcugggacaacuggauguccacaugcaaaagaauggaguuagaucccucccucacacuguauacaaaaauuaacucaaaauaaaucaaagaccuaagcgucagagcuacagcuacaaaacucuuagacaaaaacauagaaguaaaucuuuaugaccuuggauuaagcaaugguuucuuaguuauaacaccaaaagcacaaacagcaaaagaaaaacuaaacggaacaucaucaaaauguaaaacuuuugugcuucaaaggacacggugaaggaagugaaaagacaacccauagaacaggacaaaauauuugcaaauccuaucucugacaagggaucuguaccuagaauauauaaagaacucucacaacacaaugauaaaaagacaaauacuauuuuaaaauuggcaaagaaucuaacagacauuuccccaaagaagauacacaaauauauauaaaaagauaugcaacaucauuaaucaucagggaaaugcaaaucaaaaccacaaugagauaccaccucauacccaguaggauggcuauaaucaaaaagaaagauaggucuaguuaagauggcuuaucccuguaauccuggcacugugugaggcuaagacaagaguucagaaggccaggaguucaaggaccagccuuggcaguauagcaagaccucagcucuaaaaaaaucuuuuaaaaauuagccaggcauaguggcaugugcuugcaguccuagcuacucaggaggcuuagggaggaggaucgcuugagcccagguauuuaggcuguagugagcuaugaucacaccacuguacuccagccugggugacagauugagaccuugucucuaaaaaaagaaaaaaaaaaaaagaagagaaagaaagacaauaauaucaccugaggauguggagaaacuggaacuccccuauacagcuagugggaauuucagauggugcagcagcuuuggaaaacaggcuggcaguuccucaaaagguuaaacauggaguugccaugugaccgagcaauuucacucuuagguauaugcccaagaaaacugaaaacauguguccccacaaaagggauuauacaagaugggucaaagcaguacgauucaucauagcccaaaaguggaagcaaaccuauuguccgucgacuaacgaaugaacaaauaaaguguggcuuaauccauacaacaggauguuauccagcaauaaaaaggaaugaaguacugauacacgcuacaacauggaugaaacuugaaaacauuaugauaagugaaagaagccaggcacaaaagaccauacaucucaugauuccauuuauauaaaauguccagaauaggcaaaucuauagagacagaaaaugguugccuaggcccggggagacaggagugacagcuaaaaggcauaggguggcuggguacagugguucacgccuguaaucccugcacuuggaggcgaagcaggaggaucacuugagcccaggaguuugagacuagccugggcaaccuggcgaaaccccaucucuacaaaaaauacaaaaauuauccaggcguaguggugcacaccuguggucccagcuacuugggaggcugaggugggaggaucaccuaaacccaggagguugagacugcagugagccgugauuguaccacugcacuccagccuggagugagacccugucacacacacacaaaaaaaauuaguuaaaaaauuaaaauuaaaaaauuauaaagggcauaggguuuccuuuguggguuauaaaaaguguugcagaauugguugugcugaugguugcacaacugccugaauacacuaaauccauggaacuauacauuuuaaugggugaauuguaagcuauaugaauuauaucacaauaaagcuguuaucaaaaaagauucauugauucauacaaguauuugaguacccaucauaugccaaauacugcucuagguggacaggauacaucaguaaacaaaacacacaagaucccugcccucucagaguaggagccagacaaugcacauaauaaaaacacaaaccacacgcaggcgcuccucgacguacgauggggcuacgucccaauaaacccacuguaagcugaaaaugucauuaagucagaaaugcauuuacuacaccuaaccuaucaaacaccauagcuuugccuaccuuaaauaugcucagagcauuuccauuagucuagaguugggaaaaaaucaaaauucaaaauucgaaguaugguuucuacugaaugcguaucacuuucaccauugguacaguggaaaaacugcaaaacgaaccacggcaagucaaagacugucuguaguaugucagaaagugauaaauguuauuuuaaacgagagaaacagguaggggcucugaaaugcaugggaggguuaugacgcaaugugacacagggagaccggggcagguggugcagucacuggggcaaacacuggagggugguggaggacagcaugggaccgccuggggaaggguguccaggcagaggggacaggagagcagccugugccugugccauaaggcagcagugugcccaugugucugagcaagagcaggagcucaguguggcugcaggacgugauggggugggguguacagguccuggggaccaucauaaaggcuuugggcuucuccacugagagaacaggaaggcccggguugaacagaggacugucacggacugaccuguguucuaaaagagucacucuguuugcacacccauguucauaguggcauaguucucaauaacccaagugucauugggcagacgagcggauaggcaaaggugguccauucauacaauagaaugcuauucagccuucaaaaggaauaaaauucugacacaugcuacaacauggaugaacccugaggaccuugugcuaagugaaauaggccagucacaaaaggacaaauacuguaugguucccucauuugaggcucuaaaaggagucagacucacagagacaaaaauucaaaugcaggggugccagcggcuggggggauagggagauggagaguucgugcuuaacaggaacagaguuucaguuugggaagauagcaaaguucuggagauggagauggugaugguaccacaaugugaauguacuuaaugcuacuaaauuggacacuuaaaaugguuaaaauucuauguuauguguauuuuuuucuuuuuuuuuuuuuuuuuuuuuugagacagagucuccuucugucacccaagcuggagugcaguggcacgauuucggcucacugcaaccuccgccucccagguucaagcgauucuacugccucagccuccugaguagcugggguuacaggcacacgccaucacacccagcuaauuuugguauuuuuaguagagacggggguuucaccauguuggucaggcuggucucgaacucugaucucgugauccgcccaccucggccucccaaagugcugggauuacaggugugagccaccacgccuggccccguuauguguauuuaacacaauuuaaaauaacuuuaaaaaggaaagcagaaucccuggccgccguguugagaagacgcugagggaggaaagggcagaguugggaaaugagugaggagguguggggcgccaccuauuucuggugcaggacagguugcacuuccccgcucucugaaaucaggugccuccuccccucugccacagggacccucaaugcuccugacuguagcagccccaagguagacaaugggagacaaggggaccacaguugagcccugaggaggcugagaggagggaggaaaaccaggaaccaugguguccuggacgccaggugaggacggucagggaggaggggaggaggagaagaggggaggaaggacggaggggaggaggggaggagggccggaguggcuguguuaaccgcugcuaauggggucccacgagauaaggaaugagggccagucacggcaccagccacaagcagguugcuggugaccuugagcagggauagugcuuacagaguggucagcacguugcccaggacaucgaaggcccccaacagaaaucacuggaagcuggagccggggccucugcauucguguucucguucugcccuguggcaccuucucaugcccugcucggcccagagcagacugcccaggggccacucugagugagaguguccaagcacagacugaaguccuuaaacacgcaaacaucgugucuggccgugcugcccaucacagcuggccacacuggccucacagggguacagggccacucagacuaucaggccucucagggcagaccuggcuacagcuugugcuccucccaacuggcucagcucccuucuccguuuguggcacaaagagcccaugguuuguuuugguuuuauuuuuuauuuuuuuagagacagggucucacucugucacccaggcuggagugcaauggcacaaucauagcucacugcaaccuugaucuccugggcucaggugauccucucaccuuagccucccaaguagcugggauuauaggccaccacauccagcuaauuuuuuaucauuauuuuuguguagaaauaggggucucacuauguugcccaggcugcucucgaacuccuggacucaagugauccuccugcuucagccucccaaagugcugggauuauagcaugagccacaguaccaagugagcccaugguuuaacucugggguuuauccaccagccaaaugaagaauauuuuauaaaauuguaauacuguucaaaauugcuaaguacauauauaagguuaaugucacuguaauauuaaaauacuaaauucauuuauauauuuuuauuuaaauugcuggggcaacuugccauaguugauuaaaaauucugaacaggguguauuguauaggccaauuaugaagcaggguguaaaugcugggaacagcacuuggaaugugcagaaaaccauuuguaaaaugagauuucuuuaaaaaaaaaaagaaaaaagaaaaaagagaaucagggcauagacaggggcagccuugcaugaagcccgugggugaagcuuucccaggacagcagcgcagcccugacucacucgagcaaggccaguguuguccauccucggcaaguuuuccugguucucaggcucuucaguggcugcauuuaccaagccaaggcucccaccucuccuuccgcagucauggaaaagagcccuggccaugccuauaguggacacaugggcuucuagcccaucccaggcacugcuggcugggcacaggagcagaacugcaggccucaccuguacggccuccacccuuccagaggucaccugcacugcaggacugcccagaagugcuagguacuaauacuucaggagugacucucacccaugaaggacgagagcuuccucgccugucaggggacacccugaggugugcucccugcugucacugaagggccccaauugcccacggcgcuaaccugcucauuaacacugggcugacuggagccccacccucccugauguguuuucugggaugaccuccuaaauaggccauuuacaccuaaaucugugccucgggucagugucuaggggagccacaugcaggcaccaaguccccacacucucccggucacggcuuccuugcugcucaaugaacaccccagugccuggccucugagggacucggauucggaaaagcuggagagcugggguaagugugcgauucaagaaggcuuugggggccacugggcaucuuucucuuggagacagcccggucucccaaugguguccuacgacuucaagugcggcugugcccagugccccgcagacaacugaaaacaauucccagucaugcuggaacucuacaugcagcuauugagagcuauggggaucuucagacauaccagaggggcagcagacaggacgagggaaacaccagggacuggaagucggcgaaccucaguuccaucccugcucugcacuuccaggccaugugggcuccucggcagaaaaugagacuagucaugccuaccugugagggucccuccuaccugaggacacaccuucccuguaagaaucuccccuugccugcaaggauccccccaccuugcaaggauccccccucccccugaggauccccuuucccugugaggauccccugccugugagcacagugcccaccugucaggacacccugcagaguccaucacaaaugggggauagugcugagcccggccuuggcagaugaagaggugggugucggugaggaagggggcuguguggacaccugccaucuauccuucucuggccucccucaacuccgagggcuccaguaauccccagugcacacugaggcccucguuucuauugccccuagaguccuuaagugucacuccucuggacccuuggcccccaaaaggcccauuucuucuuuucugcugaacgauucacagacccuagccuggcacuagguccccaggagggacucugugaugguucauuuuaggugucagcuugacuggaucacaggauucccagacacucagccaaacauuauuuccagguaugucugugggagugucucuggaugagauuaggcuuugaaucaguaggugaguaaagcagggcuuccuccccaguguggggggcaucauccaauccacugagcaucugaguagagcagaaaggugaggggaagcagaacccucucucugccugccugcuggagcugggccuuggucuucugaccuugaacugggacuuacaccagugguguuccugugaacucagacuagaauuccaaaaccagcucuccuggguuuccaguucacagagaguagaucaugggacuucucagccuccauaaucucaugagccauuccuuauaaaucucacauaaauaucauucauauauauaguagggguccuguuucucuagagaacccugacuaauacaaacuccaucccagcaccuaguugaagauuucacaggugcaggguggggacucaacucaacacacuucugcuuagacacggauaugcuggcauuggccauguggccacguagagcugucccuggccuggaggagcucacaguccaguggaggagaugcacagucaugcaugcauucauccagcgagcaucugcucaugccugcucugugcccggcacucgcccaguugcuuggggugcuggggugaacagagaaggugccugcucucauggagcuugcauugaagcagggagacagaugcuaggcagaagccuuggagaggaagugccaagaugaaaacagagcccugcgccgugacgaagggugaccgggguuugcuuggguuugggcuucucugaggugagaucugagcagcaagaagggcuucugugcugaguccugccccagggaauaaauaggguccagacagcagaagguggagaggaagaacucucgccacaggggaccaggcuaagcaggaccccugcaggcuggagacagagaggacgggaggccauggcaggaggacagguuggagccacuuugcugugcauggaguugugcuggguccugagcccagagcccaugggcggugcuggcagcuccaaguccuguccacacauuaucaaugauucccuucuauuggaaaaugauuguguuuauuuucuuuucuacauucuggacugaggccauaugauaauuaugaaaugcacaacccauaauguguucuaaacugucucugcauaguaugugguuuuggaauaauacauaaaaugcuuaauaaaaauuaauguaaaaaggagagucaucagccucacuuggaaauaaaaucaguauuaauuucuuugcccgcaguuccccugcugaacuagugaugacauguccaucuccuugaccucugacgcuccacgccugcuccucugguuacgaacccaaaucccaaaggcccuagggucucauaacaacacaugugagugugugggccagcccuaugggucauggcaacucccugaguuuucccaagccacauucaugcugggucccagggcgaggacugugccugguggacaauggacgcaugacaaauaucugcuaaaagcugcucuuugagagacucauaucugucaggcccaaacgucuugggaacugauguaaacaguggggccgcagggcagcgaggagaaugugacacgucuccaucuucugguggccacagcccugucaugugucugggcagcucagccaagaagcaugaagccauaauacuggucagucuauaccgcagucaagcaccaaacccagagucccagaugggccacagggagccagaggagaucaugaaaggccagaaaaacaaagcucaagcuuccuggaggcuguguggccaggacagagagaucagaguaugaaccacuuggcccagccuaccagcuccgacugaccaugugaaaacaaggcaacccagcaggacaaacacacagcagaacaggccaugcugcugcucacauagcccaggagaccugggaggacagcaugguugacuucuuucccaaggcccgccagccaagccuucaagagccccagacgcaucccuccccugcugccguggccccagggcugccagcauggagcagagccuggcaccuccccuuugcuccccaccuccugcugugacgcaaccaaguccccagggccagcucucugcagcgccuccuccauccuccccaccccagcccugaccccagccaaccagucucucagccgcccugguccccagagcugagggggguaccucucuccccauuugccagccacaugggaaaggaaauccccaugggccagucuucaaacucaaaauuauugcauccucaaacauuucucuugacaaaaguacagaguugacgucuccuuucauccuuuuauccuauaaaaucuuaacaguacuguauauauuuaaagccccuaaauaaaaagguauggcuaugagaguggacuccaaguccuggcuucaaguccuaguucuguuacuuaccgagacuucuguuuucucaucuguaaaacaggcagaauaucugcccccugagauuaaaggagaugaccaauuuaagggauuucuccaaaggucugguacauaagaagugauacauaaauuaagugaggugguaguggugguaguguuggugaugaugguggugguuuaaguggugaauggugauggugacagugaugauuauggugaugacagugaugguuaugguagugaugacagugaugauggugauggugaugguggugguaaguggugaauggugauggugauagugaugauuaugauggugaugacugugaugauggugauggugaugguggugguaaguggugaauggugauggugauagugauggugaugaugauggugauggugaugaugguggugguaaguggugaauggugauggugauagugauggugaugaugauggugauggugacgaugguggugguaaguggugaauggugaugaugguagugguaaguggugaauggugauggugauggugaugauagugguaguaaguggugaaugaugauggugauggugaugaugguggugguaaguggugaaugaugauggugaugaugauggugaugaugguaguggugaugaugauggugauggugaugauaguggugguaaguggugaauggugauggugauggugaugacgguggugguaaguggugaauggugauggugauggugaugaugguggugguaaguagugaauggggauggugauggugaugaugguaguggugaugaugaugguguuggugaugauaguggugguaaguggugaaugaugauggugauaagugaugauuauggugaugacagugaugguuaugguggugaugacggugaugauggugauggugaugguggugguaaauggugaauggugauggugaugguaaguggugaauggugauggugauaagugaugguuaugauggugauaauggugacgguggugaugaugauggagacggcaguggaauccucucucuguuuuuuuugucuuuuuuuuuaaacagagucucacucugucgcccaggcuggagugcaguggcguaaucucggcucacugcaagcuccaccucucggguucacgccauucuccugcuucagccucccgaguggcugggacuacaggcgccugccaccacgcccagcuaauuuuuuguauuuuuaguagagaugggguuucaccguguuagccaggauggucucaaucggcugaccucgugauccaccugccucggccucccaaagugcugggauuacaggcgugagucaccacgccccacccucucucugguuuauaguaacuucuggucaauacaucaaaaagcuugguggcaaaagagcucuggucacagcccaaauccauaagccagagcucucuuuccucccccaguucucauguccugcaggcucagcagauacaaucuugaauccuuauucaucaaagagaaggucaggagaaaugagccucccucucccccaaccccugaguuagcuccauuuacagaaaccucaucccccuccugcccccauccacaggcaucugccucuggccaccagugacaccaggcaccaccagaaacacucagcaucaucucuccucccugaauccuaacugcuaaaccagugauuguauuucauuucaguggaaaugccaucacuuuguacuaaaucccaccauauacaaaacaucgaguggcuucuccugauaagaagagauauaggaaaauugccacauuagauacugccuauuaucugggcuacuuuugucgaaaacaacacaucauaggcaggaacuaauggcacagacuuucagcagccaaccuaaguccccgcagacuucacuccaagaaaucugaugcuuuccaccucagucagggcacugcugcuccaucccaaguuuuuauuuuccagaagguuuuaacggaagagaaagaggaaggcaauucucugaggccauccuccaggcucaggcgcauaaccuuaaacaguuagaccuccgacagccucgagucacaaaaacacaguggcuuccugggagccagaaguucuggucuccaguuuccgaccugccaccuucugagacccugagcccaccccuccagacucugcggggucuccaucuggugaaggagacgguccaccagggacugucuagggcuccuuccauucugagaugcaacuaacagugauuuccgugccugcagcagaaacaugagcauccacugucggccagcacuuuucaguccaggaaggaaaaucauucauuuuggcucaagaaaaccacggaaaaguuuacuuuuugcaaauguuuucuuuacaaaagccaaaucccagagcugaugugaugucgggcggauuagacaauuaaagcaggcgcacagaauacaaaucugcauuuguucagcugggucuggaggagaucgccauuuccuuccucccucaagucaauuuauucagagagcagccuucucuccagauaagcacauugacuuuaaaauaaagugugugccaacagcugcagccccgcgacuggagcagacagagauguggcauggaaugauaauuaaauauauuuucaucauccgucauuuuuuuuuugcugcaggugccaggguaauaaaucuggacucgccucuuuugucagcuggcagugaacacauuuuaacgugaaaucuccugggaagaauuaagagucacuuggccuuguaaaggagaaaggguuuuacuuccaaacugccaaguggggagcucacagcugauugguuucauaauacuuuauuauuugacaauauauaugccucggguuguauuucagaauaccacaccuacgggauaaccagcgccgugagagauuugucaucaaauucuagaauaaaaacuuauuugggaagauuuucaccacaauuucuuuuuaugaaucccaaauuuaauguaugauugacuagguauauucccaucuuugaaacuuuuccugcauuucuuuuaaguuccccaauagucuuuucuuccccuuguaacauauugcagggaaaucuguugcucuugcugccuguggucugaguuaggugcuuucgacuggccuaaggaguuugguggacuuuuuauuuugacaguuuaacagcuccuucuccccaggggaagccucaagugagcaguccucggaaaagcccaaagaaauggcacaucauagcauccucagagcccugccuuccucuccaaccauacgcccucugcaagauaccuucacugaagagcagggcuagguaaagccauggugcgggcauaagaggggagagaggggagggggugguggugaagggaggggaggcauuugccccgggaucucgggcagcuccugccggccacaggucuccccuggaaggcaaggauuccacaguaccugucacagccagcaacacacagagacacgcagcuagcccaagcggguccacaguggccaaguuccuuuucucuccuccucaaaggaauguucuggaaaggaaauuccucccacaccugcccuuacccauccucccagggcacccauucaccacauccguggagccucaaauaugaaugccuaaagcaggugacauggggcagauuacagcaggagggcugugugugccucuuuuacaagaggggugguuccucugccaugcccugacugagggccaugagcgaugcuaacuuccgggagcaugccucauccuuccgguccacauuucucagaggacaccugggcucagccaaaagcaucccauccugaaacccuaaggucaaugcagagugucucugaaaaugccuuauuaaauaccaauaaccuccccuucugccgaccacgggcgcuggccccucagucacucauaugguccuacacccaccgguguggcaggacagcagguggcauagcuccagaagaggccaucugcagagagcaaugugaggcucaaucccaaucaaaaucccagcaggcuuugugcuggaaacugacagccaauucuaaaauccauauggaaaugcaaaggaccucgaguggccagaacaacuugaacaagaauaaaguugcagagcuaacacgacuuagauucacaggauuucaagacuuguuauacagccacacuagucaagacagugggguauuggcuuaaagacagaccaccggaucaauuaacagaacugaguccagaaauagaccuucauauauauggauaaaugauuucuuacaaaggggcaaaaugcaauucaguggagaaagaggagucuuuuccacaaauagugcugaaauaauuggaugucuacgugcaaaaaaaaaaaaaaugaaaaacgaaccucaacccauaccucacaccauaugcuuuaacugaaaauagacuauaggccuaaauuuuaaaaucuauaaaauucugagacgaaaacauaggagaaggccaggcacaguggcucacaccuguaaucacagcacuuugggaggccaaggugggcagaucacuugagaucaggaauuacagaccagccuggccaacauggugaaaccccaccucuacuagaaauacaaaaauuagccaggguugguggcaugugccuguaaucccagcuacucaggaggcugaugcaggagaaucacuugaaccugggagguggacguugcagugagcugagaucaugccacuauacuccagagacuccaucucaaaaaaaaaagaaacgaaaacacaggagaaaauauuugugacuuugcauuagcuaaagauugcuuagauggccagacacaauggcaugcaccuguagucccagcuauucaggaggcugaggcagaaggaucaugugaggucagggguucgaggcugugaacagcuacugcacuccagccugggcaucauagcaagacccacaucuuuuuaauuaaaaaaaaaagaugaugauugcuuagauacaacaccaugagcaugaucccuaaaaacagaaaaaaaaaagauuuaaaaaaacugacauuaucauaauuaacuucuguucuucaaaagauacuguuaagaggaugaaaagacaaaucacagacuggaagaaaaucucugcaaagcauauaucugauaaagaacuuuaucuagaauauauauaaagaacucucaaaacaauaauaagaacacagcccgacuuuuuuaaaggacaaaagauuugaauagacacuucacuaaagaagauacauggguauggcuaaaugcagguaaagaugcucaacaucauuauuuacuacagaaauacaaauucaaaccaugacgagauauaccacaugccuguuagaauggcuaaaaugacaaagacugaccguaggaaggguuggcgcggauguagagaaacuggaacucucauaccccgcaguggggauagaaaacagcguggucacuuugcaaagcaacgugucaguuuccauaugauccggccaucccacuccuaggcauuuacccgagagaaaagaaagcauauguccaugcaaagacuugcacacaaauguucacagcagcuuuauuuauaaaaguaaaaaguggaaauaacccaaauguccaucaacagguacauggacaaauugucucauauccauacaacagaacacuacucagcaaugaaaagaaaugaauuacugauacacacaacauggaugaaucucaaaauaauuaugcugaaaggagccagaccccaaaaaaagacaacaugcuguaugacuccauuuauauaaaacccuagaaaugcuaacuaacagacugacagaaagcagaguggugguugccuggcgaggaggggggaggcccuggaggaagcaaucaccaagggacucaaggauacuucuggggugauggguacguucauuaucuugauuuggcgauggugaugccagaacucacugaguuguacauuuuaaauauguguaauuuauuauaugucaauuaugccucaauaaagcuguuuucagaaaagaauacaaugugaaugguguucccugaggucacacaaggaggcaccagugcguacagguguuauaagcccaggaaagaaaaauaauaauugccaaauggaacaguaauuugccugugaccgaugguagaaaagcuugcauccaaauucaaaagcaucccccucuccucauucauucauucagcaaaugagguaccaaguccccagggaacaaagauaugguuucucucccaaaagaaacuagaccaggaacccugauucuauaccuuggccauuaaugugcacaucugcaggcauguggggguaugugugcacagcgaggcagcccagccacguagcguaggcaaaucccaugaaugcuuaaugccucaacuuccucauugguacagugaggaaaacaguaauauccacaucacagggucguuaguucguugggcagaacuuggagguacccagagaucaacaaggaagcagaaggaagaggauguacaaaggcuccuccuaaauuaucaucugcgugauucuuuaaaaaaaugccuggcgcuuccuaagcccucgguaaguguguguuccauuuaguacuauaauuaccacuacuuuuauuacuacgcuaccuguagagacacacgccaggauggaaugagggcaucuccaggugcugagauaagugacucugauucuauucaccuuccuguuuuuccuuuccucgccgaacacauauuaccucugaaaauuaagauuuuuaaguaaauaaaaauacccaaauaagcuagaaugcuaaauagcuucugcauuuacuuacccacacccacaggcacauuuuaaaaguaagcucccuaggggugcccagcccacacccucuugcuucccucagaugagcagcuagcugcagguuaaccacuggggguaugaacggagguuucuuuuugcccccaugccuuguagccuuuuauucuaaccagaccgaggcaucuaugccccagggaagggcccuuaugaggaaccagagaacagaagaaucaaagccguggcuuuagaauuucaaaagcuagggcccagaugugugcagaggagacgcggcggagccaaggccagcaagggccacucccugcccagagccaggcugagggaggagaaggaaacagaugcuccuucccacgccuggugaagagugggcuaagacuccagagaggcccaagcuccagagcaggggcugagccuuacuccucaugcagagccaaugagcauuuuuccgugagccccagagaccagagauggcugcuaggguucaggggacagccaaauggucccuugcuccccaagagggguguggaagcagcugaggaucucacccuucccuucagagaccccacaguuaggacaaagggggguacagcauagaccugcacagggguacagagagcuggggaacagcagugaugagggccgaaccccuaacccccaugagcuccucacaugcgcgcaaacccaggaggcuggaggaacuuucuguuggcugagaaaacccacaauuaaaugugauucuguuucuguaaccugguggaaugaaagacugaaguagaaauuagaaucaguuacagaaagacagagugggcuccauguagaguccuugaggguggccuaucuguuucugccacauacucaaagucgccaccagccaacauccuucauccuucagcauaugacgguguacaauggugggaacaugguacgccagcacccugguccaaaacagagaagacuuggaucccagcaggcaggcgagucgacagugauuaccaaggaucgaggagaggcaaggccaguccugcaaagcuucaggagagggcgucugggcagaacuuggagguacccagagaccaacaagguacuggaggcagaaggaagagcaugugcaaaggcucacccuaaaacacaguguccagccacagcauuuacagccuggugcaaaggcucauccuaaaacaccaugucccgccacagcauuuacagccugguguaggggacaaauaccacgagagcacggucaagaccacauugaauggguuacuaaguuccaccgagggcaaaugcagcaccuccuaggugcucauggaccgaaggagaauuuucauccaaccuccaagaggugagaagagggacgacacagcagguuuucaauagugcuaaaguuaugccauuuaaagaacuguccuuuaagggccgggcacaguggcucacgccgguaaucccaacacuuugggaggccgaggcaggcagaucacgaggucaggaguucaagaccagccuggccaacacagugaaaccccaucucuacuaaaaauacaaaaauuaggccgggcacgguggcucacgccuguaaucccagcacuuugggaagccgaggcgggcggaucacgaggucaggagauuaagaucauccuggcuaacauggugaaaccccgucucuaccaaaaauacaaaaacuuagccaggcgugguggcgggcgccuguagucccagcuacucgggaggcuugaggcaggagaauggcgugaacccaggaggcggagcuagcagugagcugagaucacgccacugcacuccagcugggcgacacagcaacacuccaucucaaaaacaaacaaacaaacaaacaaaaaaaaaaaaauuagcugggcauggugguaugcgccuauagucccaacuacuugggaagcugaggcaggagaaucacuugaacccaggaggcggagguugcagugagccgagaucgcaccauugcacuccagccugagugacacagcgagacucugucuugaaaugaaacgaaacgaaacaaaacaaaaagagaagaaaagaaaagaacuguucuuuauucuaagaguauguccuuccaacuuuuacaacauguugaugauauaugguagcuguaauuuuucuacaucuuacucagcagaauuaaaagucauuggcccuuaagucccuucuauuuaaaaaaauaauaauaaaaagcagcacuguccugcggaagccccacuccuacagacacgcuugcuggugccuccgaugggccaggcacaggacuaagugcuaaguaaacaacagugaacaugguagaugcagauggacguggucucugccugcaugaugaagcuugcauuuaaagggccaugaggagcaaacagaggagcugggggccugccuuagacagggugcucuuggcugggcuguuuaaggaguaacauuuaaagugagaccuggaaaaugagcuggggcaagccaaggacgggccugauaauggaaccccagguagggggaauggcaagugcaaagguccuggggugagaaugagcugggagaucuucaaauugacagaagucagugagggaggaggagugaggcagcaggcucugaaacugcaaguaaggggcucucugggaacaggcaacggcaggcaucuucccaggggagaguuaggguggggagggcagaugggaauaaagguaaaggggaggggcugugugggagcuagaacagcagaagcaccuauccuaagacaccugaguuuacagucgaccugucccuaagacguaagcaccugcugaacacaaaggcacugaacacccgauucucucucugaucucuucagacucccugucuuauaagucuagugguuuggggagcucccugcccuuugaagcaaugauuucaguacuucaggcagagggcacguacgcaccaaaacaacaaagggaauucucugcucugaacggcaagacugauuucuguuagcaucagcagcguggccacagacuugaaagcgcucuguuaagagggaggguuuucugaauccacauccuagaggauucagaucaccgaguucucccucggccacaaagaagaugccccuuccagcgcugguggcuggguccugaggcugaugccccaggcaggaggagaacaggaugcaggggagcggagagaguggagccuggccccuccuguccugagagauugugggaggagggaggcaggaagaaggcaggacaccuggauccuugucgucucuccugcaacugccagauggguacguaggagucugagagccucaggccuauuggccaguuuccuggguagcuaggggaaggccacaagucacuagaaacacgguucccaaacugugcaccaaggcugccugaggagccucugcuaacucacaggagaccugcaggaauauuuacauuuuugugggaaacaagcaauacuuaacaucugccggacaccacuggucccacuagcuugaggcaguggacaguuucaccauuagacuguccugcaugucuucugaggaugucaggccaugguaaagcugggguuucaguggcugcugaaagaaaaagugaguaccucacaaaaaucaauaugaaacaggaaaugagggcacuggugucuaaucugaucccaggauuuuacaguuguccagugccugauaggcacacauaucccauucguaauuugguuauuuaagaauggaauuuuuaaaauuaugugcauuauauuuucaaacagcuauuguuaggacacaaauguuuauuaagguguuuauaucuaacuacuuaauaaacggaacuguuagauauuuauuuuggccuagggacaucaggaaaaaaaaucacugaggcggcugggugcaguggcucacaccugcagucucagcgcguugggaggcugacguggucgauugcuugaggccaguucaagaucagccugagcaacauggcaaaaucccaucucuacaaaauaaaugaaugaaugaaugaauauuagcugggcaugguggugcaugccugugguccuagcuacucgggaggcugaggcaggaggaucaccugagcccuagaguuugaggcuacagugaguuaugauugugccacugcacucuaaaaauaaaaauuaaaaaaaaaauaaucaccgaggccaggugcaguggcucauuacuagcacuuugggagaccuagcacuuugggagaccaaagcaggaggauugcuugagcccaggagucugagaccagccugggcaacaaagcaagaccucaucucuacaaaauuuuaaagaguuagcugggcaugguggcaggugcauguagucccagcuacuuuggagguugaggucggaggaucauuugagcccaagagaucaaggcugcagugagcugcaaucgagccaaugcacuccagccugggugacagagccagaucuuguuucaaaaaaaaaaaagaaagaaagaaagaaaagagagaaggaaggaaggagagaaggagggaaggaaggaaggaaaugaaagggaaggaagggaaugaaagagaaagaaagaagaagaggaggggaggggagaaagaaagaaugagagagagaggaaaggaaagggagagagagaaggagagagagagaaagaaggaaggaaggaaggaaagaaagagagagagaaagaaagaaggaaggaaggaaggaagaaaagagagagagaaagaaagaaagaaagaaagaaagaaagaaagaaagaaagaaagaaagagaaaagaaagaaagagaaaagaaaagagagaggagggagggaggaaggaagacagagaaagaaagagaaaggaaggaagggagggagggaggaaaggaaaggagaggagaggggaggggaggggaggagaggagaggagaggaaaggaagguaggucacugaggcacuuggaguacaagaugcaagaaaguuugggaacuucugcucuggggagaacuuggcccauccccucccaacguggggcagauaggcaugaugagagugaucauuagugacaaccaccaagcacuguccugagcaaguggcuuugaguaacuuauuucauucuccuaacagcccucuuugcccuguggauuuaaucaguucauagaugacacagggaggaacagcgccugggacagaguuaagugcucaguaaguggcaguagugguggcugugacuuagauuauggacaugauacccacaggagauggaggcauaaggagaggaagucagguccucaggguuacagcuggagccgggagggggaggaggccccaugccuauccucuugcccuacuacccugccuccuggugauggaucagccagcggacagcuuagggcccuauggccugcaggcuccagugaccucacacugucagaauggagaugccucuugggaagagguauugaaaagccaagaaaauaaacagugggaccagggcuccacuuaugggugccaggauuccccagcaaagucuccacggggcuaguugcuccuggggcucaauaguccagccucucugcagaaggaaccagagaggguaccaaggaguggcuggagggcagagaccccucccucagcuaccuccaggcuacagggacgcacuccuccccauacuccaaggcgccgaggggagcaggagaggaggcacuuggaaagaucgagcacagccucaacacagguuaccucaagaggcaauuugagccauucgauuaaauccaccagagugggccuaaaauguaggacccccaagccuuucccccucgaaagcgaggucaggccacuuagagagaaagggagaagugacccuuuuuuugcacgaggcacagugugaggacacguguaaccccaugacgcgcaggggaggcaugagagacaggagggcugcuggcggcucuuggcccaucaagaaaugugggaaagaggccugggccaaggcgaagcuucuagaggccucauggccccauucccccuagagacaaggcagggauggagcagguucagaaauggcuucuccaaguccccaugcucaggaggcccuucugcccuugggcccccugcccacugcccagugugcaaggcuggucaaaagcagggcccagucacuggcagcagccccuccucaaggcuccaaggccagauaaaguugucagcacaccggccgugaagggccagcauagccagucagcuguuuguagccacagcacagucccccccaaccauauccaagaaagcuacaccaaugucacaugaaaaaacucccagagaaaucagaccaagaggcaaaugugggcugccagaguucaucaaaaucacuauuugcaagauuccuaucugcccuacucaacgcauuucaauuccgaagugcuagauuccccgguauaguaauagaaaggguauucauaggcacuccggcuuccaauaagaugcaaaaacuuagcucgcauuuuuuaaaguuuauaaauagccucggaaaagaagcuggaacaugcuucuuaguaaauacagcugacccauuuuccucauucuucaccaggaauaaagcggcuguuaccacggaaaguacagaagagucuaaauauauauuuccuccucacagggacccagaucagaaaggcagagucgacacucagugggugaaagagggagaagccaggccagggagggccgccccuggucaccucccugcaccccaaggggaugaaagucguggagcccucagccccagcucagggguggggugggcaccacugacuccaggacccugcaggaggcugcucaagguccgcucagcaagccccucccagcuggccugacccccucccagcuggccugacccccucccagcuggccugauccccucccagccugagccccuccuggcaguuugguuuuucuccacucggccuuugcaccaucuuuauguuuccagucuccccagcuagaagguaagcgccaagagagcagggaggcuucccucuugugcacuauucacacccagucccgggaacagugccuggcauguggcagguguucaauaaauauucaugacaugaacaaagucaugccguguggccagccaggcucagccugcguuccuaacagucucuuacugacucuggguaagccuccauuuucuucuuguggacacaaccagguagccccuucauuuuggaagucacagaccagccuaauggucuugggcgaguaauggggguucucucuggugaauucuacaccuuggggaauuguuuuuccccuuccuuuugccaagagcugugauagaaaacaauuauccaccaaauuggcaggucuaggggauucagagagaggacaucaccuucuuggcagucucaugggaagguaaaggugucuaucuguucacugcccuguuucuagaggcgugccugacauaggacaggugcuuacuauccaugaaagaaggagaggaucuaggacauuggucacucacauggacuccccgcuucccaggcugaccccaacacccccagcucaccgccacaggaaaccaccaguguggcugcccucuuccugcauaccagaagcccccagccccgccacccuccauuucacaccuguggaccuugaauaagccaggccucccuggaagcaacaaggagggcugccggcacugagccaggggcugggccucguggcuuugggauggucuaguucucuuccucaucuuucagagaacucuuacaauaaaccccucuaaacaggaaccuugagggcaucucuguucccugaaacugaaagcagguagcccacacccaggaauggggauugaaaagagaucagugcucccccuucccacacucagauccuaacagauggcacagggaugacccgaauuggaucacagauacucaggagugcaaacugggaccccucucgcuuccacauaccacugcagccaucacuggucggacagcaccagccagugcuaucuaugcacacagcaagcgcucaacaagugcacaagugugggaggcugcuuucugaugaagagugagugccugcaauucagagaguuuaugcugucuuccugaagucucuguucuuuuacugaucauuuaucuaaaucgacuuuaauucaucaucucaacuagaucauaaaacagcuuaauugauacuuauuugauggaaucuaccuuauucgugaaauuuaucacuucauacaagugcaagcagggaccaggaagcagagcuugccaccgucaccggagugauccuccagcagacucauuccuggaacacuuaacggaaggggguguguuccaagaucccagcgcuccaaauuaaaaccuggcccucccuagggcgcuuuggacuuagccuauuggauccacacugugguuuuaaaacaugucugcaaauccucuggcacuccucccaccaagaaguggaggccaauucuccucccacugaauacaggcuggccuuaauggcucacuuguaacuaauagaacucggcaggagggaugccgugugacuuucaaggccaguucaugaaaggcaacacagcauccaccggcuuuucucaggacaugcauuugaggccccaggggagaaauguggcuguccugcagccgucaugcugaaaaccacauggagaaagggaugccagaggagcccuggcugcucuguccccaaaugcuugcaucuucccagacccacucagagaagccuuuaagaugacagcccagccacuaucugacugcaacagcacugagaccccaagugaagcugcuugggccagccccagaaccaagagaggugauaauaauaaaugacuguuguuucacacugcugagucaggagagauuuguuaugaagccagaaauaacugaaacaauacacaaaucucacuagcuguggacccuggccaggucccuucccucugcaccugcuuuugcucaucugaaacuagaggccuggggacccagaacagaauugugugaguuuuuggcaaaaaaaagagaaauaaggaaaaagggggaguuaaaaaaacagguauaguggagcaaauccuucauaaaaccaauuauaaucaacugaagaaauauuuuguaucuugaaaugauggccuucuuauauuguuggugucaaaauauucuuuccuuuauuucauuuuaugaaaugaugauacaguagcugacaacuggcuuuuaauggccucauuuggucaaaucagaaguuggccauccugggucagccccacugauaugguuuggcucuguguccccacccaaaucucaucuuguagcucccauaauucccauguguugugggagggacccagugggagaagacugaauuagcgggacgggucuuucucaugcuguucuuauaauagcgaauaagucucaggggaucugacgggauuauaagggggaguuucccugcacaagcucucuuugccugccaccauccauguaagaugugacuugcuccuccuugccuuccaccaugauugugaggccuccccagccacauggaacugugaguccaauuaaaccucuuucuuucguaaauugcccagucuuggguaugucuuuuaucagcagugugaaaacagacuaauacaguaaauugguaccaguagaguagggcauugcugaaaagauacccaaaaauguggaagugacuuuggaacuggguaacaggcagaggcuggaacaguuuggagggcucagaagaagacaggaaaacgugcaaaaguuuggaacuuccuagagacuugcugaauggcuuugacaaaaaaugcuuaaugauaugaacaauaagguccagguugagguggucucagauggagaugagaaacuuguugggaauuggaauaaaggugacucuuguuaaguuuuagcaaagaguggcaucuugccacauuuagcaaaaagguggcauuuugccccugcccuagagaucuguggaacuucaagcuugagaaagaugauuuagguuaucuggcagaagaaauuucuaagcaguaaaacauucaagaugugacuugggugcugcuaaaggcauucaguuucaaaagggaaacagcauaaaaguuuggaaaauuugcaaugcaauugaaaagaaaaucccauuuucugaggagaaauucaagccugcugcagaaauuugcauaaauaacgaggagccgaauguuaguccccaagacaauggggaaaaugucucuagggcuugucagaggucuucaugcuagccucuuccaucacaggcccagaggccuaaaaggaaaaaaugguuucgugggcugggcccaggguucccgugcagugugcagcccagggacuuggugcccuaugucccaguugcuccagccaugacuaaaagggaccaagguauagcucaggcuguugcuucagaggguggaagcccuaagccuuggcagcuuucacacacucuagagccugcaggugcagagaagucaagaauugagguaugggaaccucugccuagauuucagaagauguauggaaaugccuggaugcccaggaaaaaguuugcugcaggggugggacccucacagagaaccucugcuagggcaguguggaagggaaaugugagauuagagccccacacagagucccuacuggggcacugccuaguagagcugugagaagagggucaccauccuccacaccccagaauggcagauccacugacaguuugcacagugcaccuggaaaagccacagacacucaacaacagccugugaaaguagcaaggagggaggcuguacccuacaaagccaaaggggcggagcugcccaagaccaugggaacccaccucuugcaccaucgugacccagacacaagacaugcagucaaaggagaucauuuuggaacuuuaaaauuugacugcccugcuggauuucagacuugcaugggcccuguaaccccuuugcuuuggccaauuucacccauuuggaagagcuguguuuacccaauacauguacccccgaagcaucuaggaaguaacuaacuugcuuuugauuuuacaggcucauagccagaagagacuugccuugucucagaugagacucuggacuuggacuuuuggguuaaugcugaaaugagcugagacuuggggggcuguugggauggcaugauugauuuugaaauguaaagauaugagauuugggagggaccaggggaggaaugauaugguuuagcucuguguccccacccaaaucucaucuuguagcucccauaauucccacguguuaugggggggacccagugggagaugacugaauuaggggggugggucuuucccaugcuguucucguaauagcgaauaagucuccugagauccgacaguauuauaagggggaguuucccugcacaagcucuuugccugcugccauccgcauaaggugacuugcuccuccuugccuuccgccaugauugugaggccuccucauucacguagaacugugaguccaauuaaaccucuuucuuucauaaauugcccagucuucgguaugucuuuaucagcagugugaaaacagacuaauacacccaccagcguucugaaauuugacuggucuucaucaucaagguuugggaacacccagcuagcuggucucagaucacuuccacaucugagaaguggacauuucugaaauucccuguagaaagaggagaucuaccucuuaaaauauacucuacaaaaacuugcccuggcuugucagcucagacaccuagcuccagcuuccagcagcucacuggucauggcugucgcacacccuuaacacagccccacaugcccauccaccagaggcagcauccuccugccucagaaccccugacuugccugccuugccucuggggcccacuccuccagccaggcccagcagggcugcaggaccccugaggggauagagaggugaaggaucaaacaaaaagaauuccuucaaaccugagcaaaaaaugccuugcucccuaagccacgucccuccuccugccagcaucuggcccugucagaggcagggcggcucaccacggagagaaacacacaaaccuccggaaaaaggugucagcagaucugcacuuuccaaaaacagaguguuuucaggucacaaaacagaaagacgccagcccaaaaccacugugggcuucauuucaaaaaugguaaggaggccuuccaauguucagcucuuuggcuucuagcuugcagggucgccucuccuuucucuguggccuguggugccuuuggagcggccacacccuugaauuugaggccaugagagcggcuaguucugcugggcccgauucagacccuccuuucuucucugcaucaaguggcagcaagccacccuccagccacagggugacaggcugggggaacgcggugggcaugacugaacuugaguguuuucuaacuccccaggcgucauccaccaggaagucccaaggagcccagccuccccucccucugcccaacuccugucaugggcagagaugugcagcgauccugggccugaggcccacgggggaaguucugaguuccucgggaggugcugucggcaaggcaggcuggcguugaugguuucccaaugccagauaaauaccguuuugaagccacaguauuucucaagcacaaauaguacaguaaagccgagacauuuauaugcaauugggagacauuuaucugugacaacauucuauuccaaugacuuuucuauuacugccaaugauuaaugauguaaauucugucacuugggaugauggaugcagggcagcugaggggccuuugcauagauuacccaaacucugucugcucauuggcucccaggacaaauguggccugugcuucagucaagcauaaauguaaaguucuuuuagauuaaaaaaauauuauucuucuucaguacucuccagaagcagcugguuuagggcugggugaaagguuucuccuccuccaauaugucuucccuuuucagugccagggcugcugacaugcacuccauuuaggaauaauugcauaauucuucccaaacaggagcaugggaggccuucaccauuaggagccacagaaggaaaguuagagacaagcaagcaaggcccaagaacuugggcauuuggggccuucuagaugugaggccuaacccagccccacccagccuaggucccagacagcauggacaccucuugccucuccaccuuggucauguugguccagcuaccuggaacgucuucgcugugacccauggccuccaccugcugaaauacugucccuuguucacagcaccaaagauggcauguagauguccccccccgcccccgauggguuuugcuucugcccuuccccuccuugcugcgucuuucucggggcccccucccccaccccacucugcccucuccugugggucuuccucucuacucccaaaucuguauuuccugggcuauccuuggcucugaauuucaagcccauaaauccuacugcaaagccgcaccuggcugucucagggcggccuccaacugaacucuccucugcuccuccugggucauggcagugggugccaaaacagagaccucagggcuguccuuaacgccucccuuccccccacccucaaugucugaucgauggccaaguccuacagauuccuuuucuuaccaaucucuugaaucugucacuucucuccagcuccauugccacacucugggccaacugucaccuagguuaauaauugcaaguucuuggucucuuaacaguuuccucgcauccaaucuugccacccugggcuucuccaagucagauaucucaucagcuggcucucuccuaggcccuccacggcacuucauuuaaaccaccacggcuuaccaggcccugcaucccgcccaccugcacacaacuccacccucauccugcaccagccacacccucauuccccacacugcaaacccucuggcuuccuccagugucaugaacaggcucauuccccacacugcaaacccucuggcuuccuccacugucaugaacaugccacucucucccuggaugccaucucuuuauagggcaacucccucugccuggaacaaucuuucucucccuggcccccuucaccuggcuaacucucacucauccuucaugucucagcuuagacaccacuugcucagagaagucuucccugacccaccccacacagacuacgugggcuuuucuaugagcuccagaauggccuguaauuguccccucauguaccucaacaggccuccgccucccuacaguggaagcucacggcaagcucagguccacauuggucuuguucaucaccuguacagcucagcaccugcuaugacaucugcacggaauaaguguccaugacguaucuaucugcucaaugggugaacaaagcagaaaacguaucuacugugaggcuacuuccccaucccucccuagagugccaacuccuggaggcccaggaccacaaccaguucaucucuggaugccuagggagcccaccaugggucucacacagagcagguguucagaacaagcuuguggagaaaguaggagagaagaaagaaaaauccugauauaaaagcacauggaaccuagaaaaucaguggccuuauucauacagcaaagugauaaaaguuuaaagaaggagagagaauugauuuggagugugcagcaaacaugagggccuguaagucaagcugccguaaaugcugggggagagcagccugguuucccugcagaaacucggaaagcaguugucauucagagguggggcgggccuuacaggaacucggccggcggcuccuggaucuggauuccuggcacuccuaacucaauuuggccaucgucuuaguguccuuucuuggaaaacggaugagcuuucuacucugugaugcccgggaagcgcccugggcucugcgcugacaggugguggagcugaauccagcccaggcagggugagacccggaggucucugugguccugaggauucccacccgauagcaggagaaagcaaagaggaagaacacaaagacaucacaugccccuggcucccuucucguccccuucucuggcagccuggucgccucugagaugucugcaccugggaacagaccgcgaacagcacucacaggcaugcccaggagacucagggcuccaccacccacuccaagugccagggacccaccagaaagcagcuagggcacauucaagggcuccuaaugcacagaccccaggggaucagucccccaugcugaagucuaagaaugaccgaugguggggucagagacucaguuguaggauagacggucuuggagaagucaucagggccaccccugucugcaggccccagucagagagacaggcuucgccagcauauaggaucacugcuugcuuagagaccaugaaugcuacugacuccaucuuccucaccacgccaguggccauggcugacagggcuggaaaccagaggccggcugcugcuucugcugugauucuccucccucuccggcaagcccugugaugagcccuccacugcacagcccucccucccacaguccucuccuucuagaccacguuguccacucucucuagcuucaggcugcacugcucccaccuucuugaacaccuuggcuccacuaaaacccuuccggccuggcuucuucucuuccugugaaauuucucaaaccacagccuguaccaaugcccccacaucaggaagcugggcaggaaaagaauuaaaacccaagucaccaagaagacaggacagggaaauuauaaaaugcagaaauccaggguacuuaugaaauuacuagauuucuuggcugagugaaugcacauaccuaaccacaaaaauuauuuuccaaguuuggcuuuuagguuccuggagugaaaggaguaaaaaaaucuaaucucugaaaccuucauaaauauaugcuuuucuuuuuuaaugaaacuacuuagacgaauccacuuuugccugacaaaguagaggaauccaaagugucuggauuuuaaaagcuuccauuaaaguggcuuuucuuuuuucaaaaaguaaugaauugaaaaauaaaucagaaggcuuaauuaagccugaggcccguaagaggcagccagggcaaagcuuccugacaagcccacagagccagagcagggccgagccucccgcucugcuuauucuugaagcagcuccggccaaaggcaugccuuugaaucgcacagaauuagaauucagcagugauucuuucaggcaguacagugugucuuuacuggugcuacagcaggcucauaaauuaagauuaaaaaguuggucagauggagacaaaaacguguuucuggggagaggagaaaaaaacgcagaguaacaucccagagucugcaggcucccagcaucucccuggccacaugagcgccucagcccagcuaaacuaaaagccccuggcucguucaagccagaccuggccuuaaagagggaaaaggucucugucccaaccauguacaugugccaccccuuccuaggggccugccugggaauagguuccaccaguggguaaacagcaccccacacagccuaaccacuagucggaggccacaaaaaauggccauugcauggccacuagcuagggcagccgauagccgugugugcaugugccugugagagaauccgccucaucucagaguacauauucauuuauuugaaagccuuauauagcaucuguuaaauauaucaagugcacagagguagaacagugaaaaagucagagauggccagguguggugguucacgccuguaaucccagcacucugggaggccaaggcagcagaucaccugagguaggaguucaagaccagccuggccgacauggugaaaccccaucucuacuaaaaauacaaaauuagcagggcuuggugucaggcaucuguaaucccagcuacucgagaggcugaggcaggagaaucacuugaacccgggaggcagagguugcagugagccgagaucacgccguugcacuccagccugggcaaaaagagcaaaacucuaucucaaaaaaaaaaaaaaaaaaagagaugagcccugccuuuuugcaaccuacauuaaugugagggaggcagaugcucaaauggaucaucuuagaaauaggucgguguguuugugcccagugucccaaaagcaguacgagaugauaugagugaagaagcuggccuuguagccucuuuacuccuuucucaggacacugauggaaauccugugcuccagacaaaaauacuacucauuugccuccaaauucaucauuaccugcuccuacgccuguacucaugcagucccuuccaccaggaaggcccccaucucuaccuuucaaacauccuacucugccuuaagaacccacauccacgcugccucuuuugugaugcaucuaguaguccucuccucccacaaucucccuccugaggaccuuccucagcaccaucucuggaacugagcacagggccuggcacagcacaguuugugcugaaucaaacagaaacgcucauccauaaagcuacuugaaaauacucaggaaaagaagagaucagcacccagggcaggaagaaacuucugggaagaagucaaucugagucuaugcaggaggaagcugggggcagggggaaagggaggcaagguaccccacgcagggggucaagcagggugcugaccacuaggggaagaaugccucguuaccaugauggcucugcuggggagggcaccccaacaaggcuggagggccagggaaccccaaaagcaggcagaucugggagguuucugcaggcuccucagcagagcucugaccguccugauggaaacagucuggccauguggcacugcacacacugggucagagcaagcggaggguggggaggccaacucacccuccaggccaaggggacuuggggccaagcaguggccgccagagcaaagacagggcauggaccuaaaggagaaacuggccucuaaaauacgaccccuuccuccacauccuuuuguccccagaaguguuuacaaacaugaagaggaaggaaagcacuuagggaauuuauuuagaguggaggaaccugagcacagaucauguaaaucacucaaggucacggcaugcugauggcagccuggggagaccaaguuguagccaaaaacagggaggugcuggcaaggcaauaacuccacgcugggcgcuggaguucacagggccugggcuggguucaaauccugcuucugugacuggccacacaaccuccuggugcccaagcuucccuccccacacaguggaaacagaaacaacucccagcugccgacuggguagugggaggauucagugacgggcauggaggcgggcagcacgccuggcucccagcucaagcucaguguggggcaguaugacagcgccuccccugugaacugggguagucuucugcugagagggaggcagagguggggcaugagggagcugggagcaggcauccgccuggaggacaggcugcugggagggccgaccaaaauccuccuccccugcggagggacagagccccucccuaagccagacaguuaucuaacggaaacaugaacuucuuuacuauggcaugagaaagaccaagguuauuuugaaaaguaccaagaaauguuaauuccccggggcucuuuauguaaagacagacuaaaauccagaggauagagugguccccaggagacugacaggaagaaagccacuuuaauauuucauuagugucccauuagcaagacaacacacauuuucacacuuggugacuucuugggaauaauuucucauucagaaacaaagggggaugcuacugcugcuuaccccgcuggccugcuaagcauccugaagcagccaguuggaaagaacuugaccuucaggguuacagcuacucaagccaaugaacuccauugugcaagacuuccuggggaggcuccuaugaaacccacuaauccagggauugaaagccaagcaauugagcugcaaaaguaaagcaagucugucuuauguuccuuaagccaggcucacacugcucagcccuccaggccugucacacuagagccacccaccaauccggggauccuacaaacaacacccuucagcuauagccugaaaagaagggaagggagagggaaggggagggaaagauaagagaaagaagggaaagagagcagggauucaggaagacaaagggaguugaucuuagcagcuagcauugugcagaucacugucacauucagcugcucaucaaauaucuccugugcccucagugugugccaggaauaugcuugaugcagggcucgcggaacagagcccgcagacagcaagcgaggaaacacaugagggaaucacucgaaguuguuaauuuagguuccacaagagaccagagaggugguucucggccuucccauuuuucagaugaggagcucagccagcaccuuaccagcgggguuucugggggacuugguaaagggagggguggaucuggccucggacagggggcuucucagcccuaugaaggucuaccugucuuacagaucauuuacagagauggcucaaacaugaagaucauuuacagagauggcucaaacaugaagaucauuuacagagauggcucaaacacaggaagaucacuuacagagauggcucaaacacaggaagacacugcacagggccuuuguuuucugguuucuggcuuuguggcucauaucucucucuccguguugacgauaauuacucacaggcaggaggauggcucagccccuucuccucaucccccacaaggucacagggaggucgaaggagcugacaccagguacuguccucucagcuccagugggcuucuucaugcagguggccuccugggccccaacucccuccaaggaccaccucacagagccagccugccauuugccaccagcucccaguccugagcuaacguccucaccacguucaaggagcagagggcaccuggucuccaaggacacccuccccucuuucccuccaauuuggucuauuaacuuaaaacaaaggaagcuggccaggagugguaggcacaggggaugucugagaggauguaauuaaugcagcugcuccaaacggaagguaacaccuugucuccucauuagcagauguacugcaauuuaggaugacauccuggacgcgagcaauggggacacacagcucccuggcaaguccacuccuugcccgccacuuccauuuccucacuguugagcaauuaugaacaaagcacccccagcagaagguucugagcugcugaaguccagccacaggguucuagcagcccagggccuggguccaaagcuccacggauccagcaaccuuggguucccacauauagccccaguaggugacaggcaagcacaccuccgccuuugaaauauuuccucauuaaauauucagcauggguuccugacccuguuugcugcgcucuauaaacagaaaaggcacaagauggacugcaaggacacaaugaccuucccagauagugacauguuggagggacucaagguaugcagagacccgcuuuccaacagcucaggcccaagucaaguuacauuagcauuuuccuuucaagaaacaagaccagcauuucccuccccacccugcuccccucaaaaaaugagcugagccuccaauguagcaaaaacauuucaguagagggaaugaacccugcaaaguuacguuccagccuggcuaaaaagaaguuuggggccacccaggugacucugugccuaugcagaagcugaaagaaaacugggguaaaaagaagaaaaaaacaguugccauacugguguuuugagacuacagcuucuccuuucaaaccagcaggucaccuagaucaagcccaugaaggcuuuggaaucaucugaauagugaaccuuaauuaugacccagcaggagaacaauaaacaaggugccccuugcauugcugggcagccaccugggcccuauaacggguacuagugccuuagcaugucaacuccaagaggacagcaaguggcuuggccuggacccaaacaccuagucaauauauagauaaagccaaaagcaaacaaggauugcugcaaauuccacaauggcacauugugagaaaggccaacugauuuucaggauuggugaccuggaccagguuagcugcuccagagaguuccauacaggcugggccacccuuggggcaaccagccuaaguacaugcagaggcaggaaaacuuccuuggcuucagcuuaacaccagaggggccaaagccaaaagucaccacuauccuugcuuagagcugagccugaaaaccgggagacccaggaaguucacucaggagucuuuuccccaagucuuuuugugcacacagauuaauuguaucuggcucauccucaaggucacagaaucaguccaggacagagcugaauguacccaggccaccuccugugggucaccccaccugcuccaguuagucccucauugcaaacucacaggcaggcagaggccccuuaggagaccagagcccuccacgccccaugggcugcgccaaucccauacagccaaaccccugugaggcacagcucuaccgccugcugugucugccagcccaagggucugcuguagagcccacugcaggguagaggccccccgccccaaccugagaacuguuacccugcuggagaugggccuuuucuggcucugaauuuccaaauugugccugcuuccaaccucccucgugaugccagaagcacuucuuugucauuuuuagggaguuccugagaaugaaauaacuauacuuuugcuuagaaauucacaaguauucggaaguaauucagacauacuguauccaaauauuagguacuagguauuauuaaguaguauuaggugacuuuguguguccuuucaucuaaauuauuaaaagucccaaggauucuccaguccacaucuaauacuucagaugaucaaagcagacaaauaaauugaguuuucuuuuagaggccaggaaauccuuguuuucuugaggaguagaagagaacguagcaagucagccugcuuaauccuaccugucaccauuggaaaaaaauuuuuaaaaggauuaugauauaaaaugaugcagaugcuugugguuauuauuguacuucgccauguuauucuuugauucgaugcuuuuuaauuaaauuuaaauugaucgagcaguuucagccaugacuucucaauacucaugugugauucugaagaugccagcaucuggcuaaauuaauauugcacacuuacuugucaauaacaacuccugguggagaacugcacauucaggggcccuggcacaggcugucccacugagcagcugcaggggaggcgaagccaggagcacuuccacgaagacuccuaccuagcucugggguugagcucacaaugccauaaccccagagucucaugaaggguauguuaucaaaguugaaccaagcauauuuuuaaaaauuuucauguccauuucccuaacucucuaccccaagaaaaggaacgaggacuauaauccacaacuaugaaccugggcugcaccaaacccuggagaagaugacagagccacuuuccuaagagccuccaguugacaguagaccaucaggaggugaucgcguugccaguucacugacaugaaaaccuuuucuuggggaaagcaugcucaacuuuuacuuuaaauauacuucuugaauauucuggcuucacacuugcagcgagcagcgggcagcauuuccagagccaggagauaaacuugagagcagagggcaugguggagaaacaaggcaagaacccuggccugucagccugcuugccgugggcacugcuggacacaagaggcgugaagggagugagggggaguaacggccccucugcgugugccuuggcacccuggaggggacaggacgugggaugaugacggauagcauuaagugccuggaagaaaaugaugcaggcagaaggggaugggaugucuucuucauaaagggugacgagcaaagaagggguucucaagucacagggugggcacugucuggggguccaggcagaagggacagcaacuuacuuggcacgucugagggagaaaaaauggccagccuggcuccaguaggcaaggaaaaagugacaagacaugaggccacgaggcuggcgagggagccggaaggcagaccaccacggcaauagggcugggaggccucuggguuuugugggcacugugaugggcaggcaggaaugacaguggggcgggagaggcuggaacugcgccaggucugaggaccacaguggcucccagguggggcaggagcagaagggcuggacaggaagggccccaccgagggcugacuggucugccagucacggggcacaugcccacgcuacuucuggaguggcugagggcacuccucccaggccagggguggucguccuuacgcccugggcaggcuggccccguaccugcugcucgacucagaaccuucagucuuacugggaagagacuauggacccaggggaccaccggcucaccauucagcaggagucccaugaagccccgaacggugccuggcucacugaaggucauagagcggcggucuggacaagccagaauucuucaguugccuucaugugaaacucccccaggagcaugcccugcuggggaaguguucuugagucaagcugcagcaacccacucacacuugaaaaccucugcaugcacccugcguagaaacacgggacagcggggggagggcaggagggggcgccgggagagcugcugcugagacugcaaguucguuugccaugucuccuuacaacaaaguuccuagaggucagggacuaugucccuccauccaucccagagcccagaugucuggcgacucagcaaacacugaauguugaugaugcugcucggccuccagaacauccuauaacucuuacuguuuuaccaacucaaggacacagcagaaaccacacaccggauuuuuagaaagcaaacaaaacugaaaagcaauuagaacagacaaaucacauauauuuaaauacugagaucuuaaaugaugccugccuaucccgaagauggaucucaauuuccucuucagacccgagacuuccugcgagagaacaaaggccaugucacagggcugggacgcgggggaugggagagacaacagcucccaccucuacagcgggucacaacugcuucuccuuaguugcccacauggcuaaggcagaaagguuuuaaacuuagcuaaaauacauauuuugauuuacuuuagaaacuugaacuggccccaggcaaauaauaacuacaugagaauauuucauuuagcaccuuccucuuucacucccuuuagggaaaagacugcugcacucgaaaaugagggggagggaaacuuaaaggaaaaauauauucgaacaacagccagaguggggaagguaggcacacauuucugagccaaguuccaagcuccuguugcuccaauuugccuuugaaacaauuccacuuugccuucuguugcuugaacaauaauuauuaaagguaucaauuaaaagugcccaacuccauugcucccauggccaaagucccuggcacaucucccgccauugccugcagcaccugccaccacccugauuuucugugucagugggguagagccagucuaggauagagccucuucuuugguugauuuaaggcugggagaagggccacuacccauggcccugccacagugaggaaggaaaagcagagccuuuucugccaucucuaaguagcuagcaucaguagccuagucacaacaaaugcacugggcucaguauugggaagacaguccuuuauacaaauuuggcaccucuauauccagaaagaccccuuggcaggggguuucuccccauucuucucccuccucccucaucuugccaggaggaggaggaccugggaguaccauuugacaugacacgaaagagggaaucccucuucuuagcaucacccacuggaaagcuuccagauaaaacagcagucgcuccuggcuugucagaaaagaccgugggugacuuggagggcucacgauccuaagcaggugcugggcuccuguggccagagccucagaguucccacaggcaacaccagcuccacaucccuucaggacaucuaucugaaggagcagaggcgugugugggagcugcaggcacagaaccagcagcaggagccacuccagggaggaugaagcagcacuucccauaggguccacaggcagcaacucugcacucuggcaacccugcaccgagcacacucuguauaugaggcccuguaucuggccccagaacacgcaauaagagaugcaggcacuaacccaaagagcucuaaguaugaggacagauacuugcaugaacuauuaauaagagacaaagcacaaugcaaacgcaaagcagggggcaggggcacggacaauacagagaagagggagaguuuaacugaaacuugaaugugaagccuuuacccaagugcagaagggccaagggacugcauggacaaaggguuccacuaggagcugaagcuuuauuaugagagggaagcggggcugguggcagggguggggcaagacagagguggaugguaaagaaaggaggagcaggccgggcauaguggcucgcgccuguaaucccaauauuuugggaggccgaagcagguggaucaccugaggucaggaguucaacaccagcccuggccaacauggugaaacccugucucuacuaaaaacacaaaaauuagccaggugugguugcgcacaccuauaauccuaccuacucaggaggcugaggcaggagaauugcucgaacccgggagguggagguugcagugagccaagauugcaccacugcacucuagccugggcaacaggaacaaaacaccgucucaaaaaaaaaaaaaaaaaaaaaaggaacaaggcaaggagacccaggaauaguucagggacucacgagggcccaagcuggggcaguggagauggagaagaugggagaaaacaugaaguucacaggcagaauuuauggaucuucauucaugacuccagggagugccacacagcaacagagcggaccccagaguggcaagcgugggccacuggccucaggacacacagcaaaccacacgaauaaccuguuggagaaagaauguuuggcuuuggacacacagcgagucggaguguucagcgugcaauacgaaacaaaggcuuaggccagguguggcggcucacgccuguaaucccagcaguuuggaaggcugaggcgggaggaucacuugagcucaggaguucgagaucagucuaggcaacacagcaagaccucgucucugccaaaaauuaaaaaaaaaaaaaaaaaaaaaaaaaaaaaaaauuagcugggcaugguggcgcaugccuguaguuccagauaucgaguggcugaggugggaggacugcuugagccuggaaguuugaggcugcugcggcugcugugagcuauguuguucaugcuacugcauuccagccuggggcgauagaggaagacucugucucaaaaauuaaaaaaaaaaaaagaaagaaagaaaaaaaaaggcuuaaaguucaggggaggagagccuaaagauauagaugugggugucauuggcagauaaacagaaauuuaaaucagaaaacaguccagagagcucuuaguaaaagaaaagagagccaagaauauaaagcucaggagagccaucucagagggugcccuugaaaggggcagggaccagauggugaggcaggaagacggugucccagggcugagggagagacaggucuccuuucaagaaaaggacagcuaacaucaacaaaugcuacagagaagccaggaaggaugagggcugaaaagaggccaugggauuuaauaacuaagcguguucagugaauucuaacaugagaagugccuauugaauggaaugaggaggcagaugcacgauuucuguggugaaggaaagaaugggaagggaaauggagagagaaaauaguaccagggaagggccaggagaaacuuacacaaaaugagaauggcagcacauugcugaguagagugagcaagguagaauaaauaucuggauaugucguuugaacucaagagagaggaauaaacuguagauaauuugggaaucgucaacagagugguaaugauagaagucuugcccaacgaugacacugcccauggagaguacagauaaaaagaaggucugcgauguccacaggaaacuggagcaagggccucucuuccaauccuuuguccacaccguuccuuccuucccacccauccagcucaauccauaaugaugaauuccagcuacauuaguuucuggaaggaguugccccuuaagauuaggcauauggaaagucuucaacuucuucguaacacugagguucuacagauggugaacugguaaauaaagacagguccuauaggacccagggucagaaacauggguuacucaccuguuccuuggauauucugaagcucugagccauguccaagagcacaaucacaagcugagucuuuccucgugcuucaguaaaauacuggauaaugccaacaagaugcaccacauagaaacuuggguuaugcaaaaugcacauaaugaugacccaacagaauaaaugguucuaaauaaacuuaggauucaauaaaacagcuguaaaaguggguuuuaaauauauuuuuaauuaagguauaauuaacauacaauaaaauguauagaucuucaucugcuggaugaguuuuaagaaguguauaaacacguaaucacuacccaaaaugggagugagccuacacuuccaccacccaaaaccuuccuugccucuuuccgguuaauuccccucccuacucuuaagaaaacacuuuugaucaccauagaguggucucauccguucuuggauuuuaucuaaaugcauucauaggguauguccuucuguucuucagcuccauccauaugguuguuaacaguaguucauucuuuuuuauuacucagcaguauuccacuguaauaauuuauucauucuucaguugauggauauuugggcuguuucuauuuuuggcuuuauaugaacauucuuauauaaguucuuuugggaacauauauuuucauuuuccuaaaguaaauacuuaagaguggaacuguuggaucaugguguacauguauguuuaauuucaggaaagaaaaccugccaaucaagucucccaagggguuggacuacuucauacaccaaccagcaauguuugagaguugcaguuguuccacaaucucaccaacauuucauguugauagucuuuuuuauuuuagccacucuaauaauagauggcaucucacugugguuuuaacuuguauuucccugacguugaacaccuuucuacaugcuuauuggccauguguauaacuucuuuugugaacuaccuguucaaagugcacagguccauacauucugacaaacaaacagagcugcauaaccacaaucacaaacaccauacagaaaauuuccaucaccucaaaaaguucccuugugcucuucuguaaccgacccacccacagcaacccaguccacagcaaccacugauguuuucuucccauacaauuuuggcuuuuccagaaggucacauaaacagaaucaggccuuuugagucuggcuucuucucacuaaucauaaugcauucgagacucguccauguugugucacuuuguuccuuuucacugugaguaguacuccaaugaaguugcuuauucauuggccaguugaaugacauuuggguuguuucagcuuuugaacaucaugaguaaugcugcuguaaauguucccauacaaauuucuguaggugcauaacuuuauauucucuuagguaaauaccuagaagugggauugcugggucuugcuguaaaugcagauuuguaagauucuuaaguguagacuuauaagaaaaugucaauguuguuuccaaaguggcuguagcauucugcauuccuaaaagccaguacgaguuuuuauuuuuauuuuuuuuuuugugugugugugugugugugugugugugugugugacagucucaccuugucauucgggcugaagugcaguggcgugaucucugcucacugcaaccuccaacuccuggguucaaacuauucuccugccucagccucccaaguagcuggaauaccggggcccaccaccaugcccggcuaauuuuuguacuuuuaguagagacgggguuucaccauguuggccaggcuggucuugaacuccugacuucaagugauccaccugccuuggccucccaaagugcuggguaaauuacaggugugagccaccgcaccaggcaagaguuucaguuucccuacauguucaccagcacuugguauuaccagggucuuuuugguuuuauuuugggaagauacccuaguaacuguguaccagcaucucauugugguuuuuaguuucauuucaaugaugaauaacgcuguugaacauucuucaugugcuuaguugccaucuguguauccuaagaugucuagagaacucucuugcccauuuuuaaauuggguuguuuuaaaguuuuuaaagguuuuaaaguucuucauacauuauggaucccuuauuagacguauguuuuacaaagguuccucccagucuguggcuuguuuuuucauuaucuaaacaguaccuuuugaagaacaggauuuuuuaauuucuaggaagucugauguuuugucucuuauggauugcacaauuggugccauaucuaauaaaucacugcuaacccaaggucaugaaaacuuucucccauguuuucuuccagaaggcuuauagauuuaaacuuaggucuaugauccacuuugaguuaauuuuuauauacaguaugggguauggguugagguucauuuuauuugcacaugaauguccaguuguuccauuacaaucuguugaaaagacuauccuuucuccauugaauucccuuugcaccucugucaaaaaccaauugagcaucuauguguggaucuguuucuggauucccuauuugguuccauugauuuauauguccaucuuuuugcaauaccacacugucuugauuacuguagcauuacaggaagucuugaaaucaggcuaucuccuagcuuugcucuuuuucaaagcugcuuuggucuuucuagaucuuuugcauuuccauaaaaaccuugcaauuaguuuaucuagauuuugaguaggauggcacggaauucauaaaucaauuuagggaaaacagacaucuuacuauuuagucuuucaauacaugguauagcccuccauuuauauagaucuucucuuaauuucucucacagauauuuugugguuuucagcauagaggucuuacacauauucuuaguuuuauucuaagguaucugaaguuuuugaagcuacuguaaaugguacugauauuuaaguuuccucuuccaauuguuuguugcuaauauauagaaauacaauugaucuuguaucuuguugucuugcugaauucauuuauucucauaggugcuuggguuuuuuuuuauauagauuccauggguuuuucauaaucauguuguuugcaaauaaaggcuaaauucuggaguuagauuaauuugacugucuaaaacuccaaaagacaggugcuuuucaauuauuagaaaguguccaaaauuccagaaaaaaaaacuuaagaauucugaccucagaguuuuuacuucccuuucuugucagauuaacaccaucuuacaagggaugacaggaggcugucucauugcacgggaacgggaggccaccaucaagaaacucugguggcuaugauaacuuacacacaguuucaaaguuaucccuuccacacaccaccucuguguccugugcagucugcagugcugguggcaggccugaugacuaccaauguaccaagcaaugaagcagcauauguuuaguaucuccaggcucuaucaccuggauauuuacuguaagcuucugguaaagugaucucuuucagccugguaaacaaacucuggauuucacaugugacuuuucaaagagcugcagggaguggggcuguugacagcauuuuucccaccagcaaagagacacacgaaaaggucucaauuauagguaacugacaauccaacagcaacaaacacgcacaguguuggcaauguaaaauccaaagaugcuuguauaacacagaggcaacaccaaguucaccaaguuuauggcucaauuacuaaaguacacagaaacaaggaaacagaucaaccgaugaaggacuugacaagggcuuguguuuaaaauguauugcugccaccacgugauuuucuuccauuccacaaccuuauauaacuuaaguccucagucauaucuacaguaucaacugcuaugauuuguugaaguuaauuccugccuccaucacaaaaaucaagcaauuauuuaucaugcuaguguuauuuuugcccagugguuucagguacaacuuuauuaugagauagugaaacucugugugugugugugugugugugugugugugugugugugugcgcgcgcgcgugcgcguuauacacauauaauuuuuuaacagcgaaguaacucucaagcacuccacugccauuccaucaaaugcaaggcaagugauugcugaauucccaauuaugcucaaacuuaaaucacacuguuuggucugauuguauacccagcccuacagggaguugugcaaaggcauauauuuggcaagcuuucaaaccacggcaacaaaacaugugcugaagaaaaggauucaaaauauuaagaaagcagucauuuauuuuagaaagccuguucacgugagacaauaagcugcuucccagaauaggcuccauccaucaggaaaacacuauaaccuagcacacacuggcuggaaucccucucagccaucacacagcagugaugauuauuuaucauccacagugcaucaaagauggggaaacagacugggcacgcuuccaugauggugcagggcuaucaauggcagcaaacccuccccacccugaagaagcauccacgguaccgaugaccucacagauccuagagacuuaccugguuuuccuacagauccacaggcgagcuuguggguacucagguacaugaaggugauggaagacaggggcaccuuggugcuacgucuagaucaucuauuccauuuaaagaaaaaaaaaaucaaacaaaauaaaacaaaccagggggccccauguuggccagcuaccuguuuggaggucggcuaggcaacaagaggcuggagguccuucuugguaucaggcuagcugggccugcugaguuaggccaguugaagcaaagcaaagcucauuugagaugagacuuaggaaaaucucuuuccaguaucuuuccugagcauaucccuggaaagcaucuguaccaucacgaagcaccaacuccacccaggauaacuguuccauuaugagcccauucucucacacucuaugaacuauaacuuaucugccuggagacagaauuucuaucuccuuuuguuuguuuguuuauuuuuggagaugggcucuugcucugucacccaggcuggaguauaguggugcgaucucagcucacugcaagcuccgccuccuggguucacaccauucuccugccucagccucccgaguagcugggacuacaggcacccgccaccaugcccagcuaauuuuuucuauuuuuaguagagacgggguuucaccguguuagccaggauggucucgaucuccugaccucgugaucugccugccucggccucccagagugcugagauuacagguuugagccaccgugcccggcccagaauuucucucuccuucuaucacuguaucugaggaaugggcaacagauggaucuaguaagauguacauaauaauuaguuuccucuaaaucaggacacauuacaauuuuaacaaauauuuaagcuccucaaccaauuuuaagaaauauuuaaugagccaacugaaguaccaagacaagaaauaagaaacugcagguuagcaaaugaacuggaaucucaacuuucguaggguaaacaacuuuggauucguaggguuuuucagauaccacuaaacacagugucugcaaagaagagaaaaaguuauggacugguggcuagccagaaauuucugcaaauaucuuagccaugaaaagacaggcuagaaaaagaaaaccaagacguuugugggcagaaaaucauuuuggcucuuaaggcugggaaaaaagaaaugaacaauaguaaguggauacuuuucccuuacuaacauucaaagcaguuaaacacaacccauauauccaucuagaagugccaaucccacuucuucagguuccaucagagagcucuguuucauuuucaaacaaauaaucaccaccauauacugaaugugugucaaacauagggucaaguguacugcacacacuaacuucuaauuaaucucugugggaaagacacugccuuucaaaaacucaccaggaguaccgaccagguagguaaagggagauguuuagaacauucaguugacuaaaccacauuaacuucaaaagcaaucagccaaaaagucaaaucagaaaagcgauauacaaucuggggguguauauaugagaaaaauggcuuccaguaaauacaggcuuauugaguuugcacuaacuaggaaaccaaugacugacauggacuuccaacacuacuccccgccccacacugacccuaaacacacaguggcucagcagcuugucaccaugggaacacaaucugcugugcuuacaugcuucuugcacacaagaccauccauauguuggucaaaacccauuuuccacccccaucuucccaccuucauuucacacaucuugauccugaacaggccaggcccuuuccugacucugccugugcucaaccuguuuguucccuccuaccugaaccuguucucuacucaggcaaguggggaaccaggcagagucgaggcaucuucagcucuggucaaacaugagaagggagagguucucuuaaaacuagucuaaugaauugaugcucacucaaaagcaacugaaauccuccagcuccauggcuuuaucucuaggucucaguucuaaaaagguccauuucacuauaaauuaacugggaaguuacuguuucuccuugcacaacccaaucacuguaauaaugcccugauaaagacagcaacaagaaugaaaaguugcacaggggagcuucugccaagcagaugggucuccugaguucuacaauccaguccccaacgaguauauucaagaccaaaguaaauacuucaacaaacagcuuggaguggcauaauacauuugagacucagugaguuggaaacgugauucuuuucuucccuaaggaagcugaugcaaaggguuccucagaaguaguuaauugaacccucugcaucagcuucuuuagggaaggaaucacaacugccuagguaucaguagccauuaccauguuuuccuccugaacgcuuggauguugccagguggaaaacuaaugaaacgaaaaguggcugaccaaaguuuagauuuccgcaaauaucucuaucuuaacagauuugcuaccuaaccccaaaaugaacauucaacacagaaagcaucccggccagacacgccacaggagaaaucacagaaaaugcuaucuggcuccgaaggcuggaucugagggaauucaaauucagucuucagcaaaggcaagcagugccaucccacugccccaggaaggacacagaggcagaucgccacuggugaacuccuacuauggaccaagaaugcuaggaaauuauauuuucaucucauuuggggugaacuaggggaauuucauguccuucuagggacacaggcugauucuguuuaaguacaagcauucugugaauccccaaauuucaauuuucaacccuaaaaggcaaaguuuagagcaguuuuuuucccaaacgguucaaaaaaaaugugggcaagaauuugaggagcagcuucuaggcagcuaguuccaccaagugggagcucuucuugggcauuagugaucugcaggguuccgcuccugcacugauuuaaucaauggauaccuaggcacuugcagguacaucuaacuacucagaacauagcugaaaaggagauagacagggcccccugcccuaaaagagcuaauaggauggggaagagcugaggacaaaaagaaaaagaagagacaauuucagacaguaauaaaugcuacgaaaaaaaccacacugccacaugacagagugacaggggacuaucaccugucaucaggcuaucgggggagggucucucugaggauauaacauuugaggugagcccugaaugacacaaaggagccagcaaacaaagauggggaggagaggaaauaauuuuagguagagaaaacagcgaaugcaaaaaagaaucauguuugauggauuccccguaugggaagggugcuuagagggaagaggcaccugguaggaaauggagaggcagaggccagauuauucaugcugaccggacuccaaauggauagaaagucacuguaggguuuaagcuagugaacgaauccuauuuacauucuucauagauugcccuggcuagugcauggggaaucuauuccaaggggagcaaacuggagacaugaaguccacacaggaaaaugugacagaucuccaggcaaagaaaagaagguggcuuggacuagggugguacuagcagagaugugcaaagauggauguauuuuggaaggagaaagaugggugucugggauggggaaaaaagggcagaaucaaggacaggccugagauucuggcuugaacuacugaugaguuuguguuaagugaaucucagccuucauguucauaaauauucuuccaugcucuuucaccaacuuugaacuucaacccucaccugacaccuuuuaacagcggacagagaacacugcacccuguccggacagacaccaaggcagauuuaaguguuaauacuuagacaaucaugcuccaaaaugaaaggugggugaguucaggcccacacacaggcucagggccuguaaguaguuugccugagcuaccucuugccuccucccuugaccucgcccucccuacugaaaagucuuggucucccggcuuugcaaagacccuccaucugaagcagcugcucacagagcauuuucugcuuccuuuuaccaggcuuuuaaaacagauacuuuuucuacccugaguuugucaccauuuaaaauguugugcuaguuagcaguaauuauguaaaugcaagccgccauuucuauuuuuaaaaggaacccccauuuagcauucuuauauccugaaauguuuaaaauagcuaguccagugauguuuucacuuuauucaaacuguuuguguggauuuaaauacagguucagcagaaaccaaagcaagucaaacguuuacuuucuauuaaacaucuaaaucagaagauuaaaaaacuauuuuacauuuaacagaaagaagccgucaaaucagcacagcggcagcuucaccguauuuacugccaagaagggcugacgcuugagagguaaucaauuuaggaagggagggauggauuucuuuaaauucuucaaaaagggaaaaauacauuugagcaaaucuuuuaauuauaguaucuuccaaagaaccuacaaagccuuuauucuuuccaaaccuaaugcuuuuuaaaggcagcuuuugccccuuaauuccacaugaaauauucaguauagcauaauuaaauuuuauuccaugcuauuuuuacuggguucacagaaauagaggguggcaucauccuuaaaacaaacuucccagcaacuucgcuuucacagugaauggcugguucuuaaaauugaaccuaaaaugcaaaaccuacuccaaaugccuauuucaguuccggguagauggguggguacugaaaaaauaaguucauucauaugucacaccaaccuucaaauaaacaauugccccaguucuccguucacuuaauugugcuugccacaaggcaccugaaagcaucaaucuucauuuucagcauuuaaaucccacagccuguuuuaaucuuucagugugaaucuaucugguggguaaagaaaagagagaggagaaaggaaaggaaagaagugcccaucuacagcugaaagacacuaaucauuggaguaaauauuuggaugccugggucaccugugugaggagugggcuugauauuuuuggucauuuauguuaauuauacaaccaaaaucuuaaucucuuuuccagucagggucaguaagauacaaauuagcacaaacccccuucccucgcagccugacaaacggaauacagaacgguacaaaagcaaggauuaugggucucuuaagugauccacagcuaaacccaccagccaacagagccaagaaccacaccuagucucucucuuccaagaucaugcagaagcccgauggaacauaagccuaugaaaacgcacaacccccucagugcgcaugugaagcuacaaucuccauuuagaauucugcaaaccuaaucaacagggaugaucucagaucagugguuacccacccucuuauuccagccagacugucucaucuguuuccuaacuuccuaaaagcaucacaacugaagagggcaaccaaacaacaacaaauauuuuucucaagugacaucugaaacugcugcaagggagcagcucgcccacccacgccaaagaggcuccuaggaaagccagcaggaacuggcuuugggugcugcuccagaacucauaggugccaggcuagaacagacaaacagcuuuuuuuuucuucuuuucuuuuuuuccucgagauggagucuugcucugucgcccaggcuggagugcaaugacgcgaucucggcugacugcaaccuccaccuccugccucagccuccugaguagcugggauuacaggcacgccaccaugcccggcuaauuuuuugcauuuuuaguagagaugagggcuucaccauguuggccaggcuggucucgaacuccugaccucgugauccgcccgccucggccucccaaaagugcugggauuacaggcgugagccaccgcgcccggccacagcucuuuuuuuuuuuaacaguucuuuaaugaggcuguuucuuuauuucugaagauaaaaaacuucaaaacaugaaaaccuaucuacucauacauuuuacuuuguaguacagauucaccucuauuguugauuuaaaacaaaacacccaccaaaguggucacugagaucucauagucuagaacuagcugccacuacagccaccagcacaugagcuccucugaacccacauuuuucagaaaaguuaccugagaugcuguuagaaacggagaccuaguugaaaaugaaaccaaccaaccgaggcaaaagaggacaaaauuugauuuuuauaccacagaaacagguauagaauuuauauaaaagcaucuacccccaccacauuugcaaaaaaaaaaaaaaaaagaaaagaaaaaaauuugcuuggaagacucauuucuguuuucagauuggaucccaagguuucaauaagacauucugcuaguuucucaagaaccuggcccauuuaucacuuuuucaaacuacaucaucuucucauucaaguaucucagugacucuuguaaaaaauaugucacacgucucuacugucaagguuuaucucuagcacaauauguaacccacagaucgcaaacaagauguagccucucagagggggccgcaguuaucccagagccugcugauggugcugguagugucaaugucaggaagaggaugagaugaacucacaacccgcccaaucugggauuucugaaggcacaguauggcgaaguuugguuaauucaagcccaacaaugcugaucucacaaaauuuaguaaagaucugggcugaaacaaaaugugaaaauugucuacuagacuuuaaagaaugauuauguauaugaaugcauaaauaagguugcugaaguagagguuagccauuuuaagaggggaaccacagcaguuucaaagccuccugauggcagaagugggugggcuggugcucaggaugugucuguacaaugacucacguggaccugggcucuaacucuggcugugcagucucaccaggccacuccuuggccucccuuacaacauucagguucaugaaaagggagggacgaagcucuccuugcuggucuuucaggguugcuaagaaaccaaaugagauguugucuguggcaucacuuucuuaaacugcagaaguacauaaaaucugagcugcuacuauuuuuuucauauacuaaugcuaaucauagauuauuuauguauuaaaauuggcugguggacuuucuauugggaaguccaauaagcuucuuuccuuauuucugaagauaaaaaacuuuuuguuuuguuuuuugaagaugcaggugcuacuaccuugacuuaaauuguaauugcuugagaaguagcuaugagauggcaaaaacgccuaguugaaauacugaugaaaacugacuaccccauguuuccuuaggcugcacaacucauuagcuguacaagcagggaaaauauuuagguguuaagaucccggaagaucacagaaggcuauucuaaugucaaaugaccacagacacagggcaagcuaaaaccagaaggaugguuuggaagcaaaugccaacacaucuacaauggaauucagggacugagcgcaaacauuucugucuuagcaaagugguaaauaggcauuuaagccaaauuugauccaaguucacagagauuauauauaugaaaacucaucagggaaacucaacaguauaaaaguggggauugcacaagaaaccagguaagggaucuaugggcacuccaaacuaucuuagcaacuucauuauaaauaugggauuauugucaaaugaaguuccuuuuuaaugaccuucuaaucaagguggggaggcuugccuuugaggaaggaaagagaaaugucuuuagcagcagucugcauaggucaaugugucaggacucucagacacaucaucucacaucauccucacaacucucucuugacacagguucaaaagacagcuuagaaucugugacuauuucacagcuaaagaaacucaugaaagagugacuuucuugaggucccacaacuuuucagagugaugacaggauucaguuuuuggucugccuaaagaguacagaaucuggccaagcaggcugggcaggguggcucaucaccuauaauccuagcauuuggggaggaaagcaggaaaacugcuugaggccaagaguuccaagaccagccugggcaaaauagcaagaccucgacuccacagaaaaauuaagaaaucagcugggcaugguggcccccaccugugguccuagcuacucaggaagcuaaggcaggaggaucacuugagcucaggaggucaaggcugcaauaagcugugaucauaccacugcacucccuccagccugggcaauagagugagacuucaccucaacaaaaaaaaaaaaagaaaacuguccaagagccuaagugggcaaggugggcugcccuccagggaagaccaaaaugggaaacaaaggccuaucaaagacuaacccacugaaggcccaccccaagcugugccagucagucacucaaaggccaucagggagccuuccuuccuuaacccaggaagugacauggucugcucuucaaaaggagcuaagagaugcauccaaaaauggauguccugguuccucaugggaaaucucaacauugguaaucccuucuuauaucaaguccaccuggaaauucccucacaaccuaagcugcugaagacuugcuauaaagcugguacugagucaaugccagggccauggcuuaauggaguaggaaacugacgagcacugaacacaugaaaaaauaugaaauuacagggccagucauaaacuggcuucucuucagcagagccuccggaaggcuccugggucagagucccucucugccugacguccucugugugccaccagagggcacuaacucauggaacugcucuuuaaaaucaggucacacacaaacugcaggaauguugaaugaaaacuagccuucaaaucaaugaagugcuaacuauguaauuuugacaguggcuuuaagcauuugcuggucaaaauuuucaauuuaauucuacaaaacuuaaagguacacacaugcagcagcagaaaauacuaaaaacaguaagcugaucaaaccuucagauuuaugaaaauaacauauaaaacaaauaaaauaaaacuaagagugaugcaugugcuccugcaucucuggucacagggguugucguauggauaacccaucccagcaucuucuacacacacacaauauaagagcgccaagaaaaacaugcugauuucuccuuugcuuuaaaaagccacucuucauugaauuacaaguggacauuaaccauaauaaaacuacaguaccauuuauuaagcaugauuaaaacaugauuuaaucuucugugcuagaauccucguaagacaagcagcagacacugacgagugcgcacugcggccuagcuugcuguucuaagcacaucccacuuacuuuacuccccacaucccucugagcagcgauacaauuccauuucaguaaaaaguuaguucgaccuugcauuucuugaaugcaaucaagaauuuuucuuuacaucuguauccucugcuuaugauuuauuugccaugaaacuauaaauacagauuugugaguucugccucauuaacugcuuucuacauuuauuucuucaccucagaaaauucauacuuguuauacuuucauaagaguguaagauuauauaaucaaaauaauucagcaaucaguugaauaaaaaaugcaucaugaccaaagguuuuuucguuuuauuuugcuuugugguauguaaaaaauuuagccuuugcuuuuauuuaaaaggaacugaaacagcuuuaaugguuugaucagaaauauugguuacuucucuaugcaaaauaaaacucaaguucaauuggacauugguuuuccugauuuuaguugauuucccucaguguguaauaaauaacugaaguuuacacugaaaugaacaaaaucugacaaauaagcuauaccuaaaaagaaguuucaguucuuuaaacaauucguuacaaguuagugcuacaaauaaacucaccuugagguaacagccuacaucacaggauacugucuccuugguuuuguuucuguucuuugcuuaaaaaaaaaaaagaaagaaaaaaagaaaaacuuccucaaagguuuuuaagaacaauauugguauucuggccuaugccaacacacaacgaauaaagacgggguaaccauggcaucuguggagguaucuggaacaaaaguacuucuguuaguauuaucuaaguaaucgccuccaaguuuccucuauaucuuuguuaaugccuacuugaucuagaaaauauuuugauuuaucuuguuuacucgaugccaaaauuuaccuuaaauaacugagaaccacuaaguauuugccuguuuccugccucccuuuuauuucuccauguuucuuucuagacucucacuagaugucgauauuacaguauuccagagacaugacucauguuucuaugcaucucugucuucuacuucuucaggaggcaccgauaccaucacauauaguaagucuguaauucauaauuccaaaguccugauaugcuccagcuucucacagcacccugaacuaggcuuccaguuacuucaaucacaacaaaagcuuuaugcuucuuuccaaacuuucacugcuuuaucauuggaaaagguauuuauaaauggcaaguuaaaggaaaaacauucagaaaggaugcgacgcaagugacccacacauucguucaacagcguuuauuuagacucugcacugugucagcacuguccuaugcacugaagauacaaggggacaagacaaaggcccugcucucauggagcuuccauucugaugagacaggugguaacugacuggaaaacauaccaccgcuggggcaggugcuaggaagaaaaaggcagcuugcugaggggacagaguggcaucauggauggucacggaggccucuggaccaggaggcgugugcacagagcccugcucuccagagcucagucaggcugcggagcuccuucguaauaacuccggaugaggcaagaguaggucacuuuauucuauuucauuuuuaguaacauucgguucaaauuaauuugggguuuugagaacaguuaauucacuaauagaacugucuuaaagccagacauggggcuggcaggaugggaaagcucucccuacgaauucugccagcuuucauuccaaugugucagcccucauggcuccagcucuguggaucccucuucuuugcugcgcccaugaacaaguguguggugagagccugaaauaaauagguguaaaaugggucaaaaccgucgcuucuauuucuguuuuuaacugaagaaaaauuugccccauuuccagaggcagagagaggaggagacaucuggguaaaggcaaacuaaaguauauauuaaacacacacauacguauacagaugaacagguauguaucuacccccacccacauacuauacacauguacauacaaccauauaugucugacuucuucgccuaugauaauccaaaacugggucucauacaauggucuuuuugcaaucguuacagcaugacuuuuauuggguuguagguuuuaucuuuaagaggccacaaaacuuuuuuaaaagaucaaauaaaaaauuaaagguucaaagaagaucaaggcucagauucaauuaacacuaauuuuggaagaauuuuuuuacuuacuaugcauauucagcaaacuacuuaaguuuuggguuuucuucuaacauagcaacccaggggagucauuauguacaaucaacucccuaauucagauuaacauaucuaaguacauauugauacaacagaacacaaugcuugcagaggcucccugcuagagacucucugcuuaagcacaggacuaagaagguggacuucuuaaauuccauuuccagcacuucccauuguuacuuccugggccaguuucauagauuagaagaauauaauacuucaaagggauacucugguuuccaugaacaaaacgacuagcaucucccaauuaauguaacauccuaacaagugaaagaugacuucuaaaaugaccaaaaugaccaaaaaugcacagugaagcugaaggcaagccccagaucuguucuuucauuucucucccucacuauuuugggggaagggucaaaaagggaguggcuguagauaaaacacuccacacugugcucaugaguuuucaugggaugagcuggaagcaugugguaggguguggaggguucugucucauuugcuucccaaauuugggacugauuuccaaacaaaccucaaaucaacugaauaucagcacagcuguuuaauuccaguggacaaaaugugaguaaaacaucgccuucaggccugugcccaaugcgcagaggccagugacuuucacaagucacaaguaccuagaacagguacugaaaagagcaugcugcgagaagagcugugggcuucuuacaaggaaagcacgagugacauuuauggccuauuucccuaguaguuauucaacuaaauaauuaguuacuuaagauaucagcacaacaaauugaagauuucaaggcaaucaaaugucaauuacauuuuuuuuaacauaaaauacgaguuccucuggaaucagacagcagcuucugacuuguuuuccauugcucuuugcacauuugcuuucugcuaccaaaauuuuaagaccuguauaaacaaaaacaguauuuauucuucucuuccuccaaaacacuuauuaaguuuacauuuugggcuugaagguauguuaccccacugucacuucccccauccauccacccauaaccacgugcagauggugggcucaaggaaaacaaaaauaagggaggaccagcacccuugcccaaggagcucccacuugaguggaguaaagacaccaacagagauaaaucacaauaugcuauggcaagggcccgcacaggacaugggaagcagugcccaggguaagagugaaccaaaggacaggcuguacugaacacaguucccaagaaaaggugcaugggaggaguggcaugcgggcugcccuccaggggaaggacucgugcagagaagggaacagcaaguaggaacggacagaaagaguguccacacaucaggggaggaggaggggaggcagcaggugagaugcagcuggguggggcauguugcacuucaucaggaagggguggguuugguauuucucugcuuucaccugcaucuacauucagagguaggaguuucaaguuaaugaauacuuuauuaguagagacaaguccaaaugaccagaaaaagaacccaccagagcaauggcaugcauguggacucugcagccugaagacgagggaugggggcaaaggcuugccuacugcagaccaaauaccugcccugguuaaggcuacgcuggcuaugcugguuaaaguuuaaguuucagcagcaaauuucugaaggaaugaaugaacugcaaguuuaaauguuauacuuuggaugguuugagcauucuaaugacucagguauaaauagaaaauaauuuuuuaaaugucagaacucucauuuucuuaauccccuacacacacacacugaccuucacuuucaaagaaacuagaauugugugugugccaaauuaauuauacuaacaaugccuuuaaaaagcuaauauuuuuaaaaaagcaaauacuuccauaacauguguuguaauuuacaagagguaucauaaaauagcucuucuuuugcugggauuuauuccaguccauucaucauaaagauuucugugugaggggugacucuguaagcaaaacaccauuuagcaggaagaaaaaccucaaaacaaauuacaagaaagccauuaauguucuuuuaauuucuugcuuaauuuccacuucuugguauccauacacuuccucaucagauggaaacauuuuaauuagaauaaagagaguuuaagaaaauguauguaaugaguaagcuuucauuauuacuaaaaggcauuaacugagcuuucugucaugugaauacaauggugcgggaaggagaauacuuuguguaaaagauaggaaagcaacacaguuaaugauaaaccagagucucuacaugcuccuaggagauuuccaaaggugggauacugacaugcucuagacugcuuagacugcgcauucccaggauuuuagcacuacaaaaugaacaaguaauuauuccuucaacacauaaggcauccaagaacacaggguucacaaauacuuccucaaaaugggcucgcuuccuaacagugggguuuguaggauuuuugaggguaauuuuugagaagaauucuuugguuaauuaugauacugcaggcaacaaacuaaagggaaacugaaguaagcuuaaaccugauaaagguacagaauuggggcauccauuaaccuccuccuuggaggcuuucaugagaggcucacaugauuaagaugaaaaguaacauguaugcugcugagacgcuccuguuuacucuuucaaaauauuuuacuuuuuccuggccuacgaggcuaaaaaauaccugauauuaucaauuuuuauucaucuuuaaaaacacauuguguggaucaaagccaaacaaaauugugugugugugugugugugugugugugugugugugugugugugucucuagagaauaagcuaaauucucugcaugguaaaaggcugcuagguucagccaucgaagcacaugaccucuaccaacugccaugguguccccuccuuccucuucagccuugcuccccucagaaggagugagaaaugguuuuagaucuacacggccaauccuucaugaaccacgaccuccuuguuccuuuaaacacuuccccugugauaauccuggacuacacuccaugaccaucccaugagcuguccaguaaggcagccacugagcaccugaaaugugucuacuucaaauuagaagguaauggaaauauaagauauauaccaauuucaaagacuucauaccaaaauaaguaacuucucaauuuuuauacuuacuacauggucauguaauguagacuuacuggguaaaauaaaauauauuacaauauauuauuaaaauuaguuuccuuuauuuuuaccuauuaaaaauaugguuacuagaacauuaaaaauuacacgugacucacugacacugcuacuguacagcagagccccugaccuugauguaaccaaaacugaccccuccaugauaccgauuucaagcccucuaucuacucuucgacuaucccaacuccaacaacuccucgauccuauuccuugaauccacugaccccaugaccucuuacugacccucagcuccuucaugccuccuggcuccuugccuggcuuagaccacauggucuauccucaauccucacaucgauucuucugcgcaaugcucaacucccuuaugccuccucccuccacuguacucaccuggcaaaauccuaaucccagguuaaauccaacucccugcccucuccugcccucuccugcccuacacuuaggcugccgaaagcagaauuccuucagagcaccagcucagcucccuauccagucguuuuugcuugaaccaccuggaacugggcuuuuauucucaccauuucacucauacagcucuuaucaaagucaccaacgaucgccccgcuaccaagcccacagugaaacccgucuguuucuugcuccagcuuuagcagcaucugacauagauaucacucugcuuugaaacaugagcuuccuuguccgggcgcgguggcucacaccuguaaucccagcauuuugggaggccaaggcauguggaucacuugaagucaggggaucgagaccagccuggccaacccagcaaaaccccaucucuacuaaaaauaaaaaaauuggccaggcaugguggcacacaccuguaaucccagcuugggaggcugaggcaagagaaucacuugaacccgggaaguggaaauggcagugagcugagaccagagggacauucugucucaaaaaagcaaagcaaagcaaagagaaacaugcacuuccaggacacccccaucuccugucuuccuucucugauugcuucucauucuccuuugccucccuucuacccgcuuccccuuaacauugggugucccagggcuccaugucuggacuucucuauuguauacacucccuaaaaaauuucauccaguccuacggcuuuuagaacccccuauaugcugaaaacacucaaaaucuagcuccagccucagccucuccuugaaguuacaaacucaaacauacgacugccuauugaacaucuccaccugaucuuacagucaacaggugcaaaacacaaccuacauucucuucaccccuccuccccaaccugcuguucucagucuuccugaucucaguaaagaagaauagcauucuuccaguuacucagugcaaaaacacagucaucaucccugacucuuccuauauuaauacagucuaccagcucuuccuuucaaacauaacccauauaugaccauuucuuccugcucuguccaaggcaccaucaguucuugcaacagucuccucacuggucucccuacuucuaucccaaaccagggaucaacaacucuuuucuguaaagggccaaacaguauagaucuuucagccucuacaggccauaugcucccuguuacaacuacuuagcuuggcuguugcagcucaaaagcggccucagauaauacacacaagaguguggcucuguuucaauagaacuggaacuggacacugaaauuugaauuucauauaauuuucaugugaaauaaaauacugauuuuuuuucaaccacuuaaaaacauacaaagcauucuuagcuugcuagcuauauagaaacaggcagugggccagaaccugccaugggcuguggucugcuggcccugcccuggaagauucucugcacuacauucagagugauuauuuuauuuuauuuuacuuuuauuuuuuugagacagagucucacacugucucccaggcuggagugcaguggugcgaucuccacucacugcaaccucugccucccagauucaagcaauucuccugccucagccucccguauagcugagauuacaggcaaccgccaccaugcccaguuaauuuuucguauuuuuaguagugacaggguuucauuauguuggccaggcuggucuugaacuccugaccucaagauccgcccacacuggccucccgaagugcugggguuacagacgugagccaucaugcccagcccagaaugauccuuucugucaugucuuuuuccugcucaaaaauccucagguggcuuuccuucucuuucggcaaaaccaaaagaccgugccaagcccugcggggcugcacaggacacuacuuccuggcuccuccccucccgugccccuucccacgcucugcacagcaacacaggccuccuugucauucuccuggcuucucucucgccauugccaaaucuaucucugucuaucucagcgccuuugcuuuugcaguucccucugcuuggaauacucacucuagacaccuacguggucacgguguugcuuccuucaaguggucacaguguugcuuccuucaauucaccucaugagagauacccgcucagucacacuagaauagcaugcacaaacagacaugcaagaacccucucacuguguaccuugcugcacuguucaccacacuaucacugacauuucuuuccuucuuuagaaauaaacagauugggcaguuuuuuaaaagagaaacaaaauaccacagugauuaagggcaugaaaucuggaguccaaugaccuggacaggaaugcaacagcaccacuuacuagcuaugugacacugagcaaguuaauucaacuucucuguaucucgguuuccuugucuaugaaauggggauaaugacagcagcuacuuccucaguauucugaagagugaguuaauaaauguaauuggcauauauaagcacgcaauuacuguuauuuauuuuuguuuuuguuuauuguuuauuauuauuccucucccccaaccagaaaauaagcucuucgaggggaauaacaugguuuuguuuauugcuucauucuagauacaccuaggacagugccuaguacucgguauucaauaaguauuuauugaacaaacaaauauuugaauuuaagucacucuggggugggcagaacacuccacuccccucccaugaucauacagauaucagacagaacaaaagcuuccuuaaaaucuguuagaggccggacauaauggcucaggccuguaaucccagcacucugggaggccaaggcgggcggaucacuugagcuccagaguuugagaccagccuggacaauacagugaaacccugucucuacaaaaacacaaaaaguuagcugggcaugguggcaugccccuguggucccaguuacucaggaggcugaggugggaggacugcuugagcccuggagguggagguugccaugagcuaagaccauguuauugcacuccagccuaggcaacagagugaaacccugucucaaaaaaaaaaaaaaaaaaaaaaaacacuuuuagaggcugggccugguggcucaugccuguaaccccacacguugggagguugagacaggaggaucauuugaggccaacagcucgagaccaaccuggacacauagugaaacccugucuauacaagaaaaacaaaaaaguuagcugggcguggugguaugcaccucuggucccagcuacuccagaggcaagccuaggcauuugaggucacagugaugaucaucgugccacugaacuccaggcuggacaacagaauaaaacccugucucuauuaaauuaaagauaaauauaaaaaauaaauaaaauuuaaaaaaaaacccuacuagagaaagagaaauaaaaagccuaccauuccagguggguuugcugaugcuucucuauuuccuacccugaagcgaggcauaaugccguucugaguaacaagugguuucacuuuauaagaaaccucccacagggccaggcaugguggcuuauaccuguaaucccaucacuuugggaggccaaggcaggaggaacacuugagcccaggaguucgagaucagccugggcaacagagacuccgucucuacaaagccaaaaaaaaaaaaaaaaaauuaggcgcagcagcaaagguagucccagcuacucgggagguugaggcaggaggccugcuugggccuaggaguucaagguugcagcaagccaugauuaugccacugcacuccagugggcggguucuucaucugggugacagagcaagaaccuugucucaaaaaaaaaaaaaaaaagaaaaaaggaaaagaagccuuuauaaucuaaaccuguguuguauacucaaagguuacauguucaggucuugaaccaaauuagagaagaaauagauuucauaguccgguucaaauuccacauguaaaaugccaaccuaauaccuagcagcacaaaucugaucuuacuguauuuucuaaacacaaccacaaauggcuguuuacucagagcagcuaagauuuaauugacuucugaaaccaaaggacauaucaucaaauaccugaagucuuccccaagccagaaaguaauggacacauuucugucuaccagccaagacacaggcuucgcucacagcacaucacagggucuuguggguuugguaugucuccuuacacuuacacacacacauuucuccuaggaugacugaguuuuauagaugguauuaagauaaaauacuuccaggcucuacauuugaugacauauucuuuaaugugaagauccuuauauuuaucccgguauaacauggacucuuuuucaagcggaaacucuacuuccuuuaaaagaagugcagggaugguaagguaauucacuguucagcaaaguagaaauuacucuccuagccucuaaacuaaaacucuucgcugugauaaaagaaaugaacaucuucaguacugguucuaccaaguagaaaaugaauuagugagauguaggugguaaaaacauacuuguaucaacuaguauguaaucccguugcacagcugccuaucugcacugaaugccugaaaaugacaugugugacaaagugaaggguuuugaggagggguaagaaacuggggguuauggaaugggugaagcccaagcggucauggugaacugccauggacuuuaccaucugcccacgucccuuacugauccagcuuccugcugauggcaacggaacuagaacaaaucgcuggggauccuugggggagcgguuccuggaaaagugcuaagauaugagagaagucgucuucugucacucuuuguggguguuuuuguuuuuuguuuucaaauucugcacucaauugaccauuaaggucacugugacauggcugagaggaucugcaugaggcaggcagguacaagucacuucucaauucuguacugcuauaccguggcaaugccugaaaaaucagaaugauagcccucuaauuuaauacuguauuuagcugauaauccuaaauaacaccuugucagcuuuugugaucuagcacaaaaccacacgucuugugaucuacgagcugggcugugguaaugcccuugacuugaggcuuaaaagcuuugguugggacauaacuuugauguauugucuuucauuucaaacugcaaugauuauccuugaaucuggcaucacauagagugcuaccaaaauuagauuaugguuaguuuauaagacaaccuauucccuuugguguaccaccaugaauguugcuacucucagcuuugcauguuugcaagaucgaaaagccacggcuguuugguuuacaggaugcagggauaagaaccaucugccuggucugguguuucuuuaauuaaaacuuuaauuacagauauaucucugcacagauacgugcagucuaucagcuccuguuccuaauuaccugugcuaaugagaaaugaaaagacaguuaauguuugcugaguaucuacuaugugcaaggaccuauguauggucagaugcuccaaggugaacuagagcagguaaaguagaucccaggucaaaccuugguaguuuccccuaccaguccuuuucccaccauuacaaaagagugacaaaagucauucugguuucuccuuuggaaauacgaaaggcuuagagguauaaaguacucaaaaggauccacacagaagagagaaaaggggcuggauauccaaaccugaauaauugaaguucuguggccagcguaugugacagucugucauauggaguauuugcgaccccaccugaagaugugugcggaaaguggaaaaucucgucuaauucuaggauucugaggagcaucacacagcgugaugguaaccacggccaguuucccagggaaacaaucaccacaaaugagaacaaaugggagacguuuucuguuauuuccugaucgugcagcaauagcguugccgacuuuuccuucauuaacucccuuucuaccuagggcagaucuucauugaggaaugacaaaaaauccuuccacaccuucaccauguguuucuuaguguccucaaaagccucaagcaggguuaaacaccaucaggauggacaccuaaagcagcccacuugguggugccaaggccaaaaggacagggucuagggcacaaccaaagcuucccgacuuucacagugaggaagucugccgcuugcccucaaaacugcccuaaccuucuaucauuuguuuccaugggagggggagcgcagaaggaugauuacuuugacuguuucuccaacaugucuagaggcaggcaguuaaucgcagcagcuaugcggucacauugccucugcucuccgccaucccaacucucacucagcuaaggacacagaggaggaggaggcaaguccuggccuggaggcgggcaccgaagaagcaccuuucucucucaggaguggguuccucaccaccaaaaaugaaggguccaacccagaugaucucagaccuuccagcucuaaaaacuaugcagcagauaugcuaaaagccugacauaagugcucccuugaaugguccaaauccaucuuauugcccaacauucuguacuauucagugauugaagccugccauuucucgaucuaucuaaaucuaugaggcuaaauuaccuaagaucuucaagauaaaccaccuaaguuaggacagacaaucacaaacaaaaucugacaauuuucaagcuaaugacgggcaguaccuacuucuuugaaagacagauacuaagacaaauuaagaaauguucauuuggccaggcgcagcagcucaccacgguaaucccagcacucuaggaggccgaggcggguggaucaccugaggucaggaguucgagaccagccuagccaacauagugaaauccugucuguacuaaaaauacaaaaauuaguugggcacgguggcacacgccuguaaucccagcuacuuuggaggcugaggcaggagaaucgguagaacccagaaggcggagguuugcagugaguuaagaucacaccauugcacuccagccugggcgacaagagcaaaacuccgucucaaaaaaaaaaaaauuaauuaauuaaaaaauaaagaaacauucauuugcacgucaacucugugguaggcaccugaaggauuucagggaccucacagucugaugacagauacauuguaaacauacgccagaugguggaagaaagagaaaacaaggaaagagggaacuacgaaggagaagaaaagaagggaacgauaaacccauaaaagagaggaagagaaaaaaaaaugaaagaacaagcaagcaagcagggcccucuacuucauuucacucuaacuaaauucaaaccuggcuucuguggugaucaagugcucacucauggaagaugguauucuacaggguggaugccaggaacuuuuccuacagaaacaguacuaacaauuguuggcugaacaacuaaacuggcccauaaaacucauuuuaccuuacaauggagucaacuacagaauuaacagcauuggcccacacuccagaagcacagauccauaugugcacaauguaaggaccuauuuguuuucuuguuuacaaaauaaacuuccuguauuucugaaccuauccaucucucuagaacaagagucuugggauggggcaaguguuucuuaaaaagugaauuauuuuaaaagcuguacagaggaaucuggaugugcagccaggauuaaggaagccauugguaauaagagucccuaaaagugacacauguaugacagagcccuccauggggggcaggaagaggggcgguuguugaagccagcuaggggccuucagaaguuaggggcgcuguugcauuaaaaggucugggccaggcacaguggcucacaccaauaaucccagcacaucgggaggccaaaguggacaaaucacgaggucaggaaaguucgagaccagccuggccaacauggugaaaccucguuucuacuaaaaauacaaaaaaauuagcuagguguggucgcgggcgccuguaaucccagcuacucaggcaggagaaucgcuugaacccaggaggcagagguugcagugagcugagaucgcgccacugcacucagccugggugacagugcgagacuccaucucaaaaaacaaaaacaaaaaaaggucugauggcugaaggaugauaaugcguacagcugaggucccuacaacuaaaagggcaaaaccguuuccuaggaguggcucagccagguuugcagcucaaugcaaggcagcagugcugugauaugaauggcacuuggauuuaagugccugucuggcaguuuacugagggugugagccugggugaauuuauuuaaccuaucugggcaucagcauucucaugugcaaaauggggugaacauaccacccaccuuguagguaaauguggaugauuaaaauguauggaaagcccugggaugaauauguaacaggcauucuuacacacucaggaaaggcagugaugucccuuccaccucacucaagaggacaacgaagccucccgcagcugggugaaaaccuugaaacaguucaacacuucugacuccuucaaagcucccuagacaccuuaccaagcguaaaagggaacgagaaaggcuaagcagguaaaaggugggucugucccucagguuuccuuccuugucccuccauagccaaaaacaguuaaaagaaccuaucaacaaaggguuauggagcucuuugugaucuaaacuuuucuuccuaagagauuaaaaacccagauuuaacuuuaugcaccugaacuugcaucuguuuuagaggagcuuaauuaccauaaacuauucgguuccucucucuaaacauauaagggucucuaagucaguguuagaagacuacuggggaaugguuucgaaccugauuuucuguaaggugugagucccccugcugggguuuucugggugugaggaucagccacacuacauggcaggcacugcucuaaggacuuuguggacaugugcucagcuaaaacucaccaggauccuuuaguggguacuauuaucauccccaauuuaaagagggggaaacucaggcacagagagguugggugauuugcuguggucagaccacuugcaagaggucgaggugggauucgaaccaaggcagccuggcuccagagcccaugguccuggccuuucaccacgggguucacuaccacugccucucagcacaccgguuaugccugccaacggcacagccauaggaugagguucaguuucaacagcaccuuucuucugaguucccagugugucugucauacaguuucauuuauccucccaacaacccuaaaaagcaagugggagacacacaguaucuacauuucacagaggauaaaacagaaguagcaucgaugaaaugucuuacaacuccuauauuuuaagucaaacagcuaauuucacuguuuuuacaccaaaaugaaagucuucugaagucuuucuguuggaguauuucaguuuugugugacuaccucaacagauaccaguaacauauccagagacuuugcuaguccaaagcagguuaccugacucucaaaugaagguuuuucucaaugaaucacauuuacaaaaacauccauuggcuuacagucuacuaaauguccuaaaugcuaaccaaauaaacaaggcucauuggaaauaagccauaaauguguccauguacuagcucucuuagaaaaaugagguuaucuuaaaauguauuaagcagaaaacuuuaaagaaaaucuaacugaucuaaucguaaaauaagagaauuaaaaacuuuucucgucuuaaccuauuaauuucucuucagcugcuacuggacuuacaaauaaaguacugucuaccucaaaggcagaugggagccccaggggagccgauuccaacagcagggagcugugacucuccuggggaccaucaaccagcucaucccucaggggucagccgguuuggggcugcuugagcaagaggaauggaggcaacaagcagucauggccccccacauggcuuccauguaccauccacugagccagaugccauuccuuuagugcuagaaggacauggcaucaaaggaacaaauaaaggacauacuuaaggcaaaaaagucuuuggggaucugguaaacaugccagcacaacugugaaaagcauuauuuaaaaaaaaaaaaaaucaccuuaaaauuccagguuuagcaaaaaaguugcuccugacuacugggacauuauaaaucacaggggcuuuauaaucauaggaugguuuaccuauuuguauuucucagcucugauauuuugcaauucugugaaaagaaaacauacccaacaggccaaaggcagcuuuucaggcauccaaguauacuaggcaagaacaagcucgugagccugaacaaaacuguucgugagaguuccaaucgccagugaacagcuaaccacgacuaauuuuaauuugugguucuaaugaaugacauaaacuuuuauagguaucaacaaagcucaaagaggacuuaaauccauuucaguacucauuuagcagcuucagcugugugcaauuaaaacaucagcauuaaauguuagagaauaaaauaaugagacacuuaaaaaguaaucugugcuucagugggccaugcugagagaauucacauguuuuuuuuaaggacaugauuucuaaggaguaucuugccaguucaaagaacugacucaaguuugguuucugucuuucgguuuugguuuguuuugcuuuagauuaagaauuuucugaaaagagaaauacaauaaaaaugcauuguuugaaaaacagucaugaaauugcauauggcagaaaucaaucugguauugagacuaccagggcuggcugaccagguuuuggcagagacaaaaguacauuuuuuggucauguuaaauugcuuguucuuaacuuaugccuaaaauuaaagaaauaaaauauuaaaagaguggggaaaggugaauuuggguaaugaggcaacuuuguauuuuucuaguccuuaaaugaaauuaaaauuaaaagucuaagcuuuuucuccccaaaauacuucagaauacaaaauauaaucugaagauguauaauguggcagcuaagacuaauaaauucaaguugcuacuauuucugaaagaaagauaaguuacucugcagaggaaaggguauguggugguggugguggugguggugguggugauggugaggguguaugugugauaaggugaggggcaaugguuugggugguuugggaguagagaagagguauggguguccuggguguguguaaguuauacguaaauaucaaguuaauucagcuucugcaaaacaugaauaaaaaaggaaauauacuguauggggaaaugcacucauuaaacuuaaauuuuaaaaggaugaaaacacagauuacacuuuauuuuaaaacugaaaugaauuuuaauacagaaaaugaagacagcauuuugcaaauuuaucacucaaagggguaucucuauuugaggaaaucagcguguuacacuuugaaagaugaaauguuacagcuuguacaccaaaauuaaaaaaugaaauuaaauuaaaaaaugaaaugguuaccaagguaaugcaggucaggggaucaaaggugaagggucacacauuauuaaaaagaaauccaaaaggacggcugcaucaugaucucugcaaaacaaaggagcuccaguaaguaaaacuaguaucucugagaauuuaaaaucaagcucuugaaaagauuccacuguaacugaaccccaucauuccugaugucguguagagccauuuuuauuuacauacaaaaccacacuuucauuaccuguuaccaacaauuuuuuuuuaauuuaaccauucaaucauuaaaaccuaaaauaucuucaacugaaagugaccaaaagugcugauauuucaauuugaccccauaaccuguuuucuggaaaugacaguguuugauaaguugccaacauaucagaaaucuaauguggucacagcauggugaguuuuuccucuccucaaggaaugaguuccaaaauugaguuuuugcaaauuuguuucauuugaaguagcugcauaaaauuuccauuauuggaacauuuaguauaacaauguucuagaagacagcaauaaagugauacaugauaaaauaaaccguguaacuauaucuauuaagauguggucucacauucaacuuucacugcacaggggaaaaaaaagacauuuuaagcaaaauaacuugcuaguucuacuggaauuacacagaauuaauaggggcuugacacgaggaauaucuacaaggguuuuuuguuuuguuuuuccuguaucugacaggcuucauuucaucaauaaguguuauuauuuacucacuuuucccauuaacaaacuaaagcaguuuauguuuuuuaaaaggauagaccuaugguuuuguuuugaaacaugaagcuaccacccaaaucaugacaaacuuugcaguaaugguaagcacuauaauuaaugguuauacuaaauaauuucaguauucauuucacuaguauauaaaaugaacaguaucauaacacaaucaucuuuagugucuccugucuaaaaauuaagcuuuagcaggcuauaugcucccugguuuagggauccaaauuccuuagugcuuacuagacagcagauucuacaaagcaguguaaaugauggccugccauacagaagaguaaauggcaggagcauaaccaggaaaaagaacuuaguuaccauucuuuuuacaagaguucccacuugccauuucuucuuacauucuccuacuucagcuguagcccacaauaaauuuaacauuugaguuaaccuuguuaaaacuaaauuccaaaaacacuuagauauuaaaauauagacaacuuccaaaaggauuuuauuaaaagaaacagaauauucuuucuagaggcuuacggcaaucaauaaauaaacaaacucuauaaaugccagauguuuguuccugugauuagguuuuguuaaaauaacuugcagagcucaugcacucgguccgaguguuagugcccuaaagccauguuucaaaaaacacaauguuuuuuuuuuaaguugcauagcuacugaaaaguaaacuugcauuucauuucucuggaaugcucaucucacauaaagucugucacauauguguuuguugcucggaggcaugcaaguaauuuugaacacugcagaaggaaucaacaccccaugaaaacaaugcauacguuguuuuaguagcaucauuauuuagaccauuucagcauguuuguaacaaaaaacaagaagcgaguaguguaacacgagucaaguucuguuucccaaaaauauuuugcauuaaaaaggggaaaaaguaaaccgguucaaaucaauuaucucuauguaccuccuucauuacuaaaacauguauguauuaaauaacaaucucuucuugacaucaagaugaugcaguauucacagaugcuuuuuuaaagucuucuaaaucaucuugaaaauucaccaacucacacacuaaaaaauguuagcccaaaucuucuaucagcuuaaucucugccaaaaguuucagacaccagacuaccugaacgugacguccaggcaggaauugcucugagugccugaauauuacaaccaaccaaauucccacgugggaaugaaaucaaucgccucaccuaaauacuuagugguucugacaaaauggcuccaaaugaaauggugccaauaacaacauuuuaggugauuucaaaaaaaucugcaaaggauuuuagcuaauguuuucuacaugaguuugcuauuuagggaggggaagguaaaggcuacuaggaguuuacuaugucccucacagucaaggaaccuggaauauaauuuaauaaguaaaaagaaggcuagaagccauccaaggggcaaugcaacccuagggaguaacuaauuccacuuaaauuaugacaacaaagagcugauucugaguccggucuguuugcugaggcaaguauauaagccacacacauuuucccacagaaauaaugcuguaaagaggaauuagacuugacaacugucgauuuaaccugaacuauuugagguuauugggccugaguagcuucucuccccaucaagggcuggccuaagucuuaacuuuggauacaaagcccucucuucagaaccuccugucuuccugccccacucccaggcgccagcagcagugcuucaggauccaagauuauccaucuuccucucucuuccagaagccucccuuucuucaauaaggcacagucagcucaugacuaugaauggacugaauuaauacacaccagugcaugaacagacugagccugagggguuuucauucaccccaaacaaauccccaacuggcagaacuaccagguauuuuuaaaucaaagaguacagaaagcuagucuagcucaaggaagacuuuuuacauuacagcuugucucuuuguaacuaguaagugaauuagacaggaaauacucaaagacccuaaccaacccccaaaaccuugcauaggauacaagcuauccuuaaucuaaaacuggaaaucuacucuacacugcccuaucugugaguuacauggaggcugaaagaagaaacacaccaaguuucacuuucacaaguccaucaagucaucaguguuacagcaaagaauauucuucuagggaaauuaucacccauauuaagcucuaacuaccuggacaacauuuuauagggauaccuuuuccaacaaacucaauuuguauucuauguuaaaaaucuuccccccucccucccugccccacaccaaggaguaguacuuuaagcacagggaauugguucacuucucaacuaaacagacaaagaacaaagaaugucauuucuaguaagguuaaaucaugacagaaaugccgccauuuucaccucaggcauauuacuuucaaaacaaaauacauggaagaacuguaaagaaaugaaaaacaaagagccaagaaaaugcagagucauagaagcuaaaaggagacagcugaagaaacccauuaaaauaaaacccuauacagucguuuuuuaacccuauacagucguuuuuuguuuuguuuuguuuuguuuuguuuuguuuuuaaaaaaaaaaaaaaaagagucucgcucugucacccaggcuagagugcaguagcaagaucuuggcucacugcugccuccgccucccagguaaaacuuuacacauucuacuaacucuuuacaagaucgcuguuaacucaacauuauauaaugcuuucugcagcagaaacuaaccucagcaaguauauucaacaauuaaaaagaacuacccaggccaggcacgcuucuguggcucacgccuauaaucccaccacuuuggaaagcaaaggcaggaggaucacuugagcccagaaguuugagacuagccgggcaauauagggagaucccaucuccacaaaaaauuaacauuagcuggguguggugguacaugccugcagucccagcuacuuaggaggcugaggcagaaggaacacaagcccaggagguggaggcagcagugagcugagacugugccacucgcugcauuccagccugggugacagagcaagacccagucucugggggagggaaaaaaaagaaaaaaaaagaggugauuacaaugagagcaaaguuuauuauuuuuaaucuauaaauauaaauaaaucaaucaccagcaugccauucaacaacaaaaaaaugcacuugagcuauguauacacuacaguuaguggggauuacauuuuuauuaccauuucauguuagaauucauguuagucuuucuagcaugauaaaaaugccaucuauugaaaaaccaaagaaaagcgcagccuuuggcuuucaugucuguagcucacccgcaaguggccggcaggugcuguccucccuuucucucccucuccugccagcaggcaccaucuccaccucuauuccagccuuuccgaaaauauauuuccugucaaacucuuccaagauggucuguucagagaaucuguuucucaaaacuuucuauaaauauuacagcaaccuauaccuacaaucauauuauuuccacaauacuccucaaaaagaaaaaaaaagcgaaaacuacaaguuaaauaucuuucuaccuaguauuuuauccucaauaauguaacuuuuuuuuucccuaaaaacaucaaagcuuucacaaaaggaggagaagggugggcagaaggaaucgcaaaaggcaccaggaaacuuuggagagugauaacaugcucauuaucauaguaugguaaugguugugcgguguauacagaugcacacuugcaaaauguacaagacaaugcacaacuuaguaugccaauuauaccucaacaaagcugcuuaagaaugguggguggggagccugagacaagaaugcugcccucuccgcgugcuuuaggcacgcagccaugcuguggccauccacacaaaggaagcugagagaucauggagaagcacacgggagccgccaucccugagcugcuugucuucuuguuacaugagacaauaaaagaauccucaauguuuaugaauauagaaauacauaauaaacacauaaaugcuacauauuuaaaacccuuaguauugauuacuaauuuucaaauuagccacaaaccugaaauuaccauauuuuccaaagcaaaaguccgggcacagucugacauaguuucgcuaaaaagagacuaucugaaaucagcuuuagauauacuccuauuuuugcaacugacaugcuaauccacaaaauaugcuuaaauuuuuuucuuccgauuggccugcugcauugcaccaacucuaucauagucuagacccacucauuucucgugcuaccccacuacccacuagggaaaaaugaucauaaaauacaaaucaaauuccucccaaacacaaauaauauaaaaaguaaaacaacagggagacaaauucaccgacuguugauuuuauuuccacauuacuuguuuuuaaacuuacuagccaggcauaccaggguucacuuucaucuuuccacuggcuuccuguagggcagucuggaucaucaaggaguugacauuucccauucccucuauucacugauucucaaacuucagaaugaaaaagaauccacuaucuaaauaacaucacuugcaaaaauguuuucuaaguccuaccccuaagagauuauaaugugggguaccaaagaagugguuaaggaauuuacguuuuugauaaaucuuccaggugagucugauuacaaguucacaauucucacuuuaagauaaauacugcccagaugggucuaacuucaaacuucauccuccagucccaacauauacccucucuccucaacacaggcaccaagucacagaugucaaagcugcuaaaaugugaauaaagaaacaaauucaaguugauaauagcuuaagguaaucgucccucuaaagacuauuacauuuuuuuaaaugccaagauaccuaaaaagucuuuacaacuuuaaagaauaaagccacacuggaagaugggguagcuacacagaauguaaggaguccuuucugggcuuuaaaaucacgccguccuugaaccuggguucagguuauagcucucccacuuacuacuucugugccuuggacaaaguauuuaauuuuucaacuaaggucucacuuucuucauuuacaacaugagaacaguaacaucccuaccucacagaguugcugugagaauaaacaaaaauaauuaauguaacuacuuaggcuaguacucaggaccucaaaggcaaaaaccauuaguucugugauuacuaugauuauacugauccucuuacauuccuuuucuuagcugauucuuuccacaacuuacaagggagacaaugcugcccacauuuuugcagacggguagagguuaagcucaagagugcagaucuuaaaaaugguagagccagaauucaaacuaaauccgcccaaaucuauccuaaccacaacuggaaaugcugaaggaucuauaaguuucucccucucccucaacaggcucacucacaagcccucauaaccccacacucugcacuaggccuggcagacccagguucccaguaacugucuggugaaugagagaaugaaugaaugggcccucaggaguggcagaggcugaacacacuuucuagauccacuacuguacccaccacagcaccuuaugugacagauuuaaaagaauacaugugggauuuaaaucaauggacuaagaaaaauaaauucaaguacuuuuuugcauacuggcaugcuaaaaaugaagaguguuuuccauucaaaagauaaaauccacccauucaggcugggcacgguggcucacaccuguaauucuagcacuuugggaggccaaggagggaagacugcuugagcccagaaguuucagaccagccugggccacauagugagaccccauuucuauuaaaaauguuuuaauuuuuaaaaaauuucacccagucaacaaauacuuaucaagcauccacucuggcacaggcucaguacagguaacagggacacacagugacaugccgaggcacgucucagccuuguccaccccagcacugaggaacaauuccgacauagaacaaguaacucccagcaucagggguacaguguggcaugcuccagaaacacccagcaagagugccccauggacccugcaaguggaugggaaauguccccugaagaaacaacauguaaauggcauguaagcuggggucccaagggaaccaagguggagggcgaccaucauucuaagcagaggcaacgacaugucuaagggagcugagaguguugaagggacucgggcaagaaaccgguggcuggaacagaggacaaggcgagaggggcuuggcaggagaugagagaggugacaagagacgagcuuaagcaggccuggcagacugugucuagaagguggggugguaucucaaguacaacaagaagccgcucaaaggcuugggaacaagaguaccacugaccaacuggcauuugaaaaggaccacauuggcaucuggguggagacugggcuggagaaggcaagggcacaagcagggcaugagucagaagaucgcucaauaccgucugcgcacaggcaauuguggcuuggacugcagcaguggcugcaaagagugacuuggacagaauggaaauuuauuugggaaaaagaaccagcaggaauuguuuuggauucaaaacagauaaaaagaagaggaaagugucaaaaaugucaguaauuuuacagugaagaaaucuaacaaacacuaccucagccaggugaucaagguuaauaucaucaguaguaaaucauguugagagcagguacccuugauaugaugugaugagaaugguacuuugccgcuguggucuuccuuccccaaaacccauuauccaagucuaaucacgagaaaaacaguagacaaauccaaauugaagaacacuguauaaaauacuuagucugucaaggucaacaaaaacaagaagaaaucuaacaaacugucagucuaauggagccuaagaagauauaugacaacuagauguaacguggcauccugaaugggauucugaaaaagaacaagacuuuaggggaaaauuaaggaaaucugaaugaaguguagaguucaguguaaauaauguguugguacugguucacuggugugaaacauguaccacaguaauguuagcaggggaaacagguguggagugcacaggaacucuccuuaauauucuucagacauuucuauaacucugaaacuauccuaaauuaaaaaguuuacuuuaaaacugaucccugaaauuugacuugaucgccugggaggcucaaguacccuucacugagaacacggaaggggacgugggaggaaaaucaugaagcucuaucucagacaugaggcuggagcacccaucagacacucagcauagacagcaaggaggcagcucuggaguggggcucagcaaagagcucugaccucaugaaacaaaccuaggagccaucagcagauuggaucucuguaagcagaugggggucaccuagaauaagaaggaauauagagaagggccugaacucacagggguuggggagggaauggggagaugguggucaaaggguauaaacuuuugguuauaagaugaauauuuucuggggcuguaauguacagcacggugacuacagcuaauaauacuguauuguuuauuugaaauuugcuaagcaaauuaauaagcagaucuuaaguguccucacuccucuccuccaccauacacacacaguaaaacaccguauagugagggacgugcugguugauugugcuaaucauuacacaauguacacacacaucaaauuacauuguauacuuugaacauauacaccuuuuacuugucaauuauaccucaacaaagcugggggaaaguuuaucauuuccuucagaaacaaauuaguguaauucugaugauuuauauucuugucaccuuuuuucccgaagaaaauaguuaucuuuuuuggguaaaagaugagauuauuugauuaagcuuuuuugacucucuucuuuccaaaacaagggaaaagaaaagagccucgcucuaauugcugagaaauacccacauuuaauggucacagacagaaggcccagggucaagcucuggggaaauuccaccuuuaaaugaugcgagaggagggucacaaaggaaaucuccuaagugggagagaaacagggggcaugcaccaucccaagagccaagggaggauggcacagccaaagugggugaguaugucugaaaaaucauuaaaaaggaaaaauguuccuucuacuuaauagugaucuaagaaagaagguuuggcggaauaauggaagcuaaauucaaauuggaauaguuaaaaaaugaaagaaaaaaaacaaaacucuuucaagacgucuggcucucagauuuuacaccuauguucauggcauuauucaaaauacccaaaggcugaaacaacccaugcacccauggauggaugaacaaaucaacaaaauguggugugcacauaacgaauucagccuuuaaagggcaggaaaggcuaacacaugcuccaacauggacgaaccuugaugauauaaggcuaaaugaaauagaccagucacaaaaaaagacaaauacuaggcugggcgugguggcucacgccugcaauccuagcacuuugggaggccgaggcagguggaacaccugaagucaggaguuugagaccagccuggccaaccauggccaacauggugaaauccugucucuacuaaaaauauaaaaaguagccaggcauuguggcagaagccuguaaucccagcuacucaggaggcugaggcaggagaauagcuugaacccgggaggcagggguugcagugagccaagauugcaccacugcacuccagccugggugacagaguaagacuccgucucaaaaaaaaaaaaaaaagacaaauacuauaugacuucacuuuaugagguacuuagaauagucaaauucauacagacagacaguaaaagggugguugccgggggcgagggguagggagaauggggaguuacuguugacuggguacagaguuucgguuuuacaagaugagaagaguucuggagauggauggugcugaugguugcacagcaaugugaauguuuaaaugguuaagacaacaaauuuuauauauguauauuuuaccacaauuaaaaauuuuuuaaagcaguuuggccaauccauaucaagcuacaaugacgugucaugagaaaauuuuaaaguugaagaacauuagccuacagcagcacuuccuaaacacuucccuacugacaugcaguucaauguaaauggguuacacgugccuugugaggggaacuaagccacgcuaaccccugaccagugguuucugaccucaaggauacucauucauucuccaguacguccuacaaauauucuuauuuuuaauguguucuaagaugugagaagucauggcugaagaaguauggguuagagaucauuucaauuccaucucagugacaagaaaaguugcuuuaguuuucguuaaccuacaacuucugcugccaaaggacaaaaaagaugaugugaucuuacugaaaccaguaacagagauguuagacaaaugaaucucuacuguaaagucacacuccauggccaggcgcaguggcucaugccuguaaucccagaacuuugggaggccaaggcgggcggaucgcuugaggucaggaguucaagaacagccuggacaacgaggugaaaccccaucucuaccaacaacacaaaaauuagccgggcgugguggcaugugccugcuacuugggaggcugagccacgagaaucacuugaacccgggagguggagguugcagugaguugagauuacaccacugcacuccagccugggugacagggcaagacucugacccaaaaaaaaaaaaaaaaaaguaagucacacuccacuucugacaguuuuuugguuuuuuuguuuuguuuuuuugagauggagucucacucugucacccaggcuggagggcaaugacacaaucuggggucacuacaacuucugccucccggguucaagcaguucucccaccucagccucccaaguagcugggauuacaggcaugcaccaccacgccaggcuaauuuuuuguauuuuuaguagagaugggguuucaccauguuggccaggcuggucuugaacuccugaccuccaaguaauccgcccaccucgacuucccaaagugcugagauuacgggugugagucauugcgcccggcccugauagaccuuuaagaacagaauaggagcaauacuuuccucuuuacaauauguuagaaugacaaaaacuaaaucaguguauaaggaaagaaaaaacaaugugguaauuuuguaggcacagaauaaacagaucaaugaacaaggaguucagguaaaaaaccacauauuuguggaaacuuagcacaugguaauggcaacaucucaaaucaguagaaaaugaucaaugacucaauaauaaccaucuuauuuggagaaaaaugaaauuagagcucuaacucaucccauucacauauaaaaaaaguucagcuauauuaaacaucuaaggauaaaaauucaaaacaaagaagaaaaucuagggagaauacuuaauuacuggugugggaaagaccaaguacacaugccaucaaggccaaaaagauucagaguuugggagcaugacucauaggauuggcaugaggacauaaugaguuaagaaaacuaagacugaaauacagaugacuaaagggagaaauauuauacauacuucuuuuaaaagaaaaacagaaaucagaaagaaaaagaacgaagaaccuacuagaaaaaaagacugaagacuauuauaaaaaguaacauauccaaaaaaauagcauaaauggucaaaccaugcuaaauugcaggaauauacaaagaaauguaaauuaaaaggagaucugagucuucuaccuguugggcugagaaaggauuuaaaagacugacaacacuuaccauugguaaggguuuggggaaauggaugcucucacuuuuagcuaaugagaguccaaauugguauucuacaacauuucuuuucuuuucuuuuuuuugagacacggacuuacucuguugcacaggcuggggugcacucgcacgaucacagcucacugcagccucgacuuccugggcucaagugauccucccaccuuagcuucccgagcagcugggaccacaggaacgcacaaccaugcccagcuaauuuuguuuauuuuguguaaagccaggucucccuauguugcccaggcuggucuugaacuccugggcucaagugauccuucugcccagaccuuucaaacugcuggaauuacaggaguggccacugcaccuggccugguacaacauuucuaagggcauaugucaaauauuuacacucugacaagcacuucuguccuagaacauaacuggagauguuaagugcaucacuuauuguaagagcaaaauaugacgacaaccaauaagggauuggcugaaaacuuuuuauggcauacccgugcuaugucuuuaugcacacacauacccacacacaggcacugacacaaaaauguccacaacaugguguauaaauggggaggaaaaaacagggaagcuguauaugauuccucuuguauguacacucaaacauauauacauacaacacacacgcgauuuacacaagcauuuguaaaguccaaaaaaggauauaaaucaaauugcucacaaugguuaucuccuaggauguacaauuuuaggauaaaaucaguuuauaaucucuacacuccuguuauuagaauuuuucaaagaccauuuauuacuuuuauaaguauauauuuuacauacacuguuguaauaaaauauaauaagauaauuucuaugggaggggacagcaaucuauggcaaaaaggacauaaugauuuguauguucccuuucuucauuaauauguaaaguccuuuaacuauaaggcagcuuccaguuaugacugaauggucuuaaaacauccauauuauuuuuuuagacaaaggaaugcucuauacugcacagucagaaguuagaucuuccugaguuauggcaaaguuacgacacugggguccucauauaaaagcauaagacucagcaaauagaggacaaucuucuucacgcaugcauaaauuagaaggagcuacagccugucaauacgauuucagacacacaaaaucauugugaggcuaaacuuagcagagacccaugaaaauacccacuauaggaucagaccaauuaacugaucaaaagaguagcugcaagaaauuuaacuuauuuaauauauaaccacaccaguauaaugccggcuaaacugguuucuguaaugggcauaaaacaaucacaacaccccccccccaacacacacacacacaccaccaccaccaccaccaccaccaccacacacaccacuuuaaggauaaugcugaaaagacagguuguaacagaaccucaauauacaaagugauauguaaucucaauuuuauuguaauaauacugaaaacagucacuucuuaaguggguaaugucccuaaggauaaguaguucuguaaacuauauuacugugucuaagaaacauacaguaaacaaaaugaaugccaugaaacaaagcuaauucaaagaauucaaaauacaauugaacaguuaaaauccuuuaaaagcaaaaacaacuguaauuugaauuggagauaucaguacuaacaucccuacaauaugucuucauuuaugacuggccuaucuuucuuucuucaguaucccacuccucauuccuucccauuccugggauccugaaucauuaauucauucgcacagcaauucuuuauugagcauuuacuaugugccaggcaccauucuaaacuggagaugcagcagugaguaaaacuaaaaucucugcccuggcauaucuugcauucuaguggcaucaaauccaucagugccacccacaacauaaaauuacauccuucuggccgucccaccucaacaucccuagaucuccccauuaauaggcuuuuuuuuucuuuuuacagugcacucggcacaugauuugauuuucaguguccccacuuuagaacauuaagcuccagaagacaggaauguuuuuuauguuuuguauguuccaagagcuuagaguauugccugucauacagacauucaaauauuuguugaguuaacgaaugccuucucuucccucuauggucuagcucucucucccaaugaaaguugcucacaucuauccuacucuguaaacaaaacacauguccuuguccuacagcccgacccuaccuugccugcuacuuucuggcuucuuugaagaugcagaacugcaguagucuguagcaacuaucuccaccucuucacuuucacugcaacugcuuugguuuuguuuguuuggucaccaaagccuucuucaucugcaaauccaaacuuauuuuacuuuuuuaauugaacaaguaauucguauucacuacaaaaguacacagaaaauggcaucacaugccauguaaugacuuaagccagaaaccugggaguuauucucaaugucucccugucucucccagcccacacucaauccaucaccaguucugaaugacucuauuuccaaaccccaucuccaagccauccaguuaucuccagcuccacugcugggccuuggcgccaccuccaccguuaacuuucacuggauuccugcaaauugcacccaguggucucucaacuuccauucuugccuccaauccccugaccacucagcaccccacacgguggcuguaaauagcaaaacaguccaagaaucuccuauuucagaccucuaucacgggcaacccuucacagggacacccuaguuuccaagguggccuauggcugugaguagcaugaccccugcuguggccucuucuccugccacucucuaccucccccuacccucuagagaccucccacuccucacuucagacaugccgagcucuucccaucaugaagucugcccgcaagccuccccuccaucuagaucauucuucucugaucacucaucucaccaagcuaaccuccuccucaucacuuucaucauaaaaauaucacuuucuaagagaagucugcccuggcuucucaucugaauuacauuguccucucuuguagcagccuguauuuuuccuucuuacacccuuuauagcacuguguaaguauguacccauucuuauaauuaauuaucugcucaauggcugucucccuuugaaagcaagauuuuaucuugauccaucuaucuauccauacauccaucccaucuaucuaaccaaucuauuuaaucuauccaucuauccccccagugacuagaauagugccuggcacaaaagagcucagaugaaugacugacuguccuaucagccuauaaacugcaaaaacaaguucaaugucuauuuugucugcuguuauguaucucguaacaaacacauugucuggaauagagaaaauacucaacauucauuaaauaaaugcugaaugaauaccaaaaaaaaaaaaaagcggcagggggaagcaucauaauucuaucugucacagagaaaaaaaaaaaaaaacacugguuccaucuuggccaucuugauauauacagccuuccagauugcucuacauuguguuaauuguauggcguccagcuccugcaacgcagguggcuucuccaguacccaucucuacaagcaccugcagcugcuccagccuccagagacuacagcacacaacagcaggccauacccagcagccagcagcuccccccagcaucccacucuggagguuuuguagcaggguaccuccagugagacaccuccccaugaagagcuuuuguguggcgcccuagugagcaacuucuggcagguaucagaggguggauuuccauuaaguuccacuaguaugacaugccagcaacuucuuggccaugcaguaaaccagccaugcccucucuggaugaggucuggaucuugguccugggggaaggagagacucuuccuugcagacucuaccucagccccaggggcagcaguugcucuguuuaucugcuauuuucauauucuuuacaauucucuucacuuuucacuagccuaaccaaaucccuccuuacuucgauucccuguuauaauuaguaauuauccacauuaaacgcugcuuucaauuuacuggugaugaaguuugaaucuguguccacacccaaaucucauguccacacuguaaucuccagugcuggagguggggccuggugggaggugacuggaucaugggggugcaccuucacgaauggcuuagcaccgucccuuugguacuguucucaugauugaguucucaggagauccgacuguuuaaaaguguguagcaccuccccuccucucucucucucuugcuccugcucuggcgauguaagacaagccugcuuccccuucuccuucugccaugauuguaaguuuccugaggccucccccagaauccaagcagaugccggcaccaugcuuccugaaccgccuguggaaccaugaacaaauuaaaccucuuuucuuuauaaaucacccagucuuggguauuucuuuauagcccuaugaggacaaacuaauacaacugguuucucucuccugauuggauccagauugauacaaauuuggaauuuguguuuguuguuggcauauaaaauugcaauuguguccagaauuaccuugaaucuugcaaccuagcuuauuauuuauaauaaguuauaaagagguuuuuuuuaauuuucuacauauacaaucaugucaucuacaaaaucacaguuuuauucuucccuuucucaucccuguacuauuuuucuugccauacucaacuagguaggacuuccaguaaaauaauaaacagaauuggugacagugaaaacaacuucucuuucccugucucaaaagaaaacuuccaacauuucaccaguaaacaugguguuugcuauaggauuuuucugaguaaucuuuaucaaauuaaggaaguuaacuuucauucauaauguauuaagagauuccauuuugaauggguauuggauuuugccaaaggcaauuuuugcaccucugacauuaucacaugauuuuucugcucuacucuauuaauuuagugauuuauacugaucaauuuuucaaauauuaaaccugucuuuguaaguaugauauucugaauuuagucuuucgaaaucuguugagauuuacucuauaaaucaacaauuuugaucaauguucccuaugcauaugaaaagaauguacagucuacaguuauugggugcaguguuguauuucauauuucauuauauuccauauuucauuuugaauguaucuuauuuucaacagucuuuuguugcuuaacaacagggauacauucugagaaaugcaucacuaggcuauuucaucauugugcaaagaugacaauguacuuacacaaacguacuuacacaaagauguacuuacaaaaaccuagauaguacaaccuuccacauuccuaagccauaugguauauccuauugccccugggcuaugaaucugcguauuauuguacugaauauugcaagcaacugugacacgauagguaucuguaucuaaacacauauaaacauagaaacaguaauguguuacacuaugacacuaugacaucccuacgagacaggaauuuuccaguuccaauaaaaucuuaugagaccagcaucauauauuuagucagucccuuguugacugaaacaucguuaugaagcacaggacaguaguacgucuagauuacacauaaacccacugagauuucaauuaggucaaguuuguucauuauguuauggaaaucuucuauguccuuacugauacuuuguuucugaguuaaugaagacgguauauuaaaacuuuccacuaugaauugcagauuugucuguucuuugucauuuuuguuaauucuugcuuuauguauuuugagauaguguuuuuagguacauacagagguagaacuguuguaacuuccuggagaacugaauugaguauuuuaccauuauguaugucuuuaucccaagcaauuauuucuacccuaaagcccacuuuguuaauaaagguacaccaguuuucuuuuaauguuugaguaauauggcuuuucuaccauuuuauuuucaacuuuucuacauccuugaaagcgguacagaguugugaucugcuuugauuuuuuauccaauuucccaaucuuugcuuuuuaauuagaaauuuugguucauuuuuauuuaauauaauuacugauagacuaaguuuaaaucuaacaacuuacuguucacuuccuauuuuucccacaugcucuguuucuguuuuuggucgucuugccuucuuucagauuaaucaaguuuuacuacuacuacugcuguuacuauuccauauuuccccucuauuaauuuguuaauuacauauauuuuacuacucuuuuaaugacuaucuuagagauuacaacauguguccuugacuuaucaaagucucaaguaaauuaauauuuuuaccacuuccugggcaaugaaaagaccguaagauauuaacuuuuauuuaacacccccacaacuuauaugcuacuacuauauuuuuaaauucuauguguauuuuaaaccacaaauaauuauuuuacccaacaguguucauuuacauuuaccaucuuauuucuccuuucuuuggucuucacuuuuccacgcaucuuaaagcugccaugcaggaucauuucucuucugccaaagaccaaucuuucuauuauucccuuuagugcaggucugguguaauuaacucugugauacugugauauaauaagaaacauauauuuggucuucauuucaaguuccuggcauugagcccugaaacacgguaguaagaagagcagacauaccugaguuuaugaugagaggacucucgggagaauggcgacugguuaccaaagcaaccaaucaugugauuagaggauucagacuuucauccccugucacucugcuccccaccccaccaccuccugggaagggagagagguuagagacugaguucaauaaccaacggccaauggccaaugauuugaucaaucaugccuucguaauagagccuccauaaaaacccaaacaacagaguccagacagcuuccgggauggugaacacauaggggagcugggagggugacucaccuggagagggugugcaaguucugaguuccuccccauacccugcccuaugcaucucucuuuuagcuguuccugaauuguauucuguauaaucaacagguaaaccuagguaaauguuucccuguuuugugagccauucuagcaaaucacugaaucugaggaggggguuauaggaaucacuucauagcagucgguaagaaauaucggagaccuggacuugcaauugguuucuaagcaaucuugugaggccaagcucucaaccugugaagcaaguaauuccaggcaguuaguauccaaauugaguuaaauugcagaauacccggaguccacagagaacuggagaauugguugguaugaaaaaaacccuacacauuugguaugagaaguuuugugaguguagaagaaagagaauugggguuuuggcuuuuucuuuuaaauccuucucauuuuuguugaucuaaagaagugauaauuuuguccucacuuuugaaggguauaacauucuaguuuggcuguuuaccuucuuuuuuacauuuuuaaaacauuaguucauugccuucugagaaggaugcacuauuacaucuauugagaaauuagcugucaaucucacugcucuuuucaauguaguacguaguuuuucucugguuacuuuuuuuuuuuuuuuuuggagauagagucucacucucaccuaggcuggaguacuuuggugggaucuuggcucacugcaauaucugccuucuggguucaagcaauucucgugccucagccucccaaguggcuggaauuacaggcgugcaccaccacgcccggcuaauuuuuguauuuuuaguagagacaggguuucaccaugucagccaggcuggucucgaacucccggccucaacugaucugcccaccucagccucccaaguggcugggauuacaggcaugaaccaucaugcccagcuaauuuuuguauuuuuaguagagaugggguuuugccacauuggcuaggcugaucucaaacuucuggccucaagugauccauccgccucagucucccaaagagcugggaucacaggagugagccaccgcaccuggccucugguuacuauuaaaauguucuccuuaucuuagauuucugguaguauuuuuuaaaucugugaugagauggcuuuugccuguuaugaacaauucucagcuaucaucacuccaaauacugcuucugcagcacuccuccuuccuuuccuacuaggauuucaauuacauguugguuagaccuuuccacagaaucccuaagacucacucuauaauguauguccagaccauuuuuauuuccauauuucauucugaacauuuguuuucuacuuauuacuaauguacugcuaaacccauuaacugacaucuuaauuucauuuacaguccuuuaacucuacaguuuacauuugguuuuucuacuggggaggggguggugugguuccaauuucccuauucuuaaucuuuuaacuccguaaacauacuacauaccuuacccuuuucuaauaacuucacuaucuggaucccugucgauccacuuccauagucuguuguuucucuuggcguucaguaacauugucuuaaauccucaucugccuggugauuucugagugccaaacauuguaaauaaacauagagcucaucugagguucugagugauguuaucuucuucuauuaaugaaagaaauuauacuugcuucuuuccagaacaccuugauccagccaggaacugagagggucuggagcuggacuucaauaccuguuaggagcuacuaucucuaagauauaggcuuuugggucuccuacucaaagccuaagaaguuuuccugcucccugaucugagccaaacuccaauuuuuguccuccgcccucugagucuaacaaaaacucuguucagccguccagcuucucaucugccuaauucuucuggaaugagcagauuccucugggaaagaaaugacugcaaaugcuggucucacaucuugggcuucccuaccucaucaccacgccccaccucuuacacccacaaaucuucacuauuuuguuaacucuccauuuccuucacauaaauuuuguuuuaaauuuuguccaucaucucgacuugcucucagcaggaaauaaggcccaacaacuuagucuaucaucaaccagaaaaaucuucccuacucucccuuuuucacucuuugugggucuaccccuucuguaauuccugucauuuuaucaaaauuuuggaaggauggaagauaaagacaucuucaaugaguccuacuuaaccagaaaccuucaguuauucauuuuuuugauagaucauuuagauaugaaggauauuaaaccucugccugucaaaucuauggcaaauacuuuuccuaguuugccauuuacacuuuaauuuuaugauauuuuuagcacacagacaugcuggauuuacaugaaaauuucuuagucuuuucuuucuguuauaauuagaauggguaugguccuuccuaacuugaacacaaaguaaguauugacccacguuuucuccuaauauuuuuacuauuuucaauuucuacauuuaauuuuuagauuuauuuugguauaaggcaugagguggggaccuaaacuaacuuuuuuuuuuuuuuuuuuuucugagacaaagucuugcucugucgcccagguuggauugcaguugcaugaucucggcucauugcaaccuccaccucccagguucaagugauucucgugccucagccugccaaguagcugggauuacaggcaugcgucaccacaucuggcuaauuuuuguauuuuuaguagagacgggguuuugccauguuggccaggccagucuugaacuccugacuucaagugauccuccugccucagccucccaaagugcugggauuacaggcaugugccaccacauccggccuaaccuaauauuuuuuaagugguaagccaauugucccaaauguccauuuaaauaaacagcccuccauuuccuccucaaaacuguaccuuuaucauauacuaaauauauauauauauaauuuuuuuuuuccuuaacacuucuauaauuuuacucugcaccuuggcacugcugaucccuauugcucagucuccuugcuacuauguccugccuugguuucuguaacucucccagcuccccucaucuucaacuauuccuucuuagucuccuuuguaggcucaauuuccuuucuauguccccucucucauuucauccucucucauuuuccagccuccuucaguucauuucuggaagcucuuucuucucucauucuccuacucuccaaggaaaauuuuauccguacucucagcuucuuugagcucucucuaggucccaaaucuacauccaacugcuuucuaggaucucuagauguuccccaggugcuccaagcucaaccauacaaaugaaaauacaguauguccugaaaccugcucuucuuuauguauuucauuaucuacaguaccaccaucacucaaaccagaaucucaggaauuucuccucuccuucaccgugaaaggauccagaauaagccacuauagcauaaaaauuauuuugagcugaaggcauuugaguuccugaaaccccuuaucugccuaaaagcagagccucccaaaagaacucaaagaacucaauugucaugaacccuuucccacaggggcaacucuaaucaucugagaugagaagacaaccaaacagaaaaugucacgaaaauauacagcuuccauuuauucuccuaugagcccauuuaucuuuccaaauaguucuuuguuuucccggaaguacccuuucucccucuccucuucaucuauuaagauggugcauaaaccccaaauucuaacaacucuuuucagucacauuuauuugugaacuccccuaaguauuuacaaaauuaaaaucuaccuuuucucuugcuaaucuaucaucugucaguuuaauucaaaggcccucaaguacugaaccuaacagaguagagaaaaagugugacaggaucacgucuuagaggucacauaaaugcuacuaacucuaccucccaagucagauccuucgcuacugccaaugucuaaaaacaggucuuaguuacuaccucugggauggauuccucaccagacucccagcguucuuccaaaccauucucuacaugguccacaggguaacugcauaaaauaaaaaucugcucauuuuccucuucugauuaaacugugcuaaaaggccagaugcaguagcuuaugccuguaaucccaauacuuugggaggacgaaacgggaggaccacuugagacuaggaguucaaggccggggaaauguagggagacucugucuuuacaaaauaaaaauaaaacuauuagccagauaugguggugcaccccuguggucucagccacgcuggaggcugagguaugagaggauuguuugaggccaaggaguugaagucuauggugagcuaugaucaagcugggagacagagugagaccuucaaagaaaacaacaacaaaaaaaucuguuaaaauguaaacccaggcuggugugguggcucaugccuguaauccuggcacacuggugagguggguggaucaccuguggucaagaguuugagaccagccuggucacuauggugaaacucuuuuucuacuagaaauaaaaaucuuaggccaggcgcggaggcucauaccuguaaucccagcacuuugggaggcugaggcaggcagauuacgaggucaggaguucaagaccagccugaccaacaugcugaaaccccgucucuacuaaaaauacaaaaaaaaaaaaaaauuagcugggugccacaugcgugccuguaaucccagcuacucaggaggcugagacagaagaaucacuugaacccgggagacggagguugcagugagcagagaucccgccacuguacuccagccugggugacagagggggacuccaucucaaaaaaaaaaaaaaguuagcuggggguggcagugcaugccuguaaucccagcuacuagggaggcugaggcaggaagaauugcuugaacccaggaggcagagguugcagucagccgaaaucacaccacugcacuccagcuugggugacaggguaagacucugucucaaaaaaaaaaaaacaaaauuuaaacgcaacguggcauacauagccuucuaugaucuagcugcuacucucuaaccuuaacucauccaucucucuccuuaaacccuaaacuagccauagcgaauuauccaagcaacucaaacuacuuccuucuuccguuccuuugcacaggaaaggaaguauuaauaguuugacuaaacguaguaccuucagcccagaaaguuuucuugcugauucucuuugucugccuagcaaacuuucuaaucaucuucaaaauacagcuuuagugucauuuuuaaaaaaaaaauccauccuucacuugaggccaggaguucgagacaugccugaccaacacagcaaaaccccaucucuacuaaaaaguagaaaaauaagccaggcgcaguggcacaagccuauaaucccagcuacucgguaggcugaggcaaaagaacagcuugaacccaggaggcagagguugcagugagccaagauggcgccacugcacuccagccugggagauagagcaagauuccgucuccaaaaaaaaaaaaaaauccauccuucaugugcucaagcagaccaucacugcuccuuuuugccgcagauacaucuuauacacacauacuuuauaauucuauuauaccuuuuauaccauauugcaaucauuuuuuaugucugucuucccuccaagacuauggcugccuuuuauuuacuuccaauuagccagacuuacauacugaccaagagugucuccuugaccaaacucuagccaagcuccucugaauccucuucccaacuaggucuucagugucaaccuucaguauccauccuugucugucuagccuaguuuuagcaagaauucugucaauaugguuuaguaauacuaaugauucuuuauuauuauaaauuuaauccauguagaaauaaccuguguuuugggacuccuuuuaguuaaaaaguugacaaaaagcuagaagucuucguaacuacagcuaaaaauguuucuaguuuuugcauauaaaugauacaagcuacucuguuuuugaacuuuuuaaaaaaccuucauauccauuuccuuacuaugguacaacuacagccccaggcaggaaagcugcauaucuuuauuugggcaauugucuccuuauaaagagaauaaaaagagccauaacaaacauucaaaugaaaaguggcuccacguaaauggagaguagauaagggcauuuuccaauaguuugagaugaugagaauaucucagauuaucaaaacagauuugauaugaaaguuuuaaugaaucuguaaaaccuacuuuuaaguauaaguaaagaaauccuaguucaaauuuuaaaaccaaauauacauggugaaaagugagaaaauguaucuuauaugguuuggcuguguccccacccaaaucucaccuugaacuguaauaauucccaugugucaagggcggggccagguggagauaauugaaucauggggacuguuucccccauauuguucucaugguagugaaugagucucaagagaucugaugguuuuauaaacgggaguuccccugcacauucucucgucugccauguaugacaugccuuugcuucuccuuugccuucugccaugauugugaggccuccccagccauguggaauugugaguccauuaaaccucuuuccuuuauaaauuauccagucucagguaugucuuuacuaggagcaugagaacggacuaauacaauaucccauuaaccuauuuucaaaacuuauucccagaccugucaggagaccuugaggucugucauuaacaaacagaucuuaguuacuacgcucuagcuuuccaaagaauagcaguguagaguaacauagauacaaccugcuaagaagcaauuacuaaacugaaacuuccauaucuccaagaagcagcacuuaaaucauccaugguaacauuguuucuuuaaaguuuucaacauguggcaguuuuguuuaaguaaauaacagcuuuauugagauauaauucacaaaucauaaaguccacucacuuaaaguauauuuuuuaauauaugcacagaguugugcaaccaucacuauugcagcuuuuaacucaauuugguuaggcuagaauuuucucaggauucccuucccugaaucuggacaagauuuaaaaagcgaaaaguaaaaccaccauuacuuccugagggccgagguaguuagaggugguagcagauauaaacggagaugccagaggguuccagcuuguccacgugcugcuucugucacuagcuuuuucccccaacugccggccuugucagcgaacagaagccccuggaccaucagcugcuggccagcagaccuagagaagugauugcuaugcagagguaauagcuuuucauagacuuuuucaucagcuuuccuuuguggucccguucuagcagcugcucaugccuggcuucucagagccucccacaaguucuaacucagccacccguacaggugcuucaggagaggugcuuucguggcucuucucugguccucuaauucuuccuuccagacugucauuuuuccagcuuuuccccacaguuguaaaauaucuuauugcuauaaaaaauaaaucccuuauuacauaauacagugguucugcuucccugacugaauccugacugauauccacgaguuacuuauguguccuuaaacaauagcuuagcauugacucuuugaacuuuagaaaacuagaaucugaucguauguauucugugagaaucuucuucuauggugcugcauguagcuguauuuugcucauuucucacugcuguucaauaaucuacucuacaccauauaccauuucaguaaacuuuuuuuuuuuuuuuuuuuuuuuuggacacagggucucucucacucugucacccaagcuggaguguaguggcacaaucucagcucaccacaaccuccaccucccaggcccaagcaauucucccaccucaggcucccaaguagcugggacuacaggcacgcaccucuaugcugggcuaauuuuugcauuuuuuuuuuuuuuuuuuuuguaaugcaaugguuuugucauguugcccaggcuggucuugaacuccugggcuccagcaucugccugccucagccucccaaagugcugggauuacuggcgcgagccacugugcccagccccauuucagugaacuuuuuauuaaaauauuauauacaaacaggaaacagcacaaauuguaaauauauuuguguguaugugugcauguguaucacaccugucaucaagaaagaacauuaccaacaccccagaagcccugcuaauauauccucccuacucuccaaagguaacuacaucuccugacuugcaacaccauaaauuaauuuugccuuuguuuugaaccuguauacagaaucaaacaauauauauucugagugucugguuucuuucucucaacauuauguuugugagaguuacucacuucuugaauauucaucaauucauuaguuuucacagcuauacagucugucaagaauauacauaaggaguagaacugcugggcuuuauggugugcaaaucuuccacucucauagauaauucuaguuucccaaagugguuaaacuaauguagauucccaucagcaguacaugaaagcucccccugcucuguuucuugcugacaccugauggugucuuuuuuaauuuggccacgcagauguauaagggcaucuaaauuauacugaagcuguugugggaguaugucaaugucauagagaauuauaaaaaaguuuggggccgggcgcaguggcucaugccuauaaucccagcacuuugggaagcugaggcagguggaucaccugagaucaggacuuugagaccagccuggccaacauggugaaacccugccucuacuaaaaauacuaaaauuagcagggcaugguggugcgugccuguaaucccagcuaccugggagacugaggcggaagaacugcacaaugaggaugguuaaguuacucucauacuaauaaaacuauccucaaggaaaaaauuauaagagaccauuaacagccaaucucuauucugagaacucccuauaucagguuugagcuaaccucuugaucacuuuucuggaucuuucccugaccaaaccaaaaacacaaaguuuucuaacugaaauuccucagaaacugaucaccuuguaaaauacugucuuuccaaauuggaugaccacuuaucaggaaugcucaucucacaguguuccaagacuggguagggaauggaauggacaucuaagaaccuuaagcuguagaaagaacagcagcucaaagauggagacagacuaugggaggaaaagaagaaaaaauaauucccacauguuacaaauagcugcuucgucauauuaggcuauucagaaaggaaaaaaguguaaagaaggcaacgugaaaaacagaaaugaacaaacugugcccuaccaguaccaagcuuugaguaccguauacugcuuaggaguuuuaauccaaauucagacgugucaguugauucaaaugaucuacauuuuaauaauauaacuguacauuuaauaaugaccacuugccuauuacaaauguuccccuccagauuuccuuuugcuuccuucuuuuuuuuuuuugagauggagacuugcucuugucacccaggcuggagugcaauggcacgaccucagcucacugcaaccuccaccucccggguucaagcaauucuccugccuuggccucccgaguagcugggauuacaggcaugcaccaccaugcccagcuaauuuucuuguauuuuuaauagagacgugguuucaccauguuggccaggcuggucucgaacuccugaccucaggugauccaccugccucggccucccaaagugcugggauuuacagguaugagccgccacgccuggcccuuuugcuuacuuuuaaccacaauuuguuuaagcacagugaagacuucuuuugaaagcagucaacaguagauuuaaggcuguaguucuuagcccuggcugcacuucagaaucuccuagggagcuuuuuaaaauccucaguuugggcccuaucccugagacuccaguugaauuaguuugugguagggcccaggucgugauauguuuacaaaucuguccuggugagucuaacaugcagcagggcugcgaaccacccauaugaaggaggagcacugacuggacuaggagcaggaggaggccuggcucuucugagccucacggcgagggcguuuuuacacucacuaugacgcccacuuguuccuaaacacccuuuaagaccagcaccucucccacuugagagccacuggguccaggaaugaaugggucugcacuaacuuggucuuccaccucugugagcauguuguggagugaauaaauguuauuaaaacguaacaaaguaaagaaagaaauggaggcaggccuacaauuuagcgggugaggagagaagagcagaaguguaagggaagugguuggggggcaggagaggaaaggagaugucccuccaccauggcgcugagucugggcaagaucauggcugauccaggcuccccaggaagaaagggcagagguucuacacugacuucaaagauuuggccaccacccguggaaugacagcaucugaggugggcuugcgggcccuguaguggcugcugacaaggauccuguccacugacccaggcgcaagcaacaggagucaucaguaccuucugcuguucuauuaaaaauaacccugugaauuucacuuucauauguccccaucccuauaaaccauuucuugguuucacuccagguucuucauccaguuaaucucuuccaguagacacuacacuaaugccccuuccuuccagcagucgucccugaaccucuguuccacauuccgucucccauuucauccucucagagcuguccucugugcuuuuccuuuguaauucuugccacuauuuacuuuccuucaaagcaaaacugccaccaagaaccauuaagauguguagccuccacguccucaccucgcuggcucuucaacucacucccauugggccaccgcaccaacacuccacuggaaccacccauugagguuacuaaucaguugaccaaauccaacaaugacuucuccguccucauuuuauccaacuucccaguaaccuuugugauacccucugugaaaggaagaacaggaaccccaaagauauacacacccuaauccccagaaccuguaaauaaauaacaucacaaggcaaaggggaauuaaggcugaagauagaauuuagguuguuaaucagcugaccuuaaaauaggaaaauuauccuggauuauccagguggacucggcguaauuaaaaggguccuuaaaaguggaagaaagaggcagaagaggucagggugagugaaugagaagagagcagggucacaaagacucuacgucgcuggcaucaaggaugaaggagggagccacaagccaaggaacauuaagcagacucuagaagguggaacaaacaaggaaacagauuccucucuagggccuccauaaagaacauggcccugcuggcacccugauggcaacccagugagacccaugucagaugacugaccuacagaacaguuaagaaaucuguguuguuuuaagccacuaaauuugugauaacugguuacaguagcaaacauaaaagugacgcacccuccuuaaaacauguccuucuccuggcuuccacuucacaccugccugccucagcacugccucccuggcuccccugcagccuccugugcuggcuccuccugcacugcucggggcuuagucucccuuucuccaucuaucuucugcaucccaggugaucucaccuagucuauggcuuuaaaugucaccugcgcauugacggcucuccaauuuuuaucuccagacaggaccucuccccagacuuauggaaguugccuauucaacaucaucacucuggugucuaacagacaucucacaaccaggacaucccagaagaacacucuuaaucuccacuuccuugucucacugacgagccccagcaccaacgcaguagcugaggccacaaaauuucuccuuuccuuuacccccuacauccaaucccaugaauugacagcuccaccucugaaauacauccacuucucacucccuccacccccaccgucauuucuuaccaagaucaccaguuaucgcaacagacucuuaacuggucucucugcuuccccugacugccacacaguagccaagaaagccuuugaacauaaagcuucauauuauguugcucacuuccuaauagcucauccuccaauaacuucauguugcccuuaaaacaaaaucucaacucuuuuuuuuuugagacgguguuccgcucuuguugcccaggcuggagugcaauggcacgaucucgacucacugcaaccucugccucccagguucaagcaauucuccugccucagccuccgaguagcugggauuacaggcaugugccaccacgcccggcuaauuuuguauuuuuaguagagaugggguuucaucauguuggucacgcuggucuugaacuccugaccucaggugaucugcccaccucggccucccagaguacugggauuacaggcgugagccacugugcccgacccaaaaucucaacucuuuaugccuacuuggcacaacaagaucuagcccuuaccuaccucacccagcucaucugccagauccccacacuguuccaaucaacaacuuuuuuuuucacauuuccucaaagcaagcacauuccugccucagggccuuugcacaggcuauuaccuuugccuagaauauuccucccccagauacucaaguagcuggcuuuccuuuaucauucaguucucagcucaaauauaacuuccuaagaaaggccuuuccuacgaaaucuacugaugugcucacaccucaguacccugcucuacuuuguucuuagcacacucagaaauccucaccuacuuguuuacuuuuguauuguuuucccucuaaacgauaagcuccaugagaauuggaaccucaucuuauacccucagcaacuccaacuagugccuggcacauaguaggcccucaaaaauauugcugaaugcauaaaugauggcauuaaauuaaauggaauuuuggggggguuuuuuguuuuuuguuuuuuguuuuuuuaagagagucucgcucugucgcccaggcuggagugcaguggcacgaucucgacucacugcaaccucugccucccggguucaagugauucuccugccucagccucccgaguagcugggauuacaggcacaugccaccaugcccagcuaauuuauuguauuuuuaguaggaacaggguuucaccauguuagccaggaugguaucgaucucccgaccuugugaucugcccgccucagccucccaaagugcugagauuacaggcgugagccaccauacccagccaaaauuaaauggaacauuaauaaacagucgauaaacauaauguuggcugagcacgauggcucacaccuguaaucccagcacuuugggaggcugaggcaagaggaucauuugaggccaggaauucaagaccagccugggcaagacagcaagauccugucuccacaaaaaauaaaaaacguugccaggcauggugucccaugccuguaguccuaaccauucaggaggcugaggcaggaggaucucuuggguccaggaauuugaagcugcagugagcuauaaucgcaccauugcacuccagccugggugacagagagagaaucugucucagucaaucaagaaacaaacaugaugcuguggaucacugucaaaaaaugccuaacagauauauaacauauuaagagaaaagccagguuauagaacuacauguacaguaaaccuauucuggguuaauaaauauagaaaaaaugcccacaccggcacagagaaauaucuguagauacauauaucagaaagaaaucugaaagaaaaaaaucugaagauacauaauuagaaauuguucacuucagaugguagaguucagagugguuuggccaucucucuauuggugaugugcuguauaaauugccuuuccugggcuucaugcuucuaccuggaaagagcuccuucacaggggacaugcuggcuuccugccucacccucacucgccccuuagacaggagugaauucccugacugaugagucugagauuaagaaccaagcaugucugccgcaguucuuccuuccgugguugugggaauccauuugcacacagggagcgcacauuuugcuccucuccucugcaucacaagcuuuucugggguagcucccauggaucugcuuggugcugucagugacuaucaccaagccagacuguuuaauucagaaacagaguauuacagcccacuugagcacuagacuaaaugauauuuguugacagaagucuuuacucauucauucaaugaacagucccuggacacuccagggacuauuguauauacuuagaacagugccugccauacauacauguaugccauguccaccuggcauaagaucccuguccaccuggaacuuaagagucuagcaguggcagccagacaauacacagugaaaagauguaauuuacacaguauauuagaugaugacaaaugcuaauuccaaaacacuuaugccucacuacccccauuuaugaaauaaaaaauacauaaucaccacacagcagguucucugaauugcuugaggaauagauuguugaaaacugcuuaaauacaaaaaaauuugauuaauaauaauuaaagcauuuaacaaaaaugcuucuuaaauaaaacagaguuaagucuaaauuuugcucaacaguacaaaaauaaaauaaaauuuuaacuagcacauuaacaacugucuucugacaccaggaaugcggaucuguugcuacacagcugaaagaugugucaggaaaaacgggaaaugacuauacucagacguuaauuuuauacauucugcuuaauuucaagcuauuuuaauguacccuuucucagaaaugggaagcagauggcaucuucccauucuuuuaacuuucucaacuucuaaagaaguaaauauaugcgaguguuuuccccuugucucucugaaaaagugucccuuugcagcaccaccuaaaaaagauccccaucuucccagggggagccuccccuuggccagccucucuggacagccuccacuccccaacacaaaguacuaagaggguaggcaccucggcgccuuguccuugaccuucugacucuuccuacagcgaucuuaaaagggaacuccugccaggcacgguggcucacgccuguaaucccagcacuuugggaggccgaggcggguggaucacgaggucaggagaucgagcccauccuggcuaacacagugaaaccccaucucuacuaaaaaaauacaaaaaaauuagccggguaugguggcgcgugccuguagucccagcugcuugggaggcugaggcaggagaauggcaugaacccggguggcggagauugcagugagcggagauugcagugagccgagauugcgccacugcacuccagccuaugcaacagagacuccaucucaaaaaaaaaaaaaaaagaacuccuucaggguaugagcuacucacagaauuucggaauguuguucucuuuccucaagaggcuuggccugggaccagcauuaccugucucagccccucugaacagcugcuucucuucugacuauagacuagagguggccgccuuuucuagccuaggucaaaugacuuuucugcuuccuuguuucuugcacaugagagccuuuauuucccccaugaacuccuuuggagucacaauaaaaugaacucagggccaaaugaagcuugccucagaauccaccucggugcuaccgcagacgccccaccuggaugagugcacaugcaugcacauacgcgcacaugcacacacacauacacacacauacacacacauguggacucugcuucaccuuguccaauuccccagagcugaagggccucccaguuucuuuucuccccaaauguaaauuccagguucucgccauuuuacaauuuuuucaagucuacccccuucgccagaccagugaacauuaccacagaagcuucuaagaagaccucaugaaagccacauagccugccuuccuuacagagaauauucuuccuuacagagaaaacacucucccaaacacacauuucuauuucaucgcauucaccccaacccaucugugguuucucauccaucuagaaaggauuucuuuuuguuguuucuucacuugcuuuuccagcuuucuaaaagcacuaauacuguaaaacuuagguuauuuuuuaggagcuucuuuuaaaaccuucaaaauaacuucauaauuaccaagauaacagaauuuaucaucagaaaccugggguaggcaguauucgaaaagacuugaagguggguaggcagguagcuggauaggcagguagacagguagacaggcagguaggcaggcagacugugacacucagcuuuaagguucugcuguuuucagcuacuugagccaaacggauaugaagaaggaguggggagacuauuguucaugcuacccuuucaaaaaacauugaaaaauuagaauaugcuucuauaugcccucuccacugccacccaaacuuuaaaagagcuuccuauaugucaagacaugaacagauacuucagauaaaugccaaaaauaaaaccuaugcauucuacaacuuuuaggugccuacuagcuaaagacaugagaaaaaagcucuagaaagcucaacuguaaccuauguagccaaagcacaccaaaacaugcaugagugguauggggauggcaaagcugagccuacaguccagugaaguuaauuagaacacacuuccaggaggcugagauucuuccucuaagugagcuuucaccugggcacuuguuagaaaugcacauccucaggccccacccaggaccuacuggaacagaaacucuggggauggggcccagcaaucuguguuugaacaagccucccaggugauucugacuccagcucaagccuaaauccacucagcuaaagaaugccagccucuccguauauucuuccuuuuuccuuccaaccaggcucagcuucuccuuuacggaaaucaccaucacccaaagucucccacccacuacugagaagagcuggguauuuuuauccugaggcaacuccaccaauaaacugucugcacaguacagagucucgagugcaacuagaaacuccacucaacugcucuucauccaacuuagaaaaaugugggcccaaacuggauccucauuugcaccuuaacauuucuuaaaagcaguuucaggaaauagcauauuaaguuaugacuuggacaaaaggucaaucuccaauuccagcuucaguacuggacagguauagaaacuugaaaagacaccaaagaagaaccucgagcccccugaacagaugcugccaaccccugagcaugcugacuccacucaguccagaaggcugcggggugaugaaaaauguucugaacuuagguaguggcgauggcuacacaacuuuguagauguauuaaaaacuacugaauuggccgagugugggcgggagcucccacccauaaucccagcacuuugggaggcugaggcaggaagacugcuugagcccaggaguucaagaccagccugggcaacauggcgagcgagauuccaucuccaaaaacaauguauaaauuagcugggcguggcacacgccuauagacccagcuacucagaaggcugaggugggaggauagcuugagcccggaaggucgaggcugcgguaaguuaugauugcgccacuacacuccagccaggacaacagagcacgacucugucucaaaaaaaaaaauuaaaaaggucucucuggucucagccacagaagugagaugaccguuuggaaaguguugcaauaggacacacacauugugccaccgcuguggcgugaaggccuaccaccuucagaaguugaccuguggcaaauguggcuaccccgccaagugcaggaggacguauaacuggagugccaaggcuaaaagacaaaaugccaccaggacuggccgaacgaggcaccuaaaaauuguacaccacagauucaggcauggacuccgugaggaaacaacaccuaaaccaaagagggcagcuguuggagcacuuugaucagcuuaagaauuucaacaauuagucaugcaguaaauguucugguuuuaaaaaaaaaaacaaaaaauaaaauaaaaauuaaaaaauaaauuuuuaaauuuauaaauaaaaauaaacaacuacugaauuguacaacuuaaaaguaaguaaaaagaugauuaacaguaaaaaaaaaaaaaaaauuaaucaaauaaacuccgaagcuggacccaagccucccuggaaaguccaacauuccuaaagaaaaccuucaaaagcaacaauaaucuucaaagacaaaucuucaaaggucaccaagcgccaucaccuaagacccaagagaggccaaguagguuaagugccuuacccaacacucagcugaguagcggcagagccaagacucgaaucugcuucugacaccagcucugcacccuuuccaagagagcaguguuucucaacugcggcucuguggaaguauuaucaaggggcuguaaguccauauaaaauuuuuaacuuugcaucuuaauuuaauguauaaucugaaaaaguaacaccugaaccgaguauguucuaacacacaaacucauugcucaaguuugugauuugugguuacguuuccccuaguacccaguagugucauuuaaauuuuucuugggcuaaugagaaaaaccagaagugaauuuaaaacuaaaugauguauuugugccaaggcuuaaugacagacuuauacaaaugcuugauauguaaaaaacagcuucucaguauaaaauaauugcaggacacaagauaguaccgcaugccaaauucaaaagaaccugcuugagaacagucaguaugauacucauguugcgagacaauuuaguuuuggcaaaacaucaucuauugcauuuaacuaacccuguuaauauaaaacuuuauuaguuuuguauuuucuuuuuauguaaugcauauaucugaguuuuauauuugcaaaagaacuccaagaauuaauuuuauacugaguuuuuuguguuuuuacguuaauucauccaacaaauauuuauugaacacugacuauggccagguuaagugccacaugcugaaguaauaguauaauaaaacuaguuuagauugaaacugaggaagacccacaggaauuucuuccuuaaaagaaaauguucuuuaacaucuuauucaaaugcuauaaauauugcuguacucugagggugcaauuuacuucucuuacuauuccucagugucaaaccugccuucaccugucuccccucaccugugugggaggacauuccgccccagcuuuucaauauauccuguggagugcugcugcugcugcugcugcugaggcacugcacacuugacacaggcugccugaucuccaggcuugugccuaccuguauuucaguaucauguaucucacuucacacuagcaaagcaaacagaggaacuauauuuaaccuaacugcuacacaaguaucacuuuuaauuugaaacuucguacuauauacuguguucaaaaaucacauaaugucacucuuaaaacuuggcucucuguguuguuuauaugcauuuucauuuuugcaauuuaaucagaaaagcccugccuggaacaaaauaaucugggaccguucaaaccacuagcccugccaaaagcuaaacaaaaccaagcccuaccuaaagguuaacugacuuuccacgccaucaaaacugaaauaucucaccugccuuuaugauuagaguacuggugcuuuucagcuuagcucacauuuaggaagucugaagagucuuaaaugauccccccaaaaugugugucuauauuucaaagagauaacauauaaauacacuagaaaaaccaaucacugaaaaauuacagcccuaaaccuaacacaaaguuacacaaaggaaaaaaaauuaaaaacacaagaaacacucaagauuauguaucgacaccaaaaaaagacuaaauaaauuuuuuaaaagguaagguaaccaggcacaguggcucacaccuguaaucccagcacuuugaggggccaaggcaagcagauugcuugagcucaguuguuuggaugggccuuggcaacauggugaaacccugucucuacaaaaaauuagccagguccgugguggcgagcaccuauaaucccagcuacuucagaagcugacaugggaggauugcuucagcccaggagguggagguugcagugagccaagauugugccacugcacuccagucugggugacagaaugagacucugucucaaaaaaaaaaaauaaaaaaaaauaagguggcuugauguuaaaaacaguugaaauuaauuauuauuuaauaauucuuacaguguuaaaggccauuuuucuuaccuaaauauaaaaaguuagggggaaaaaguacucaagauuuuuaaagaguaaguuuccuccuauaaaaagcauuauaauuauuacucaaguuuuguuuuguuuuuucuccugcagacgcuuugguguggcuuagaauguaucaaccuauacugcucucuacauagacauuuuuaccauuaaaaaaugcauuuaauaugacacucuaaagcuaccaccaacuaaaaacaucugaugaaacuuucuuuaaggaucaguacaaacuagaauucuauuuuguuugcuuacucuagagaaacuguguauuacaggaaaaacaaaaaaagaacauuaguucaaaaauaguaacacacaaaagugauuugaacauauuuagggagaacauuuucauuauaaaagguucauggugcugcauuaguuuggcuuuggaagaaugccaagugaaaucuagauccagagacuagggaaugcaguaguuauauuuuaagucaaacagcuaauuaaugacuaaacaaaacaauuuucagucuggacaacauauauggaguacuaauauacguaauuaugaaauagucauuugugaauucagacaguuguguuagcauaauuauuucuggcucuaggccuuaaaaauacuaacuuaaaaugcagaaaccuuauagcaguucaccugaugaagaugugaacaccaaacugauuaugaaacaagaguagguucuuuaaugaaugugcucuguguuuaauacauucuuucucccuugcccugaauauaaaagucaggcuuaaugcucaaguuacacacagguacaaaauuucuauuuuuaauauaguuuuuucacuauccauaguccacauacuaauagucauuaagaaucaaaacuaucgggccgggcgcgauggcucacguccguaaucccagcacuuugggaggcugaggcgggcggaucaugaggucaggagaucgagaccauccuggccaacacggugaaagcccaucucuacuaaaaauacaaaaaauuggcugggcguggugacgggugccuguagucccagcuacucaggaggcuaaggcaggagaacagcgugaacuugggagguggagcuugcagugagccgagaucacgccacugcacuccagccugggcgacagagugagacuccaucucaaaaaaacaaaacaaaacaaacaaacaaaaaaauacucucucaagcuacuuauggggugauagaaaugugccgugucuugauuuuggagguaguuucaccagcauacacuugucaaaaacucauugaauuaugcacuucaaaugggugcaguuuauauuguaauacauaaauuaaaccucaauaaauuguuuuaagcugggcgccguggcucacgccuguaauccaagcacuuugggaggcugaggcaggcggaucaccugaggucgggaguuggagaccagccuaaccaacauggugaaacccugucucuacuaagaauacaaaauuagccaggcaugguggcgcaugccuguaaucacagcuacacaggaggcugaggcaggagaaucgcuugaacccgggagguggagguugcagugagcugagaucacgucauugcacuccagccuggguaacagagugagacuccaucucaaaaaaaaaaaaaaacaaggccaggugcgguggcucaccccuguaauccuagcaccuugggacaccaaggcgggcggaucacgaggucaggagaucaggagaucaagaccauccuggcuaacacggugaaacuccgucucuacuaaaaauauaaaaaacuagcccggcaugguggugggcgccuguaguccuagcuacgcgggaggcuacggcaggagaauggcgugaacccgggaggcggagcuugcagugagcggagaucgcgccacugcacuccagccugggcgacagagcgagacuccgucucaaaaaaaaaaauaaaaaauaaauaaauaaaaaaagaaucaaaacuaucaaaauacacguaggagaaaacuuuuuuuaaaaaaaggaaucaaaacuacuuuccuaagaaaugagugucugccacuuuuuaaaaaaucauaaugcaaaauuagauuaacuuuguuacaacauuuuaaaaucagaugaagaagccaaacaauucuauaaaacgaaaggauuagaacuaaauagcuacaagaucuuggaaaagucaacuugauauugcucugugggacaaaaugagggauuaugggacucaaagucgggcugcagcggcugaacucccccgucccccacuucccggcucugacugcggguacauuaguuaacauauccauggcuucaguuuccucaucuauaagauaaggauagucaaauaaucuaucucauaggauuaacugaaagauuaaaugugaugauucauguaaaggacucacuagugccuagcauacaaaggauguucaauacauacuggcuuccauaauuagugcagccaucaucaccuucacuccuugugucaucuuuaccaccugaggaccaguauugguggcugcgggagcacaaucuaaaauugauuugguuucagauguaacauuuaauuuauucugcaauugcaaauaacauccaagaagggaaaggauuuuagguauuccaauggguuagaaaagguuaaaaguagcuuaaguagguccaacgaucucucuuaccuucuuagagucuuccuuuuagugacuuucagcuucaccaaacauuugcauaugaauccacaauauuaagacuauauuaacucuuuuuaauucaaaacuacauuacaggccaggaacgguggcucacaccuguaaucccagcaccuugggaggcugaagcggguagaucaccugaggucaggaguucgagaccagccuggccaacagggcgaaaccccaucucuacaaaauuauaaaauacaaaaauuauccaggugugguggcacaugccuguaaucccagccacccaggaggcuaaagcacaagaaucacuugaaccugagggguggagguugcagggagcugagaugacaccacugcauuccagccugggcaacagagugagacucugucuccaaaaaaaaaaaaaaaaaaaaaaacuacguuacagaauagacuugcuguaguuuagguuuguaggccuuugauuaaacuccuauagaguaaacaauagaaugaaaguuccuaagaauuaacaagcaacacagaugcaauuaagcucagagacaggcucuaucaaguaugcucucuugaccaaaaaauaacuacugucuaccuacacucccucaucucuaaaaggaaauguuacccaccuugcaauacuauuuuaaggcuuacaaauaauuauauaaaauacccagucaguaguaaagaacaggugcucaauaaaugguaggauggggccgggugcagugguucacgccuguaaucccagcacuuugggaggcugaggugggcggaucacaaggucaagagauggagaccauccuggccaacaugguaaaacccugucucuacuaaaaauacaaaaauuagcugggcaugguggcacgcaccuguagucccagcuacuugggaaacugaggcaggagaaccgcuugaacccgggaggcggagguugcagugagccaagaucaugccacugcacuccagccuggugaaagagugagacuccaccucaaaaaaaaaaaaaaaaaaaaaaaaggauggaaugagcacaaucucacucacaacacacacaguauaaaagguuuuuucaaacaaucacaaauauuuaaacacaggucugaguaaaggaauuccuuauuaguauagaggagucacauuauacccagaaauucaacuguacacauccagcagagagagcgagcgagcacacacgaacauggagaacagagaaagaugacaguugacauuucauacaggcagcucgagccaccagucuuacuuugugaacauaugcuguacagggagugagauggaaaacacaaaucuacugugcucucaacugugcgcauucccacacgccucuuccagugugagccccuucagugggaucuaagaaauagaguuuuuguacaacacagcuucuaaauacaagccaacuacuucaugugguccucauccaaaacacagaaaucuauuccaacucuggaaggaaaacgggcucuuaauaagggcagucugacuaaacuuuacuuuaugagcaagucaagggauuucacgggcaauuuugacuaaauaugauuuagcaugacauaggaccacaaagccccaaugagaaacaaguccacugaacuacguuuccuucagguuuucaugucaacaugaagaauggcaggcugaagaacguaagaaaaugccaauucccagcuagaucaaagaagugcuuuaguaacaccgcugauugcuuuauuccaccuauauuaccaaagccaguuuaaaaaaaaaaaaauagcagguuaucaucgccacauaacauucugcagaauuaacaauucguaggguaagucuucgcugucacacuuaauauuccucuauuuuuccaaagccaaaaaauaaaacaagaaaaaagucaagguccucuacagagaaaugagucaaccuguaaauucaguucccucauaggagcuuuugucagcugagcugacaauuaacugaaagaacagcccaucccaagggaaagggugcugcauggcuucacccaucagcugugccaccuccugcugccuccacccuucagaacauacgcuccucuaccuagauuucagcaugagugauagcugaugcaaaacaauccacguuuucccaucuagauccucaaauuugcauuacaccagugagagaaugggaugcauuuuccucucuguaaucugaauuauggcagccucuggccuccaagggaguauguggacugagguccagaaagaaaauaaggaaaaacuucucauuuuuuucuuuuaaucucauccucuauaaaaauucuuuaucggaugcuuuaaaacguaucuaauauacuaguaaggugcaacauguaaauaauuuagagguuuuauuaaacaugugaaaguugaaggguuaugcugaaaaguuucaaaaaguuuugaagccacugauggaaauaaucuaccaacuaaauucccagcacugcuacauccagcuuuauaagacucuucaggccacugauuuuaauucacuaagcaauuucugguuucaaauauaaugucaaaucauaguuaaaauaaacugccacaagacauggguccaugggaaaaaauaaaauaaauaagcugccaauuccacaggaaauauaauauggaaaaauacauacuuauuauggguuggguuacauuuauaaauaaacuagaacuaacguguauaauaauuugguaucaaaucuacguuucagggaauacuaagaaauacacugaguuuuuaaauaauucauaaucaaguuccgacuuauuaaauggcuuccaaauuauauaauacuauuuugcugaaagaguaacaaacuaugauuaagacuaauuuuaagcauaucuacuucauuuucacgucuaaaaaugucugaaauaguuaauaaauaacugguuaaacagcaggccucuaaacuagcaaacauuugucaaagcaaaaacauucugucugacgggaaaauguaauuuaugaaaaugaucaaaacauagaguccuucaaagaauuuuacaaucaguugagacaaguuaacaaagcuguaagguuccagugaguauuuaaaucuaaccugugauaaggaaagagacuuuuauccacauaaccucccaccacgcaaaacaaaagcauucugaaucaggaaguaguuagcgccaaagaaucuuuaaaaaauaaggcucaauaggcagcacuauuuucuucuugugucuuuuaacagaacugaguguccaauaaggauagggugcuaaauuugcuuuaacuuggacaucaauguugagccaaggcacacaaauggaacuuggcaaaaccagcaaccccagccaucugaauuaaaggaauauaacucccaaauugauggacguauacccaauucucaucaccacacuaaacggguauuaccuuaaauugaaauauucagauuucaaaauaaaaaagaugacaaagcaauccacuccuaacaguaagacuccuggauuaaaauuuaccaaaaaaggaaacaucauccaagaugauuaacuuuuuucauucuacuucauaaaucuacuuucuaauuggaugcuaaauacauaaucuacuguacagccuucaaucuuaauaaaaauucuuagcauuaagcaaacuuucuucauuagaaaggacgaaaagcuguuucacuccuaugaaaccugcccuuuccaacucuacaaaaauucacauugucaagacacuacacauucuguggaacagugggacuguauauuuauuaauucaugaagacauaacaacuaacguuuaacuggcaugcaggcaggguuaaccacuaaaugcaagacacuaaaaugcaagaaaacacagacagaaacucaugcuacuuuaguuaagucaacgugcacauuguguaucuuucaaugcaagccaagcagaucagagacagaucaaaaaacauguugguugguuucugucaaauccagauuaaauaaugucauuuacaauuuccuagaucaguauuuuaaauuuaaagcuaacauaaaguaggacuaugugaagcaaccuaaaaaauuugcccuuaaaauaauuauacccuuaaaaaaagaaacuuaucuaccucauuaguguuccagcggugccucucuuuugguaaacuugaacauuucggcagacauucaagcagcuuuuucgguaaaaagauuuuuacaugacuacuauugcuguucccaugaucaucuacaaagaagaaaacaauaaauuuagagaaaauaauagauaaaaucuccuuuaaaguacacugacaaagucagaaauagcagcucaguuuagucaaugugagaccaagagcaucagaggccccacuauuccucuuaguuaauaauacucauuuacccauuuaucagauugauggcagcaggaaucuggucaagaggauuuaaaacaggaucgggcuugugcucccugacaugugagugaacagggaaaauccccgcagcugcccauaaccgaaaguuauuuuaaaagguucuuuccccauguuuugaugaagcacauaaaaauuauaaaauuaaccucacaaagcccaaaaaucuuuuauuaagcaguugaaaaaauguuaaguuucuuagguaagaagaauuauaguaauauaugacuauuuuguucguaaauacuacuucauccccuagacuauaaaagagauuuauccuuucaaaagcaaaucacaaaucuuauaaauauaagggauuuaagccugcaguuagcuacucagguaauacagaagcuggccuuucuaggucugaacauaaaaucaucauuuuaauuaacuugauuuacauauacauaucuacauaauuaauguauuucaucaaaauguaacucuucuaaaugaguuagagaaaaaauaauuacuuucagacuagaugguaugucugacuaccuaauaaucagucuaccugaugauuucuagaagagaucauuuccuuuauauaacauuuauuucacucauuuguuugcuuacauaucauuuauuuuuucacuccuauaacaaaguuucuuugccugacucaaaauuucucacaagcuuuggcacauuuaggucaaaguuacaaauuauucaucccaggcuuuuuaugcuacauaagauccccaauauacaaaggguacacauaacuagguacuaaggagcugcacauuaaaacaucaaagacuuaauuugcuccaguaagucacaguugaaacaacuuuucaugauauaauaagguuuuauaacacugaacucagagucaagaguccaagaucuggcccaguucugcuacuuucuaauugugugaccuuggguaaguuacuuaauaguuucaguuuucccaaaucaacaagauuagauuaucucuaauucuucuccagacacaaaucccuauaaaauuuacugucauuaaauaacuuaauaggccuuacaauuaagcaaccuuacauaaguauacaggcauugguuaauaaucuuaaaagugaaauacaacaauaucuuuuuccaguuauuuacuacggcuuuguucaguacagucuauuuuuuugaacagaugaaaaacaucaaagaacaaaaaauauuuucuaaggucacaaaauccucuccaaacauuuuucaucugauuaacacacuucuucucaaggaaaagaucuuaaaaggaaaauauugggcauagaaauaaagucuaaaaaauuuacuacaucauauagaaagauuuuauggagaugaacuuaagagaguuuuggcauacuaaaucuuuuuugguccaugaacuacauaaccaauugaauuauaauacccauccucuauuucuauaagcaguauaaaaacuuuaaaaaccuaaaaacugacugcuuucaagaauuucaaauuuuaauuuaauaggaaaauaagauuaaaccuuucaaaaaaucuuccugugaaaccaaaaggaaacuguucaacuaaaagaaaguucauagaaaguucuguaugaauuacacacuauaaaaccucgguaaucuuaugugcuuaugcucccugcacuucauccucccgagggagguuccacgggccauaaaacuuuaaagcagagaauaccagaucacgugagccuuuaccucccuucucucuuccccuaaaguacuuuuauuuccauuuuuuaaaaucccccaugauauguacaauucugaaaauagaggugaaauucuaaaaucuauacucaauucaaauauucaacauuuacagguaccuuuuaugaaaacggcacuauacugguugcucaauggaugggcuugcucugaauuguauaugaauagccauaucucugagaaagcuaucaguuugaaguacaauucugaacacuuacgagcagaguuuuaaaccccagcuucuauguuugugaucacaaucugauguuaauuuucuguucuuuuagccucuucgaggaacccagcuacugugcgguauauaaagagugugcguguguguguguuugugugugugugugugugugugugugugugugguauuuauguaauaaagguacucuucucaacagcacaauuaacugcuauagaaaaggcuucagucuuccacucugauaccaaaucaggcagugguaaaugugaccaaagggcagggcuguguaagcacucucucaaucuaguuucuaaacauuacacuuuacacggagguguggccacagagucaaaaggaacaggaauaugacuggccaguggguuccccuugaucaguuuuuaaaguguaccauuuccagaauuuuagguucacgcugaauauaaacuggauguuuuuaagaaacauaacaauggguaaauuuuccuacuacauuauaaggauugcgaguuuaauacugagaaaagaauuacuggaauuucaaauaggcaaaauguuaaaacucauauuuuuaaauuucaguguuucuacaggugaagugggauacagagaaacuuugauuuuacacuggaaaagaacuuuacauggcuauacugcauaaaaaucuguuuuuaaauuaaaaucugcuuuuuaauguuuugggauaacuaagaaugauaaaauaacuaaacacaugcaccaguuuucaaauccuaauaauaguaucuugagugaacaguaaaauuaaggcauauacugguuuccacugcauuauucaguauucaauacaaauaguugaacuuugacacugaaaagugggagugucaaccaaaugacaguaaaacacuucauuaucauuaucuaacaaaauauauguguaugguauuagacuuuacaaaauaauuuucuaaccuacuucacaauaaaaaaauaacuagugaggcucuugaaaaugacagaugauuugcuugacugacaacucuaauucuaaagaacgaaccauccuuucuagucaaccuacaagguguaguauaauauaacuuuccaauaugcaaaaaaaugcucauucacuuagacaaaaagcagaauuacuguuuucauguuuuguuucaaaaaaaugagauucacauugccaaauccuuuacuuaaauccaaagaaauguauuugaccuuuuccuucgaaaauucugugacuucugccaagguaaauuauaacuauauuaacuaaucuagaaaugauacauucauuuuacuuugauucauaauaaaaaauaauguugguucuaugaauaaugaugaacacuguuauucauucaaguugauuacgauuaaucuuucaaacucuagaccaaacuguucaaacaguuugguauaacaguguaucaaauugcuaaaucuuauugggaauaucuuugaucaacaacauggaguaguaaaaucaaaaggaagcucuacaauuuucuguuuagcucuaauuauuaugugcuuagauuuaauuaguaggauaggaacugaaaacauaaacauauauuguuauauucaagucagcauaaugcucacagcagcaaauacagccauuacuaaccuaaggccuucaaaucaccauauauccaaaauacauauuaauuaagcacuaugugccaaacacugaucugauuuugcauuauucuuuuccaaagucuccaaagugaauuaaacccaguaguaauucuacaaaagauuuuuaaaagguuaaagaaacagaaacuaacagcuuuuuaaguagaaaaauauaauuaguuuugcuauuuaacaauccccuucuuguucuuagaguugugugaugaucaacuuaccgcuucuauuuuuagguagcccagauuuaccuuuuuccuguugaucauauuacaaaaucucggguccaggcuuaggucaaaucauaacucagguucaauaaacuucucacuguuuaucuacauuuacauuuucaaucuaaaaauauguaugagggaacagauaaagugagggcacagcagcccuguaagccaucacuucaauuuggguuuugggacauucucuccuccucuacuucauucaauuccaacuggagguacaugugauuaaguaaaucuauuuuccauuauuuauuagggaguaagcacuugugggacucuacuguguaucaggcacccagaaaggaucuuacauugcacucuuucauuuaauccucacgauaaaacacaagggcuuaauuacucccauuuuacagaggaggaacaugaggcucagauuaauuugcccaagauccacagcugcugaguggcucagcugggauucaaacaugaccuguggcuuuucccaaaauaccacacugcuccuacucuaagucaccugguauuggacacuagaauuacagaaguguuguauuaguaucaaacauuuguuaagugcuuugauuucuccgugugauuaaaucuuuugccuuuuuucaucuccacagaaacuuuaugaggagagcauucuuuuugcuaccccagaaggauuaaguaacucaucuaagaucacacagcaguuaagugcagaacccaggucuucugaguccgggcugaaggcuguuuccacuguacuagaugauaauuacugccacugccaagcccaccccuuccuguaagucaaaagcuuuuucaaauccuaccuucuauagguggcacgguguugagaacacaguaggugcuaguuccgcagaauacacuuugggaaacgcucuaaggaaacagaaaauaaaauguaaaacuaaucuuucaaaaagauauaaucuggcucuucugugauauuccugccaagaugcaaaaccugaaucuaaucaugaggaaacaucagacaaauccaaaucaaggaacauuccacaaaaugacuggccugcaauccucaagagugucaaggucaugaaagucuaaaaggacugaaaacucuucuguauuaagagauugaagagacaaccaguuaugacccaagguucugauuagauauuuuucuacaaaggccauugcuggaucaacuggcaaacagcaacaggacuuuaggacuggagaguaggaaugucucaguguuaacuuccugguugugauuacuguucuugugguuauggaggagaauguucuuguuuguaggaaguacaugaucaaguauuugagagugauggaacuuaucagcaauuuauccucaaauggcucagggggaaaccguucuuugcacugcaagcuuaaggcugcuucaaaauuuuagauacauaugugagaaaaggucugugcugaugaacaugcauaacuuguguaauuuguuuaaaugggaaguaugugugcuguacauagaggaaauuuuugcuaagaaccaaugucauauucauuuugaagcucagucaacaccaacaacauuuuuaaccauuucccaacaauaaacccaacacccgacucacccaaaaaaugugcagagcgccaacuaguauuauggcauggcaaguaaaucaaggggaauuccguuaacaggaaagaaacaaggucucuggcugucaggcugcuucacucagauaaaauuaaagauuucaccuaaaaccuacacaacgguaacuuuuuaaaaaaaaagaaaauuuuuugaauauugacggccaauuauuuucaguccuaaaaauaucuuuuuuguuuggcugcaguauuaaauaaaauuuuagauuauucauccuacauuauaaaccacauauuuauacacuuagaaaaccaaagauaguuuacaaguucaacaaccacccucaacauuuuauauuuaaaagcuaccaggcaugguggcuugugccuguagucucagcuacucaggaggcugugguaggaagaucgcuugagcccaggacuuuuaaggcugcagugaaccaugauaacaccacuacacuccugcuccagccugggcaacagaacaaggccucaucuuuaaaaauaauaauaauaaauaaauaaauaaaugugguggcucaugccuguaaucccaacacuuugcggagccaaugcggguggauuauuugagcuuaggaguuaaagaccagccuggauaacauggcaaaaccucaccucuaccaaagauacaaaaauuagccaggcaugguggcaacacaccuauggucccagauaccuggggggacugagguaggaggauugcuggaauccgggaaguugaggcugcagugagccaugaucacaccacugcacucccgccuggaugacagagugaaacccugucucaaaaaauuaauuaauuaaaauaaaauauaaagaguucaguucuaacauuuacuagcuguccuuaggaaaguaauucaaccucucuguacuaccucauccaaaaagggcggguggauacuucucucuccuucucucugaggcaggaggaggauuagguaauacauacccaagugcuuucaauucaaagguaccacccaaauacaaaacacuauuguuaccauaguuaaugagggugagcuuuaacaauguuaacauuuucuaagaacaaacaggauugccugaguuauuuauuuguuguuauuuguuuguuuguuuguuuugagacggagucucacucuguugcccagacuggaguguaguggugggaucucagcucagugcaaccucugccucccagguucaagugauucuccugccucagccuccugaguagcugggaucacagguguccgccaccaugccuggcuaauuuguguauuuuuaguagagaugggguuucaccauauuggccaggcuggucucgaacuccugaccucaaaugaucugccagccucggccucccaaaaugcuggaauuacaggcaugacccaccgcgccugaguuuuuuaugccaaaaaauguugcaaucugacuaaaguugacuuccaagaauuauuaauuuuccucucccuuaugcccaugaucaagugcuucagaagucaaauuguuuucaggguccauauaaauaaagucuuucucuauaaugugacuccuagcuaccaggauaaccaugagcuccuuaauucuuucuuuucuauuucuguaaaacucuuguucuaggacuguuucccucuccaauuuaaccaauaguaguauacugagcuaggcacaguggcucacgccuguaaccccagcuacucaggagacugaggugggaggaucacuugagccaggaauuugagccuaaagugaaccaugaccaugcuauugcacucuagcuugggugacagaaugagacccugacacaaaaacaaaaaaaguaguuaacuaugauaacaucugugguaacagucauguccaaggauucacccuauagacuagacaaggcucggaauucauguauccuuuggaaaauccaacauuacuuucuacccaugacugugagcauggaaucaucauaccuuaggaaaagugguucaugggaagaucuccaauaggggaaaagucagcagcacgcugacuucuuguaacaucuuuaagagucaccaguaacagcccacuaaucacaugaauguaauaccucauuuuaauuuaguuucugaauuaaaacuugaaauuuuacgauguuaaaaauaaugucuuacauucaaggcuuaacauuuccuggcuuccuauuaucaaaaacugacgguauaagauuaccauuugagauaucuuaacaauggucuuaggugaaaaguuuuuaaaaaucacuuugguucagugggacacacuaaugaauagcuucauaaaaaaggauuuuuauacccaacuucaaagucuaacaauaaguaaaucagugacagaauaucugaaauaacaggaagaacuuggcacuaaaauaacauaugacacagaaauaucauagacaaaaaccaaucacacucucuccacagcacugcauaaugaagucuccauaguuaacuaggaaagaaaccaaaguuaaaacugaaaucaagucauucuaucuuugaaaaccauagguucucaaaacaagccaaagcacaaaaaaacuuccaugauaagaaagggcuaccuuguacuagauaccccugugccaaacacugggccaggaacuuucacaggacaacuucguguuuugaucucccucuaggcgccugucugcaauacuggggcggcucugccauagagggaggcgggcuggccuuaagcaccugcagagccgcggugguguguuccaguccaccacucacuacuaagaaguccgggcaaaucagugagccacuguguccacaggacaacacaguggaauggaaaagcacaagcuuucaagucagaucuggguucaaguccuuccucagaagcaggucuucaagcaccucccccgcugauucugcacuucaacucagaccccucacccuucaggaagccucucgcccacaggguaccuuuagaguagccuguguuuuccucucacagaacacauccuucuuuaugguagcuccuuccauuuguucuacaacuauuaaaggagcaccuaacauguaccagacacuguucgcaagcugggacacagcacugaacaagacagacaaggguccuguccucuuggagauacauucuaguggggggaagacagaugguaaaugggacacuauccaauagggguaaauuccuauaaaggaaaugaaauggagugaugcauuacuguaaaaauuugauaggauguuuuucauuguuucugaauguacagccaugguggaguggaaggaauacuugauuagagcaugaagaaaccuggauuccaucauuaaucaaaucaaugguucucagccuuagccagucaucuagugaaaucuccaaaacucugaugcccaaaccaauuacgucagaaugucuggggaugggacccaggccucaguauuuuuuuaaagguccccaagugaucccaagauguauccaagguugagaaccacugaaauaaacaguuguaugacugggcaacucucugacuuccccaguuuucucaagagucaaaugaguaguugaccuugagcagaacuucuccaaauguaaugugcaugcggguuaucuuaggaucuucuuucaaugcaaguucugauucacaggucugagggagaaccugagauucugccucuaacaagcccccaggugaugcccaugcugcaauuaauggccacaccuugaguaucagaaaccagaugaucaaacuaaaagaucaggaauuagauaaaugaucuauaaaagauccuuccaauccuaacauuccucaacagcauaauuccacuaauuccuagaagauuuaaaaaguacuuucaucuguuaguacauaauacaaaacuauaccagaauauccacacaagauaauuaguagaaacucuagggaugguuacucaaguauagugcccaguuucugcuggaaguacccaagaaggcugggcaugguggcucacaccuguaaucccagcacuuuggaaggccaaggcgagaggacugcuuaagcccaggaguucaauaccagccugggcaacauggcaagacucugucucuacaaauauuaaaauauuagccaggugugguacugugugccugcagucccagcuaaauggaaggcugaggcaggcggauugcuugagccugggagaucgagguugcagugagccaugacagcacuacugcacuauagccuaggcaacagagugagaccccgucucaaaaaaaaaaaagaaauacccaagaggagagaugcagagcucuauaauauauauucccuguuuucaaaaaguauacuaucuaauugaaacaauacuuuuaaaaaaagguaaugaaaaaauaauauaugacuuaaagguuaaaacaagggacagaugauagcaguauggaaauucaguaacuaccuggcuaucaagcagaaacucuuugaagccauggacuauguuuuauucauuuugucuccacucagagaaccuagaucaggauguuacacacaggcacauucauuguauauggauaauauauacauauauuagaguuuuuggaagauggauuaaugaaacaagaugcuauauaguaagaagugauuacaggcuuuggaacagagaaacagcauaaugaaaaguguauuuaccguucuuugaaauaaagacaaagaauauuuaggucuccacagaauuaaagccgcgccugaaucuuagcaccuuuacuacuuagcaccuuuacuauuuuuuaaaaagaaaaaacuguagauacgaccucucaguccaguuuugcuuagcauccuaggcaucgugccuagauaguuagggaggcuaacuguauaauggcucaaauaccaaaaauguucacuucuugcucagguaaaguccaaaacaggugcuccuggugggcagacuguucucacagcaguggcucugcugccugugcuccuucuaccuuguggcagaagacuuucuaggucacuaggcccucugcaucaagccagauaaggaaaaggcaugauacccaugccucaagaguuucaggggccaagucuggaaguggcacacuucguugcucucaccccacuggcuagaauuuggucacgauuccaagggggacuggaaaaugcccaggaagaggaggaagagaaggagauggguuucaugaucaacuagcagucucugccacaguaucuucuguaaacugcuuuuuaauuacaaaauaguuacuccuuucagaaauguccucugcuaaccuacaacuccauuuucaaucccuaaggccauucgggaucuaaaaccaaucuaggagguuuccuucuccaauaaauauuuuccuaacauacucaaaaugagauuuuaucaaaugcauccuugaaaggaugucuggcuuguucuucccaguaucucugguaauacuuaauacaaugucugguacauaacacaagcucaaauuacuuauagaauucauaaauuaauaaccagccccuaaguuuauggaaaggaaaaauggucccgucucucguccuggugauggugguggaauuuacuaaaagccuucugucguuuucaagcacaucucuuccuauaaggccaccgaauugccacucauccucuuggucacuuugauuugcuaugucuugguacugugccacugagacaaaagcaagagacugaacaagcaguggcucgaaccuguagucccagcuaccugggaggcugaggcgggaggacuguuugagcccaggaguucaaggcugcagugagcugugagcugugccacugcacuccagccuggacaacagagcaggaccccaucucuaaaaaaaauuuuuaaaaagaaaaaacuguaaauacgaccucucaguccagcaauguugcagauauuuuuaaagaaaggaaccuuaucccucuauucauuugagaaaucaaggaauaugauaaaagcuacuuuaaaccugcuuaaaaaaaaaaaaaaacuuaaaaggaguagggggaauacucaacaguuuucagagauaccaagaaaaccaaacuaaaacugggggcuagagcacaauuaauuauuuaauuaguauuaauuuaugaauaauaaaugaaauaucaauuuauuaauaauaaauaagaaacagcacaaggucugucaaaagacauguuucagagacacucccuaaaaucagguuaacgauuuuaugagaugggcaauucaacauguaccccaagcccaaguaacuuuauucuuuuucugaaccacaaaagguuagugugggaaaaaauuaugugcuacaguacaaaaauauuaugugcucacauauuaccacuuuucaagaaguuuaaaauaugccauuaagugcuacuauacuauaauaacccucacaacucccccaugggauagagacaaaaauuaaaguauacagucaaguuaaaaggaaaaagucugguagguagccgacuuccuacuccuggggcaggcuaaauaaaaaaaugaaacaguaaccucuaagguaauuggggcacaaaccauuuuaggcucucaaauugaguucaacaccuagaauugaguucaaaagcaaacaaguagcuggaacagacuacaaaacaguucaaguucuaagaggcugacacaggaacuaauauuacaauauaucaagccagauuuauggccugagaaaucagauuaauugauucucuauuaccagagaugcacguaaagcauguuuaaagugauuuuacaguuuuuuuuaaauuauucuuucuagauaugaaucacaguaucauuagaauuuucauaaauuuaauuuggcuuggaagccaguauacucaaagucugaaaauaaucaaagagcacuuacuaaauguccacauuuguacaaauagauucaacuagaauacauucaguaaaaaaaacuguauaacauuuaaaaugauauuguuucaguaguacuuauuguuacccauacuaaugauaauuuuguuuaacuccucagagagagcauuguaaaauaucaacaaaaucaacccaacaaacuaggcauucuauucaauauuauguacguauaacaagcauuuucauauauaaaaucuuauuucgauccuaaaagguagcaaagcacacauuaagccuauucuagaaauggagacaccaagacauggguaacaaggcacugggcaaaggccacaagcuaggacggggcagaauuagaaccagaccaguucucccauacuacugugugauuuccacaagaaaacacgguucucucccuaauaaugcagcaacgcuucuccacaaagcagcaaugcaaaaaugcgggcagaaaaaguaaguacgaugcucugagagaaagcuaaggcaaacgcucccacugaggaacaccgagcagguuagcugggagggagacauccugaaggagaagagagcgguggaacagaaugcuaccacauacaccuagaaggugaucuugucuaaagauccuccaugccucucaaacauuuuuugguccaugaaccacagaccaccaucaccuaucacuacuugcuacugcccaaagaacuaaaaccucaucaaaacuaaagaagagaaugacacuguuucucguaacagagcaaugagguggacgccaagaaaauggcagccacagccccggaauggaggucggcuaucugggaaccucccuuaauccgaacacagccagaacuaggaaggaagccaagaacacucugaaggccaaaagugaauuuuacgaaguccaugcacaaaagcuuauguacuccacugugagaagaguuucuccgacccacauucguagcuugauuacuauaaaacuacucacagcucuaauaugcuucauuaucagguugccaagcccagagaucagaagcaacaaaucggaggggaaaaaauguagcucaaaacugacacacagaagcaaaagagugacaggcaacggcaaggugagauuguuuuuuuaaacaauaaaaaugggacacaaggauuugaaagguauagcaguuuggggucauuuaucauaaaaguaaacucucuacuccaaaaacccaaaucacaguguuaaauaaagcccaguuuaauaagcuacauacaacauaaugaacccaaguuauuaaggaaaauguaaguuaaauuccauggguucuacuuaacauagagaaaaagguagcaccguuuaauaccuuuuguuugcauauuacuuuguagucuauaaaacacuucauaugaauuaccucauuugauccucaacaaaaccauaaggcaagagggcagauaccuccacuggccaggaauuggcugguaaauaauuccauuuuagccagacagauggauuuaucgguggcaacuguaacacagaauguucauuugucuaacaggagagagcacauagaaggcacaugaagacaaagggcacagaaggccuccugagaagcgucaccaccugacuaucccaacuuucaacuggaacugcacuuccaaaacuuccgccucugaaagcucccguuuuuccaucugcauccuccaaggccucaccugaagaacuguuauaaugccuucuaaucccgucaccaccccucuacgguggaggacaaacuuuaugauggaccuccuaugauccccaccucuugauguuaacagcuuuuuuuuuugaaacggagucucgcucugucacccagacuggaguacaguggcacgaucucagcucacugcaagcuccgccuccggguucaugccauucuccugccucagccuccggaguagcugggacugcagguguccgccaccacgcccggcuaaauuuuuguauuuuuaguagagacgggauuucaccguguuagccagauggucucgaucuccugaccucgugaucugccugccucagccucccaaacugcugggauuacaggcaugagccaccgcgcccagccacuguuaacagcuuuguguaacccccucccccggagugugggcuggaccuagcaaguugcuucuaaccagcagaacauggcaaagguaaugggcagacugugacuucugucuugcuagagacugucccuccuggcucugaugaagcaagcuaugguguugcagaggccccuggggcaggaauugaggguagccucgggccaacagcuggcgaaaagcugagcccucagcccaacagcccaaagaaaggaguccuucaaauggccaagggagccuggaaguggauccuccccuaccagagguuuccaaggugagcccaguccuggccagcaccucgaccacaguucagcagucccaauccagcagacccagcccugcccugcccaaaugccugacccaugggaaccaggagauuccacccugggcuguuugaagccacuggguuugugaugauugguuacagcagcuauagauaacuaauacacucacagcccaucaggccacagugguuucuuuucucaucuuggacuggaucaaucauuucaccaucauuucuaccaguacucuguauaugccaccacgguucugaaauaaucauccacccuaucucuacuccuuuauucucucauuaucgaauugacaaaaccaauacccuuccuuagucuucagucuacucaacucugcagcauuacgacugacaaccuccuuucaacccuccacacucagcaacccugaauucauauucugcuuguucccuuaccucuccgaccauucuuucucagccucuacugguucucuccccucugguggcauuaaaauguaagcauucaucacauuucugcccucaggccccuucucugcuccccuuccaaucucacucacaacugugacuucuaauuguuuugaacugauucauucauugguugcaaagguacugucuguaccuuuugugcugugcugcugccacugcaucugccccuccagaccuccucacagcccuucucucccugccccaagcccagggggcugaccucuaaggacuccagcaccaaggcucccucccuugcccucuggaagaacaaugaagaaaaaaagcagggugauaugaaggacucccugaucuuugacccacaucuccaaugucacgcuguauauacacauucuaaagcuacccaaugacgccuuaaaaacagcgauaccggccaggcgcgguggcucacgucuguaauccuagcacuuugggaggucaaggugagcggaucaccugaggucaggaguucaagaccagccuggccaacauggugaaaccccgucucuacuaaaaauacgaaaauuagccaggcaugguggugggugccuguaaucccagcuacucgggaggcugaggcaggagaauugcuugaaccugagagguggauguugcagugagcugagaccaugccauugcacugcagccugggcgacaagagugaaacuccaucucaaaaaaaaaaaaaagaaaaagaagaagaagaaaaacagugguaccuuugcagccauucuccccaaauauaccugccuugucuucccuaucucagucuggccucacuaaauccccaguuaugguucaaaaccuaggagucaccuucccucaaggcccacauucagucagucacaaaauugcaugugugugugacacacacacuccucagccaugcgagcucuuuccucaccccaauucuacagacaacucuugccagaagugauuuucucccgacucuaguccuuccuauuugcucauucauucauucauucauucagccaacaagcauuuacuaagucuagguacucaagccucuuaccuccagaaaugcacaucuaauugagagagaaagagaaguaaacaagcaacuccaaugcaaacuaaaaugugccaugacuaggaaaaccacguagugcuauggugcacacaggaagggcauccgauccaaucugaaaagaggggcaaggucaagaaggcuucuccuauuggaaguuucauuuaagcugaaacacagaagacacagaaagucagcaagagcaugggugagcgugugugccuguguuccugaggcaggugcaacuucuaaaucaaggcaacagcaaugugggaggccuaaaaccaccagacacugugggaccuuggaacaaucagagucuaaaaaaugugacgugacuguagagaggaagcuggagaaguaacuagguggcccuuauuagcaccuguuucaggagaaucgacuuuauccaaucaauuccauuccucuacuaaaaaaaaaaaacuucuaaaagccucuccugagcagagaauuaaauccagauucuucggucugacuuucaggccccuaacaacaugaccccuaccuacuuuccgaggcuuaccuacccauaugcacaugaauuccacccacucccuguacucucuuggcucuaugccucuguuccauuuccucugcuuggaauuucuccuccaacuaccauguuugcccgucaaugauuucaggucaaauuccaccuccucccggaagucuuuccaucuucccuuccagagccuuauuaaagcauuaugacuugucuugaaucacuuacauccauaucugcuucccuacagacuucugucacuacagacucugucccugacaggcuucugaaguauguguaaacagaaaugacuccuaauuucaaagucuaggaaaaauguucagaaaaguauucaauuuaccacuaaagcaguucuaaauagcuaaccauggaaggucacaaagaaauaauuuuuuuuuuuuuuuuuugagaugaagucuugcucuguccuccaggcugaagugcaguggcacgaucucagcucacugcaaccuccgccuccuggauucaagcgauucuccugccucagccucccaaguagcugagacuacaggcacgugccaccacgcucagcuaauuuuuuguauuuuuaguagagacgggguuucaccauguuagccaggauggucucgaucuccugaccucaugauccacccgccucggccucccaaagugaaugauuuuuuaauuauaugaaaacaaucaaccaaaagccuagauuucuguauguuuucauguaaguaucuguaaauaaaaauggcuacagaaauuuaaaaaacaguaugugaacaagcucagaaagaguaccugcucagccacaaggcauuuaagggacagaguaaaggccagagccaaguauucagauacucuuucccaaaagugauaaacaggauauaaccagaguaucuccacacaacucacuaacaaacucacccaauuaccuggaacuuuucuccuuaauucuucccacaauuaauucccauuuuccuccagagcucucaagaagccucccccaaccuugcagauuagucaaaucccuuuaugacauauugcacgcaccuucacagcacugagucccagcugaaauuucauauggcaucuugauuaauguccgucucccccuuagcuccauaaggacagagacugggucuguccuuccuugugccuggcacagauaggcacuuuguuauuuguugaguaaaugaagugacuuaaaaguauaacaauaaccaauguucacguggccccugcgggacuacaagguccuaaaauaucuucugauuccuccaguaauaauaacaauuauauaaauuuuaaugucacaauuuuauuguaacauguccuaacucuuugauaaauauucauauauauaaucugcuaguucucuauuaaccagaauguauauuaaccagaauaccacauuuuuuuuaaaacaugcaagguaucagcaaacuuucacaucaaaaaaacauuuacuacaggaagucaaccuacacgcuacguggaagagcuguuugcucucuuagaaccugaaaaguccaauuccagucuaacagugaauuacaguguuucaccaaggcagccuacuacaucaauaaauuaaaacaaaauuuuguguuuuuaaggcaagaugcuugggugucugaguuagccaggacuuccuaagcauacagcaaauccauaaaaugaauuuaaacuccccaaauagauccucagauugaauauaauccccauuauaucucaguugucucuucuguggaaacuaacaagcugauccuaauauucauacggaaauacaagggagcuagcacagccaaaacaaucuugaaaaagaagaacagaguuaaaggacugacaguuccugauuucaaaacuuacuacaaagcuacagaaucaagacauugugguaauggcacaaagauagacauauagaucaauggaauagaaucaagacucuaaaaauaaacccacagauuuauagucaguugauuuucaacaagggugccaagacacuucagugaggaaagaauggucuuuucaacaaaugggcuaggacaacugaauauccacaugcaaaaaaaugaagcuggaagccuaccucacacuguguacaaaaauuaacugaagaucuaucagagaacuaaaugucagagcuaaaacuacagaacucuaacaaaaaaacacagguguaaaccuucacgaccuuggauaugacaaugguuucuuauuaugauaccaaaagcauaagugaccaaaaaaaaaaacaaaaaaacagauaaaugggacacaaucaaauuuaaaacuucuguucuucaaaggacacuaucaagaaaguaaaggccagcacagcagcucauacuuguaaucccagcauuuugggaggccaaggcaggaggaucacuugagcccaggaguucaagaccagccugggcauaauauaauauagagacuccguuucuauuaaaaaauuucuaaauuagccagaccaguggugccccccugaagucccagcugcucaggagacuaaggugggaggaccgcuuaagcccaggcaggcaagacugcagggagacaugacugcaucacuacacuccugccugggugacagaaugagacccucucucaaaaaacaaaagcgaaaagacaacccacacagaaucagagaaaaaucacauaucacaugucaaucauacauuugaaaucacauaucugauaagggacugauaucuagaacacauauaaagaauuccuacaacugaacagcaaaaauucaauugacucaauucaaaaauggaagaggauuugaauagacauuugucaaagcagacauacaaauggcuaauaagcucaugaacagaugcucaacaucauuagucacuagggaaaugcaaaucaaaaccacaauaauauaccacuucccaucuacaacaauggcuauaaucaaaaagauggacaauaacaaguguuugcaagaauguggagaaauuacaacucucauacuugcuggugggaauguaauaugaucuaaccacuuuggaaaaguuuggaaaacaguuccucaaaaaguuaaacagaguuaacuacgacaccacaauuccacuccuagguaucuuuccaacagaaaugaaaacauauguccauauaaaagcuuguacacaaauguucacagcagcauuuuucuuaauagccaaaaaguggaauaacucaaaugucuauuaacuggugaauggauaaacaaaaugugguauauauccacacaacagaggauuauucaaaaauaaaaggagugaaguggccagguguagugguuuacaccuguaaucccagcacuugggaguccgaggcagaaggaucacuugagcccaggaguucaagaccagccuggcaacauggcgagacccccaucucuauuauauuaaauuuaaaauuuuuuaauuuuaaaaaagggaugaaguaacaguacaugcuacauacaacauagauaaaaaccuugaaaacauuaugcuaagggaaauaagccagucaagucacaaaaggacaaacacuacaugauucuauuuauaugaaauguucacacuaggcauaaauaugcauaaagaaauaaagcagauuaguaauugacuagggccgggaggaggaggcaacagggaguggcugcuaauggguacagauuuucuuuuuggagugaugaaaauguggaauuagagaguggggacaguugcacgaaacauguaaauauacaaaagaaaacccacucaauuauauauuuuaaaaggguuaauuuuauaauauaugaauuacaucuuaagcuauuauuaaaaaacaaaucaggcugggcacaguggcuuauaccugcaaucccagcacuucgggaggccaaggcuggaggaucacuugaggccaggaguuuaagaucagccugggcaacauauugagacccugucuuuaccaaaaaaaaaaaaaaaaaaaaagaguuucgcucguuucccaggcuggagugcgauggcacaaucucgacacacugcaaccucugccucccggguucaacugauucuccugccucagccucccaaguagcuaggauuacuggcacccgccaccaugcccagcuuuuuguauuuuuuuuaguagagaagggguuucacccauguuggccaagcuggucuggaacuccugaccucaggagauccacccgccucagccucccaaagugcugggauuacaggcgugagccaccaugccuggccaaaaaaaaaaaaauuuuaaucagcuaggcauggugauacaugccuguacuccuaaccacuugggagucugaggcaggaggaucacuugaguccaggaauucaaggugccagugagcuacgaucacaccucugcacuccagccuggaugacagagugagaccaucuuuaaaaagaaauaaaauaauuuaaaaaagaaccaaaucccuguaacuacugaaaccacugugaagguuguuucuuuaaaaacauacacuuuccucuuuuguuuagcagaacauacucaguauugcuuuucugaauuuacucaaggucaacacuaugaaacaucaaugacuaaacagcuguaaauucagagaauucaacggugcgcaggcuaguagcccuuuacauaguuaucuccaaacuacuauucuuucacaguauuccaccugucuucuauaauuuuguuuccuccuucuaccaugaaaaaucaagaacaacaagagaucagaggcaggagggauauacuaaggaaaaggugaaggacugugcacacaggcagccacauacacuuaaagagaggcuguuuucuguuuucuuccccgcuuguuuucugcuuucuacccauucugaaggcaacgucucccauucuuacuaaggauacacaucuccauccuuuuauguuuaccgacccaaaacaaggggaaaaguggggaagcccacccaaauagcugaacuguggaagaccucaaaugauacugacaucacccaaacugccugauuccaccugagaacacccacagggcaaagaccgcacagaccauagcauuccaagguguucugcuucuccacuauucaaagaaaaaguucuggggccgggcacgguggcucacgccuguaaucccagcccuuugagagacugaggcagguggauugcuugagcuggccaagaguucaagaccagccuaggcaacauaaugaaaccccugucucuacuaaaaacauaaaaaucagccgggcguuguggcauaugccuguguuuuccagcuaaguccucagcuuggggggcugaggugggaggaucacuugagcccaggcugucgaggcuucagugagcugaaauugugcuacugcacuccagccugggcgacagaauaagaccuugucucaaaaaaaaaaaagagagagagagagacaaagaaaaagcuuugagacaguuacuacaccuaccacuaacuuacuccacacacacccaggcuggcugaccaaggacacuuggccuucuaucuguagcuacacugaacacuuucucugcaaaacucuauagcaucugaacauaagacacuccuuuaggagucaauaucuuuucuuuuacacuguuugauggggacagaguuugaggugccaggacccccugcuaugauaaccagcuucucacacaaucuccucucacucuaagacccucuaaaugaucagcaggcugcuggaucuaaccaaccuucuuucauagucgaccagagugagaugaucaccuggccuauggaaacaaagcaaauggcugagaggagucaguccaauacccagucuugaauauuuuuguacugagccauagaaaugggagucagaugaugaugaguacuggaacuagagucaggacaugcaggagccaugacuaaggccacuacauguaacucaagcaaggaagcuacaugugaauggaaaaagcccagcuccagagaagacauguacuccagacucuccagauccaguucccacugcccagcugcacuucaguuucugucccgagaggcuacgauugcuucugcucuucuuagacuaaaacugcuuucacuuggccuaaacuguguggcucaugggacuugcaaucaaaagugcucuaaucuaaagcacggccugcuuaccuucccugacaucaaccccaaaccaucuguuuccuaguguuuauuaagaaccucagacuuuucugaaugagcuagccaauccucuuuacaaauauaaauauugcaaauauuaaaaucucaccuaaaaaucacuuucuguauaaaugaaccucagggccugauuaccaucacuuuuuuuuuuuuuuaaugugugauucugacaguuuauuuaaggcacagccucccaccuuggggucaugaaaauauuggccauauauuuacuguuaggacauuauaacuaguuuucucauuaagcuucaaauccauuugaaguuuuuauuuuuuuaauuguggcaaaauaugcauaacauaaaauuuaccacuuuaacccuuuuugagcauacaauuuagugaaauuagggacauuccuauuguguaucaccauuagccauagcuuauuuucaaagcauucugaaaaucaugacuuuuuuauuuuuauuaaacaaguguuuauguucccucaucaaaugacaagggccaggagccucaucaguggcaggacuguggcaggacagugacgaagguagcaaagagcacccacaacaacuuggagcagcaccagagcagcuaaauccauccucaguuccuccagacauggccacagaagcuaaagagacuaaaaauacuuggagaggacagauaaaaagcugucaaggauauuuagcccaguuagagaggucgccacuaucaccauauuugcaucagaaaacacucauacaagcugcagugggaaauauuuagaauaauuagauucaguacagaaagccugauguuccuucccucccagaaugccuggaagaaaucucugggccuugaauuuggucaaguuaucuaugaucaauuucuggaggaccccuaggaagaaagacaaguacuucaaaaauguuaagugcccacucuccacccuucuaacuuguuauagcuuucuuuuuagcacaacagccucuaucaagaaaaccaaaugaggaagaaacuuucaucaaagcuuugugaaagcaaaugauucagccagaacauuucauaauggcugagauggaaaggauaaggcagggaauguuuacacgaacaccaggaacuucaacuugccucucaguaucuuuaaaaaugaaagaaacuuccaaaaauaaauuauguucacggccucuccaaacgcgaggccuauaggaggcccagggagcagguucaagugaagaugugauaugaucaaugacagugggcccacagcaacuccccaauccacacgaguuucuaaauaggaagagucuucauuuacugaauuacugggaaucgauagauuuuaauaacaguuauauuaaucaacuccagaaaguacaacuaaaugaauauaaauacuaccuuaaacauaaaaagucugagguuagcaaauauuuuucaucuguaaucauauauuauuuaagucuauuuuccaaaacuaugaacccucaucuaugucugaacaaagaccucagaucugucauacagaauaacuaugaacauuuugguguuguacaucuuuuuuaauaaauuuaaauuuuuuuacauuuuguuuguuuugagacaggaucucacucugucauccagacuggagugcaguggcgugaucguagcucacugcagccuugaccucaagggcucaaguaauccuccaaccucagccucccagguaccugggaucacaggcgcacaccaacacaucuggcuaauuuuuucuauuuuuaguagagacaaggucucacuauguugcccaggcuggucucgaacuccagggcuaaagcaauccucccgucucggccucccaaagugcuuagauuauaggcaccgagccacagcacccggccuacguuuuuuaaaguaaauauaguauauuaaacagacagaccuaaaaaauuaagcccucuauguaccucagaaaggagauaucugagugucuguaguucaaauccccccauacagcuugagucaacauauuauucuuguccuggagcaaggaccucaaaaggaaaagauacaguuauacagaauagcugaauaucaggaaagcaagcccugaaaugaaauuccauaucuccgacuucauuuccuuacacaauagucccccucuuauccaugguuucaguuacaagcggucaacuaagguccaaaaauaggugaguaugguacaauaagauaaucagagagagagagagaccacauucacacaacuuuuauuacaguauauugcugcaacuguucuguuuuaucauuaguuauugcuauuaauuauuaauaguaauuauuauuaaugggaaggaacuuucgaggucaucgcuaggaaaacccuuuacccaacacaugaauccccucaaaaugacuaccaacuaucucauuacauaagagcugaggucugagaaaagcaagaugaggaaaagcugugcuggaaucaagagugauaaaugcagaaauaccaucugguaaaagaagguauggaggccauggagagaaaggcuucuagcuccugguccaccuaaguggcagcaaagacagcacaggaugcagcucugcugggauccuugaguccugcucaccagcauucccagcuagugaaagaguacaagccaggcacagcggcucaugccuguaagccuggcacuuugggaggcugagacaggaugacugcuugaggccaggaguacaagacaagccugcgcaacauagcaagacccuuucuccauaaaauuaaaaaagaauuagccgggugugguggcacacgcccguaguccucacuacucaggaggcugaggcaggaggaucacuugaacccaagaguucaagguugcagugagcugugauggcacucuagccugggugacagaucaagacucuugucucuaaaaaauuuuuuuaauuaauaauaaguaacgaauaaauaaauaauaaauaaauaguaaaaaggaaagaguuugagcugggaauccaagugggcuuguucuacaagcugucuaggaagugcaaagccuucacagcuagagaacuaaccaaucacugauugguucaggguuagauaaaaaugauaacgcuuuagccaggcguggagguggaggcuaacgucuguaauccgagcacuuugggaggcagaggcggacggaucaugaggucaggagauagagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaauuagccaggugugguggugggcgccuguggucccagcuacccaagaggcugaggcaggagaauggcgugaacucgagaaguggagcuugcaucacugcacucuagccugggcgacagagauagacucugucucaaaagauaaauaaauaaauaauucugaugcuaccgccaguauuccagacuuuuugaaaccuaauaauaauagcccauaacuuuucauaaauucuacaguggcacauggcuuugaaaauuaggggguuuuuacagagcccucuaccauuaaauauuccuuuuuuaggcugggugcgguagcucacaccuguaaucccagcacuuugggaggccgaggugggugaaucaccugaggucaggaguucaagaccagccuggccaacauggugucucaacuaaaaauacaaaaauuagcccagcgugguguucagcaccuguaauccuagcuacuuggggggcgaggcaggagaaucgcuugaaccaaggcggcggagguugcaaugaaccaagaucgcgccaucgcacugcagccugggggacaagagcaagacuuugucucaaaaaaaaaaaaaaaaauuccuuucuucauuaucacuugcaaauagauucuuuuauagaaauuauauuuaaauaauauauaaauuauuucauuauuagggaaaacaaugucauuuaagucaucuucaauguuuauucacagucuacuugcuuuuauuuccuuucucuuagcaaaucuacugaaaggagaaagccagcuaacagaccacucuucuguuaccuauuagauaauuuaguuuaaccuaaaggaacacaaagcucuaguuucauuuaagaaugggaggacacaggaucugugaguuguuauggcauuuaaaaagucaucucaagacaggcgcgguggcucacgucuguaaucccagcacuuugggaggcagaggcaggcagaucagcugaggucgggaguuugagaccagccuggccaacaugguaaaaccccgucucugcuaaaaaaaacaaaaauuagcuaggcgugguggugcaugcauguaaucccagcuacucaggaggcugaggugggagaauugcuugaacacaggaggcagagguugcggugagccaagaucaugccacugcacuccagccugggugacagagcuagauuccaucucaaaaaaaaaaaaacccaguaaauaaaaaauaaaaagucaucucagccgaacguggugguucaugcuugucaucccagcacuuugggaggccgaugcaggaggaucacuugagcccuguaguaugagaccagccuggacaacagggcaaaaccccgucucuacaaaaauuagccuggcaugguggcacgcaccuauagccucagucacuugggggacugaggcaggaggacugcuuaggcccgagaaguggaggcugcagugacacaagaucacgccacuacacuccagucugggugacaaagcaagacugucucagaaaaaaaagugaucucaagaguaagacuggguaucaaucaaagugguugcagcuugaaucaucaauucuaaucaugcauuauuauuuagcuaaaaugaugauuccuaaauauaacacguuuuauuucuaaauguuucuuggcaauugaguauccagaaagucagcaaaucccccacgaaaguagagaaaauaaacuuuuuuacggcucaccauucaucagcuacagcaggcuugaaagauacuaugggccggaggcuuagccugaaauuuggccugcagaagaaaacuccaaauaagauuucuucaagaacuguucuaacguaguacugaacugcaagcagugaccucccuagaggagaaaccggagucaacagcuacacgagugcacaauccaggguagaugcacccuaaguccaauacaaggaauacuaggcuaguuccaccacaauaauaauaucuuaaaauaaaaguaucaaacaaugaaguuauuuaaaauaugucaaaggcaagaaaaugcuccaaaaaaaaaucuaaauccauuacaaagguaauuugaauaaaacaucauuuaaucucuaggccuaaccucucugaaauaaagcauuauauaaucuuccaacuuagucaaauuauacaagaaaugcuacuuuaggccagcucaguggcucacgccuguaaucccagcacucugggaggccaaaguggguggaucacuugcauucacaaguuggagaccagccugggcaacacggcgaaacuccaucuccgcaaaaaauacaaaaauuagccaggcaugguggcgcgugccuguagucccagcuacuugugaggcugagggaucaccugagcccaagaagucgaggcugcaguaagccgagagagaucaugccacugcacuccagacugagugacacagugagaccgucuccaaaaaaaaaaaaaaaaaaaaaaaaaagaaaugcuauuuuauaacaaaggagccauagcauagcacucucaacuuccuguaagaacaaaaauauugugucaauauguucacaacacaguucaagucacaaaaucaugagauaauuaaauugacuuuuuagguuucaaucuguuuagccagaaaccuuauccaaacuguacugaugcaaaucagcaugagaacuauagcacuaucaaaauaacuccaguaucuuaucuuuuguuuuaccuuuuaucagugauuuaugggcugacuaaugguaaacugauuugugcaugugccagaagucagcucaggaauacaaaacaggaaaaaaauuuagaagaaucagauucaugaaugaaaaugcugacgucauaguucaguucccagcagaguuuagaguagcauauaaaaaacaguguaucuucuggaauguuaaaacaccaaagucauuucguaaaggaaauaaaagaaaaagucauuccuugcucagaaugagggaauggagaaaaaaagagaaaagcucaauuaacaaccuuuuccacaaaccaaaaaugaaaaauauacaauguauauggcacaaacuaucauaacuucuaaaccacauaauuauuuuguguuauuguuagaaauaauauuuuuuaggcagggcaugguagcucacacuuguaaaucccagcacuucgggaggcugaggcagacggacugcuugagaccaggaguucaagaccagccugggcaauacagcaagaccccaccucuacgaaaaagagaaaaaaaaaaccuaagcagccauggugacacacaccuguagucccagucacucagggggcugaggcaggaggaucauuucagcacaggaggccaaggcuucagugagcuauggauugcacuacugcacucuagucugggcaacagagcgagacccugucucuaaaaaaaaguaagauaaaauaaguuuuaaaagaagucacauuuguuacaggugaugacuaguugugucucuaaauaaguaggacacagccgccccccaacuuuaaaucuuucucccaccacacggcauaacuuucaaaaaugagugcauaauacagcuaggcaguccuccacugaaaaugacccagcacaggccuaccacaccugauuuuaaguaauucugaauaauaugggguggaacucagugaccagaagaaagcuccugaauuuuuaugugagggaagaaaaaacaaaaaaacaaaaaaacaaaaaaaacaaaaaaaaagccuuuaucuaaugauguaauauaaacuaauaaaaaagauuauaaaaauuugauuuacuuagaacuauuaaaaguggcuaguggcauggauuguucauauuuuucaucucucggcagcacugaaaauacaacuaguaauacaaacuucuguaaaguuuagacacaauuuacuaaaauccuuuuauucaggacacuuaaguaacugauuccuagaugucuaauguuucccagggaauuuaagauuauuacauucuuagaaaauaacagugacccucacauccuuggugaccucuccaaagcacaaaacuguaaggacauucucucuucuuuaccauucauauggcuuaaaguagccauucacccaaaauggauuuuuuuuaauuuaagcaauaaacaauuuugccaauaaacauuuuaaaaagaagaucuuauuaaguuaaaaugcaaacaugccaguuuuaucuguaaaucuaaaaugugaagagaucaucucacauuguugccaccacaaauaucuuugaaagaacaucacuacccccuuguggauucgcaauaaaaaaauccuucucuugaaucuuuuuaaauauuccauucugcugaacuuccaucaaaguuuucauuuucuucacuaagaaggguuauuucaauuacuuuuuaaaaagacaaacaauauuuuucuuaaaaccaauccaaucaacuuauuuguccucuaagcguccccauuuuggggagcauucuuuauacgugugcauguguugauucaauacaauaacccuaucaacauuccauuucuucuucaaauaucugaauuuauacuuccagucaucacuuugagauuauuuuuaaucauaaaugaguaauuuuuuccacuauaacaucuuuuuucuuucuaucugauaauuucacacuuuguaccaauuucuuauuaucacucccaaaugauuugauauccaagugcccagaaaaccaacagggcacauauauccucagaaaugacuuuucagaaaaggauuaaaaaacaaauuuaaguuuuaagaacauuaauucuugauuguauuaauauaccuucagaaaugacuccuggcaaucuaaaucaagcaccaugaaggaaaaauagacaauaacuuuuuuucaaaacuuguaaaaagaaaggcuuucucucucucucuacguugaaagaauaccucugguuguaucugcauuucauucuaauauaagacacaaauacaccuuguugaaugcacacuguaaaagagauuaagugaacuuaaacaucugauguaucccuuaucauagacacuaaauuuagcugaaaguauaaaucaucacugcacaaugcacaggcuacauggagaaagagucaugacugacuguacugcccuuacuggaaguuagcuccccauucucuuagacauguugaacacaaaaauagggacaugguaauuuacuacugucaacauuuauuccaaugguuagauaggaauaaauggggaaaaauccacuuugcaaguguuuuuaagugacugaauacauaaucuuaccuugugguaacugauaaggggaaaaaaauggaagagauacugcauggucugcugaacgaaugaaugcucuaugucccaaaagucacacaucagccccacugagaauauuacacauccaaaaauuaucugcuuaugcaccuguccaaaacuagcgacugaacugcacagcagaaccaaucagagcugggcuucacaagguuuugcuuuucuguugcuaugacuauuguuuugggauuugcagguaggggagauauauauaagauauauauaagagugggguauauauauauauaagagugggguauauauauauaagauauauaugagugguaugaagaaaugaaguuggggugagaccuuugccacuuagucuccacauaauaacauguuuaaaacuauuaagaacacagccccaaacguuucuuucaagaaaugucacuuuguacacaugaaaacuacaaaaccguagagagcagagugaugaauacagccccaaacaagcauaucuuccuugaaguuaccuucggcucacagucucaggaaaggauauguuacgugacuugaaagcccuggcuaaauuugaaaaacaaaaacaagaaaguaacugcaaaaggauucauguacaggagaacaagcaaccaugucaggauagagccaaacacugagguugaauauggaggaaccuuuaaaaaaaaaaaucucuagucauuccaucuuaugccaugucaaucaguucgaaguaaaugaacaauccuccagaaaaagagcaaaaggggaaauaauguggcugacccuuggccucucuuugcaaugggguacauaauauuucucuguaaguccaggguaaugagguaaaaaaaaaaaugcucaggaaacaguaccaaucuuuacacaggaggcccaugaccuucuacaagcaaugguguucaaagcagaaggaugcaauacaaccuuagaaauauacagcuagcauacugauggcaaaaaaaaaaaaaaacccaaaaccacccuuuacucacccuuuacuuugucccaucacgugaacugcucuccauugucaauuuauacaaggaaacacuuccggccaggcacauuggcucaugccuguaaucucagcacuuugggaggccuaggugggcggaucacuugaggccaggaauucaagaccaaccuggccaacauggugaaaccccgucucuacuaaaaauacgaaaaaaaauuagccgggcaugguggugcacgccuguaaucccagcuacuuuggaggcugaagcaggacaaucgcuugaaccuggaaggcggagguugcagggagcggagaucgugccugggcaacaaagcaagacucagccucaaaaaaaaaaaaagaaaagaaacacuuuccuuauaaaugcaugacaauuaucaugggagaccaucuauauguuuguaagucccucucucuaaugacaaaauaggaacauggcuuaaucacaggacuaagggacacuauauccagggauggcacaaaauaaaaggauaugauagucggaucaaccucuagcucgaaccugauuagguauucaagaaaaauaaaaagaaagauuauacacuaucuggaaaauagagugaaugaccguacacucuuauucaaguuacacagacaaaguagcagagcaagaaugcuucucacucucacucucaaacacaccaaaaacuaaaggcaguacuauauauaacaggcaaaggaacauuaggagaggcccccauacuuccuuguaaaugaaggcuccaaaugaaauaauauacuuggcugugcuuaaagaaauuuauuguaucaagccaaagagacagaaagaagcuggcuaaaugcagcaaaaaaaaauuuccaaaauccuacauggggaggcccagagcagaaaggacccaguguuuuaucuagagaugcuaucuaguuacaaauacuauuaccagcggccuucuggcuuaaaucucauuccaucuaccuauucuuagggaaacaagaagcaaugccuugugcuacaggacaaagggauggugggcauccccuucuuacuaaaaggcuacaaauacaguacaucuaacaaacacuuuuuuauaauaaugacaggucagugaagaaaccucucuaugugggaaaggacaaaaaauaaaaggaaaggccgaagaaaagaaagggaggucggauuuaagucaccuagaacauuuaaaaaaaaaaaaaaaaaaaggacaggguacaugauucuagaagauacacaccaccuuaggaaaagaucuguauaauggaaaugcaaaagaaacacacacaucacuugucaacacaaaauacacucagucacauacucauacugccaaaccacauauuacaaaccucacacaggaguuuucacaagagugaaauaguagcagaauugguuucuauauacguuguggagaugguaaaucuaauuuaauagaggaaaaaagaaaagggguauuucaaauuguuaguaauuuuuauuauuaucauuauuuauaccuaaccuguacccacaaagaauuugaggcaauuuacaaaaauaauaauaccauuaaaaagcauaaauuaaaagucauauaauaaaagugauaauuauaucagaugccuagccuaagaaugagcaucaauuagguauuaaauuuggauauaauucuucauggcagugaaaauguaacagcagcucauacaguucucacuaucuacuaugaaccauaccaguuaauccgaagaaaaaaauauuuuucuaccacuuccuuauauaaaaaauacauuugacucuauguucuauagaaugccuagugcgaugcugccguucaaauauuaaauaagcauuccaaccaaucauguaucuaaacaaccuaaaaguuaugccuacacaaucagauuaagaaggcugacuuuacuuuugucuacacacacacacacacacacacacacacacacacucucucucucucucucucacacucugcacacagucugggggaaagcugcuaaaugccucucccaguccacccucccacccucuucaccacccccacuccugcugaggaggaaaaaagguucaacaagauagcacacuauuacacuauaucuuuguaaguuaacaauccaaaaacuuaaaaaucagaaaaaaaaaauuccuugcaagacuauauaaaagacaagcauuaagacaagcaccacaccgaaggccaggcguggcagcuugcgccuguaaucccagcacuuugggaggcugaggcaagggaggcugagguaggcggaucacuuuaggccaggaauucaagaccaaccugaccaacauggugaaaccccgucucuauuaaaaaugcaaaaaaaaauuagccggacaugguggugcacgccuguaaucccagcuacuugggaggcugaggcaagagaauugcuugaaccuggaaggcagagguugcacgaaccgagaucgugccacugcacuccagccugggcaauagagugagacucugucucaaaaaaaaaaaaaaaaaaaaaaaagauacacuaaaaugucauuaauauaaaaggcuaacaagauccaauauggucucaagcaaagucacaucacccccuacagcuccuuguacauaacagaagcucgguaaaggucuccugaaugaaugacuccagucaugggaguauaaauacaaaaacgacuucuccccagaagggcaaauucaaagguuccacaaaagagucaacugacacaacuaugaggggaacagaagaaaauaagagaaucaccuucuacugcuuuuuccauaaggaaaggagaaagaaguacaacugcacacaaagggguauuucccccaaacaggaaaggaagaauggcucaaaguaaugaaacaguggggaaaaaaacguuaagauuuugagaugggcuaccucaaaaucagucacaaagaauuaaaaaccgagcaggacacaugggcggacauccagcauaaacaggagacuaaacuaaacacuacucucuaaagaauaggcuauuucugggggaaagccuaaaaucgccagagccuaaaaacuaaggaaacagaaaacacagcugagcaggaugcauaaauaugucucaaagagcaaguaagagcaacacuacucuuuugaaaaggaaaagcugacccaaucugaccuugaguagagguugcucuguguaugucaacacuuugaauccacucaaugaugagauggagaaacccaacauuugcagaagcaggauaaguaagguuuccaagaagacaaaggaggaagaggucacccaaccuagucccaaaaacuggagguaaggggugaaggagaggaaagagucauguccuaacagaaagucgaacagaaagauuaaacuaugugguucagagaacccgucuagucugcccaacugcaacagagcauucugcacuacaagguaaaaggaaaaagcuaauuuccaaucaucuguggcgaccagugacacagaaacacaaccacaucaaacucaagaaaaagggcccagcuucagacaauaaccucaagugucuucuuccaaccaaucuuuaccacuuuuccuuccacugcgccuugcacggagcccccugcuuaccagggaaaacucccaaagucuccauggggccauggaggaaacgguaggaagaaccaccacuggaaacgggaugacuccgcugagucuacaccaucuacagcagguauucgacucuucguuuuuccgaaguucccuaauaacacccccuaaaaauacacaaucccaucaagcugacuacagacacagaauacgaacagcauaaaaacauuuaaaaccaaaaacaagaaaaugagcucaaaagcucuacuuucugacauugggaaucaggcccacuggacgacucaaugcuaacugaaaggcaaaguccagaagucacagaacuagcgcugacccaaucuccgaugagccacuucuccuuacacaguaaacugaggcaaagcgagccucugagcuagaacaguuuuaaaggccaaagccccagagcccaacggaacuuguuggggaggaugagucuccacacuaagccugucaaagaguaagacuucccugcugagugacagcggcuagcagccauucugaauuucgugaaagagggagaaagggagggagggagggagggagggagaccugaggaggcaaagcaccugacuagagccgacagggcucaaaucauuccccuguccaagagaaaagaacuugaagaauaacguuccccauccucucaugaagcgucgagggccuuuccacagguacauuuugcuaauuucacaaccucucucaauuauuuaaauggccaaaauacaaaagggacauauuuacggucauucguuccuaguucugucacaggaaaacauauucuucucacccaucuccugucguuuguccaaacacacgaaaucucuuuccccuacacugcaguaaagaaaucaagaacuuuucacucuaugcagaaucaagcaacgaauaccaccccuaaauucagaccgccaaaguugcgaugcguaugggcaggcacuguacgcuucgcacauucagggacuuggugaacacgcaggaugucguucugcuuauucaguacaguacacauuacaaaccaaagaauagucagaauuggccauuuauccgugauucuucugcugcugcuucuaagccugaagaguuaccaacaacguuaauaucuaucuguaucauuacacauaaagguccccauaugcacccaaaauguagagcuagucaucugacccuuccaacuuccugugcacuguauauguaaugaaugugauuucaucuguguauaccuacauguauguauauguaaacaaaugaauauagcaucaugaucugguucuccaaagcagaaccggaacagcaaaaaacagaaagcauucaaauucccccuucugaaagcuacaagaucuaaagaaaugucuggaucccacaagagacaacaccagagccaaaggaagguucuaguacaacaaggagcacacaagcaaccucuuccaggauggcaugugggcgacacgggugucuacacucccuuuucugaauggaaaggcauauggcuucuccuuacccagccaacaugaauacaauuugagaaaauuagaaaaagucaaaguaacaggcucacuaaauauggcugacugcgaagcagaagccacagaggaggauaugaguucucucaaaaaacaaucgggaaguuuauauccaggaaagguucaaggacucuugagugugggacggacaaagucugguucucacugcacagaagacaguaaucaaaacaucaaaaaacaaggccacaugacccuuuucccagugagguagugucaacugaugaagguugcccccuccugagacacaagagucaaguggaggcaaaaauauaccccggucuuccucagacacaggagcaacuaguguggccccuuuucacucaagcacuaggcacaauggaagcccugcccuacaucuuauuggggcgcccacucucacccagacaaggaacuccgagaagagagaacaagucaguguagacacacaaauggcgaaaggagcacggugaacguccaguugucuccauaagaaaaggagggcaacucaaaggguauuuaggaaaugagcucgcccuaacccagcaaaguguaagaguaugcaugaucuggaagaagugucugcuuuccuauuuagaaaugacuucagagcugcacaagcccccacuauccacugggugaggaaagaagaacaugggcagccugaguccccuuguccuggcaaaaagggucaacggagagugugcagaggccccaaaagaauccaaagaagaugagcagaucagacggaccccugugccaaggaaggaucggggucacggaagguaaagggcaagggaguguggagauccucacuugccauagaaacggagaccccacccuccuggcugugagggugcaagggcaagaguaggaugugaacgacugcgaggggcggggaugcugcgcaggcccccuucccuucccgggaagcgaagggggaggggucacacgaggcccuucggccgagggacgcucggcaggacggggucccccuggcggggagaagcucggggaccccccgcccgcucagggagguguccacggggcugaagagggugccggagagaguacaucuggcccugcccgccggagagcagggggccggcgagggcugagcgccggccgcugccgcccgacggggaccggcccggagcaguggggcgcggggccaggaggacccgaggcggauaaacuuuccgccccgcggcccccaccguggacccagcgccgggggugcgggggccgcgcagcgggcucgggagcggcggggaugcccgguccgggugggggaggcgccggcccuccgccggcuccuccuccucgcugggcccgguccccgccccgcgagccccccgcccccuccggccccagcccgcccccgggggugggguguggggcgccgcgcuccgccggccccgcgagucaccucaggacucggccgcgcuccgcccccccaccccgccggcccccuccccggccgggucgcccgcccgcccgcccgccgcgcccccgcgcucccgcccggcgccgccgaugcccgggauguccggcggggccgggucccgccgcccgccgcgccgccccccagccccucgcgcuccggcucuuaccuuccggcuuguuuucggcagccauuuccccuccgcgcgccacauccuccuccuccucgcgaccgggaccccgagcgcgcgccucguaccgccgccgccgccggcccagccaccccgccgcc

SEQ ID NO: 21395 - RNA, 78551 nt, Homo sapiens
cgccgugccgccgugccucuggcgcugccgccgccacccucggccggcugcgggacucgggcugcggggcgcggugggaggagcgcccgggcuuugcggggagcaggcuaaggcggccgagagaaaggggggucgagacggggggguggagguuugggggggugggggggcaggcggccgccaucuucucgccgaggccgccucgcccgccgcgcgcgccgguccggcagcgcacggguuaaggcuggcaccgcgcccggcgggagggggggcgcccaccuccccuccuccccgcgccgggcaugcggggcccagugggcaccgaggaggagcugccgcggcuguucgccgaggagauggagaaugaggacgagaugucaggugagcggggcgcgggugcgccuggggccagagcggcgggggcgccgagacgggccgggcccagggcggagcgcgggcggcgggggcggcgcggccgggcuggcgccucgcaggaggggcacccggguugcggggcugcgcucccgcccugcuggcgccgcgcggccaagggcgaaggcugggugagcgcccgggccggcgugagggcggcuaagggcggggugcgauccgggccccccgggcggcgacgcgggccaggcgggccagaggaccgcgggccggggccugcgcuggggggcgcggcgcugucagggucagcccgcgugcccuugaagggggcgggaaucgcgcuagcucccggagcggcgcaccccgcgcucgcgucccgccgccgugcgccucuggccucgcugcgggcaggcgggacccggccccuggcccaugucggccgcggggcgggcuggguggggcccagagaggggcgaggaccggcggugcuuggggacgcguugagcgcccaggauggggcggcuucccucccggcccaggaggacuccgcucugggacgcacgggcucggaccccugcuccucuuuccuggccucugugcgcugugaccgccgcucccaagcacuuuacccgggccgccggcguccuucuggcgcgaccuagcgcccgccgcugucuccagccucaccaucgcccagggugguggccguucccagcccacccugccuuggcuacgggccugacgccccagggccaccgccccugccccuaccaucucucuccuuuuaucucucucagaauuuaguauacacagggcugugcgccagggguugccuugcgggacaguucuuuaguuaacugcucaccauuuguuugggacguuuucccuccuggcacagcuggguagggccccacccugucagccacccucccuccuuucugggagacucuuacuucucggcuucccugcgccaagucuguggccucucuggacuucggagagacuugugggaggcuggaggcccucccgggcccaggaacgugcaucuggccccuucugacuuccaggggugagaagacuccacaaauggacaccuccagcuccuguuggaggaagcagccagcgucuucuggggaggguauucccaccagguggccacacccccugcccccuucuguuugcuugcuugguuaguugguggcuuuaaugcugucacugagcuccuacaggagcccggcacucaccucgccuguuagacaggccaaguuggcagcgagcgugcuggggacggggaauaggggaguccucucuugggguggaguugccuggacaauaguugacugucauauccuggguccuuggaauuagacccauucuccggaggggaacucugaggccccgcacaggcacaaaaaaaaaucaguggccauuuuccaccuaggaggcuggcuccccaguaagccaguuuacugguuuucucagcaaguuguuuguuaugguguuugggguguggcccuuuugugggaucaguggcauuucugggguugcaccgacccgcugguggaguccccuggcugucuuucccaucuuacacuccggcucucucugacuauguggggacuuagagguuggggaggggaagaggccagggaaggugcccccagucuaguaggcacccgacucacugcuugggccagagaggcggggcucuggucauccugcccaccacccgugcucccccucgguggguuggccccagagccuccaggagugcccccagagcccugcagaagagacgcccugcucuggcaccucuggccuggggauucuguccccauccaucagcaaggccagcugcuccaccuccagagccuuuccaggcuccuggcuucucuccauguucuggguccaagccucuguccccuccugccgguccccuccagggccuucuacccacuccuucugaccacccacugcacagcagcuggggucaccucgugaacccaagucagaucccgacccgcauggcuccagucgccucugaaacccuugucccggguccacuccuguaccccuuuguucacagcagccacgcuggccuccuugcugcuucuggaacacuccacgcuccacgcuccauccugccauggggcccuggcugugaccucugccugaccugcucuuuccucugcucaccgcugccuccuggucauuuaggucccagcucgaauguuaugauggggagggacacccuugcuaagggccuuccagucacucugagacacauugucaugcuuucuuuggaagagauggggucuugcuguguugcccaagcuggauuugaacuccugugcucaagcgauccuccugccucaaccucccuaguagcugggacuacaugcuugugucaccacaccucacauacucgaaacguugucaucaguuuccuccuggaucuguggguuccccuucgaauguaacucucgauaaccugccaugcccagcaccugaaaccaugcguuccugagagaugguugugguuucagugucugagggcugggacucucuaggucaccccagcuucuggcugugaagacagcccuagccaggccuccugucaagucgcacugcuggccccccacucacccugagcucuuccucauagccccuaugcagcccugaguccaagcucaguggcggugacccccaaagaccagaaccagcugguuccaaaagauggaaguuuguggcuggaggagcuaguguuuuggaagcugucaugaugauuuuucagucuacggcuauuaaacucaugacuuguccgaucuuuuuucuuugacucugcucaucucccaccucccccugggaguugcucacucucagcagugaauuauuguuucccgugcagugaugguggggagggggagguuugcccuggccagcucuggcauugaggcaggugucugagccagcuucuaggaggaaggcagggcgggugccucuucugguugggggaccagcaguugccagauucuccugggaguugggguggcugguugaagccaggggucaagagcuggugggaugaggccuuggcuucuagcucugagcauuagcugaguggucuuggacaagccaggcagcccucuccucggugugcccacuuguaguauggggacauagcacuggcuaccucauagaggguuauuaugaggaacagugagacagugcauguggaacauuaggccacagugcccagcacaugauaggugcucaauaaacuguggcugguguaguuagcaccagccaaggagggcagcuguccugccuucuccaaggaaaugcuucugauacuugcauccuuagccaguaagcucaggggaguaggagccugggugggaggagggcugugaagcccaagguagggguggcaggaagcaggagagggcuucagaaaauguggcucucagcccucuuagggccacugcugggcuggcaaauucccugccucauuggcccagcuuuuccucaaucacagacaaagcuagugagcccagaaugggcaaugucuggacuaggcaccguuaccucucuggccccagugacaauuggcccuagauguguaaguaucuuaggcuugcuuccucagguccaggggccaggagagagugacagucaugauucccaaaaggccaugacauuuuagccugcaccccuaccccuguggaagcaugguuugguaggggggucccagggagccugauuguauuuaacauucuuuucugggaggagggagacaaaaugaccagcacacuuugcccaguggcuuggccaguggguuauucauugucauuccaaguugaucagguaauaggauccaucuaucauuuuaucaguucauucagucgcucacccaucauccauccauccaucuaccuacccacccacaucuacccauccaccuacaaaaccaaccaaguaaccguucaccauccgccuaucaauccauauccauaccauauccauccauccaucuguucuuccuauccacuauucauccaugcacuauucguccaugcuucccaccauccauccauccauccaugcauccauguauccauguaucuaccugcucucccacaucuacccgucgacccacaaaaccaaccaaguaaccauucaccauccaccuaucuauccauauguauauccauccguccguccguccauccauccauccauccauccauccauuuguucuuguucuucuuauccacuauucauccaugcacuaucuguccaugcuucccaccauucauucauccauccuccaauccauccauccaccauucauucaucuguccauccaccauccacccauccaccauccauccaucugcccauccaccauccauccaucugcccauccaccauucaugcuuccauccauucauccaccacccaccauccauccauuccuguacccaccauucauccaucuauccacccgucauccauccauucaucuauccaccauccauccaugcauccauccaccauccauccaugcauccauccaccauccacucauccauucauccaccauccauucauccauccaccauccauucauucauccauccaccauccauccaugcauccauccauccauccacccaccauccauccaucaauccacaauccaaccacgcauccaaccaccauccacucauccauucauccaccacucauucauccacccaccauccgcccaccauccauccaucugccauccauccauccaccuauuguccaucuauucaucaauccaccauccauccaugcauccauccaccauccacucauccauucauccaccauucauccacccaccauccauccaucauccauccauuauccauucagccauccaucugccauccauccauccauccauccauccuucauccaccauccauccauccacccacccaccauccauccuucauccaccauccauccauccacccacccaccaucuauccauccaucuauccauucaucuuucauccauccauccgucauucauccauucauccauuuauccauccguccauccuccaucuuccauccaccauucauccauccacccaccaucuauccaucaauucaucauccauccaucaauucaccaucuauccacuuauucaccauccauccaccauccauucauccauccacccauccaccauccauccuuccacccaccgucuauccaucaauucaucauccauccaucuauucaccaucuauccaccauccauucguccauccacccauccaccauccauccacuauccacccauccaccauccguccaguguccauccaucugccauccauccauccauccauccauccacccaccauccauccaucuauccauccaucuacccaccaucuauccaucaauucaucauccaucaaucuauucaccauccauccaccaugcauucauccauccaccuauccaccauccauccauucacuauacaauuauccguccacccaucagagacuucuggaauaucuucucugagcuggguacugaacacaauguguguugucuaacuuucugggcuuuugcuuaucucuguggcucuguccuuauuucacucuccuucccugucucucucucucccucuguccccauaucugucaguuuucgucuccccugaggucaugccccugccucucccuuucugucuggccguuuuucucucuuuugucccucccuguccccccagguugacuuccccucucaccauucuguccuccuccuccccacccaugcccugggccucucccugcuuucccugcacccccagggugacuccccccaggccccagucacuugggguaaaugccucaucuauccccgucucuucccuccacuccccacucaggacugaugcuuucuuuugaugugacaccaaugaggugaugucuggguuuuguuaaaugucauaaauaaauuaugaauccucucuugggcgguguacugccccccuuugccagcauaagcccugucucauggggggagguucgaggacuaacggcagccugagaacuccuuggccagcgucuaggguggcccugagaaccucuggcccagcaguggccaaacuagagaccgcugcccucugcccuucaccacugccgcccugacccuccugggucucgcugggcucugccugccauugcugagccccugcaggcaucguguggguccuuugcauucacaguuuuuacuucuccccauagcccugggggaaaggcugccacauuaggcccauuucacagaugaagagagaggcucaguggggaggggacuugcugguaucaccuccaggagggguagcuugaagccucugcugccccuguugcucccuccuccugaccuccugguggccuuguucucugcuuguugcugguuggggaguccagguggggaacagaaauagccccucucggccgggcgcgguggcucaugccuguaaucccagcacuuugggaggccgaggcggguggaucacgaggucaggagaucgagaccauccuggcuaacauggugaaacccuggcucuacuaaaaauacaaaaaauuagccgggugugguggcggacaccuguagucccagcuacuugggaggcugaggcaggagaauggcgugaaccugggaggcggagcuugcagugagccgagaucgcgccacugcacuccagccugggugacagagcgagaguccgucuaaaaaaaaaaaaaaagaaauaacgccucuccccagguccuggagagagugguggacauugaguggggucccuguccuuggcagguuugccggccuuugcaaccuggugaugguguucucgucccagcuccuggcuuggccccugcaaauccuucaaccacccagaaucagaugaccuaacuuucgcuccacagucacgcgccuuccccuuguuuugaucaccuuguguuugccaagugcccuggcggcugcguccuugcucugcugcugccccuccccagaggagugaggggcuggagccugggucuggcagagcuguggggcugugugcagggggacuaguguggugaaccagccuugacccccuugagggaccugugaccugccagaccacagaccagccugagucaccucaguguccccagggcauccaccgagccgguuuacacagcgugggcuguuucagugggagggugcugggggagagacuucgcaagggggugggcgcccacugccuguguucaaacaguggcagcuucaccacugccagcuguaggacugagauguagguaaauaaugagguccuuugagccucaguuucccaaucugcagauggggauaagaauagaacccugagccagguguggugguugugcguguugucccagcugcucaggaggcugaggugggagggucgcucgagcccaggaggucgaggccugcagugagccaugaucauaacacugcacuccagccagcgacucugucucuaaaauaaauaaauaaauaaauaaagccccaaaccagaaagaauaguaccccucucugaguugcuguguugaacugauacaaauuaaucaguccuagguacuuugggccuggcacgagccuggcaggugguaugcaguuaucacgacugcugcuauugcaaugcgcuacccugagaagggcccaccucaucggccuggccgcagccugcaguggcucagccuaggccagccugggggucccacagggcugagcuggcgcauacugggagcuagagaggggcugagggagcucuggagaaagcagcagaaggugccucuccuuccucuggucgacuugagccccaccccgccuccacccccaggaggugggugaucacaggguaaugggucuuaauuagagcaggcuuggauccguggagccucaggcccuggaggguuagggcuggugcaugagggcacugccaggugggccaggagggugguggggcagccacgaggggccaggagcuggcaggacaaggaguucugaggugagguugcuccucccuggagccccucacccgggacgggcaggaugccaccuuaacacuggcugcaugcucugcgucuuggaacccucugggccucugcucuguccccaccagauggagccauagggaggagggacuggugggcucaagggcacaggcugggcuuggggaaaggcugaccgugcaguugcuuguauggugacccccagaucugguuuuagaaagcucaggaccugcugcgggagcagagaguguccaagggcagaaaggggcuggggcuuggcugaagacgggagcgugugagguguuggggggggcagugucauagagaaucaggcguguggugaccucagggccacccaccagaagccaucuggggagaggaagggcccaucagagacaggguuaggcagggcugaguccccgucuccgugugccaguuccagagccuucucagagguggguuucaccaggcagaggcccugggcugugaggucuucugggaacggagcuggggucuguccaugggcagagggucuggggccuuguccucgaaggccuguucugggcguggguuagggccagagcaggggucccccuuuguccuccccuuacccacgggcagaucccagacuuccuuccagaacuucuggcagccaccugugcauacccucauccguucuguuggucaggccaccagucagugaccaugugcugggcuggguuuccuaagucugggaccacccugccggaaggggacagcugggaggaagcaggagggagaggcccccccucgagauugcaucagccagagcccguuacauaagcagugcugggcaccgccaggguguggggguggcucugcccaggcggucuccugcgguggcgggggaggcggaggcccgguggcagagcgggcaguuguggacuggcaucccaucggcugccccaccacagacagcuccccgccagcccugccacugccccaccgacaccugcucugcaggacgacuccgaggggguccccgugcacguuuucagcugguuugaaaaauccccgccuuuccacacuagugaucagaggaaugggguggggucagccggagcagcccagccccugccccuggcugcuuggggccucacccacauaaacccaccuggggcggcccuugcugcuggcuccccugugugcccuagcccuccacagggugcccucccugugugggagccccaagcaccuggccacccuugagggaggcccuggugcagagaggcaccaagacaguggugcagcccccaccuuccacuggugcaaacaccuuccacuggugcacauuggccccgugggaugcaagggugggaggggcguccgcucagccaccagagccccggugcccccgaggaguggggacaguggggcuaaagcugcacccauagugugggccaugggagccccagagacccaggguaggagcccuccugucccccuuuccccgcuuaggacucucugggggucccaggccgggcggugggggccuguguggagggugacaggugaguguugggugcacaugcaugucugugcgucugcauguggcgagugugucugagcgugugggccacacugggggucgccucgaagcccuuuuggugacccaggggucaccagggucaccagacugccuggguucgaaccuggcuccaacacugccagcuguaggugguuaugaucaaaaacuuccucgggggaaggggcucucugucucuaaacuugauccagcagggacacucugcccccuuccugggugaaagccuccugguggccccaggaccucucguccuccgcggggucccacuggaggcaacccucaggcucugagugacacucccuguugugucuccacugucacagaaggucaggccugggguguccauggcagagggucugaggcugaggggccucucuuugccccucagcuuccccugagugcuccugagugcacaggggaugguggagagcgaguaggacaagcuggcuggggcgcuggggccgcaggcuggcaugaagggccggcucucucgugggcccuucuagaggacucuuggagguucuucccuucuggaagccuccuuugcccccacgggcagaagugucucuacuuuggaugguuugauucuugcugcugugccugccaagaggacccuccccacagccccuccacagcucauaucuggugcgugggaacuccuuuucucuauccugauuucccagaugagcgucagaccccaggcuacugccgucccagcaggggucucacgucacaccccccaggacauguggcagcccuuccucuggguuggagguugagggaggcagaccugggacuguggccagugucgucaaacauacucccuucccgagccugcccggccagggcccccucggccuuucgagucagugcaggugaggugaguccugaacacccacgugugcugggcacggcgucucucuguggacugucacagcuuucuagugcccagcuggaaugcgcuuggcuucccguugugaguguguuggaggugggggagugcggaccugugugccugugugugcacaggugcgggauccacgaggagauacgauauggucuuggauucuccauuaagguggcauccucucaaacccaugggguauccuggcaucuuccuugcugaguuuguccugcaaaccccugggguccucagguuuggggcuugagugucccugugcuccacaauucucucucucucuuuuuuuuuuuuuuuuuugauggagucucacucuguugcccaggcuggagggcaguugugcgaucccagcucacugcaaccuccaccuccuggguuugagcgauucuccagccucagccucccgaauaguuggaauuacaggcgcccaccaccacgcccagcuaauuuuuguauuuuuaguagagacgggguuucaucguguuggccaggcuggucucagacuccuggccucugguuaucugcucgccucagccucccaaaguguugggauuacaggcgugagccacugugccuggcagguccagcauucucgagccaccuccuggccacacugugguccucucucuggagggagagaugggccucacugaggucuguacucugcucuaucagccccaacuccuuccugguagagaugcuccguuucuccggcagugauggcaacaaggcaauucuguuuguuguucauggagguucaguuuucugaacacugucuuaucaggggcaggugguuauugucccauuuacagaggagggaaggaaaggccuggaggugaggugaugucacacagucccuagagcuggggcuccuguccuguguucucucacuucacuggguuuggggagggcagggcagcugugaccuggcacaguugggugucugggggucccagcuuccccagggcuggcucugugucuccagggcucuccuggaggaagcucaggaguaacugcugccaccuucugauuuuuccagaagaagaagaugguggucuugaagccuucgaugacuuuuucccuguggagcccgugagccuuccuaagaagaagaaacccaagaagcucaaggaaaacaaguguaaagggaagcggaagaagaaagaggugaggggcagcaccugcgccggcgagcuuggggcgggugggguuguggcugcaucugcccggccgcagaggagggcuggggucccuggaccuuggaguuugaggguuucugagagcugaguuugaugaaaaacaccauaaccaguuucucguaugaagcguugugcacggaagccuuuuuaagacguugcugagcuguccuguuuccggagcaggaugucggagcgucauuuuuccuuccucccguuguccuauccugugcgagggacagggcuggauuccgucgccacggugccucccuaccucccugccccacucccugcucuguagcugacuccgucccucuaaacugaaaccugaugaagugaguuggagaagagaagcaaggccccauuuagggacagucaccugcaggugaccucuggauucccgucacuuugucccugguucucggcugguucuggaugggcgaggcugccgcaugcuccgcugccuuggguuggcagggugugauggugugaacacgucccuugucuucccacgcugcugacacauuccgagugugcuucucugugcuucacgcgggcucacuugauccucaugaucagcccuggaaauugguggcaugggagggaugaucgcugguuggcagauggggaaacugagguggguuugcagcuuaaaguccuuccuacuuggucuaggacacugaggucugccauuuccucaccauaugcugucugcuuccuucugggcgucuccucugauccuccaagcgacccuauguugagagcaauggcaagcaccucacuucacagaugagagcgggggcucagaggugcccuggcccaaggucacacagugacacagugguggugcugagaucugaauccagggcugucagcuccaccagccaccgcugccaggaguguuucuccccucccaccugccccggggggaccugaggccagcucuccaccuuucuuucccccgccuagaggggacuggccuggccccaccuugcaagugagaggcccagggagguagcuggugaggcgcagugguggugaggugaggugcuaaugcuaagggggugcccuuggcagcgcugggcccggaucuaggccucccugcagagugagguggggagguggcugccagaagagcuuagggguggguuuggggagcuugucccaggcuggagacacuccgugcugugaggguuucgggagggccuguugcggguggugcaccaugggccucuugucccgugaacaaggugagaucacuggaaggcuucgagcagaggagggacugcuaugacaugacauccuggcaggcuccccuggcggcccuggggugggagagaugguggugguggggggcgagggucccugccuucgccucugggccucgggucugugccccauuuccacuuccccggcuuguucggguacuuggaggcauuuuggggggcucugaacucuaccugcagccugugguuccuuuucuggucugggugucagccuggggauguugggagggcagagcccgcccuggacuguguccuugguccccacggaguucagggacugcuggggaaaggauggggcugggagguguuagccccaacccucuggccagaguugccccagguguguaccgccccggugcucuuugcugggggcggcagucagcaccucucacccaccuccuaccggcccuucucucccagccccugccuuguggggcuucugcagcccugggcucuccugggagagcuuccugagugugcucugacugugccccacggcccccugguccagagccugugcagcacccccacugcugccacuccaagccccugcccccgacccccaccugcuuugcagccaauccaggcccuucugguccuccgugcacacacgugugugcaugugacuguguguguaccacccugucuuccccuagagagacccuggccccucugcccaauucugcuugccuucucuguugucccucagcucugugccccgucugacacaguguccgggauggaugugugucugucccuucccgggaacccccccuuaccacugggccagcaugggggcugcauggggaggauuugugaggugaagggggaacccgggucuguggagcuggguguggaggcuccugccuggcccaucaugccccagagacucccaggccugcacucugcggcucuugcaucuuccccggggucucaaagagggugaagcucccugucccuguuauuugauggggaaguggagauaggacaggggaagcggggagugcgugccuggaggcucccccagggaaggagaggcugugagccagcuccuuugggaggggcucccugaauucccugcugcagccccgcccuccucuucugcugcuguggccgcuguccccuggccccagaggucggucuuugugcugggcaugggguagauggcucuggagcugcaaggcccugggaugaagacaccgagacugucugguggaggcuguaaaaucuugcucugcugccauccccgcccucacuccucagaccugggcuccaugggcucggggugauguggauuuuaggaccccgaggccucgugguccauggcagggacuccuaccugugcacccacugcccaccuccucugacuuagaagcugggugggagucuaggccaagaggggcagugucaccugggccugggucucaggccacugggcugggugggccugacuuccaaaugcagaagaaggacccaguggggugcagcagagaccugugggagcccugugggagcccccauccuccccagauagggcuggcuccccucccgucuccugggcucaggguacagcaccagcccuggcuagggaggcuugggaggugggcagcgccuggacaggggcgaggccugggggcugggggccagggggucuuugagaccugggagggcugguucuccgacgcucucauucccagggccaugaucacgcugagccuucccuuuuccaacuggcccaggucuucccucccgcuucuuucucugacaauauguuuuuguuuuuguccagguccuuaucucucucuggcucuugucugucugucucucucugggucucagacuuggucauucccucuggccugugcuugguguccaccuugguaaccucucggcaucuccucucucuccuuugccgucuuuucucucuucccccuguacccucauuucucucccucucuuugauuugcuccaccccuuccucacccucucuccuucucucuacugagaugcagcucugguucuuggaaggggaagggggcugggauggacaagaggccuccagaggugcccccuccccugcauuugagagccuggcucgggccagcugucagaucuuaaggggucuggagcacacuguggcccagcugccgggugccccuuugcccaccugccuggcagacuaggagccccaggauaaagacaagggaauuucaccccucugccccucucugccuccaaccagguggcuccaagaugacggggugaaggggccagggcaggugggccgcaagcagcaguuuguuaguggggggaggccggcagcaagucguggauucugauuuacauaaaauaaccgggcugcagccggaaccugagcauauguagaugaagcucccugucagacccuagcgagcgcaggagggagaaaugauuucaaccuguacugcagcgguuaccauagcaaccaauuauucagugcuaaauuauaacuguuuauaacacucgugaaugggaaggcuccuauuucauucuucccuuuucccucucaaucuugaaggaccccaaauggagaaugacccacucuccgcacccuuccuuaugaguuuaaaugucuccguuuuuaggagaugcggugcgugugcggagcaucgggccuagagggaagggagauggaggugggaggccucugccaagaaacaucugcggagcugggaaggaggaaggguggcgggacuguccauugggauccccagggcugcgaccacaugcugugcccucagcagggugggggcucagagcagagaccccuccugccugccccugccuccuggcacacauaggcugggcauaacauucaaggcagcuuugcagguggaguucauguggggacuccacauccacuaagauucuucugcuagcugguagggcguccccuguagucacgccuaaggcugcugcagccgaaaggucagugccaaggucgaaggccaacugucaucuguaucuucaugccugcagugugguuugauggcccucaaaccuuaggguuggguugguucgggggcuuaguuagggacuuauuggucugcgucucugucuccuccccugcacguggcuuggucuacgagccucucaguauguuuugagauacugaacugugaaucugccucugguucuugaucguuucuuuccuucuugccgcuggaugaugcuccgucccuccagguccugcucaugggccacugcucugcuagguguuuucagaacuauuugcagcuuucucugcaaggagagauuuuggaaaaacaccacaaaaaggaggccuaguucuagaaugucaaaacagcuggaugcaggguucugcccugcacccccacccucggccagccccugguaggggaggaggguucaggugauaucuggugcaggugggaggcccagcugugcgggcuccaugugguggaggcagggcagaggcucagggcaggggaggcagguggggacuugggcgucagacccuucucaucgacugggcuuuccccagugcagguggauggaggagggagagaagugcaccugcuuccaagaaaugagggcuuugcuggcuugccugagccccagugggugacagcagggaaggggccacagaugggcaacagacaugccugacguugucugagcccauucugugcugagggucugugcccuccugcucugccacuuaacccugagcggacgcugggcgagcccugucagugcugggcucauggccuucugccagcccuacucucccaagguggcaugcgcugcugcuccugccagacaguggaggcugcuggaggugccuuccccucccuaucccucccuccuuccggcucucccugggccgccacuccuggucuccccugcaggucgccgaggggacugcuugccaucagaugcuggguuggcuccccguagauguugccacagcagccccuucuuguccagguccugcucccucuguaccgcgucucgccccagcugcuggcagccucugugcaguuggcuggagcccaaucccgacagcaaaaaugugggggugagcuugguguguccccuccagcuugucguccuggcuguaucuuuggcuuccaugcagagcuggggucaucauggguuguuugggcauuuucugggcauuaucagaaucccagcggccucuggugucuacauguggucgugguggugucagggggaaagggucauucugacugcagccugcucuggcuuggccgaguccccugcccaggacacagcaaggcggcccagcccuggagaccugggugcacgucccaucccuccccuccacccuggcucagagcccugcuucucugugcuuagguuucucccgggucacagauguucaaggcauuuucuuuucuuucuuuucuuuucuuuuuuuuuuugagauggaguuuggcucuuauuacccaggcuggaguacaauggugcgaucucggcucacugcaaccuccgccucccagguucaagcgauucuccugccucagccuccugaguagcugggauugcaggcauguaccaccaugcccagcuaauuuuguauuuuuuuuucaguagagaaaguguuucuccaaguuggucaggcuagucuugagcucccaaccuuaggugaucugcccgccucggccucccaaagugcugggauuucaagcgugagucaccgcgcccagccucaaggcauuuucuuacagucucccugguucuauccuuucuggcauucccaguucacagacgaugaagcugagguuuagcucgcuacagugacuuggccaagucucaggcuugcaaggggcagagccucccuggggagcccgggacucacuggcaggccacguaggauuaaccgugggucccucaacuucauccucgguagguuugugggguuugcucucuagcagcugaaggccacccagggccccuuccuccggccagccccagccucuguccguggugcugaaguucauggcggccucucuuguccuuaccuuugcuggggugagggcucagggagagcgugucucucagaucuccugaagggcggucucuugaagcuggccaaacucugacacccucaacgggacguggacaucacugucucaucuccaccuccccaaaggaccgaggccgagcuugggagccguggcuccagggcccagcaucuccuccagccuugagagcaggcucccagccaguggcugugucaguauucccggaaacacccggguuccggaaaagcaaagagcacagaggcccugcugccuggcagcuggcagcgccgcugacucuggaggcuuaaugggcuaagagguuugggagcagggaggcuggugggcaggggagagggagcggggcuuccaggagaggagggaagugcaggcagccuguuggaaggggugcuucccagcuggaugucagagggggcccccaccuccccugucagugaccgucucccccuccacgaacuguuggaugugacuguuuggagccacucuccugggaaaaggcaggucauccccucuugacaguguggccugaaagggcagaguugggcugggggccucccaagacuauccagggaggccccccgccuuugcugccuccucauucucuuuccuucugccacccuuuccuuuccuucucccucccucccucuuuccuucauccucccuccuggccacugcuguuuccugagcucauuuuuuaucucuccgguucugucuuaaucucaucccaugccucuccuugcucaccccgaaaacaguuaacagcaguccugcgcauggcaagccccgcaugccccggggaucauggcagugcugcccggccccucccugggaaggggcuguggagggcuucgccaguugacuugugucucuaaaggccacaaguaaaccacuuucuccgaggggcagcaccucucugguggggugcucugguuguaaacgcccuuaucuccauauaaaugggccauuuucugccuguacagacaggaaacuaaaucaaggaagccaagcuuaagagcugccuaaauuaccuugucucauauggagaggaagcggccaggauggggugggagagggggaaggugggcuugugccauccauagcagugucugcagaguccgcacauggagaaaacugugaugugccugcugcauuaauuacagguuucaccugacgaacgcaguuccaugggaugugaacuuaagcagagagcuguggcgcuggggccugagaugcagcggcccuucccuggcuggggcucuccuucucuggcuggggcccuucccuggcuggggcucuccuucucuggcuggggcccuucccuggcuggggcucuccuucucuggcuggggcccuucucuggcuggggcccuucccuggcuagggcucuucuucucuggcuggggcccuucccuggcuggggcucuucccuugcuggggcccuucccuggcuggggcccuucccuggcugggguucuucuucucuggcuggggcccuucccuggcuggggcucuccuucucuggcuggggcccuucucuggcuggggcccuucccuggcuagggcucuucuucucuggcuggggcccuucccuggcuggggcucuucccuugcuggggcccuucccuggcuggggcccuucccuggcuggggcccuucccuggcugggguucuucuucucuggcuggggcccuucccuggcuguggcucuucuucucuggcugaggcccuucccuggcuggggcuuuucuucucuggcuggggcccuucccuggcuggggcucuuccugugcacuuugcuuuuugacucugggaccacauccuccaccgccagcuccuggguccaugccucaucauguaaaacuaauucagcccccaaaguccauagaagcccaaugaugacugaagcggagccugaguucacccgcagggcugcuggagugggcugagccgagcuugcagauggagaagccugcucucacgagagccucaccucgccucaccugcagguucuacugcuuccuguggcguagacccuggggacaagacuuggcucaggcuggcuugggguugccccuuuggcugggcuuuggggcugagcugugagcaguggccucugaugaugaguggagugauggggaucggucgauccccagcgugggccaggagguagcucucagggccguccugccacccaggacucuggauguuccuggggccucuguugcccucacugucccccuucuuuuccaggggagcaaugaugagcuaucagagaaugaagaggaucuggaagagaagucggagagugaaggcagugacuacuccccgaauaaaaagaagaagaagaaacucaaggacaagaaggagaaaaaagccaagcgaaaaaagaaggaugaggaugaggaugauaaugaugauggaugcuuaaagguaacuguggaggccuggcuggggggacagagcgacaucccccuuuaagggggcugagccucuugccuguauguucugugugugugugugugugugugugugugugugauggagucucacucuguugccaggcuggagugcaguggcgugaccucggcucacugcaaccgccucccagguucaagcaauucuccugccucagccucccgaguagcugggacuacaggugcgugccaccacgccuggcuaauuuuuguauuuuuaguagagacaggauuuuaccauguuggccaggaugguccccaucucuuuuuuuuuuuuuuuuuuuugagacggagucucgcucugucgcccaggcuggagugcaguggcgggaucucggcucacugcaagcuucgccucccggguucacgccauucuccugccucagccucccaaguagcugggacuacaggcgcccgccacuacgcccggcuaauuuuuuguauuuuuaguagagaugggguuucaccguuuuagccgggauggucucgaucuccugaccucgugauccgcccgccucggccucccaaagugcugggauuacaggugugagccaccgcgcccggccuccaucucuugaccucgcgaucugccugccuuggccucccaaagugcugggauuacaggcgugagccacugcgcccagccuguucuuuuuuucuuuuuuagaaggaguuuugcucuguuguccaggcuggagugcaguggcuccugccuuagccuucugaguagcugguacuacaggcacgcaucaccacgcacagcuaauuuuugagugagcagcuauuucuaggggagagugauagauagugugagcucaaguuuagugucaggaaccucuugcuuggagcaauucgggaaaauaaaacaacaaauggagucuuugccacaagaagugcuggacagcuuuguuuaugguagaaagggaacuuguguucugaaauccugcccaagcaggcauucccggagucuccuacugcacguggggcagagcggcuacagagaugggccagcucuccccugggcccagcguccccaggaacaugggaaaugaugugaaggaagccaggccuuuauggucaugcugaggugcuccggagucucagaggcugcacccuggggcuccuuggggagauggagaggccaggggugagguugguggacaggcagugggugagugacagugccauucaggaacacugugcucccuuuguucuuuuaagagacaccaaggcucgguuugggcuggucacagauuuaaagauaaacgcucuguaaauauuaguacaguugcuguugggugaggcagaaaucaugaaugugaauaacugaaguugggaggugugggaggaggagcgauucuuccuggcgguguccugacaccuggggugauuucaugagucaguggaguguugugagucaccggagacggaucgucgcugcggggcugacaguucugaaagcuucacuuaagagagugauucaggaucacccuguaacaguaucauccccucgcucaccugcugcucugcuguccuggguggggaccaagggguccgugugccaucaggaauggccauguguguccacgggggcaggucagccacagagggggccccaugugaggaauucucugagcugucacagaacaggaggcaagaaugggcucuggaggccucccgcagccuggaugggcagacugguucucagugcugggagacgcucagggcagccuccuguugcaggagcagaagcccagcuccggggccuaggcaguagagggaugugugggaucagggcccugagaacuaagaggcaaggggcuucgggguugugggacccagugguguuaucagaggcugucucuuugcaucauucacucugccucugcuguggcaguguugggcucaggccaggcacccucauggcugagcauucuuguggcugagaaugagggcagcagcagcucggggcuucuuggccccuccagcaggagggagagcaggccucccauguccagguaugcaggcaggagaccagcauucccucugauuggacuggcuuaagacaugacuggccugaccagacuuuggccuaggagugguguguacugauuggcuuaauguaucagguugggugggggcagcucagggcugcuuggaagaaguggggugucagggaaggaagaagaaggguggguugggugcuaacaauugcuaacgcauuuugacacacccuguuccaagcaccugcacuaagucauucuguucugcaaggcagugugccauuaucuccauuuuacagauggggaaaccgaggcaggaaaguuaaguaacuuauccacuucuuaccaccgguauguggcagagccaggaucagaaccagcccaugcccacauccggcaccucccuuucugagccccgccagcccgggccuggucaucuggucaccugaccccugggcuagcucucuugagaacucacugugccccugggauguccccccaccccaggccucagcaguaguuggauccucucagggcugugcccccaggaugucccuccaccccaggccucagcaguaguuggauccucucugggcugugcccccagcuggcccauugucccaugccccugccccagcagagugcacuuuccuuucacuggaaacuggcaguggccuguccuucacaagggcugacguagcuauaccuggcauccuggggaggccucaugucuuuuuuuuuuuuuuuuuuuuugagacagaaucuugcucugucacccaggcuggagugcaguggcgccaucucggcucacugcaaccuccgucucccgaguucaagugauucuccugccucaggcucacaaauagcugagauuacaggcacacaccaacacacccaacuaauuuuuguauuuuaguagagacaggguuucagcauguuggcccggcuggucucuaacuccugaccucaaaugaucugucugccuuggccucccaaaguguugggauuacgggcgugagccaccaccccuggccuggaggccucaugucuuucuaaaguggcuuaggcagcccuggagcccugcggccucaucagggacaucuucccgucuucaggccacugugcuguccugcuguccaaauccccagaaugcaguccccacagagggcaaguucuguuguccugcccuggugucccgaggcuggucgggcagcccuaucucaggaugggggccuggucucaggcauccagucuccuugcccacaccuggcugauuucccuuucuggaaguucagggcacacacauggccucuccccaaacccugacgucgaacacuuggccugcacuucgugggcuggcaucugagacguggcacagauugggggcugcggggcugcggggcugcagggcuugaauguuuccuagggugggugagaauggucugguuacauugcagacacaaccccuccucuuuccccugugccaaagccuccuaggcagagacccuggggaugggggugcaggucagaaggccccucaacaacucuaccucuggccugggucucuguaggagcccaaguccucggggcagcucauggccgaguggggccuggacgacguggacuaccuguucucggaggaggauuaccacacgcugaccaacuacaaggccuucagccaguuccucaggugggcggggcacuagggcuguucuccaggcccgcacauccucuggugguaccaagucgggagggaggcagaggagugaagccccggcaccugggguaggggugggcucugucagaccgacugagcaaccugggggagcuggagggagggggcaggaccccuucauguuaacagaccaccaggccuucccuugugggcccugccccucagcccuugagucucuuccccuuggggaaggugguuccagucuuuccuggggggucuuucaccaccauggccucucagcucugguagaggugggacggagaccccaaggcccacuguagcccaccuguggccccacaagucuugcagggccugaaaacccaaugagaaaaucaccaacuguguggacaggaagcugggguguuuugggggugggcuguggguguggacaggaagcuggguguuuugggggugggcuguggguguggacaggaagcuggguguuuugggggugggcuguggguguggacaggaagcuggggcguuuugggggugggcuguggucaguggguuucccgccuaaucucucuaaucaggaaccuggggcugcugccauagaucgcacauguggcagaggggugggcccugccgggggucgggugggccucucaucucaccuggccuugcccucacccuccugccucucccccuacaggccacucauugccaagaagaacccgaagauccccauguccaaaaugaugaccguccugggugccaaguggcgggaguucagcgccaacaaccccuucaagggcagcuccgcggcagcagcggcggcggcgguggcugcggcuguagagacggucaccaucuccccuccgcuagccgucagccccccgcaggugccccagccugugccuauccgcaaggccaagaccaaggagggcaaagguaaggcugggguugggugggcaccuagucccgcugggaagaggucccuuucagacccuauaggagaagccacggggcagacgcgggcagggaggggcagcuggggugcuccuaauggagggcucugugccugugugaccuuggauugcccgguccuuucucagcagugaggcagcaucgucgccucuuuugugccugacucccuuuugggguugguggagaagcagaggcgaugaugugggcagaggucugggagguuugagccuggccagccaggaggugcccccgacgugggccuggagggagggcgggaccagagguacgcagaguggagccgcuccagccuggguuucugggaguuggcaggcucuuggguuugagccugugccguuucuggggaggaggaggaggccccagucgagcccgucucuucuucuugucugcauacccacugugugcaggguuguucuccaggcccucggccaauguggagcauggaggcccugccccuccagcuuuaggauccgggaagcaggcaggaguuggagggacugggcacggccaggucucgcuucccagggaggcuguucugggacaggccuggaaggagaucgagauccaaauucugccucaguggcagggcgucuggguggggaggaugcaggcagcagaggcccccugugacuugaaggcccuggggagggagcuuucugggugcagguuucuggccuuuuggaggcuggggauguugaucuccccagggcugucagucaccugcagcucagcuuuccugggugcccugauuuguuuuguuuuguuuuguuuuguuuugacagacucucacucugucucccaggcuggagugcaguggcacgaucucugcacacugcaaccuccgccuccuggguucaagcaauucuccugccucagccuccugaguagcugggauuacaggagugcaucaccacaccuggcuaauuuuuuguauuuuuaguagagacgggguuucaccguguuggccaggcuggucucagaacuccugaccucaggugaucugcccaccucggccucccaaagugcugggauugcaggugugagccaccgcgucuggcugauuuggguuuugauggaaggggcugagggggcuccggggaucccuucuuucagccccaaggagcuuuaguuucugggguucugugucuggcaucaccaugccaagucucugaagggagccuggugggugaagugacaagggucagagucuguucccuguccugcuccaucugucugggccaucaggaucucgggaggggcuccuggcccgccccugucugcccagccugccuuguuuucucauuuccucucgcgcuccagcugcugagcuaucgauuccaugagcugcuuauucagagcuuggaaaauugaaauagauuuuccgcggcgccauggagggugcagcugggcuccuagcuccauguccgugugugugguguggccagaggacggccuggggagaggcugccucuguggggugugcaucccugccuccaggccccccuuccuucuugggucauuacuccccagguagcuaauugcccuguggccagcuccauaaaaacagccucagcccugcuggcccuugcugggguugacuggcagagguggggcagucuugggugggaccagcauugccuggcuggcaggugggaaaaggccuuuuggcuccaagacauccuuugggggcucaggcauggaccacaggugggcggcugugccuucaguggcccugcuggcugugggggauggcuagugccuccuuucagugguuggagacgguauaggggauccucccaaaagggccacauuucugugggucauggacaaggggcagcaaggcggucagggcagccuccagucagagccgucaucugguuuuugccucacuugcugugugauuuuaagcaagggguuuaccucuccaagccucaggcaucucaucugaaacggggugaugguagaaaugacccuuuccuuauuggguaaccgagagcucagugagaugauggcaggaagcaggccgucagugguggcagugguuggcuaucaucacugcuguuuuucagggccuggagugaggaagaagaucaaaggcuccaaagaugggaagaaaaagggcaaagggaaaaagacggccgggcucaaguuccgcuucggggggaucagcaacaagaggaagaaaggcuccucggugagugugugcgugugugcgcgugugugugcauuugcaugcaugugugucugcacaugagcacgcaagggccaggcgagggccuucaguucauuacaaacuagcuggggcaggucgcaccccuccacuauucuccuuccauccuacaugcaggugugcugggccucaguuucuccauuugugugaugaggaguuuagauugaauccuuccaagggcccuucuagccuggacucugggcagggagugcuccccuggcucacccuccugagugggagcucaguccuggcuccugcuguccacagcugcaacuccauuugggcaggagguggagggaucuguccugguggggccuggccgcccagcacccaggucugcucucggggggaguaguugggugggggcuggacccuagagaagugguauguggguaggaucaggcuggcuggagccccaguuaccuccuccuguccucagggccagcucugggcccaggcucagacacuaagcccaggucuuacucagccuuggggccccccuuucucugugagugugaggggcauucgcccuccucacccccacagguagcugccucccucaccucaccccagcccugcgguggguggaguuggaagcucuuucccugcaccauggcaggagccaguguuaggucuggaggggagcauggagagaagguguggcccgcccuggagcugacgguccaguucagcuuagcagauauuuguugagcacauacuguguaccaggcccgcugcucagccacagugggccgugguccuguagcacucgucaccuggcaggcauguuugcugguggagagcccgugauguaccagucagacaggacaggccagaccuggcacacacgcagccacaguagguccaguaaaggagagaucugggaagacuucuuggaggaggugucccuagggcugccccuugaaggauguuuaggaguuuggcaggauggagggcaaggccugggaagcuguucagagguggaaauugugggaagugucugaggcuggagagcagggcucuggguaggcggugggacaucaggcuggacaggcaggcuguaaugugagguuuucagcuguguugggggcugagaugaaucacagagagcacugugucuccagagccucuuccgugcuuugucccaccccacacugccugggccagcgaagccuucugggugaagcccugggaucacaggacccugucuuccccugcagagugaagaagaugagagggaggagucggacuucgacagcgccagcauccacagugccuccgugcgcuccgaaugcucugcagcccugggcaagaagagcaagaggaggcgcaagaagaagaggaguaugacuccccuuccagagaguucuuggccugcuggguggauguaguggggcacgaguaggacuccccaucuggacgguucucggccugccggguggaugugcggggcauggaaccuccccgugggaagcagggggagggcauccucaugucucagccagguggggccccuguguuucccacacggcccugguuucuacugucuggggaggggcauccugucccaguaaggaaagaacaaggaaccuauggugggagcuaccccagggcauuugcauuagcaguguggugacuggagagggaagugcuucaucucaucgccauccucccuucagucaccccccacccacuuaacacccaucuuuaccucaccuuccuucccaucccuccuucucccuccuucccucagucccuucuuuuuauccauccauccuucauccauccagccauucauccaucauccaucaucaauccauuuguccauccauccgucagcuauccauccaccauccauccauccauccauucauccauccuuuuguccauccguccguccguccguccguccauccauccauccauccauccauccauccauccuaucauccauccauccacuuguccauccauccauccauccauccauccauccauccauccauccuuuuguccauccauccaucuguccauccauucauccaucccauccauccauccacuuguccauucauccaucauccauuuguccauccauccaucauccauccauccauuguccauccguuauccauucauuuguccauccauuauccauucauugguucauccauccaucuaccacucuguccauccaucauccauuuguccauccaucauccauuuguccacccauccauccauuuguucauucaucuauccauccuuuuguccaucuauccauccauuuguccaucuaugcauccauccuuccauuuguccauccauuacucauccauuugcccauccauccauccauccauccauccauccauuuguccauccauccaucauccauucauuugcccauccauucauccauccauuugguuuauccauauauccauccauucuuuuguccauucauccaucuauacauccaucuauccauccacuuguccauccauccauccauccaucauccguccauuuguccauucaucauccauccauccuuccauccaccuauccauccauccauuuguccauccauccauccauccaucaguccacccauuuccauuuguccauccauuuguccauucaucauccauccauccauccauuuguccauccauucaucuauccauccauuugucuauccauccaucauccauuuauccauucaucuuucuacccauccacccacucuccuacccuuccuuccuuccuucuuuccuuuuauccaucuucuaucuccucacccuuuuaccaccucaaccaucagucuauucacccacccaccuuuccauccacccucuauuagacaucuacucugugccugucuggccuggggcgaugcaguugguugugugcugggaguguggaugaggacuuccaugacugccucuccccuacccuaguugaugauggugacggcuaugagacagaccaccaggauuacugugaggugugccagcaggguggggagaucauccugugcgacaccugcccgagggccuaccaucucguaugccuggacccagagcuggagaaggcucccgagggcaaguggagcugcccccacuguguaagccuuggcagagccccgggcugggggcggggccacgccuggcucccccaccccugugcccucauuugggggcagaaugcggggagaugcuguaggggagggagggagucgggccugguggagcggggaccccgcccagggugccuccaccuggccuccucccccaggagaaggaggggauccagugggagccgaaggacgacgacgaugaagaggaggagggcggcugcgaggaggaggaggacgaccacauggaguucugccgcgugugcaaggacgggggcgagcugcucugcugcgacgccugccccuccuccuaccaccugcauugccucaacccgccgcugcccgagaucccaaacggugaauggcucugcccgcgcuguacugugaguguuccgcccgccccgcgccggacgccccgccccaccccaggaacaggccccgcccccaggggaaggccugcccuccucaaaaggccccgccccugccggcuccugccccgccucgguagccgaucccgcaaagcuucgcccgcgcugcucgagaccccguccacaauagcuuccucgcgcccuucuccgcgucugacuccccuagagacgggaggcaugaguguuagggaaaggcagacagguguggugaucaugccaacaccgcgaccacuguucagugaccacgugcucugcaagggcuccacauccaucauaguguccuuuaacauuacugaguauucuggcaccaggcauguuacucccuuuuuagaugagaaaacugaugcucagggaagcagagugaccugccuaaggccacacaagggcagaacuauccacucaaauucagguuccuggagccaccccagaccuggcuccuguuccaaggcuggggauagggagagggcaggaggcuucuagggcaggaggcuccuagggcgggagccucaguuucuacaggaagaggggcaccccccauccgucaccccccagucacaguagacaucggaaggccccuugcucugagcugucuguccugcccccuguggugccagauccuccaccccucagguccugggcugugccuccuuuagcccugggccguccugugugcauugugcguguguaugugugugcgugcauccgugcgcauacuugucugugucuguguaggggccaggggaggacccuuuugaggggugcagccuucugugcuuuccuaggauugauggaaggcccuggggaugggaggggggcaggagugggguuccucucagcuucuucccugaggggcugggauggggguaggaggguccauggccuggguaggaaggguccccucuuccacucccccaagagccaguggaggagccuuuccugccucccauguccuccuccuccuccucugccucucggccuuugcugucaccaaggccaaaggaaggcuggcugugugguguaccuugcaccuccagaaugccuucaggugugauguggcaccacagaucugguagguggaggaaggggugggccauuuuacagaugggaaagcaggcucuggaggcuuggaugaguuuccgaggacagguaguagcaaagcugggaccugcuauccccaccagagcugucucccugaaucagucacccccgacccuguccagucagacagcaccgccuccuuggagggccaaggcugcucccacccaucucagggcccgaguggugugguuuguggcuguuguauuucuugccuuugccagccagcagcucacugucacccuagcaucugucagggccccugcagugugucugugggcugccagagauggggccucauugucccagccuagacgcacggugccugggugcagcccugccccgggugagggaugguggauggggcugccgugucccugggcuccagcacagggcucaugcucccugagugcuuggggaucacacagugaugugaccucuuuucagggggcaaugggaagaccuaagguaggggaaguccagaaucucauguucugcucccugcucugcugucccuugccgagugggccucaguuucccccucuguccuaugcacauggcagucucaccuacgcuggcucagauauucugggugccgauaaguucaccauugagugaaagggccacguggucucacagacccccacugcccaucuccugugugcaugacccaugcggcuccuggggacgggguggaugucauggcgucaccgugguacuguucugacuugggggcaguggcacugaugggagggagccugcauggcagccugcugucaugggagccucaggguggggcccugcagcugagccccaccuuggggacccuucucuguccacagugccccccacugaagggcaaaguccagcggauucuacacuggagguggacggagcccccugcccccuucaugguggggcugccggggccugacguggagcccagccucccuccaccuaagccccuggagggcaucccugagagagaguucuuugucaagugggcagggcuguccuacuggcauugcuccugggugaaggagcuacaggugagugcccgggaggguggcugugcuaaggcccgggaccuggugagcccuggacccuccugggcuggcgggaaggggcugaagcgccucugacugaggggugcuguugggaguugggguggugcugagcgggaggauuguccugccugggaccugggcuggggcuagaggagcuggguagggagaugcaggggaccauggcccaucucccuucugugacuuugugccgcuccaugagcagcuggagcuguaccacacggugauguaucgcaacuaccaaagaaagaacgacauggaugagccgccccccuuugacuacggcucuggggaugaagacggcaagagcgagaagaggaagaacaaggacccccucuaugccaagauggaggagcgcuucuaccgcuauggcaucaagccagaguggaugaugauucaccgaauccugaaccauaggugugugccugcaggcggccacccugcccaucgcuggggccgggccacgucagcuucuuugcccuguaaaaugggugcagcgcagggugccagggcccuugcuuuggggcugccgugcagaaccacaugugggcacagcaggggcacaaggaagggcccaggguucccagugcuggagaucugccugaccugcuagaggggccgucccaugcaugccggcacacucaugcauacguguucacaccccuggggcgucgggacccucaugcuggguuagugcuugauaccagcaagaggguucugaggacgagggacgcccgaggugugggaguauguccacauuucccccgcguuuguaacagcagcuggcuguacugagcacugccuacccugggagggaggcgucuuacuuucaccucuguuuuacugaugugagaauaggcacagcaagguuaagucgccagaaucacacagccacgggguggagcugggauuugaaccccaugcuuucugacugcaggaccugcuuucuuagcuacuguugcaccccccagugccccagcagcagcucuuccuggagcagucuggcaguucccugggaugccuuagcaaucagaggcugcaggaggcuggcacaaagagccagaggcaggaggcccgugggcuuugguuuugauuugguggguggugggaaugccugcugauucuugaguugaggugcuugagaacuggugguggcugacagaugggccuugggguggggcccagaguaccugcugccugguggcagcuuggagcuugugcuccccaucccagcuacccuguggccucuguuuuugaggggcuuaggaucgguggccucugacacucagugcuucuggcuucaggcagcuguuggguagagcagagguuaaaagccugagccagauguucagauuucaaucccgguucccaucugcugagcuuugaggcccuuuuagggaacaggcugcugcacgggugacaggagcuugccagaggcuggcuguggguggucuucaguacgagggucgcggaauuugaaaaacugccccccuucaacuaugggacaccccccuuuuccuccccaggccucccugagaaugaccuucaagggucaguuccugugggaaccugagcccggcaaugaauuggcccaugguuuucuaccuuuacuaaauuacaugcuaaaaauauacaugguaguuuuucucucugccccaaaguggggcaggugaaucucccccagauuuguucccccaaucugcaaaacaaucaauuauguaugggaaaacaaacaaacaucgguugccgugguaacgggaucgguuuuucucuuaauguucccaggcccgcagcagccgcugcucaccgggucugugugccuccucggcacugcugugugggguagucaagccccagcccggcccuccagcacuccucuggccugguugccuuagccugggugggugggaggcccuaaagacccucccaguggccagaaucaagcugugugcugcugggcuuggucacugggucuuuguguccccagaagagaccaccucacacgcaggaauugcauccuuaucuacuuugcagagaugacuccucacccuacgugggcacugcacaaguccuuugcguauuuuaaguuagaaaacugaguccauuggcaggaaggagaacuuuccaacuuagaaauccagaacuccugugaaaauccagacccugugacaaaugggauucaucccugccacagaggcugcaaaggaugugggaggcuggcucauugcuccucuguuagcuggccuccgugucccucuccagcucugccacaucccccucucauucgcuguguggccccaggcaagccgcugcaccucccuggagcuucugcccucgucuccuccuccuggcugggcccagcauccgaggggacccugggugugaauggcucugcauccugggaggugcccuucaucaaaccugugcuguggccacugcucugagcgacccacaucuguucaccguguugcagcuuugacaagaagggggaugugcacuaccugaucaaguggaaagaccugcccuacgaccagugcaccugggagaucgaugacaucgacauccccuacuacgacaaccucaagcaggccuacuggggccacaggugggucgcagggauccggcugcuaggcacaggcugccgggaccugcuccugggcugagccuugcucaccugccuccaaugccguuucccagggagcugaugcugggagaagacaccaggcugcccaagaggcugcucaagaagggcaagaagcugagggacgacaagcaggagaagccgccggacacgcccauuguggacgugaguggggaggguggggcagcagugggugggguugccagggccugcccaccucagacuugaaugugcaggggguguguguucucaaaaggauguuuccuugggcccucauggcuuaugcagacagugucaugcccauguaggcuaggacagcuggaaggccccucauaacacugcagcugacaugcuacuuacacaccacucucaccugggaggagacccaggaugacucacucagcagagcucccuggguguccacuagcgccuggcccuggguuggcccugaggagacgagggccagugagcccuggguagcuguuucagaagacacacugucuucuaggggcccuugguggguauccacagaacacggagggccuggccugggacuaucaggcgccugucagaugcuggggaaaggcagaugggccugguccauugggaggacugcauggggccagugaccuggagcaggaucaagagacaaaugggccgggcaugguggcucaugccuguaaucccagcacugugggaggccggggugggaggaccgcuugaacccagaaguuugaggcaacguagugagaucccaccucuacaaaaaauuagccaggcacgguggugugccuguggucccagcuacuagggaggcugagguaggagaaucccuugagcccaggaaauugaggcugcagugagccaugauugugccacugcacuccagccugggcaacaaagacucugucucaaaaaaaaaaaaaguaaaugucuggauccaguggaggagccuguuacugggggcguugcgaaugccccagauggauguucguuuuguuguucauccaaaaaauggugaguaagugaccacaugucccaggcacugugugguacucaagaggaggcagugaacaggaccaagguggugaugacaaccugggcucagagucagagaauucaacagucgggaaauuucccugauaggagaaguacagggcugccaugggaggacacugugggagcacuucagccaggcugggagucagggagggcuuccuagaggaagagguguuccauccaagaacuggagaagaguuaggaagacagacaggagugggaagaguguuccaggcagaaggaauugcaugugcaaaggccuguaguguggacucugguggcccaggaucuggggcgugucugaaccgcugccuccccugcagcccacggucaaguucgacaagcagccaugguacaucgacuccacaggcggcacacugcacccguaccagcuggagggccucaacuggcugcgcuucucuugggcccagggcacugacaccauccuggccgaugagaugggucugggcaagacggugcagaccaucguguuccuuuacucccucuacaaggaggugggcaggcggggcaggcggccaggagggguggcugguccuggccaagggcagguggucucacggcaucggccucucucuccagggccacuccaaagggcccuaccugguuagcgcgccccucuccaccaucaucaacugggaacgcgaguuugagaugugggcgcccgacuucuacguggucaccuacacgggggacaaggagagccgcucggugauucgggagaacgaguuuuccuuugaggacaacgccauucggagugggaagaagguauuccguaugaaggugagggcucgcuauccuuggaaggacgguaggaaggcccccggucuaguucagggaccacgggugccgugcacuccuuuggggucccucagccugggagggcuaccgaggccggcaggcucugaggggcuuguccuagaggcugaguuacagccaugucaguuuucuggggcuccuguaacaaagugucacaaauggaguggcuucaaacagcagaaauguauucggucacaguucuggaggcuggagguuggaaaucaaggugagggcagggccacgugccucugaaagcccuaggggagaacccuuccuuccuccuuccagccuccugguggcggcagggguucacuggccuacagcugucgcgucaguuucugccucuguuagcacaugggguuuucccguuugugucuguuucucauccuauaaacacaucauucauacuggauguagggccuacccuaauccaguaugaucucaucuuagcuacuuauuuuauuuauuuauuuauuuauuuuuuugagacacuguaucgcccaggcuggagugcaguggggcgaucucgacucacugcaaccuccccguccugggcucaagugguucucccaccucagccucgugaguagcugggacuccaggagugcgccaucauggccggcuaauuuuguauuuuuugguagagacagguuucaccauguuggccaggcuggucuugagcuugugaccucaagugaucugcccuucucagccucccaaagugcugggauugcaggagugagccacugugccuggccccaacuaauuauuauuauuauuauuauuaauuauuauuauuauuuuuuugagacggagucucacucugucgcccaggcuggagugcaguauggcacgaucucagcucacugcaaccucugccucccgguucaagcaauucccaugccucagccuccagagucgccgggauuacaggcacaugccgcaaugcccagcgaauuuuuuguauuuugguagagacaggguuuuaccauguugcccaggcuggucucgaacuccuaaguucaggcgaucugccugccuuggccucccaaaguguugggauuccaggugugagccaccacgcucagccuauuauuauuauuauuauuauuauuauuauuauuuugagacagggucucgcucugucacccaggcuagagugcagugauugaucauagcucacugcagccuugaccucccgggagcugggacuacagguacacaccaccacacucagcuaaguucuaaauuuuuuguagagauggauucuccguauguugcucaggcuggucuuguacuucugggcucaagugauccuccugccucagccucccaaagcauggggauuauaggcauugagccaccaugcccagacaacuaauuaugucugcaaagacccuauuuccaaaagagcuucuggguggacaugaauguuggggggacacuauucaaugcagugcaccagcugugugacuucuggcaagucacguggccucacugggucucaguguuuucucagcaaaauggaguuaacagacacaccccacagagucaagugaguuaauaagcaugaggucucauggugcugugaacccugcaaggucuuguuaaagcacagucucugacccagcagugcugggguggggcccgagccucugcauuucuuuuucuuuuucuuuucuuuuuuuuuuuugagauggagucucacucugucgccaggcuggagugcaguggugcgaucugggcucacugcaaccucugccucccagguucaagcgauucuccugccucagccucccaaguagcugggacuacaggcgcgugcuaccacacucagccgcuuuuuguauguuuagcagagacuggguuucacauguuggccaggauggucucgaucucuugaccucaugauccgcccaccucggccucuuaaggugcugggauuacaggcuugagccaccgcaccuggccugagccucugcauuucuaaacccucuccacauugaggaaugaggacuuguagccauuggccccuagaagaugucagugcuacagccuugggggcugguggauccucgcacaggcccuccgagucccucaggucggccuccuccacugccuccuagcagcuguggcucuuagagaugcucggaaacuguugaaugagugaaugaaucgaugaucccacaggugacuuuguagauggaugagccccuggaucaucagacgcaaaagaaccuccccugagccacacugggacccugccgugugccaagcacuuugcugauuuggcucuucuauuuuauuguuaagaguugugguaaaauacacauaauguaaaacuuaccaucuuaaccguuuuuaaaaguacaguucagcugggcacaguggugugcaccuguaguccuagcuacuugggaggcugaggcaggaggauugccugagcccaggaguucgaggcuguagugcgccaugauugugucugugaauagcuguuguacucuugccugggcaacauaaugagacucugucucuuuaaaaaaaaaaaaaaaaucagccgggcacgguggcucaccccugugaucccagcacuuugggaggccgaggcgggugggucaccugaagucaggaguuugagaccagccuggccaacacggugaaacccuaucucugcuaaaaauacaaaaauuagccaggcgugguggugggugccuguaaucccagcuauucaggaggcugaggcaggagaaucgcuugaaccugggaggcggaggcugcagugagcaccauugcacuccagccugggcaacaagagcuaaacucugucucagaaaaaccaaaacaacaacaacaacaacaacaaaacaacaacagaacaguuuaguaguguuaaguacauucacauugguaugcaaccagucugcagaacucuuuucaucuugcaaaguggaaacuguccccauuaaacaugaacauccccaccaccucgagccccuggcagccacccaucuacugucugucuccacgagguugacuacucuggguacuucauaugaguagaaucgggaaacaucuaucuuuuugucacuggcucauuucacugagcagaauguccuugagguucaugcauguuguggcacgggucagaauuuccuuccaaggcuggagaacccccaucacagggauagaccacauuuuguuuaucuguucaucuguuguugagcacuugggcugcuucuggcuuuuaguggucgucaguaacgcugaugggaaggauuaugggugugcacauaucccuuugugucccugcuuuccugucuuuuggguauacacccagaaguggaacugccggaucauaugguaauucuauuucugauuuuuugagaaacagacuuagcucuuugagaucucauagcauucuucaccuagauaggcgaggagaccgaugcucggcuaaaagauugugugcaaacccaggugccacgugcaggcaaagccuaugcugcacggcauccucggcccucucugcucucucacaggcaugugggcugcugggagaggcaggcuuggugcagcacaggacaggccuacaucacugggggagaccggugcaaaaugaaaaugcagggcucgcaggaaaacagcuuuuuccuuucuucuguggucucugucaacaugccaagguguuuuaaauuugcuugcuuuuuuuuuuuuggagacagagacucacucugucacccaggcuggagugcaauggugugaucucggcucacugcaaccucugccuuuuggguucaagugauucucccgccucagccuccugaguagcugggacuacagauguccaccaacacgccuggcugauuuuuguauuuuuuaguagagaugggguuuggcuauguuggccaggcuggucuccaacuccuagccucaagugauccuuccaccuuagccucccaaagugcagggauuauaggcgggagccacugugccuggccuaaauuugcuuuuuaaagucguguuccuucagguguggggauccucaccgggagagugcagacccucacaggcaccaggcccuguccuggaacuuggugcauagaccgggugccuggcucccccuccccaaccagcacccagguccaggcccccaccagggggaguagggggacaguggucaccaggcaggggcaggggagcagggaaugagaaccugucccagggaggcuccacgcccccagcacacacuccauuguccccugggauauuuguuacaaaacacaaauucaacaauaaacaacaaaaugauuaauaauuucacaucagcaaccucagggcauuaaaccccaagugcagggucccuuucucuguucauauccuggcuaugccauuuguuagcuauggguaccugggagagugcuccagccugaggcccccugagcuuuaaauggggauaaaaggccaggugcgguagcucacgccuguauucccaguacauugggagacugaggcaggaggauugcuugaggccgggaguuugaagccagccuaguuaacauagagagaucucucuccaaaagacaaacauaacccuggggggagugggggauaaaggacacaauugagcuuguauguuuuguuaggaugaggugagaguggaaacaaaguaauaagcccagagccagggcuggucgugguggcucacgccuguaaucccaacacuaugggaggucgaggugggcgguucacuugaguucagaaguuugagaccagcuucagcaacauggugaaacccugucucuacaaaaauacaaaaauuagcugggugugguaaggcaugccuguagucccagcuacucgggaggcugagaugggaggauugcuugagccugggagguggaggcugcaagugaguggugaucgugccacuguacuccacgcuggggggugggaguaagacacugucucacuggagcuguuacaagccgaggccguuucuucuccuccuccacaccacccucucucagggcuguguucugagccucaguggaugccccucugcuugguggucagcaucugccccucugguccuaggcuggccggcccagggcuccguggagccuuuguggguuccugugcacaccuccuucuuggcucuuugucuccugggacugugauccgcucugcucccagccgucucauccccaaugccccucuuuucuccagaaagaagugcagaucaaauuccacgugcugcucaccuccuaugagcucaucaccauugaccaggccauccugggcuccaucgagugggccugccuggugguagaugaggcccaccgccucaagaacaaccaguccaagguagguggcgcuggccgccagaccccagagcuucccggggcgaggggccgcccagagcccccugacaggccccacucuccuccccucaguuuuuuagggucuuaaacagcuacaagauugauuacaagcugcugcugacagggaccccccuucagaacaaccuggaggagcuguuccaucuccucaacuuccugacuccagagagguucaagugagucaccuggaucuggcuagggagguggugguggggcuggguggccccagugaagacggaucaauagcccauccuggcugugagaccugcucggccguugcuuccucaucaguaaaaugggagcauuagcaauguccccgcuuugaccuccugcaggagcaggguguugggguggguggcgugggcacaugggaauguuugguaaauaucaacugcugcuaauaccacgacuuuuccuuagcucugcccuagaccacccgggguuccuccuggacugccuccccuggcagguuccuuucccuccacugagacccaagugacucacauaggcaaccgugguggaggcagaggcaagcuccccgguggccggagcccaccgccccaucccccucaucuucaccuaccuccacuugccugcucagaaugggggguucagggugcacagugucgauuuuggaaucaggagaugcaguguuuuuuuuuuuuguuguuuuuuuuuauuaaaagaaagagucucacucugucacccaggccagagugcaguggcuugaucucaguucacugcaaccuccgccuccuggguucaagugauucuccugccucagccuccugaguagcugggauuacaggcaugugucaccacgcccggcuaauuuuuguauaucuuuaguagaguugggguuucaucauauuggccaggcuggucuugaacucccgacgggugaucugcccgucucggccucccaaaguguugggauuacaggcaugagccaccaggagauguagauuugagggccgguuuuggcacagcuggacuguaucaacucgggcacucaucagagucaguuuccucaucuguuaucuggguaauagagagcuccuguccaggacgguuuugaggauggaaagguguccaguguggcugaggaaaagagggcugugauguguggaggugacacaggcuuagacagaaauugagacgauauccagggcaaugccagggcucccugguucaccagcuagccggccuacaugggcuaggcgcucugcacccugccuccccugccccgguccucugcuccuggcuguuaucccagcuuuuuguugcagcaaccuggagggcuuccuggaggaguuugcugacaucuccaaggaagaccagaucaagaagcugcaugaccugcuggggccgcacaugcucaggcggcucaaggcugacguguucaagaacaugccggccaagaccgagcucauuguccggguggagcugagccagaugcagaagugagugaugggcugaccccggagcagccugugcucgcccuuuccccugggcuggucuccugggucgauucccaggugggcggagggcucuucagccucacugaggucucggcuaaugcuuugcauacacuuucuucguggggccucuucucagguuuuagugaccagaguuugggucgcuugagugcuggcagugucccccagucacuugcagggggacuccaggccgguggcuucaccucuugggggucccuugggucucucuguaaaugggugcuuggccaccagcuuccagccccacugcagagcagagagagcccucauggaggcgggucugacccagccugccuuuccucgugcccugcugcaggaaguacuacaaguucauccucacacggaacuuugaggcacugaacuccaaggggggcgggaaccaaguaucgcugcucaacaucaugauggaccugaaaaagugcugcaaccaccccuaccucuucccuguggcugccgugguagguuuccccggccaucauggcagcuucuccaugaccgccaugguaggugccuguggccgccaugguaggucccuguggccgcugugauagguucuccuggccauuguggcgauuucuguggcugucaugguagguuucccuggccaucauggaagguugccuguggccacucugguaggugcuggggaacuuaccguggaacccgcugcugugguagggcuggugcggcugugagcccugccugggaacggggggccuggagccagggccgugggacccacggucuaccccgcacuguggggccuggccuggcucgggugugggucucauguucagugggcagacaggccaucaccccauugcucagcacuugucuguucccugcggccccuuuggugcagagucagagaggagaggggagcccaccaaugccccaccuccugcugugucugcaggaggccccugucuugcccaauggcuccuacgauggaagcucccuggucaagucuucagggaagcucaugcugcuacagaagaugcugaagaaacugcgggaugaggggcaccgugugcucaucuucucccaggugcgcugccccugcccacccccgccccggcuccacaccccacagagagcauccugcccugaugcuugggggcgcaaacuugcuggcaccccucagggcccagugccguucccaugugggucaugugacugugugucaggggucacucccccgugcccuggcauaaugcggcugaggagcucagaacacauuugccauaaagagcaacaucuccccacaccugcccuucuggucugcauguccaggcugguaggacagccccuccuccccugcccuggcccucucccccgcagccuggcuucucauuaagguagggcccuggggugugguugggaggagccccucucuccaauaggcccugaggggccacuggcaccuggcuuuuuggcuuggaggcagggccgccggcucagguguguucauuucuuccuccaucccuuuguuugcgucugucauagucaggcucugugcuggcacaugggugcagggaccagugaucuagucccuguccucaagcugcucagucuacugugggagacagcucaagggacagguacccgacccuguggucagcucuguguuggaggccacagugaugauccuacagggucauggggcuaaaaaugcuccucucgugggcccacugagccaggccccuugcucaaacccagagucugggcuauggcuccuugugcacaaacaucaacugaaagcagcguccgccgccugcagccccaggucacccugcugggcugcuucagcccgaagaauacuggaaagcagggcaaguuugagaccaggggcugagccaaggagugggcuggaguggagauggacccacauccccccaguaccucgguaccaacacgagacgcaagucugaucagaggccuugagauaccaaguaaugggaaccacacagcuuccagaaaugugcacacagggcaagcgacagagacggggcccuccugcccaaaaugagccuaugaaccccaauuccaaacccauacaaaagugaaugcugagacaucccccaaaacaauaaauagaauccaaauaagaaaauaggggcugggcgcaguggcucacccuguaaucucagcgacuugggagguugaggcaggaggauugcuugagcccaggaguucaggguugcagugagcugugaucuugucacuucacuccagucugagugacagagcaagacccugucucuugagagagagagagagagagagagagagagaaaagaauaggauagccugaaaagacuuuacauagauguguuuaggauccucaaaaaugauggaguaauugacacccuaaaauaaagaagaaauuaagcaaaagcaggaagaacugaaauaggaacaauuggauagaaacaugcaugaaauugagauaaaacauuucaacagacuggacagacucugaacacuguugaagagaacauugauaaauuggaaccuggugcugaggcauuuucccagaaugcaauguacagagacaaagauaaaacagggagaacauggaagacaccuugagaugcuccaacaaucauccaauuggaguugcagaagaaacagaaaaaauggugaagaaguuggauuuguugagaguuugcagaccuggagagaaaugugaggucucagaucuggagugcauucuggaauagcaagcaagauaaauauaaauaaaugaacccguagacacguuagaaccucuagguacuuuagaccuaguaccuacaaaauaagggcagccagaucguucucagacuucuuaacaacaacagguggcagagaccauggcaaaaucuccggugcacugagggaaaaugugugcugauaguuuuauauccagcuaaacucucucucgagaauaaagggaauuauacggggucaugggagcucagaagggacugccuuucuuuucuuauggggaggagugaaaucagggaagacaucacagaggugauguuuauguucccuaggcaguaagggggugggcauuccaggaagagagucagguaguuuggaauggcugggggcugugaaggagcacucguccugcagcgccuugaauacagggcagugagauggaacuuaauucuguguggugggagcaggggaggcucaugucagagcccugauuuagguaaguggcuguggggcuaggcaggaggauggauuggcuccaaggggugagguuggaagcuuuguucuuccccagaguccugcauugggccugccugggucccagcugucuccccaccuagcaggcagcucucuccuccccugccuguggcgggguccccgcccauggcccauggggccccuugcuccuuggcaguuccucacgugcccgucuccccugcagaugaccaagaugcuggaccuccuggaggacuuccuggaguacgaaggcuacaaguaugagcggauugaugguggcaucaccgggggccuccggcaggaggcaaucgacagauucaaugguacccccauccugcccaaggguucugauugagacuccuuuuuggccucuucucccaggccugguucuuagccaggucacccagcugguguuguguugagcagccucacaaacagcuaaagacagcaggccaguccgaguuuccaauguuaaaaggauuccucccauggaaucggaguucugaggggcccaguagauaacaccuguugggaauggaguuagacaaugagaaacgcagacggggccucuaauauugacgccaggugagccccaguuacaagugguguuggacagagccugccguauggugaaugguggcagaagguacagagaugcacgugcuaccuggggccacuuccagaggcaggagagagugaaagggcugggccacacaugaucaggcucuuuccccagagucacccaugcuuggucuucccugccugggaaggagaggcgaggguggaggucaggagggucuugccgguggaguuccuccuguagcaaaagaaacuucuggagugggaagcagucggcuguaagcuucaguagcaaguuugcagcaaauaguaacaagcuuuguuucccuggggcgucagcccuuaggggcuggggccacgcucuccaaacgcccaaagcagugauuccucucaaacacuugugccagagagccaggaggaauagcaaguucagaguuucagggucuagacguggcccagccacauguggaagcaggaguggcugaagcccugggugugccaggggccuguuugcagcuccagugggggcuguggucagucccaggucacugaagggcccugagaggcugagaaccagccauccugugacaggguugcccaguggggugggaccccaggucccggagcugcgccccugaguuuucccgggcugcccuggcagcaucggugggcuaagggaagccaggggugggaagcugcggggacaugaaggacucugagcucucuagggcucugcuuguacuugcuggcggcuugcacuuuguuuuuugcucaucugggguuugaaaauugaccuccucguuccagugcccucccacugcacuagggcucagagcucgcugggggcuaagugggcuugggcaggccuccucuggcuccccugagugcagcuguggccacccgucucugauggggucuccggcuuuguccuucucugccagggaucuguugcugcaguuccuucucucuguucucucccccauccuuucugcccacccaagguguacccccccaaacacucccaucugcuggccucucuuuuucagcccccggggcccagcaguucugcuuccuccucucaacccgggcagguggucugggcaucaaccuggccacggcggacacugucaucaucuacgacucggacuggaacccgcacaaugacauccaggucugugcugcugccgcccaccacccucccagggggccucucaucccgggccucaggcagguucuguccuucaugcccuucuugccaucacccccucaccuauccuggugcugugggccucccucccccguggagucucggccccaagaggggcucugggagugaguggaagcuuggcccccaucccuccagcucuguccuuguccagaggaggaagcaggcuuggagagggcaggggaagugucccagggcgcacagcaguuccuaguggccacugaucuggucuuucccaucauccucaggaccaaggccguggagggaggcaggaagagggagcccugggacccagaggggcacccauuuugaaggggguggggagcagagaguggggccuguuggagguggaggggaggauaagauagugcaaggggcagauggggcuguaaggaaggauggaagggcuguggggggagggguaugggaauagagccacccuaguguaccuggccaccccucucgggcgcugggacacacacauugaaugcuuacaaauguaggggaacacauacaaauugaugucucauucacaugugugugcgcccaugcacauacacagauauacacggccacacccaggucaccucauguagggcugcacagagucucaggcacuuccuuguauuauacugggcagauucagcuccuugcugcccucagaagguggcugcgugucuccagcacauggucuuguggucccauuagugguucgcucacagggaaaugcagccuccuaccuccccguggcccccacgaagcucuguguggcuucaguuacacccagcacacuggccguaucaucccucacacacucuugcacaccugcaguccugccugcuuccaauggcuagaagcuuuuccacuccaaacccagccuggcacccaggcuugugggaggcuccgcagucagggagggagcccagcugcaguggugggcuccacacaccuggacgcaccacacgccuuucccuacacagucaugcagcccauuccaugcucuugagcucaugggugugaucuccuccauugccuggagcccugggugagccacgggugcugaggugcaggucuccccaggccuucagccgcgcccaccgcaucggccagaacaagaaggugaugaucuaccgcuucgugacucgggccucgguggaggagcgcaucacgcagguggccaagcgcaagaugaugcucacccaccugguggugcggcccggccucggcuccaagucgggguccaugaccaagcaggagcuggacgacauccucaaguucggcacggaggaacucuucaaggacgacguggagggugggccucuguuccgagggagcguggcaggggacugggguggcccggcugagacacccauccagggcuugcuugggucccugcccgcuccaacacacagccucucuucugcaccccccaccuguaucuccuggcuaggacagcccaggguggugucucugggcacugcccgccaacccugcagcccucugugguccugcaccagugcuuuccuucucugucugacaggcaugaugucucagggccagaggccggucacacccaucccugauguccaguccuccaaaggggggaacuuggccgccagugcaaagaagaagcacgguagcaccccgccagguaggggccaacccagcccagccucagcuccuccuccgaccagguggcugcuccugcagaggagggguucccugaccugcccucacuugggcguccugggacugccaggugggcggcgaguggggcuguuacagcgcaguuuccucugucuggucaccaugccucucagcugcagccccugcuggggaugggaagggccauuguugggagucuguuccugggaccccggggcuggaccagggcagucuuuguccucacacugcauuugccugcuccccaggugacaacaaggacguggaggacagcagugugauccacuaugacgaugcggccaucuccaagcugcuggaccggaaccaggacgcuacagaugacacggagcuacagaacaugaacgaguaccugagcuccuucaagguggcgcaguacguggugcgcgaggaggacggcgugguaagguccccggcccgcccuccauccgcagccccgcccuccauccgcagccccgccccccacuguguccacgccuuccacugugaccccgcccucccgccgcagccagcccuccaagcugugaccccgcccuccagccgcagccccgcccucccugcugugccccgcacuccagcgugugcuccgcccuccaaccacgugcuccggccucugcagggcggcccugucgcuccacccgcgggcucaggacuagagacacaacagugagggaagggacggaggcagcgcugagggcaguacagccacaugggccggccacugcccuugcacacaucagccgccugcuccguggcgucaucccggcuccaguccagcuuccccacucucugaagugcaagcugaucugccaccccguugcacagagcccuguccccggggucugguuucagucccuacccagcugcacccucccgccccuuccucagggccugcaucucggcccugcaccuggaccgccaacguuccaggacggcccacaauuuucuuuuuuuuuuuuucuugaaauggagucucgcucugucgccccggcuggagugcaguggcgcaguaucagcucacugcaaccaacgccucccagguuuaagugauucucgugccucagcucccaaguagcugggauuacuggcaugcaccaccacgccugucuaaucuuuguauuuuuaguagagaugggacuuugccauguuggccaggcugguuuugaacuccugaccucaggugaucuaccugcuucggccucccaaaguucugggguuaaggaaugagccaccacgccugguccaccccacacuuuucucccuucucuaccgggcaaaccccagcuguccccgaagagcuccuugugggucucuccuggaggccuuuccguuuccuccucugcuccccacccuccgugcagaccuggugagcccaugaccuuuuccuuugaaaccaggagccuccugagggcaggcaagggggagcuuauucaacucaguaccucagugcuugacaggaggcgaggaaauacuugcuuugugaauggauggaugaauaaguaaaugauugacuggauaggggcagggagagaaaagcuagcuagggcuggggugaucagagaaggcuuccuggaguaggcaggccaucccauuaauccuugagcccugagggggcaaagggcaggucagguggaggcagccugaggcuuccgggagggcagagauggcuccacccauggaacccguggugcugcguccccaggaggagguggagcgggaaaucaucaagcaggaggagaacguggaccccgacuacugggagaagcugcugcggcaccacuaugagcagcagcaggaggaccuggcccgcaaccugggcaagggcaagcgcauccgcaagcaggucaacuacaacgaugccucccaggaggaccagggugcgugccgggagggagggacuggugccccucacccagaggcggaggguggggcaggauucugucagggcaucccugugcagaacccccgggaggugcgggccgggagagcugggcgagugugccaggagggaugggugucccauacccagaggcggaggguggggcaggauucugucagggcaucccugugcagaacccccgggaggugcgggccgggagagcugggcgagugugccaggagggaugggugucccauacccagagguggaggguggggcaggauucuguuggggcaucccugugcaggacccccccgggaggugggggccaggaacgcugggcggcgcugguuggagcugggaggcagcuuuuuggaggaaaggggacugggggcaggugcagaggugcuggguguuugggggaacaagguguggcucaguucagugacuucaccacugcucgugacguggccuugggcacgucccuugcacacaguauguguaauguguggguacacaugguacccuuaguguauaacguggugguguugggauuacuaaaugagcccacaggaaguaugugggccauugucacugcuuuuuuauggagcuggggugcaggggcucggcguggcccugggcaugcuugaacuugagggugggcuuugcuuguacagcucacuccgugccccucugucuggcccccugcagaguggcaggaugagcucucugauaaccagucagaauauuccauuggcucugaggaugaggaugaggacuuugaagagaggccggaagggcagagugagucucaguguuaguggucugggcuacugcugaggccaugucaggggagcugauggcagcaggagcggggcuggucuggggucccgcuguccuuggggaucaggaaucucugggcucccaccugaggaacuguggcgggcugcuccccagguggacgacgacaaucccggaggcagcugaagagugacagggacaagccccugcccccgcuucucgcccgaguugguggcaacaucgagguggggccugucuguucccgcaucucuuucugccccugcuuccugcugccccugggguauggaggagggcugggggacugccccgggucucaugccagguagaggcggagcuuggacagaacuuggucuggucuucgccgucaggguccugccccagguggaggccccugccuucucugugcccccuuccuaccuucuccuccucccaugcuuuucuucccccaucccagaauccuccacccccaccccucucuguccugggcucauacucccacgcuccacucgcccaggugcugggcuucaaugcccgacagcggaaggccuuucugaacgccaucaugcgcuggggcaugcccccgcaggacgccuucaacucccacuggcuggugcgggaccuucgagggaagagcgagaaggaguuuagguaaaggggcuaggugguggcccagggugugaccaccugccccugaguagggcaggguccugcgggugagccccacagagggcagcauuugcuuccgccaggaugaggccgucuggaaaguucacugccacuuggacuuuggguggcuagaguccuggugccgggcagggcugauuugcaaacacugaccauccgccccugcccaaaccagcugguguuauggcagcgaggaagaucccggucacccagggcuguccuaggagguccccucgccagggaggcccucucuguccuuucccgggccuggcccaggccugacuaggaggugggcgaugguugaagaucagccaggaguuccccugggguccugccagcccucucagaggguucuugccggccccccacucccugagccccagucccccccccccaccccagagccuaugugucccucuucaugcggcaccugugugagccgggggcggauggugcagagaccuucgcagacggcgugccccgggagggccucuccaggcagcacgugcugacccgcaucggggucaugucacuaguuaggaagaaggugggugaguaacucucuguagggcccuuccugguggcugccugggcuccuggugcugucccuugugggucaguggucagagaacaagugccugguucaggccacacagcugcccaggguccgagucacuccagagggacugaccuggaaagccuuucugggugaggggccugugggguggaggccaggaugguggguuacauacaguuggaggacacacagagggugggagggugggcaggggagcuuguggucaggaggggccuggcuuggccagccuugggcggagguagcagcuaccccaagccugugacacuuucagccccccuggcugcccugaggcccuuagggcugaguugccaccacugcccucccucuuucccuuccaccuucccucccaccaccccagguucaggaguuugagcaugucaacgggaaguacagcaccccagacuugaucccugaggggcccgaggggaagaagucgggcgaggugaucuccucggaccccaacacaccagugcccgccagcccugcccaccuccugccagccccgcugggccugccaggucugugggcugggcgggccggggagggcacuggggucauggaaaguggcaaggucacagaaaccccuagucuaacccacaaucccacagaagacggccucuccuucccccaaagccucuguuugcugaaaugucacucuacagagaguuuuccauuuuaaugacaguuacgagauauaauuuauauacauacugcaaaauucacucuuuuaaaaaacuggcugggcgcgguggcucacaccuguuaaucacagcacuuuaggaggcugaggcggcaggaucaccugagcucaggaguuugagaccaaccuggccaacauggugaaaccccgucucuacuaaaaauacaaaagauuagccgggcaugguggcacgugccuguaaucccggcugcucgggaggcugaggcaggagaaucgcuugaaccugggaagcggagguugcagugagccaagaucacaccacugcacuccagccuggggggacaaagcaagacuccaucucaaaaaaaaaaaaguacuauucagugauuucuaguauauucguaggguguacaaccaucgccacugccuaaggccggaauauuuucauucccccugaaaaagaaacccuguacccauuagcagccacuccuuauccccccaccccaggccugggcagccacuaaccugcuuccuguuucuggauuucgcaaugcuggaugguucguguauauggcacugcacagugcgugggccuuucugucuggcuucugucacucagccuggggguuccagguucauccacauugcagcgugcaucagugcuucagucauucugucauucugccuuauggcugauaauguuuucuuuuucuuucuuucuuccuuuuuuuuuuuuugagauggaguuucgcucuuguugcccaggcuggagugcgauggagugaucucggcucacugcaaccuccgccucccagguucaagcgauccugccucagcuucccgaguagcugggauuacaggugcccgccaccacaccuggcugauuuuuguauuuuuaguagagacgggguuucgccauguuggccaggcuggucuugaauuccugaccucaggugauccacccuccucggccucccaacgugcugggauuauaggcgugagccaccgcgccuggccgauaacguuuucuuguaugaauuuacugcauuuugcuuauccauugcgcugucgauagauuuuggauuguuucuacuuuuuggcugcugugaauaaugcugcuguguuuuauguuuuugcguggacauacguuuugaguucuuuugggcagauaucuaggaauggaauugcugggccgugugauaacccuguuuucccuuuugagaaacuacuagacuguuuuccaaagcagcuguaccauuuuacauuccugcuaguauugugcgggagucccagguucuccacgucuucagcaguaauuguucucugccuucaugguucuagcuguccugggagcaugagguggugucucacugugguucugauuggcauuucccugaugccaaggacgcugaauguuguucggugugcguauuggcuguuuguagacuuguagaaaugucuuuucagauucuuugcacacuuaauugggucauuugugcccgugucacuuuggugaucuagguauuuauuugggugaagcaaauaccuguuaaguacuugguccgucgguugggccucacaggccuggggcggacauagcuaucccauggugaugggugaggccaggcccugagaagcugcaccuccaagcacaagggagcccuuggagguggacacaucuugguuugcuucuuggcuuuggccugaacucugucuaaccuugggcaagucaccuaaccucugugggccuccgcuuucccggcugugcccaccucccggggcuucucagagcuguguaagugaccagcacuuugcaguguguuggcggcuggcuuggcagggaggaaauucacccccuguccagaggcacacaccagccagcccgcccgaaagcugggaccagagcgggugucguggcucccaaucugggccuccaucugccucacuucccugccuccagaugagcagccacggcugugugcggccccguccugacagccccucacuuuggucuuacuggguucaagguccuccaagcacuccugagucaaaggccuggccuggccucucugacuuagccggggauccugcuugucucuccuggaggugcuuggcugcaguggagccucccgaaggccaagcccccaucucuccucucugccaccccacucccugcccuacuccuucccgucugagcccaccugucucagcucuuucccuugaucuuucagacaaaauggaagcccagcugggcuacauggaugagaaagaccccggggcacagaagccaaggcagccccuggaaguccagguguggaacuugcuggcgucugggccuguggugugugugggguggagguugggucuggggaccuucucaggcccuguacagcgagguggaacccaggccuccuggcucccuuuucggggcucugaaucggcggggagcaggcuaggagcaagcgacgggagccaggagacuggguucccagcccagcgcacguuccccgcccuccguuccuggugaggccccaggccuuguaguucuccuggcuuuuccucugcaggcccuuccagccgccuuggauagaguggagagugaggacaagcacgagagcccagccagcaaggagagagcccgagaggagcggccagaggagacggagaaggccccgcccuccccggagcagcugccgagagguuggggcuucuugcaggccacccaccccagugccaugucuggccucagcaggccuggguucagagaagggcagguggcuguacuuccgcucauuucucccuggcagagagguagacuccaacccucugcaggcccccuggugaggggaggccaggagcucaggccucuauacauggacuuaauggacuuuuuuuuuuuuuggagaaaggguuucgcucugucacccaggcuggaaugcagugguaccaucucggaucacugcaacauccgccucccggguucaagugauucuugugccucagucucccuaguagcugggacuacaggcguguaccaccacacccagcuaauuuuuguauuuuuaguagagacgagauuucaucauguuggucaggauggucucgaucucuuguagcugggacuauaggugcauaccaccacacccaacuaauuuuuguauuuuuaauagagacuggguuuugccauguuggccaggcuggucucgaucucuugaccucgugauccgccugccucggccucccaaagugcugggauuacaggugugagccacugcgcccggccauuuuuuuuuuuuuuuuuuuaauuuuuaguagagacuguuggcugggcuggucucgaccuccugaccucaagugauccacccaccucggccucccacaguguugggauugcaggcaugagccaccuugcccguuggucuuuaacuuuucuuaccauacagagauugggggugauugggcuacuuuuuuauuagugauuucugacucaauugcauuguggucugaaaacaugagucuauaugagguuguugaaaccugcucucuggccugauacggucagauuuuguaaaugauguaugugugcuugaagaaaaugucuguucccuaauugcuggguuuaagguucuaacuauaugcauuagggcugggcaugguggcucacaccuguaaucccagcacuuugggaggcugaggcaggugaauuaccugaggucaggaguucaaggccagccuggccaacauggcgaaacccagucucuauuaaaaauacaaaaauuaguugggugugguggcaugcaccuguagucccagcuacucaggagacugaggcaggagaauugcuugaaccugggaggcagagguugcagugaguggagaucgugucacugcacuccagccugggcaacagagagggacucaaucucagaaaaaaaaaaaauauauauauauauaauacacacauauauacauauacacguauauauauacguauauauguacguacauacguacguauauacgcacauauguacguauguacgcacguauguacguacauauguaccuauauauguacguauauauacacacacguauauauauaugcgcauuaggucaguagauaaugcaugcuaauuauauuguucaaguuuuuaauaucuuuacuaguauuugguuugcuuugaucagucaguuucugagagacuuguguuaaaaucucucauuaugauuauggauuaaucucuuucuuauaaugccagauuuugcuucauaucauuugagacuggguugucaggugcauauuuguucagguuuuuaauauuuuucuugugaagugugcuucuaauuauuguguaauaacccucuuaucccucuuuaaaguuuuugcuuaaaaguuuauuuuugggccaggugcgguggcucaugccaguaaucccagcacuuugggaggccgaggugggcagaucacaaggucaggaguucaagacuauccugucgaacauggugaaacccgucucuacuaaaaauacaaaaaaguuagccgggcaugguggcgagcgccaguagucccagcuacuugggaggcugaggucgcaccacugcacuccagccugggugacagagcgagauuccgucucaaaaaagaaaaaaaaaguuuauuuuugcugauuuggguugcucuuucuuuuguuuaguauauauuuguuacgccuuuuucuauuccuuuuuuuuuuuuuaagauaacagcuuuauggugauauaguuaacauaucauacaguugagccauuuaaaguauaccauucaggucgggcaugguagcucacaccuguaaucccagaacucugggaggcugagguggguggaucaccugaggucaggaguuugagaccagccuggccgacauggugaaacccugucucuacuaaaaauacaaaaaucagcugggcgugguggugggcaccuguaaucccagcuacucaggaggcugaggcaggagaaucacuugaaccuaggaggcagaggucgcagugagccgagauggcaccacugcacuccagccugggcaacaagaucgaaauucugucucaaaaaaaaaaaaguaaugaaguauaccauuuguuauuuuuaguacauccagaguugugcaaccaucaccauuaucuaauuccagaacauuuaaucacuucaaaaauaaauucuucuuacccauugguaaucacuccccauuucuuccucuuccucccagccccuggcaaucacuucuguccuauggacuggccuauucugaacauuucauaccaauggaauaaugcaguacuuuggcccuuugugugucuucuuucacuuagcauaguguuuuuaaaguucaucuauguuguggaauauauuaguacuucauuccuuuuuuuuuuuuuuuuuuuuugagacagggucuugcucuaucacccaggcuggagugcaguggcaugaucuuggcuuaacuacagccuugacccccugggugcaagcgaucuuuccaccucagccucccaaguagcugggacuacaggugcacaugcuaacacgcccggcuaauuuuuguauucuuuguagagacgggguuuugccauguugcccaggcuggucuugaaccccuggacucaagcaauccucccaccuugaccucccaaagugcugggauuacaggcaguacuucauuucuuuuuaugcccaaauaauauuccauuguauggaucuacuauguuuuguuuuguuuauccauucauagugauacacauuugaguuguuuccacuuuuuggcuacuguacacauuuguguacacauuuuuuugugugagucuagguuuucaguucuuuuggguauauaucuaggaguagaacugcuggaucauaugguaauucucuguaccauuuugagaaacugcugaauuguuuuccauguguauugcaucaguucacauucuuaccagcaugugugaggguuccaguuucuucacauacuugccaauaccuguuauuaucugucuuuuugauuauagucacccuagugggugagaagugguaucucauugucauuuugauuugaguuuacuuugugcauaaagauguugaauauuuuuucaugugauuauggcuuauuuguguauaauuuguugaagaaauguccuuucagauccuuugucuacuuuaaaauuggauuuuuuuaaauuauugaauuguaagaguucuuuuuaaauuaauuaaucaauacuuuuagagacagggccuuacuauguuguccaggagggcuuugaaguccugggcccaaguaauucucuaguauuagacuuuugaguagcuaggaucacaggcguguaccacugugccuggcuuguaugaguucuuuauauagaugcauguuccucaucagauauaugauuuacaaauauuuucuuucauuucuucacuuuuaaucucuuuguaauguuuuaggucuaucuuuuguagacgguguauaggggauucaucauuuaaaaucuaauuauagggucccuaucuuuuagcuggcaaguuuaaucucuuuacauuuguuguaauaacuagauauguggauggaauucuguuaucuuauuuuguacuuuauauauuacccuucucuuuucuccuuuuuucucuuuuccugccaucucuuggauugaucaaauuuucuuuauaucuccucuuuucccccucaacucauuuggaagguuuauagucaauuucauucuguacucuuaacauuuuuaacauguauaccccugaguaauaugaggacuuuagauagcuuuagcucuaacucacuucccuuucaucugccacgaugcuguugcccaguauuuuaguuucaguuuguuuuuacuuucccaaauuuguuguuaugcuuauuucuaaauuuuuaauccuuuuuuagaucuucucacauucuuaccaguuuguguuugccuauuuguucaucauugcuucauucaaaguccuuccuaaaguacaccuuuaauggugcuuucagcaauuuuuuugggaaugguaaauucucucauuguuauuuuucuuuuacucuugaauaguuaguacaauugaagaugggauagggaucuucccucagcacuuugcagauauucuuccuuuuuuuauuuggcauucauuaugcugagaaggcugcugagaagcugagaaggcugcuguugguguaauugcugcuccugucuaggaaguuugucauuucuaucuuuucucacauugaaagacugcuuugaagacauucucuuugucuuuggugauauguagcuucacuacaauggaggguauuuuuuguuuuguuuuuagagugaaguuuuuguuuaucuugugugugacucacugugauucuuaaagcugaauauuuauguccugcaucaauugugggaaaauucucagucauucucucuuugaauauuuucuuugcccucauuauguuuauuuuguccuucuggaauuccuauuacucauugauugguucauucauccaacaaacauauauauacacacaugcauauauauauauauuuugagccugcugagugucagaugcugucccaggcacugaggacacaagcaaugaaccaaaacagcugaaagcuucauuccguggaguuuguauuccacuggggaacacaggcaauccacaauaaacagaaauacguguuguucaaccacagacuccaaaugcucuaaagaagaaagcagaguacaagguuagcaaaagaugggggcugauaaguuuucauaucuuuugcuucuuuuuuguuaucuauuucucugccaggcuuuuugaguaaucuucagauccagcuuccauguauauuuucuuugcacagcuguuuuuuaaaaccuucccaguuguauuauuuugcauggcugugucacaaauuacugcaaacuuaguggcuuaaaacagcacucaccaugagcucacaguugugugggucugaugccuggcgugguguagcuggguguucugcucaggauaucacaagguucaggacaucaaaguaucgaguggguugaguucucaucuggaggcccuggggaaaaguccacauccaugcucacuccuuguuguuggcagaauucaguuccuugaggcuggaggacugaggucccauuuccuugcuggcugucagcuggguccguuuucagcaccuggaagccaccacauuccugccauguagccucgugugucuucaagccagcaguggugaacagaaacccucccgugcuucgcauccuugacuuccuuuucugugaccagccagagaaaagggcucguguggucagguuaggccuacucaggucaucucccuguuuuaaggucacccgugccgcaaaacggaaccugcucuggggagucgaguuuguccucuucaccuuccaggggaucuugcagggcguggacaccaagggccggaagucuuggagcccauguuggaauucugcaauuaaauucugcaauuaaaauguuaaugauuguguguuuccuuucuuuuuuuuuuuuuugagacagagucucucucccaccucagccucccaaguagcugggacuacaggcacccgccaccacgcccggcuaacgaagucuggcuaauuuuuuguauuuuuaguagagacaggguuucacuguguuagccaggauggucucgaucuccugaucucgugaucugcccgccucggccucccaaagugcugggauuacaggcgugagccaccgcgccugccccccccuuuuuuuuuuuugagauggagucucgcucugucgcccaggcuggagugcaguggugcaaucucggcucacuguagccucugcuucccggguucaagugauucuccugccucagccuccugaguagcugggauuacaggugccugccaccacaccugccuaauuuuuguauuuuuaguagagacaggauuucaccauguuggucaggcuggucucaaacuccugaccucaagugauccacccacauuucuagaaauuuuauguuuuuuuucuaguuuugagggagucuuauucuuucccuguggauucucuuccuucuuuuucuuuuuucucugucuuuggucacccuagacauauuuauuuuagagcaagcuuuuucaaccugugugguccgugggacaaauguggcccaggauggcuuugaauguggcccaacacgaauucauaaacuuucuuaaaacauuaugagauuuuuuuugugauauauauauauaucacaaaaaaauguguguguguguguuuauguguauauauauauaagcucaucagcugucaucaguguuuaguguauuuuauguguggcccaagacgguucuucuuccaguguggcccagggaagccgaaagauuggacaccucuguuugagagucucugacauuguccuguuagccccaggcgcuugucugcuuccugugcgucggcuggugggggaucauuguuuucuggguuuagauugggugcauccucaucaggaauugugauuuuuuuuuuuuuugagacggagucucacucugucacccaggcuggagugcaguggcgugaucucggcucacugcaaccucugccucccggguucaagcgauucuccugccucaaccucccgaguagcuaggauuacaggcacgugccaccacaccuggcuaauuuuuaaaaaauauuuuugguagagacgggguuucaccauauuggucaggcuggucucgaacuccugaccuugugauccuccggccucggccucccaaagugcuaggauuacaggcgugagccaccgcgcccggccuggauugugguuuuuaucugcaggagcuccguguccucuggggagugggagcaucccuccccuuuuguuucuggaggcucaggccgggagguuucaugggcggugucccucugggagcagcuuuaugaugcugucucugccuugggugguccaguucauaucccacacccacgaggacaaggcguuggguguggguuccucacuggagaccuucuuuuccuugauccugugguggagacaggccaucucacucccguggccaguggugagaacuuuccuucagagaccacgguguuggaccguguuggcaucauuccaguucucugcaucuuuugggcuugaggccuccccuguccugccugggugcugagacacagcuccaaguuccaagcucuccaggcuucuuccuggugucucaucaccccaaccuggggccccuggacaccagcuccugcuuccucaccuucaguuuccccuuccuuccuggcacccggugauuuccuucucuucuugggaacucaucuucugugugcuguuuuuuuuugaaacagcgucuugcucugucacucaggcuggagugcaguggcgccaucucggcucaugggagccuuuaucuccucggcucaagcgacccucccaccucagcuuccugaacaggugggaccacaggcgcauggcgccaagcccagcuaaguuguuguauuuuuuguagagaugagauuucacuauguugccaggcuggucuugaacuccuggucugaagugauccuccugccucggccucccaaaauacugggauuacagcaugggccacugcaccuggccgaggagagcucuuuuugguggcaccuguuggacucugcggaacauauugauggauaggguuccauggguggaaagccacgagcccagaguccucuguguuuucugggaccccaccccaugccgcgaacccucuuuuucuugcagaggaggugcuuccugagaaggagaagauccuggacaagcuggagcugagcuugauccacagcagaggggacaguuccgaacucaggccaggucuggggcucuucuguguucucuaccugugccccauggucccuugagggugcccucuggacccuguucagccucccacagucucccaggcgccguccccuuggccccaggccugauuggagcuggcaggugggagccuggauucaccagccccucacagccaaugccggggacagccucuccccuacucucuccugagcccugcugugcccuugccgcuaagagagaggagagcuggucauagagccuggccugggggauuuggggcucagcuggaagcuuugcauaccucuaggcccuggaauguucuggaacaguuguccucagaucagcccccucaggcagcucugucuuugaacuugaacuguacuuuucacagcgcucuccuguccuacuccugggugguccugauguggucggggaggagcacuaggaccuggagcuaagccucccugcccaggacagagagagaggccguuggcuuguuuaagacccuucugggcagcgaguccccugaggacaagaggauguuuucuacuugccuccugggucccccgugcuuggcagagagaggccgcugggcacugcuuuuuggauggauggaugaaugaaugugaucuguccccggcagaugacaccaaggcugaggagaaggagcccauugaaacacagcaaaauggugacaaagaggaagaugacgaggggaagaaggaggacaagaaggggaaauucaaguucauguucaacaucgcggacgggggcuucacggguauugggguuggggguugggcagagagcugaggcuuccugacugugggucccaggagucuagaccagugguuaacuuuauacuagagugugacugguugauggaaguccaucguauaaccuuucuuagccacccuggaacacuggaccucuggggguggaggcaguggcaaguagggagggagcggcucuccaagccugccugugcgugagagcuggggcacuucucacccugcucaccuuggcuuguuucccagaguugcacacgcuguggcagaacgaggagcgggcugcuguauccucugggaaaaucuacgacaucuggcaccggcgccaugacuacuggcugcuggcgggcaucgugacguauccuuggccaggccgggcugggcagggacuugcccguuccuccguggaccucggggagagcccucugagagcuccgggggaagccuuccucguucuuccucaaucuuccucacuucuggcgguggcuagaaauccucggcauugcugugucgcccgcuccccgccgcugucaucccggcuucuuccuuaugugucucugucuggguccacauugcucucucuuuuuuuuuuuuuuuuugagauagaguuucacucugucacccaggcuggaguguagcagcuugaucucggcucacugcaacugcugccucccggguucaagcgauucuccugccucagccuccugaguagcugggauuacaggugugccccaccacaccuggcuaauuuuuguauuuuuaguagagacgggguuucaccauguuggcuaggcuggucucgaacuccugaccucaagugauccacccaccuuggccucccaaagugcugagauuacaggcgucagccaccacacccggccuuuuucuuuuucuuuuuuuuuugagauggagucucgcucuguggccuaggcugaagugcaguggugcgaucucagcucacugcaaccucugccuccuggguucaagugauucuucugccucagccuccugaguagcugggacuacaggcaugcaccaccacucccagcuaguuuuuguaauuuuaguagagacgggguuucgccuuguuggccaggcuggucucgagcuccuggccucaagugaucugcccaccuuggccucccaaaaugcugggauuacaggcgcgagccaccaugccuggccccaaauuuuccucuucuuacaagcaucccagucauugaguuuagggcccacccuaguccagcaugacccuuucuuaacuucauuacaucugcaaauacucuauuuccgaaaaagguucccauucacaggcacugggggcaagacuuaaacguaugcaccccagguuguuggggugaagaguuaacccucugaagccccggggcugugucuggugcacccagggcaccugucagugucugcugauacugucacuguugugucaucaauauguuccucgugcagcugggcuuaaggacuugccugagagcguacagccagaaugccgacccccgggcuggccccucccccucccugagcugccucccccuacggccccaccacuucuaacggccagguuugcccuuaauggugccccacccaggcacggcuacgcccgcuggcaggacauccagaaugacccacgguacaugauccucaacgagcccuucaagucugagguccacaagggcaacuaccuggagaugaagaacaaguuccuggcccgcagguuuaaggucugucuucugaagggccagggcugcacggggcagggagggacggugucaggaggacccucgcaaaggcaaaggaauuagagagcagcaaccccuccccguguaccugggucacgcugccacgaagcagcaguauguccaucaacuaacagugguggauccuugcucuggcccuggccccacugggaaguaucugccgccuugggguguugggguacagagaacccagcuuggugacagcuccaaggguuggccaccaccaggccagggugggcagcagauggcaguacguccucuuucccuccuuucugccgggagccuuggccuggggugggcgcugguggagcacggaggguagccauucagcgggaggggccgggccgacgcugcgccccgcccccagcugcuggagcaggcguuggucauugaggagcagcuccggagggccgcguaccugaacaugacgcaggaccccaaccaccccgccauggcccucaacgcccgccuggcugaaguggagugccucgccgagagccaccagcaccuguccaaggagucccuugcugggaacaagccugccaaugccguccugcacaagggugagcaaguccugccccccacggugcagccccccgcccuuccuccugcccagcgagcgcucuuggcuguagaugagggcacugaugggguaggggcuggggacagaugucagcccagagggcgguggacuucugggccaagauggaacaguccugucaucagaccccuuaucuccccugcagggaaacugaggcugcuugcuucuccagccuguuucucaagccugcucugugcgggccccggcccgggcuagugacacagaaaaccacgaaacuguaaaggcuucugaguccugacagcgugacuuaaaugcacugugucuuuagcccgggcaauacccaucagccuggagccuucuccuuggccccgugugggaagggaaguaguuugcccaagaucucccaggauucagagcuuuggugcuggcugcacaucucugccuguggucacagggcacacuucugcccucggggcucccggcugguugggggagggguggcccuguggugagaguugcuggaccccucccugugcccugcagcccucccugguguacucugauccugugcccaguagggccuggggcugcaggucucccugagaacucuuaggagggaagcccagcgucaggcagcgcuucuggcuggcucgucugcagcccgugggcccuugcccagcccagaggggcuccugggaggaguucuuuggaagcuccugcuguguccccacuuggcagugcugccugcagcuugggagggccuggugcagggcacccccuggugcccgguucugggcaagugcagucauacacccuugcaaauaagccccagcucucgggcuaccuccccuggcacagcccuucaucccuccaucccuccaugccuccauccuuccaccccuccaucaucccuccaugccuccguccuuccaccccuccaucccucuauucuuucaccccucaaucccucaucccuuaucccuccauccuuccacaccuccauccuuccaucccuccauaauucuuccaugccuccaacccuccaucccucugucucuccaucaucccuccuucccuucaucaucccuccauuccuccauccuuccaccccuccauccuuccauccuuccauuaucccuccaugccucuguccuuccacuccaucccucaucccucugucauccuucaucccuccauccuuccaccccuccaucccuccauuaucccuucaucauaccuccaucccuucauccuuccaucucuccgucaucccuucaucaucuccaucauugcuucaucccuccaucauccuuccauucucccuccauccuuccacccccaucccccaucucuccaucaucucuccauccuuccaucucuccaucucucuacccguccaucccuccaucaucccuucguccuuccauuccuccaucccuccauuaucccuucaucauaccuucaucccuucaucccuccgucucuccaucuucccucuaucaucucuccaucaucacuccaucccucuaucauccuuccgucaucucuccaucccuccauccuuccacccguccaucucuccaucaucccuccaucucuccaccccuccaacccuccaucaucccuccaucuuuccaccccuccaucauuccuccaucccuccaucaucccucuaugccuccaugucuccaccaucccuccaucaucccuccaucucuccaucaucccuccaucccuccaucccuccaucccuucaccccuccaucacccaucccuccaccgucccuucaucccuccaucccccaucucuccaucaucccuccauccuuccaucccuccaucaucccgucccuccaccuuccuuccauccuuccaucuuccauuaucccuccaucucuccauccuuccaccccuccaucccuccaucaucccuccaucccuccaucucuccauuauccuucaucaucccuccaucccuccauuauuccuccaucaucccuucauucuuccaucaucccuccaucccuccaucaucccuccaucucuccaucauccaucaucccucaucccuccaucaucccuccaucucuccaucaucccuccaucccuauauuaucccuccaucaucccuucauuuuuccaucaucccuucaucccuccaucaucgcuucaucccuauaucccuuuaucuauccaucaucccuucaucaucccuacaucccuuuaucucuccaucaucccuucauuaucccuccaucccuccaucucuccaccgcuccaucccuccaucgucccuccaucuauccaucaucccuucaucaucccuccaucccuccauuaucccucccucaucccuucauuccuccaucaucccuccaucccuccauuucuccaccccuccauuccuccaucaucccuccaucucuccaucauuccuucauuaucccuccaucccuccaacauccaaccaucauccuuucaucaucccuccaucucuccacuccgccaucccaccaucaucccuccaucucuccaucaucccuucauuaucccuccaucccuccaucaucccuccaucccuccaucaucccuccaucccuccaucuucccccaucccuccaccuucccuccaucccuccaucuucgcuccauuaucccuacauuaucccuccaucccuccguccuuccaccccuccauucguccguccuuccaccccuccaucauccuuccaucgcuccaucauuccuccaucccuccaucuucccuccauuaucccuccaucaucccuccaucaucccuccauccuuccaccccuccauccuuccaccccuccaccccuccucuccuccaucccuccaccccuccaccccuccaucccuccauccuuccaucccuccauccuuccacugcuccaccccuccaccccuccaccccuccaucccuccauccuuccacuccuccaucccuccaccccuccaucccugcauccuaccaucccuccgccucccaccacaguccugaaccagcuggaggagcugcugagcgacaugaaggccgacgugacccggcugccauccaugcugucccgcauccccccgguggccgcccggcugcagaugucggagcgcagcauccugagccgccugaccaaccgcgccggggaccccaccauccagcaggucaggcucggccugugugccccggcccgagcccccuggcgugccccuggguggaggcuggguggggggccugagaccaccugugaagcugaguccuugccuccagggcgcuuucggcuccucccagauguacagcaacaacuuugggcccaacuuccggggcccuggaccgggagggauugucaacuacaaccagaugccccuggggcccuaugugaccgguaggugcccguccgcuccgggcagcaugcacacgggugcccgccgggcccggccugccugcugcugccaacgucaggcaagcccggcucuccucuuuuuuugacagauaucuagccguccucgagacuucccuguguugcagcgcucauuuccagcugaggugagggcugcugggugcuguguuccuccccgccaccccauugcuggcaaaccaggccuggccacagucagcccugccccugcacuugacucccgucccuaaguccuggagcuuuuacugccuccggcggcuuugagagccacccaccugccuggagccccucuaccuugcccccuuggcccugggaccaccuuguggccagcgugucuguccacugggaggcugggguggcaggacaugaaggggucgguggacuugggugagcuccugugugugcacauguguucucauuugcacacauguucccagcggaagucagagacugcugcccccgccuggagcccuguccugccccugcuguccugcugguggcagacaucacaucuugucuuacacccucacuuccugcccaggaccaggaggguggcugaggguuuugugggggcuauuggccaggagagggggcuuauuucagagaaacugccaguucauucuggucuucucuggggccaccagccuccacuacgcugugucugucccugugggaaccgugucuugcuggaggaggcuccagaggggcuuccuggcuggcugccccugcccacugcugcuuccugggugcucucggcacucuggguguagcucauggccuggcccggcagccuguggcugggaggucauggcuggggggcaccccgaucauaguugguugugauagguggagaagcagcuacaggcuguugggugccacccugaugcccccuauaacugcccaccugcuuaacccacugauuugcguuuugcagccacgccugccgggccaccugcccgacccacaugggagagaaaagcugccaccuuuuuaggagccagcgccaccuugggacaaaaagggaaaccuaguaaugccaucacauggaggacgaggcccagcucagcugggccagagcccagaagugccaccucaucauaauucaaguguucuuccacacagcguugcccccacaaccacgccggacgugcccccucgccaccuuuuccagacgacuucuuagaagagauuucauuuauuuguacaucuuuugcacuuuccuauugaagacuugaacacguuugucuugauaaaaguuggaugacguauggaagauucgaaccugcagcacugaugucucuuuaccgauggguuccagacccaagguaguccuggcacugcccuguggacucagcccagcuggggaggacauggcgcccggugcccuaggagcccucaguguccccuaccugaccugucugcaccugugugacagccccuucugauuuggcccccugcccgcuuggagccucccagcaccagacagggcagguuuggggagccgcuguccagcccuauggugagacccuggcugacauuuccccuccuuccugccaaggcuggaggccgccagguguuugcucucuccuuguggggagguggauccucugccagcaggugucuguccccggcccagcgcaucuugaaggcccuggacucuguuaccaguggggggccuguggccccggcucuucacagcaggcagaagcguaugaucccagggagggugggcuggggggggggcagcacuugccucggagccacugcugcguuggguuugccuucugccagaggugugguuaagggcagugauagcugcgccccagcaaggagggucaugggcccugagcuggcccaggagacccuggcccugcccugugcccugggaugccuacccugcccaccuccggagguggaaccgggcugccccugggggccuggacuugucccauuccccugucccuggaaaggccuucccgggggcuuuuugccugaggcugcacucuuggaaggcguggggagaguucugccuggagggggacuggacccagugcccucugcagaccccucccagccgcagcaccaagggcuugcugccuuguuuccugccaggagcgcccugacaucccaaaaccaucuucccacauguggguuguuggaaucccacccacucccccggacccugccccuccaaguuggggacggagauggggagcaggucaggcccucccuaggccuguuugugugugauccuucuccuggccccaggucgaccuggaaggcguuucugagucuuguacugggaccuucccagggaaggugccuuggggugcagaauccugggaauguuaggaaagggcugcgugaaaaacccagcugggccugggguggaggugcacacgggcuggggcucagcuccuuggagagggccugccugggacugagggggccagggcugggucaggauucaccagcuuguguugcagacacuggagcgauugccuggcccucccuaagcccuauaugccucacucauaaugaggcugucucugaaccccggagggcgggaccuacaaguccuuccucuuggcgcauucccacacuccagucuggauccaggucugcaaggccagcccgacccugacacugcacgugggcguaguggggagcacccuggaguggagaugauugucagcgggcucacauguuaugguucauccacaugcguguugugugcucugcggugccuccuggcaaaggguccuggcucgggucagaagcucacucccgugcccucguccccaaacaagcaguggcaagcacugggguuggcccucguugggagcagugcccaccuuccuuggcccacagcagauaggucccgagcagcaggacuggaggccuguggcggucagggcaggggucugugucuccaccccaagggcugauggucccuccccugugcgccuuccucucaggcaggcuugcucugucccuuccucucugcuucccucccaggccucgccagggcucccuucuccucugccugguuagacucgggcacccaggaaagccuggccagggcuccuuugggccugggcccccugcacugccugguccagaagggguggugcuguccguggccagcaccccggggcccgggaggggugggcuacuagagucagagcggguuuggggcugaccaguuugggagaggagaaaagaucugagaauguccuucuugguuugucagucaucucugccaaaaguggugauggugguguccguauguuuggcgucuuugggcuggguuugguuuuugcugcugguagaaucaggguccucgggcaugaacgcgagcccaaagugccagucugcgauuggaaauuuccagccacuuuaagccagugcugaguagggcuucugcagagccauguuugagccaaggucuuggaaggcauugccccaugggcucaggugacucgggguggagugagcacgucugcagggcccucucauacacgccugaggcagaagcagcgucccccgugaaagccaccuuccgaagcuccugcguuuuuugcaaacuuggcuucccccaggggcaggcuggacuuucccugcccccuaugauugaaguccuccugcuuuugggggcugccuucccagagucccccgggugcuccccugccgaggucaggagcugaccaagccuuggcccggugacaccugcagcccucacuccugucaucccaggacacuugaggcccaaggagguggaguggagagugggcucggguacaugggagccagaagccagauggacuuggucaagugucggucacuuggagccuccagugugcgucagggucugugggcaggggacagggcgugggugggggccgaggcuggcacgccccucugcccucaccgucuuggugaccuggccucggccccucccccaagucucuucugugcaaggcccgccucggccucggcagcugguuccuguccuguuuucugugucugaaaguuuacagguuguggugcaucagcccaaacucacuggcguuguguuuuuuuuuucuuuaauuuucagauuuuuuuuuuaaacaaaguauuuuuuuaggugcgauaacccagaaagggcccguuggguguguguguguguccugaacuccucaagcagcgauuggagcccaagcaccccuggagaggaagggaggguccccacuggcccguggggucugaguucagggguguggagggagcagacuccaccggcccaggcccagcuaagagggggccgaccccuuuccccaggcacagccccaggcuggcaaagggagggcccugggcugggugcaaggcgcgccaggagucccagccaggguggccccggcgggggcggguccagcuuuggaagccaggcuccccugugagccguggcuugucuggucuucgcccacgggaggcuggacagaggcuguagccaacacaaucaccuuuacuuuguacucuguguguauguuuugguuuucuguguuuuaauaaauccuuugggaaaggauuuaaucagaggcuuuu

SEQ ID NO: 21396 - RNA, 1048 nt, Homo sapiens
ggccggugcugccugccgaagccggcggcugagaggcagcgaacucaucuuugccaguacaggagcuugugccguggcccacagcccacagcccacagccaugguaaggcagaugucacagguggggggaggugggcucugugccagccaauuuucgucucccucccccagccaaggucucccaggggugcagggagagcggagcugcucagagcuuggccagguucuaagugugcuccugaaagcaggucaccccugagauccucaggguggggcacagaggggcacccuagcagguaaagggaggccacgggauggcggugggcagcuggccuucuaguaacgagcccucagugccuucugugccuggggucccugccggcgggauguagaggacagacaggagggagcacugucccuggguacaggagcucgcccugcagccagugccuuguguguggugggccuggggcuggcgccgcagucucugaaccugugugacgccugcagggcugggaccugacggugaagaugcuggcgggcaacgaauuccaggugucccugagcagcuccaugucggugucagagcugaaggcgcagaucacccagaagaucggcgugcacgccuuccagcagcgucuggcuguccacccgagcgguguggcgcugcaggacagggucccccuugccagccagggccugggccccggcagcacgguccugcuggugguggacaaaugcgacgaaccucugagcauccuggugaggaauaacaagggccgcagcagcaccuacgagguacggcugacgcagaccguggcccaccugaagcagcaagugagcgggcuggagggugugcaggacgaccuguucuggcugaccuucgaggggaagccccuggaggaccagcucccgcugggggaguacggccucaagccccugagcaccguguucaugaaucugcgccugcggggaggcggcacagagccuggcgggcggagcuaagggccuccaccagcauccgagcaggaucaagggccggaaauaa

SEQ ID NO: 21397 - RNA, 219822 nt, Homo sapiens
aagcuagaccgaucuccggggagccccggaguaggcgagcggcggccgccagcuaguugagcgcaccccccgcccgccccagcggcgccgcggcgggcggcguccaggcggcauggagaaggacggccugugccgcgcugaccagcaguacgaaugcguggcggagaucggggagggcgccuaugggaagguguucaaggcccgcgacuugaagaacggaggccguuucguggcguugaagcgcgugcgggugcagaccggcgaggagggcaugccgcucuccaccauccgcgagguggcggugcugaggcaccuggagaccuucgagcaccccaacguggucaggugagccagggagcugcgcccucgccaucuggggccucgcgcgcgcggggagggccgagccgggaauccucaggcccagaaaggugcggggcagagggcgacuggggagguccugcgcgaccuguuggucuuacagagugagaguuaaguuuugucgacagagccgcgagccagagccggugaccuugccagacagcgagccgaaagacaagucaaaaaaacaugaccugagcaggcuucccugcagcugugcaacuuagaagcguuuucucccugcccacccugaaggagggucugggggaagugggugcguuuuagggacaggauaagccaaccugagacaugccccgcuagcccccgcauauuuuucguggccaugccguuggggaauuuuugaaagacagaguaggugagacuggagaaugaggaugccgugugauaaucagugggaacuuuauggguggagccaaguguaaaucagguuaacaagaugcagaaacaucauaauauuuuugccagucauacucucaguuucucuuuauuaaaguugcguaguaagaaugacuccugguggucuaaggaguuugagugcugaugcccaaucucaaacagcgucauaaaaauuucuuccaaaacuguuaucccugugucuguuuuacuuuauaucucugggcggacauacucuuuagacuaauucuccaaaggguuaaaugugaguccaagaugugguaugguuagaucauaaauguucugcccaugcuuuucccagauggauugugcgaguggguggggagacagcaguucuuacucucuccugugugguaaccaguauuaaaugaaaaugugugacuuaggauaaugguguuuucuuagugauccuggaauuuccccauugugugguugacauuguuugguugugucauccuuuucuuuuuuaaacagagaugcauagcuuuacauugaaaaggaaugccuagaaacuucugcaaauuggguugugauuuuaccuuucucgaucuugagaaaauguguagcagaaauaucuuuuuucucauccauuuagggcuucuguucaacaaauacaugccuacugugugcgcugaggaugaaaugauguaaauaagcacagcuaaauauuuuuguaaaaagucaaacaauuuaacauuagucaucaaaguggagagacccaagacugaccuuugaaauaccaaacucucuacagacucagagagaccaaauaucuacagaaucuucuugggagguuuuaacuugucuccucuuaucccaggcuggugauuugugcggugcuuuguucccaacgcaguuuagacucaagcuagaaggcaucaaagaaucauaaauauauaaauaaggcaguaaaugguuauaaaguuaagaccgcauuauaccucggccuagcuagugaaggagaaugaguguuuuagaagaugagauuauauauaaaaaccuauagaugacuuuuuuucauguguauuuuauuuguuaaaaacaacaaaauccguuuuuggggcucuuugugauauuggagggaaaaggggaggguauauuuagcccccuguaacucagcugucguccuaggggaaucaccuaauacaucccgaaggaugaauuccaccacuacaauuuuaagacggaaguucuuguuuuauuuugucuguuaccuauggaguauccaguuaagggugcuuaucauguauaugaaugaauaguguccuuccaaacguagagguacuacagaggcaccccuguauaacacuauuguuuacaaagcuuacgccauucuuauaccagaggcacacuuucugccauugugcuuguagauuuugucugauccauccuauucucuugauuuauccuccugagauugauguguuucuagacguuucuaacugacccaugacuuggauucuguacugugaauuucaggaggauauucuuaugaacugaagacaaaggcauuguuuucuaaaauuauuuuuacguguuaaggugaugauggcaccuaccuguuaaagucgugagaauaaaaugagauggcguaugugaaagcacuuuguaaauuugaaaguacuucagauaucuaaaggauuguuugcguuucagcagauugauggucucuugccauggagcagcuucacagggaggggucaauucaccugaccuuuuuuguagaacaaaucauauucaaacccagacauuacaggcucuggaaccaagaagauccuugaggauaauuagccuguaagaugucagaaaagacucucagucacgagccaugaaauucagugauacuugaggaaauuauugaugaugucacccucaugagcuacagaucuucauucccuuuuuguuuccuuccuguuucuucucuucugccucugccuugaaacaaccauugguccccaugacuugcuuggccagacuaagaauucuggauuuuagaggcugcgaauauuugcucagacagggucaggaaauaaggacaguugacagcaauucuuuucuuuccaagggagaguugucaaaguuggguccccaaaccugugauuuacuauugccccugggauuaguuuuacagucuuaagccugguucuuuaaugguuucuuaaaagggcagaugcuuuuauaaguaccuucaagucauaaguaauugaucauaauuauaggcccucccccacagauaguuaagccucuaagcuaacaggagcauaauaaacauauuaguuuuuucaaaaguuuaagauuuaauuuugauggauuugccagaaaagcugacuuguuauugcuggcacugguacugccugcaugcacagggauaaugacuugaaauucuugcuuaccugcauuugauguaucccaggcccucgccugaucagccagugagugucugggaaguaaauuuacucuuuuuuuacauuugguaaucccaaauccuggaaccuuugccagaauaggacuucacugugaaccuguauuggaguuucugcacugcacaaauggauccuguuugaacagccugaacuaaaaacaauagagauaaaauuauagcauguuuugucagcagucuguucauucaccaaauauuuacugaggguccacuaugugccagacucuucuagaagguggggauauagcaaugaacaagccuggaaaagucuccgcacuuguagaacuugccuuguaaugagaugagcaguucuuucuucucuuuaaaaauuuacucaucuuuguuuuaauugccuuguuuuguuauacuuaaccuaaccaguuuuauagaacaacugauauuucugauaauucgguuaccaggaauuuccugauugaguaggcaacauaaccaaaaggcuaaucagaaucaagugcuuuuugaagauuaaauuuuaccucccuaacauagggauugaucuauaugagauacugacacauagcuaauauaagugaacauuugagcuccauuuauucaaaaaggauuuaggaagggcauaugcuuuaaaaaccauggggcuaggugcugggaaagauaccaggguaaaucauaccuagcuacucuccugaagcaguucuucccauguuugaaggaauaagaugaucaccauaacccugauacaugauaggaucaugugcuguaagaaagauacaagccagugcuuaccuguauuguuucuagggauuauauuuauuaguguaacaguaaaagcaauucaaauucaaguauuggcucuggaaacuaaaagucauuacauaucagugaauaaacuugugauguuuaaauauuauaauuagaauagucacugcuuuaaaaacaaaacaaaaaacccaaagaaaaggcuguaaagcuuaaugauuauucaaggagaguuuucuaauuuucucucuuuuuuaaagaucuuaguaauauauugcauaaaaggugaguaaaaaugugauuuucucuggaaaaccuaauuguuaacaggguaaaagaaacaugacauauuugacucuguaaagccaggucuucaauuggauuaguucaugagaauccuucugaauaaaauugcuauuugugugguugaauaauacauuuacuagggcuuuuuucaauaaaagcaggaaaagcaggaguuuaauucuccuuuuaaauaucaguauguuaaaaguauguuuguucuuucugucucugagaguuccuugaaaaguuucugauuuuucaagguuguuuaguaaauaaacauuuucacaaugguauucugcucauuuuuuguuccuacagaagaacuugauaaugcugaauuuuugacauugcaguuauaucccuuuuauacaaccacuaucaacauagaauuauuagaaucucucuauggaaucaaggacaaaaaaggucuauaagaggaaaacuuguauaaacuugaauaucuuugaggauauuuuccuauguuuaagacauggguaaaugaauaucuaugcaaauagguuccuauuaaaaauaaauuauuucuuuuuuaaaaaaacaaaugucucacuauuaaugauuucuuaggaaaguuuuuuaagaaggaaacacagcauacaugcagccuaucauuguaaaaccauggauauuaggguuggaagacacucuggaggucaagcuacuugucugucaugccauuuuaaaguuauugacuuguucuuaaaacuaaguagcaauuuuuguuuguuuguuugauggaagcaguuaaaucgggugaguacauuucuaguuuggaaaaaaugaacuguauguagacaaaagugacaguuugccaggaaugaaugacauaacgauaaaugaauaaaaauucaguaaauuccugaauucugcaguaugccauacugaaguauaucucuacaagaguauuauuccaguaaauucuucuuuuaaggaaguugugcuauaauuaugauaauuuaaauuaauuauaauaauuuaaaauagcuauaguuaaaugaugauacagguaaauuaugcagguaauucauuaauaauauugaauucauuuuagacaaagaggaguaggaaaaauugaaacacuuaguacuugucugaugaaugaaauauuacauaauguggcucuggcacauuauguaacauucugguuaaugaaauaaaaacaucauaauacuuaaaaauuagauggcauaauaaccaucagacacauaagcaaauauguguuuuccaugccuucugaggaacuaaucacacuauuguucuuucucaugagguucagaugaguugcucugucuucauaggaaguaaauuaauugugagcuucuugauguaacagaacacagcagagaugaaaucugggugucagugaauuguuaacaggagaaguuaguguguaugauguugggcuuuguccaagauccaggaggcagcacugaaaacgcaccggugguugauaacaagcauacuuacaugaaggucacuauuugagugaugauccauagaugcuagguuugguggagcaggcaggccagcaaucagagagauuuuuccaagagcugcuggguaguuuucuugaauaucaccaguuugcugccauaccugauuuuuauuuuaccagcugcacauguagcugcucuugccugagaggugaaccggagggacugcaaggcauguggcaggaaucuaugcaaguguacaguuguagucuggaaguccauuugagucaggauuauuauuaaacauuuuugaccaucuccuuugucuauaguaguuugccgaaauuuggauaucuacuggcuuuguaauuuaaguagccacuuaaauuauuccuauucucuggccuuccuaaaggauuuaguucaguagaauuagaaucacagcauaaggauuuuuuuaauuggaagaagucuuagauuuaaccuagugcaacccccuuugaucuguuuuauaauaauaaaauuugaguuguuuuaugaaugcaaaaaauuaucucacuguuagugaacaguuuuauucugugauuguaugcauuguagauauaaacugauugaggauggcuaagauucagacagagguuuauauuaaacauugguaagacaggaugacugauggucauuggauauaccagaaaaaaaucccuugagauguaaaaguauuuucaguuuagugacuuuauguuugcugacuugagaaccaggauuguguauuuuauauccauaaauaacaugguguccauaaccauugguuaacccguauauguuuccugauugauugaaauuuuaaaccccuuagauaagcacuuuucaucguuuuagaguuguauacugcauuagcaaguaucuuggacuauugacauugggagaucuguggguauuaacuguaaggcauacacaugugaagucuauuuaguaagagucuucaaauacuuacucauauuuaaacuuuuccugacuaugcauuuuuuaucuucaauauuguacuugcuuuggcuuugacaggauauucucauguucuuccucuguauuuguuaacauguauccuacagacagauggacuacuccauuugcccuaauggauuucuugccauccaccucuauuacuuuaauuugaacagaucucugaaugugcacuugguaccucuccugcaccacucuccaccuguugaaauucugcuuauccuucagggccaaccucaaaugucacuuucuuuguucuguauuccuuaauaccucgauuuggauaacauuucugcuuccuuugaguccugguaacuuuggaccuccuuuauggcacuuagcuuguaucuguccccuuauauuauuucuguuauguaagauggaauguuaacucccaugacagcccucuucugacucucuacucuuucacacccuauuuguaagcucuuuaaggcagagagugucuugugauuacauucguuuauauccuguauccauuggauauaaggugaauacguaacaagugagugaaaucauugaaaagggguccaguuauaaaggaagacaccauaugaauuauuucuaucaugugaaauaauguuaauacuaaggagugucaaggagggagaacggaucugcauauuggauuacacuuauugggauuccugggaaauaauuuaggaaauacugaaaaaaggaaguuucauuuuugucuuacuccaaucuacauaguuuauaugaaaguuuaaguauaauucauucuuauaguuaacugugcaacuuuggacuuaauuuauauacugcaaagaagacauuaacauuaggaaaugagcauacauucagcaaaagcugaaaaugauuugaacauuucaaauguaagaaaguaagguauuauaaauacauuuugaucaauugcuugaguucuuuuauuuuucccauuaauuuuaauuucuuuggcuuucaauaguggaaaaccuguuagcagaauuagguaaaaccuuccuaauaauuucuauaaaagaugaugauucugaauuucauuugagccuugucuucuacuccucuucauaauuuguguacagagaauuuggauuccaucuugacaaacugguagguuuaauuaagaaguauacuuccaguuugaauucauuccaguuucuuaagacacauaugguuggggugugugugugugugugugugugugcacgcaugugcaugcagaacaguggaguacaagauucuugaaagaagggacuguguugucuuguuccuugcaguaucccaagcauuuagcaugaugucuggugucuuguaacccugaauaaguauuucuaaaugacagaauaugcgccauuuagaaauucagaauuuaauuuuuuuuaguuagaaaugaguaaucaugucugaaaauacaggugaggucucuggcauucagcaaguauuuaugaguaucuguuauauucaacgcuuuguuaaaugggauuaaggcaguagucacaaaaagugcauauugaaauguuuacccaaaaaaugguauguggucugcaauuuguuucacaaugggguagagaugcaauaagaaugaacuaugaguugaucacuguugaaacuguggaguuuuauuguacuagucucucugcauuuauauauguuugaaauuuuccauaauaaguuuuucaaauguuccugcuugugggcuaggagucagaaaacugauucuuauccugauuccucugcuuauuauuuaauaguugaguaaccuaggguaaauuccucaugucucuuggcugccauauccccacaauaaaaauagaaauuacuacugcucuuuagaccuuagugguuuacucugaucaaaugaaauuauguauacaaagauccaauauuauacaaauauaagguauuauuaacaaaaugaauuccugcuuucaaguaguuuauaauuuccuggaagaaacugacauguacacagauaucuguauuacugauugguagcacuuucauuccaccucacguugugaaaguaugaauggagcuagguacuucugaaaagauguguauugaguuuauaguaauuaaaguaaaaaauaaucuuucauuuggguauuggauauuggugucguguuuacccaguggucuuuccuguuuauuaauggguuuauugugagaguaucuguggaccaaaugcugcugagaacacauugucaaaacugaugggagcuugaugauuucuucuguauuugacuauucaaauuaacccaaagaggaguuggauucuuugcuuguucuuucuuucuuuuauuuuuuaauuucaaaaucucaaagagaauuauucauuuuugucauacuuuggaauuucugcuuguuuauuuucugaggcuguuccuauggcgugacugacuuaugacauuuaaaauuuuguucuguguccucuguuuaaaucguuaagaguucuauucacagcaaugaagcaguucuuuuuuaggggcacuaaucuuuagugaauuugcuuuuuuuuuuuccuuugcuuccuuuuauugcaaaguaaucucauaauuucugugguagguguuccuaaugauuaaaaaaaaacauucauuuauccuaaaauacuuuuauuuuuagaagguucaaaguauaauguuaggaacauuaacucucacaccuuuccagcagcagagcaagaaaaacaaaagaaggccaggcacaguggcucacaccuguaauucuagcacuuuggaaggcuaggaugggaagauugcuugagccuagaaguuagagaccagacugggcaacauagggagacccugucucuacaaauaauaaaaacuuuuucugaaaaaagacaucuuugcauuucaaggguagacuuuuaaacuuuaguuuaaaaguuuaguuuacucagaccaguacauuuuaaaacuuuuuagaagaacccaagagacugucugagucguuucaaguugggaguuuuagcugauauaguauacauuucaaccauguagaaucacuuuaaaaaguuauuaaauaaucuuggguuaaaaugggauauuuucuuguugaaccuugagaaaccaagagacagguuuggagauuggggcuagaagggacucccagugcugaucaugaaugaaauacauucaaauuauguaaguucccuugaccugggagaacauagcuucuuugaaaugacuuuuuuuuuuuuuuuuuuuuuuuuuuuuacauauuaagacucaaaagaagagugguaacauucugcuaauucuuacaaauuauuuuaagcccaugaaacuuaaucaguggcuauuuaacuucuagcugauuagaugagaacugaugccacuugguucucagcuaaaguuuugugaagggaagaagucuguuucacagacauuacuacucaaguauugacugacucaaagugauggaacugauuucaaggagagcuguaugaaugugacugacucggugguaccaauccaauccuagaaaaacuagacuuuugagaugagucaagagaaacaucuuuguuuaggaaagaugguauagguuugguuuuuuuuuuuuucacuuuaguugauaaaaguaagaggugaauccaucauuaggcaaauagaaaauggucuggaguuguauuuauguaucugaaaggacaacaugcucauuaaaagaagggaagacggugguagaagauaagcuaaguuaagguagcaaugagagagaaaauagaaaaaacaguaagagaacuugggauagugaguagaucugaaguuucuugauaaacuucaaacucugaaaccuggugaucugaaaguagaugaaaauucugccauauuuagaaaacccucaaaccagugcuuauggaacgaguaaacucagauuaucauucuuacaauucugcaaaaauaaaauggcauugcugucugcuuuuucuugggcaccuuauuuuaaucauuuuugcauugccccgugugccuagcacucaauuaccuguugaauaguuguaugaauuaauguugaaugucagcuucccauuagaauauaggcucccugagggcaaaaauuuuuguuuugcucacgcauuaucuccagcauccagaacaguuccuaguaaauaucaauugaguaaaugacugagugaauaaauaguuaagccaugacucaagauuacuguuuucacagcaacuuuauugacaguaaaaauguaaauuaacacuacaauuuauuagauauuuuauuuuucuauucacucaguauugcauuuaaaacucuucaaaauuauguagucucuaauagguaguaaauuggauucugaccugggaauuaggaguuauuuaauaauguaaugauuggcaaguagauuggacaaugagauauacccuuucuaagcuaauucauccacuacuguuuucauuaaauuacgaacauaauuuuaugccaauaauauugauauuuuagugauauuuuaaaucaucauaucaguuuuugcagauugaauuuacauguuuugauggaaguuugugaacaugguuuaagauucucugggcugugacugcucauuuuuguuuuacuguaaaauuaguuauauuaaaauaugacuucuaaagagucauauuuuauauuucccuaaagagccuuauauuaauggccauagcuguccuuacaaguagggauguccauguaauauguaugucauauuaaaauauugacaugcauuccccuaaagagccuuguauaaauggcuaucacugccuuuauaagcagugaagcccaaguggccagucccauuaugaaccuugucccauuacuucuguuuggggcuaccauuccaagcaccuuccuccucugcuuagaacagcugauugugaucacguaauggguugugacaucacugauaauacuaauauauuauuacauagcaauaaacuaauuauauauauaacauaauuuauacaauauauauaguaaugaaagaauuaaggaaaagaaagggaaagaaggaaugaagagagggagugaguaauagaauagaaaagaaaaaaaauugugguguucccagucaguugucagauauguuucaaggaaguuguuaauaaaguagaguaccaaaguuugcaggugaggagaguuauuugcaguuuuuuguuuaaaauaauuacauuuuucuauuaaagcaauuuuucugguuaauauugcuuguaguaaauuacuccaacauguaggggcuuaaaacaaccauuaucuuauauucaugaauuuagcagguggggaauucagacagagcacagugagaauggcauaucucuguuccaagaugucugggacauuagcuggaaauuacucaaaaacugguaguuugauuauucuaggcgucuucacuuucaagccuggugguucaugcaaguugguuggcgaaggcugggaucugaacucagguuuuugagcagagcaccuacacugaccuacaccagguggccugggcuucccuuucagcaucaaagcuucagaauaguugaauguacauguuggcucauggcuuuaaaaguuggugucccugagaacaagcaguguuaauuaugccacguuuuguuguuuauauuugaguucaaagccccagagauucaagagguagagacauacaccaccucuuaauggaaggaauguuaaagaauuuccacccccccacccccagcuuuuuuguaaucaugacauuaauacuaauacuaaauaguaugaaagggcuuaugauaaaaaggcaaagcuccugccccaguucucagauacagcuauuccuauucccaguacucagauacagcuucuuuucacugucuguuuuuggugcuucuguuuauggucuccauaaauuuagauaauaugcuguugcucuaguucuugauauuuaaacuucaguaauaucuauugacuuucuacucugaaaaaugaggacuuaccuuguuaauauuacuguguauuuccuucgcuuucugugagauagggauauuuuuauuucauauaauaauuuuaaauaauaucccuaaacuucaauuuuucauacuuucacuuugggcaguaucucuugauucuccauuuaguaagaggagaauauuuuauccccguaaccuuucuuccacuuauguucucccuuuaacaucacaauuucuaucagcuacuuugcuaaaauuguuuauuugcauucuguuccguacugcaacagaggcuucccugcuuuucuaaagguugacccuugcaaguugaacacugguaaacagugcuuacauucuucugacuauauagagagaguucagugcuaggccaaauauucagcccuuauguuuccuucucuccagguucaacauuauaacccuaugaagcugauggaguccuucuuuuguaaaaacagacaucuggauucucuuuccuuauucugcaucacuuguuuaaaauaugcccuauuuucguguacuuuuuauucaggccaugacuuucuuguaucauuuuguuuuuccuggaguuucuaauugccuuuuuauuuuuucuugccauguuugccuuuaucacaaucuguguucuccagaaauacuaugugucuacauaugguggguuucccgccaccauuuaauuugcugggcauucuguggaaucuuucuaagugcagauuugcuucguuuuauuuuuuuuaauggcugcuucuucaucauuuguucuauucucuuuacaagguucuucuguuagucagauauuugaucuugcaguugggaucucugugucucuucuuuuaaucuuuuuucuaauucaucucuuuucucugguuuuugcuuuguauucuaaagaaacuucuauauuauuuuccaaaugucuacugaauuuacucucaguaauuaauauuuuuaacuucaaaacaucauuuuuuguucuccacuuguugguuuuuaaagcauccuccucugguuuucuguaauauuucuuugaauuacugugaauuuuuuuaaaguccuccacauuaucucuguuucugucaguguuuaguuuuuuugguuaacuuuuuuguuuuuccuguggcugaauuuuuuaaaugccuggugaucuuugaauauccuuuggcuuuuuuaaagucaaaacgagcuaaagguauaauuuuuauacaguaaaauacacccauuuuaagugugugcuuuuuaugaguuucgacaaauuuauucaccuacuaaccaccaccacaaucaauaucuaaaauacucgcauuaucccacagggcccuuugcagugaaucuccucccucuaccaggaccccugccaaccuaaucuucuuucugucauuauagauuuguccuuucuagaguuucauauacacaguaucaaagaguauuauguucuauuauaucuggcuuucauugauaguguuuuugagauucauuuauguuguugacuguuugaguaguucauuuuccauuauauggauuuaccacaauuuguuuauucauucaccugcugaugaucauuucuguuguuuccaguuuagggcuguuauaaauaaggcuguugugaauauuuguguacaggucuuuguauugauaugacauaugcuucauuuguaugguaaauaccuacagguagauugcugacugguauggcaauuguguauuuaauuuuuaagaaauugucaaacuucuccaaacugguuguuccauuuccagugcuaguguauaaagguuccauuugauuugcacccuccugaacacuugggacugucaaucuuuuuauuuuuagucauucuauagugagugugaacuaauaacacauugugauuuuaauuugcauuuacuugaugacuaauguuguugaauaucuuuucauuuggcuauugaccauucugauaccuucuguugggaaguuucuguucaaauugaccguuuuuuaaaauugaguuaucuuauuguauuguaagaguucuugagcagucuuuugucagcuacauggauuacaaauauuuucuucaggucuuuggcuuaccuuuucauuuccuuaaugcuuuaugucaaacagaauauuuuaauuuaaccuaaguccaauucaucuuuuuuuuucuuugauagcuuaugcuuuuuuguauccuaucuaauaaauauuuguuuaccuccagggcauauaggauuuuuccuauguuuucuucuagaauuuuauaguuuuugcuuuuauuuuagauuugugaugcauucaagucaagucuuuguguuuggcuugagcuaagaguucagguucauuuuuccuguauggauauccagcuauuuccgcaccauuuauugaaaauacuuugcuuucuucauuuugaauuaccuuggcagcuuugcuaaacauuaguugagcauauacauuugggccuguuuuuagacucuuuguucuuuugcauugaucuauauaucuauccuuuugccaaugucauacuuugauuacuauaauguauaggucuuaaucagguaguauacauuuuccagcuuuguucuuguuuuucaaaauuguuguugcucuucuuuuguauuuucauauaaauuuuagagucagcuuguuaguuaacacaaaaauucuccuauugggauagcauuuaaucucuauuaauuagggcgaaggcauagauauugacacugacuucugaucacgaacaugguguaucucuucauuuauuuaggucuuuaauuucucucaucagaguuuuguagcuuuuaguguaaugcccuugcuugcauuuuauuaaauuuaucucuuugcauuuaauguuuuuggauguuauuguaaaaggcauuguuuuuucuuuuuaaguguuugucauugagagcuauagucuuuuuuguauagugaccuugugucuugugaucugaaaaacucccuuauuagucugguagcuucuuuguaaauuuuaguuuuuuuacauacacagacacaucaucugagaauagacaguuguacuuuccccccuauauauauauaugucuuuuauuucuuuuccuuucuuuuuuugcccuggcuagaaccucuagaaaaaugucaaauaaaaguggugagagcagauguuuuuggcuuguucccaauaauaaggagaaaacuauucagacuuuugcccuaaaguaugauguuagcuguaaguuuuccuagguguccuuuaucagauugaugaaguucccuuauauuccuaguuugcuuagagaguuuuucaugauuggguacugaauuuugucaguguuuuuucugaagaauugaauugauuauuuuuuuaaaaacucuguuauugugcugugaauuauacugauugaauuuugaaaguuaaaccaagcucacauuccugggauaaacccuacuuggucaugauguagccuuuuuauauauugcuaaaauuuuguuaagaauauucaugaaugauauuggccuauaauuuuuuuuauaauaacucugauuuuuguucugagguaaugcuggcuucauaaaacgaguugagaaguguuucuuccucuucuauuuucugaaagauuuuguguaggauuggcauucuuucuuucuuaaacauuuaacagaauuuacuaaugaagucaucugggccuagcauuuauuuuugaguagguuauuaacuacaaauuauauuuucuuaauagauaugagaccuuauagguuagaucaccuuuuauaauuuuguauuuuucaagggauuugucuauccuaggguuuuuuugggggggugguaguuuauugguauagauucuuuaacuccuuaucuuuuuuaaugucuguagaauauguagugauguccacucuuuuauuccugauauugguaauuugcauuuuccucuuuuuaucuugacauacagauagaguuuugucaguuuuauugaugauaauccaguuuuuuguuucauuaauuuucacuucuguuugucuguggucucuugauacuuauuuuguuuuuaucuucuuuuccuacuuacauuggguuuaauuuguucuuaguuuuagcuucuuaaaauagaagcuuggaucuucaaauauaugcaucuucccacaaauuugaauauguuguggcuuaauuuucauucaauuuggguuauuuuaagccauuuuuaguuauauauucuuuaauccauggauucuuaaauuuccaaacauguaagggauuuuucuaauuucuuucugucuaauucuguugugaucagagaacaauucuguaugauucuaauacuuuuuaaagauaguaacacuugcuuugguccaacauauagcuuaucuugguacuuguuccauuugauuuuuuauuuauauauuuccaauuuucuccucacuguguccauguuuuccuuuaaggccuugggcauuuuuguaguguuuauaauaguuuauuuaauuucuuugucugcuauuccauaaguucugucauuucugagucuauuucuauugacugauuuuucuccugcuuaugggucauguucuguauggcugcaugucuaauaauguguuauuggaugccaaacauugugacuaugacauugucaacugcuggauuuuguucuacuccuuuaaagagaauuggauuuuguucuggcaggcaguaaaguuaugugugguucaguuuuauacuuccaaggcuuauuuuuaguuugucucuuuuguuguuggggagaggaucuaguguauguaggcuuugcuuccaggcuaguuuagcccuacuaagacauuacucuuuuguagucucucuucuuuggcugguaaggaguuugaaacauuuucugcccucugugagcucuggaaucauucaucuuacaacuccuuggugaucuuuucucagaagcugaccuuucuugacuucaugcaguuccacauguguagcuuaauauucagccagggacucaauagaccccauguagauuucuggagcucuucuucaguauugugucuuccaaauuuuagccacuuuggccuccuugucuucucaacucugaucucugccuacccagcugggcaagacuacagaauuuacagaacucugagguuccuccuuccuguaccuguggucuggaaauugccuccaaacagaaagcuagggcaaucuagggcucaccucauuugcuuccccucucucagggaucacaguccucuacuaccuauaguccaauaucugaaagcaguuguuucauauguuuaucuaguuucuaguuguuucuggcagguaagaagucuggaccuucuugcucccuuacugccuuguauguccauuaguuuuuauaaagacugguuagcuaguaagacuauuaaauaggaucuuuuccucccugcuggcucucauuucugaguaaaauuuuugggagacuuguuuggcauaggaaucuugggaugggaguaugcuucacaggcuuuacuuuuggguggcuggaaaaauggcugucaggauguggaaaaacucucaaaugucacaauaagaaaugguuuacuccaagaucuuagguacagggauggcaauaggaaugcuaacuggugcaguuacccuauauacagacauuuaguugacuccccugaaugugggaagaaaauggcugcccuucuuccucccuuuuuccauugcaccuguugacucguaguccagcuucugcuuccuccacggugcccucauggcuuguucuagggcaguggccucccuucuaguaaaaauauuugagcaugucacugauauucacugaauuauaaaaauuauguacauauacagauauauuauuauauauuuaauaaaaauaaugauuuugaaaugaagggguacaaaauaccuaaaaauagaagauauuuucuuaauacaucuccugauuauauguucuucacuuuggagacuacuaucucuuuggugacuucuuccaucaccuuauuucuguuuauuuucagucacccagcaaauuuacuaaauucucuccuuuuuguguaugugggacgcccuuuuguaauuauggguuuauuucuuuuacugagaaagaauggaggcaaauauuugugauagguccaccauuuugaacuggaagucugauuacacuucuuaaaauaaauuuuugaauaaucaaaaugucuuuuuuuuuuuuuuuuuuuugcaauucaguuugcuuuccugguugggagcagaagggcugcagcccaagaauugcuuauuaccugcgggaaguuuuuguuaugcagcaguucuuaaauuuggguaaugucaaagggcaugugaaccaaggaaguugucugcuaauuucaccagaagcaaaaaaguuuaagaacagcugcucuggagaaauauugggaucacaugagauauacuuuuccccuauuuauuccacauuccuuaauuuagaggacaguauaaccaucuggagaggauccauaauugaagaaagaacauuguuucauucuucuguugcugauugcaccuggcuauauaaauucauugucaucuucuagguuuucauacuguugauauaccaucccugaaaccaacagcugauauaaauuguaacauagaaaagcuaauuugacaucauauugggaauguuagccaauugauuuuucuuaagggaaacaaacugaaaaaauaagcccacuaugaauuaauucuuugcaggaaauucccaugucugauuauuuaaaagaauaaauucugcaugcaaaugaaucauuacaagcuuaauugaagcuugcgggauacucaaguuuacucacugugguguguuuuugauggagacaggaagugaaaaagcaaggucuaugagacuuuuuuuuccuaugaagucucagccagucuuuuaauguuucucauugagaaacuuugguugggaggguaaaugacucaagguaucuauugcugcuuagccguuuuuaagggggcauuuccccccauguuccuccccuccccaaaauagcuaauuauguacuggaaguuucaauacauuguucacaguuugugaagucagcauauuucuggaagcucacugugaauguaauucuuaacuguacaaaugcuuuuguuucuccaucucugcagcuagcucuguacuguaaggacacaauucuaucgcuauuuuuucccucacauuugaugugguaguuugcauacagcugcagaguagacaguuaccuuugaaaggaacauuuggcugcucuaauuugauuaaagaaaaccaccucaaucauuucuagacugagaacguuuucauuuuaacuuggcaguaggaguugggaauguacucauugcacuuagauaugugggggaccaguuagggaacaaaaccaacugcuugaaugaagaaagcuuuggugcauuuuuuuuuuaaaagcaagcaguaugauucccuuucuguuucccucucaaauucucuacaaccuugauuuucaccuccaucuucuuuucacgguuauuuacuuuguaauuccaguaaacgaauucuggcaggaauagacugcuacccuaaagugauuugugauuuaaaggacuucaggguccuuaaaaauuaucccauuuuacauagaaauaaaaucccaaaucaugaauuacuaugaauugcauauauuuucuuggccacuguugagaaaggcaaaaaaaguuguuagaucauggguguacagaccaaggcugggaauuuaguuguaacuuacuuagaagaaaauugcuccuugucagaaggcugcagucaacucacauauaugcccuuuguuucugacauagaagagggucugaucaccaaauuaguaugacaauuaaaaauaaauucuggugauugugaauuggcaucaacuuuauauauguuuuuagaaaugauugagcagugguuaaugucuguacgguaaaccaugaacaaacuuuugaaccacagcucaguaauucaauauaugauauccuugugaaagguacugugcugucaucuuaaaaaguuugagugugggccaggcacaguggcucauguguguaaucccagcaccuugggaggcugaggugggaggauugcuugaggccaggaauuugagaccagccugggcaacguagugagaccucauuucuacaaaaaauauuuccuaaaauuuagccagguauaguggcacucaccucuggucccggcuacucuggaggcugaggugggaagaucaaggcuugagccuaggaguuugaggcugcagugagccaugaucacaccacuugaccccaaccugggagacagagcaagacccugucucaaaaaaaaaaaaaauugaaugagaaaauuuaaauuaaaagucugaagcuacacaugggccucagaaauaacaaacacuauuacuuauugauuauuggauauuauugauuaccuaagagaggaggucaaauguggguucacauuccaguucugccacaugacuaugugucuuaaccccauuaugcuuccuaccucuaagcuucaaugucuucauuuguaaaauuaggacacauauuaagugaugucucugaaguuagguaccuuuuaaguguuuuguuuuguuuuguuuuguuuuuuugaguuggagucucacucuguugcucaggccagagugcaauggcaccaucuuggcugauugcaaucuccaccucccaaguucaagcgauucuccugccucagccuccugaguagcugggauuacaggcacauagcuaauuuuuguauuuuuaguagagacaggguuucacaguguuggucaggcugaucucgaacuccugaccucaugauccuccagccuuagccucccaaagugcugggauuacagacaugagcugcugcgccucgcccuuuuaaguguuugauacuugucaaguacuuaguugccuuacuuauuccucuccuucagaauauuuuguaggggggugguuuuguuaauaggauugguggcagaacuugacaaaaucuucaaauucuaauauuaugugcaucucucauucucuuggacaaaaugauuaaguccauuaggaaucucucaagucugccuacuuuuucucugguuaagugugacauuauaucagguaguaguugcaagggcaaggcauagguacuacggacauaggagcuguucaacaaaugguugcuauuagauggaguuacacugucaucuugaaugccaccuucugccaucuucaagugcuauaauuauuuccacauuuaaucucaagacuguucacucgaagccaccccaguuuguucuuccuucugagagucaaaggccaagaaagaaucuuuucauuuuguuuuuacacacgguaaggagggcguaaauauuuucagccacgugucucaguguacaaggauggugaagggacuaaaacgauguuugccuaaaguacccugcuacauugggguuugagcacucaggauuucuaguagauacaacauuauaacuguaguugaaucccaggcucguucacaaugcuuauuuauauagcugaagaauguccaaugaguaaaauacugcagaaagcaaugcuggagaccuguggaaauucuaugagaaaaugcuggguacugauuauuuauguuacuucaaauuuucuuucucucaauaaaguauuauuuugauauuucuccuauauaauugccuuuuuuuuucuuuggcgcuggggggguucucauucugucaccgggcgcgaucucggcucacugcaaccuccgccuccuggguucaagcaauucuccugccucacccuccugaguagcugggacuacaggcacgcaccaccaugcccagcuaauuguuguauuuuuagaugggguuucgccauguuggcuaggauggucucaaucucuugaccucgugauccgcccaccucagccucccaaagugcugggauuacaggcgugagccacugcacccggccuauaauugcuuuuuuugaaguauauuuauauagcccuuuacuauugaauucugcccaucuacuuacuauuacuguuuaucuucuuaugucacuuccaaccugggugacaacuuaaacauucaaauccaguaaaauuauuguauguuucuaauaaaaugcauagaagcuagccugagacugaaguuuuguuuuuuaaaaaauauguaaugaauucaucacuucuuuucgucaugacaguugucuacuucuuaagugcuguuaauauaauuacguucacagcagcagugagggagacugggggaggauuguuauucccgucuugcagauaaagaaacagacaacguaaaugacuugcucaaggucaacugucugcuggcagagucaggacuagaccacaagccuuuugacuccaggguguuauuuccccuauuauauaguuuuucuaccuaauacuacaaguguuucagucaugcaaaggucauuuggauuugacuguuuuaguaagaccugcuuggcaaauuaaaugcacauaaacugcaugcugacaaaggcaugcuguuuauuugaagaggaagcuaucuugacuuacuggaaacuagagguauaauggcuuaauucugacagauaguaaaugauauacauauacacacacauacacacgcauauauauuuucaaacaaucuauuuucauagccauaucuagagaccagcauauagaauugacaguguuaaguaguguuauuuguuaggguucaugcugcuucucaacuugguggcaguuagcuuuccaugaccuacccugcguuacugagaaaaggauggaagaguagcaggucaaaggaaguacgcauaccuuugaaucuggcaccagaagugcugacgaggauguugcauaugcucacgaugacucagcacuuccugguuucucuuuucagccacacucuggcuaaugauaucgaaugaccuugguucaaacugagaguuucagggaaccuuugguuucuucaucaucaaaaauuugcagucuuuccuuucuguuuuuaauuaguuaaugguacuagguaugaaccauuauauuucacacuggauuagauacuuuuuguucuuaagauggucacaaucuaaggaaguagcuuugacccuggacuauaaauaaauauacccuuaccucucaaguaagagcaguccugcuauaacucauuuggucuuuuauuguuucugugcaaccuaauaaguagggcaggaguggaaggaaauggaguucaaacuucaguugcacuguuugcagcuuugguuuuaggaaaggcuuagugaccaguaaggccaaguaagggaagguaauuguggaucugccccuugggucccucaucacuuucugaaugguccagaauaggucuaccaugagugaaaccagauugucguugucaauuaguuuuauauuuaggaucagccacaauuuuuagacucuaaaauuauuaacauugagcacauuuggagaugaaaauuuucagaaaacauugaaaguuccaggaaaccuugaaacuuuuuaagccugaguuuuccugggcuauugagaguuucuccauguugacagccaauuuguuuuacaauuuaugaaacaauuuaaaaaccauuuuauagauuaucuagauauauuucuuuagaaauauaucuucauuauuaaaggaaaucuuaaaccagugguuugcagugaaggaaauagcuauaguauagcaaaaauaugccuauauuuaaaauacaaauauuuauuguuaaauguguuuauguguuuucaucuuuacagaggccucuaaauagccaggauuucuggcccuuuaacugcuuccaaauaagcaaaaguaaaaauuccuacagaaaacauagcccugaccuuuuugcacauguaauccaaacaaaaaguuagcuuugaaauggagucuuguuacauaaucauacugaaaauaugcaguaauauguauuccuuugaauaucuuucauucagaaacauauuuuuguuuauuugacuauccucccagcugaaaauggguuauguucugguuguucaucuaaccacccuaccucaaaauacuugagaaaucacaugaagaauuucauuccaaagcauacaauuuucagaagggcucaggacauuggaaaauugcacauuggauuuaacuccauugaugauuuaaauaaauagcaaauaaugcaagaagauagauaaacagaauauacaaacacaguuuuuacuaggcagaauaccuguccaauuaauagugaauuauuuaagcagcauuuacuuuauagaaggcacuuuaagugaaucauuuguuucagaucugucuguaacauuucuaccaaacuauuuggccgacuauaccuuaugguaucaagcauucuaaaugugagaauacuggccaauauaggcaaaagcaaagaaaccucccucuuuucuuguguguucucucagaugcugcuauagaaaucugagaauugggagcauaugcuucagacugcaggcuucugaugcugccccgcagcaacacaguaacuggcauuuugguucacuuugcauuuuacucaucugcugauuuaaugaguguucuguguauugagcaauagcaggaguucuacuuaacuaucacuaaacauaaagaagaaaaauaccauaugaggugucuaguuuuuuuuauuuucuuuuuaauuuacaggggagucaucuguuaacuugcguaauugaggaauagagcaguccaguuaauaagaaagcuuaguuauuagaaaguugccaucucuucugaguccccuuuucaaaggauuagaaugugauaaaauacacuuaacacuaaaacucauaauuuaaucuuuguugagcauugagaagauacuucaagauauauccuuuauuguacccuaauaaaaugguaguuaugaugaaugaugccuaugcuugcuacuagagaauuauaguuaauaaaauuuucgcuugguuauaccguuugacuguucaucaugauagauaagagaaggccuugugucauguccaauggaaacacgaagucaauugcugaauuaugcuugguuagguauaaaauuucacuuuuuaaauuuauuuauggagggaaagguugagauaguacuagugaagggcaagcaggaaguuuagguggagaauaaaauaaugagaaaccagaagaaaaauaauauguauuuauaucuauaccuauuauauauauugauauauaucuauauagagagaugcagaguuaaauacauuuuauuuuuagauagauauaaacuuacauauaauuauguagauauauuuauaaggagauguguaucuaugucuagauaaagagauguauaucuaucuauaucuagauagauaucucuagauacagauauauaaucuagauaucuagauauagauacagaaaucuggagauauauacaucucucuaucuagauauagauaucucuagauauagauauacaugucuccauauagauauagaucuacuuucagaaaguagauagaguaaaagaugaccaaauuagaagagaucaaauuaagaaaacaaaugauuucuuaaaguuuuaaaaauaucauggaaggguaaaaauucauauggcaaaaacuucuggaucuagaggcucucaagauuagguagaaagaauaaaugagguuaaggggaacagaggacagguggugaacaaaccaaaaaguucaagggagugauacagaauuaaaacuaguucagcuccaaaauugguauaagcuacaacuucaguauggcuuaucuuaaauuguugaccucuugcccaaaaccuaaauaaauguguauuuguuuguccucuucguauuaugucucuugugggaaacacaaaguaaauuuuucuugcauucaucuagcuuauggucuuacgguagaaaaauauggauaaaacaguuguuaucaaaaugaagaaaugcagugaagcgcagguaaaggcucacagccuuucugucuagugcucugaaugucagagugaacaaaggaguuguuauacuuggcaugcuaacaagagaagucggucuguuccgcauguugcaaaauuucuauugguuuuuauuguuggcauuaauauacacgauauccugugcccgucaucugguuacacagacauuuuugucauguuauaacaugaacugacugcuuuaaauguauagguaagugguaaucaauuuacaaaauuagguucuucauuccucccugacauccuccacuccuucccaccagggucugccucuuugcauguggacacgugcauauccauuuugcacuuuauuacaucguuuuauaaagaugcuaauaaagugauaaguagugauaaaaguaaagggaugguggggggaaucacugacaaaacaaaagaucacuucagaaucuacaauuguacauguuuuaacgggcgucuuugauaguccuggauacaggcucagaacacuuuacugaauuuugggagaguugggaacauacuucuauuuauauucauaaguauaggaagaaaagccccaacuaucuagguuuaucucacguugaggauuagaagcuucuguagacaguguauuucaaucaugcuuuuuucaagaagauagauuuuuuaaaaacuuauuuuauugugguaaauaaagguaauauacauaacauauguggucaauaaacauaacauacaauuuacaguuuuaaucauuuuuaaauguauaaugcggugacauuaaguacauucacauuguugugcaaccaucacugcuaucuccagaacuuuuucaucaucccaaacugaaauuuuguacucacuaaacaaugacucuucacuccccuuccccuacaagaagauacauuuuuaaauaacauuuuaaaaucagaagagaaccgguagguaguuuaugccauagccaguaaccuuaggguucagauuggaaauaauagagacccacugaaacuagcucaagaaagagggauuuuauuguacggggggaacaagguucaugagaaucauuacacuucuggucuccuggaacagggguucuggauaccaggagccucuguggagugcuuuaggauaguucuuaaaucguuucgaaguuuuacuaagccuuuugaagccauguagguguuacuagaccgguauaaaacugcaugccaagacuucaugguaguuuuuuuuuggucauaacauccuuuccaauuucaacuauagcacaucaugauuacacugagggaguuuaugaagaguagguuucauggaugaacauuaucagucuugaccauagugacaucuugagcucacucauuuuggugggaaaaucaugcuuucagagugaaaaguuggaacagcaugacggaaaauggauuuuuauuuuaaaccauugagaagaaaugcuguaugacuuuaugauggcuaggagauaccuuacauauaauuaccucacaagcugaugcuuuuaccaacuaacccccaaagcagcaucucuuugauccugagugacuugagccaagggaaguggcaacgugaugguggugaaggguguggagugggcagauuacaugauucagucuccaacucaucccaagucuagccaugccccucuuaguaugccuacuuuaagggcauaggcuauguggccaauuuuccuucaucgagauuucaagcucuuugaaucaagagagaaggcaauauguuuauuuagagguuaagaaauuauaggcuuucagaguuaauagguuaucuaauuuuucuacucauucguucagucuuugaaccuagaauuauacaaacaguacaugaccaguauuugucccccaagaucacauuacagcaguggucuugaaccaggggugaauuuguuccccaggggauuugacagucuuugaacacauuuuguuuaucacaacuggggcgguagaguuuauagauguuacuagugcugcgacuacugccacuaacaucuaauagguagagguuauugauguuaaguauccugcaaugcacaggauggcuccccacaacaaacaaauuucaaaaugcugauaguccugagauucagagcucugcauuucaaaaagacacuaguuaacaacaauuuguagaaggcaaaaaauuauaaaggucugcagcauaaauuggaaaaaacacauaaguccaaccaucuagcauuaacaagcucacauucauauaauuagcacuccuaauauuaguauuuuucauuaccaucaauaggcaagaagaggaaaaccaagaguaaggauagucuuuucccacaauuguuugauugggagcgaggugagauggcugaaauggacggaguuaaagacaacuggaaaaugugagauuuccuuaagaguguggcucagaacuagaauccacggugaagguuguugaaauuguuguugauuuguuuugguuggcuaaauuugugaauuaguuguauuuggacccugcuagggaaucagggguuuaaaaaaggaagcuaacuagaaugaggccuaaggaauggguuagcucagugacugguucuuauaagaggggaugcauacccucaagugaaagggucuagguaauuccaggcaaccaagaccucaaaucagagcucccucuaaauuaugaaugcauugccucaucucuguucucaauuguccuaauguauaugguugguauauuauguuuuauauuuuucuuuucaugccuccauuuauaaaaugucacuaaucuauaugaggugaucaaaugaaacaaaccaguggagaagugacucuuaagauuaauuaagguagguaauauugagaucuaugaauacgguagauggcuuauauagguugaggcuuuacuucuuuuucuacucauccagacuugaaccuugaagauuaauuuauccuacuugucauaguuugauauuaaccaagucuaauagauuuucccuuuaaaacauuuccuggugcccauuuuuucccccuuuucauacugucccgggagucaaucaauauaaaccuguaugaguaacuuuuuucucucucucguuuggguuauguuccaguucauaugaugccuucuucccacaucacacaugugccccaaaauggucuugaaugucuaccaucucaaacccagacuuuuugauuugugguccaaagcucuucgugaucuguauccgucuuacauguucaugucccacacuguccucuaaauggggacucugcccucauggcucucaaacggagccugcuugcucucuccaaccagccugguucauguggcugcccuccauggcuuacuugcucuucuccuuguuaccuaugugauauucacucaucuucaaagguugcaccuggcugucaucagcuccaugggagcauuucugaaaacuuuaguacuaacguucacuccucccuugugaaguuuauaucaccugguuuaguguuguguuauaucuuguccuacaguguccuuaguuauucacaugugcaugucuucuuuccucaucuauagggaaagcuccuuguaagcaaaaccugugacuuauugaagguucacauacugcuaaccauauugcaaguacuuaauaagugcuuauuaugugguugauugugcaagauagccuauuucuuuaaaaaugucauugaaaugauauguacaaauacaguauaauauuaguuauuauacaagaaguacuugaaaagauuaauuacugccagucaucuuaauauuggguguacaugggaagggcauauuugaaaaacuguaagaacgcagaaugacgaauuggcccucuauaguaguaguucucaacugaaggcaguuuugcuccuaggggacauuuggcaacauuuccagauauuuuugguugucacaaauggagggauaugauuaguauuuagugaguagaggugagggaagcugcuaaacauucuacagugcacaagacaguauccccauaacaguguuauccagccucagauaucaauagcuccaugguugagaaacccuaauuuacagcauugagugggcaccaucauuaacauacuuuaccaccuaaaggaaugaaagcaugcaaaaaguagugcauuuuuauauagaggaaaugaucauauauuguaaacuccuaaacggugggaacugcagcuguguacauaaagcagaacagucggauaguuuaaaagacaugugauagcugcuuguaccguaaacgagcacuuuaugucuuuggccuggacuuugagaggagagaaugauuguuaaguagacagaauucucuuaauacugaaugcacauagcccauaauuuuagaaaauuagaggcauuugcuaacccagaaggauguauuggaauuucaggucaaauuuuuaauaaacuggaauuccuuugcaaggauugauaguuauauuagaauauugaaugaaaucuaccuccuuccauuuuuucaaauauuuuagaagcuuccuugaagaauacuugauaguuuuuaagguguaagaauaauauuauuucccuaaauaauguguacacauggaagcagaguguagaauguuggacaauggagacucagagguggagacuggcagaguucuggauggagggguggaugaucagagguuguuugaugggugcaauguaaguugcaccagugauggaugcacugaagacccugacuucaccacaaugcaguauaucaguguagcaaaauugcgcuuguuccccaugaauauauacaaauaagaaagugaggaaaggaaggagggaagggagggagggaggggaaggaaaggagaagggaaggggagagaacgggggggaggggaggagagaagaggagacgaaaagagaggcgggguggcgcagcagcucacaccuguaaucucagcacuuuuggaaagcuaaggcggguggaucacuuguggucaggagcuugagaccagucugggcaacauggcaaaaccccaucucuaccaaauguacaaaaauuagccaggcaugauggcgcacgccugugggcccagcuacucaggaggcugaggugggaggauuguuugagccugggaggugggggugacagugaaccgauaucacaccacugcacuccaaaagaaagaaagagagaaagagagaagggagggaagaaggaaggaaggagggaaagagaauauucuuucucucuugaaauuaauuuugggaggugcuuauguggccaagagugguaugguggagggagcaguucagagagauccugggcaggacaccuuaaccauucccugccuguuuccucauuuucaaaaagaagggcuaaggcuugaugaccucuagcuuuaaaauucuaugucccuguaauuucagauagagagagagagagagcacgcauguauguacaguuauuuaagaaagaaacuuugaaggcaauuuuuccaguucauuucuuagaaauuucagaaauauuccauucucuaaaagcuuaauuccaguguuuaaagaaaggaauuccuguuauaaauaaaaguuguucucugcucccaaucaaaauaaaaagagugaaauaaaauuuacaauugauucaaaagugucguuauuagcuaauuuugaaauuuuuaucuauuuucuuuuguuuauauuuaaauauaaauaaaauauuuuaauaauacugacuuuucucacacaauucauguuagaauuucuuagaugguuccacaucugagaaguuucuugcuuguaaagguaaaacagauuuggaagcuuuauaaugauuuuuaauccaucauuucggaaguuacuggauauuggacaaaaugauaaaguguuauuuucuggauggaaaauuaaguagagccuugauacucaccaggcugaggauacaucccaagaaaugaggcuugcuucuauggugucucuguucuuagguuuccucagaguccauucuagaacuuggauaaugagauugccugaaucgaagauguuuuugggaugggcccagagaugcaaaggauauccagcuacauauuagaucuuauucccagaauuaauguugcuacagggaauagcaguacauggcauagaacauguucauaaauagugccuuagaugacuuuugguuuaacagagguuaauugagcccccccugaaugcaaggcaccuacuauagggacuacacagugggucagauuguguauuccuuaaucucugcuuuaagugaguuuauaaccuaguggggagagagaaaguguguguguaccugugccaauuacuguaauacaaagaauaaagcuaucgugaccauucagagauacagacacaauucuaggccaguucagaagacaaaauuaaguuuaauuugcaggagcaagaaaaugaggcuccaaacaagagaagaacgaugugaaaagaaacagacacaucguauacauggagaugaaugacaucacguauggcagacgaaccugaggugcugaguuaaccacagugugaggagaagaggaggaauggagauaaugcccaaucgauagggucagaaucauagcagaggguaaagcggccugaaauggaaucuagagacaggugaacugguuaggagauugaccauucccuggagagagaaaaaauaaugguggccuaaauuaggguagugcccuugaaaugagaggaagguuugcauaugagagauaguuaaguccuagaauuggccaauguggguagcuaguuagauguguaggugaacagagcuguagggucaacaagaugaauuaugguuuuaugcuugagugagaggauagugauggugaugucacuguuagaaauagcauucacagcagaaggagcagguuuggagggacaaugaugaacucaguuuugaacauguugaguuacauguguuuucaggaaauagccaaggcagaguuauagucaaaguucaggaaauugagagcuccauccagauaggaauccggaaaaccuguggcauucuuaaaggagauguauagaaaucuuuuuugagccccacauuuggaauaucacuuuugcauauaauuugucccacaauaaggagaaaaucacgaaugccccagugugguuacugagcacaugacuaggcugucaccagcuaagugacuuguucacccaugccaaccuucacagcacaggcgguucaaaauugccucugacacaguugcugucuguaguagaucuucagggucacuggcaaauaggacccuguauauuaaauagaugaaugagcaagaaauccuguauuuuaagugaaaaaaaaaaagacuauggaaacuugagacucugcauuuaggauugaaggagaaaaaagggggcagagagaaaagcagacacaagagaaguagagggagaaguaaaagaaaacucucagggaagccaugggaggggagaguuucggggaggaguaggcaucucauucugguaucugaggugcguccaagagguggaagagccuaaagacugcauccaguaguggggaauuacugcuauccauuugagagacagaucucgcuggaagagaaagaggggaaaccugguaauagauaacuaaggagugagaaaguguagcacaaaguguagaaacuguagcacaaaguguagacugucauucaguaaauugggggacauggaauguggcuggcagaaugacaaucugauagagauaggcacaguuaaacauuuuuguuguuaugaggaaauagggaaguguauuagaaggagccaggaggggaacacuuaaaggggaauugaaugaaagggaauaaaagcugaugaauugcagauuuagcauauuguggagaggcacaguucaggaggaauaggguucgucuugaagaggaggacacuuuccugugaaucaugagggacagaagauccauauagaagaagacaauagcuuugaucuucuauuacaagaaaaggacauuugugugaagcagggaggaauugggagcccuaaguaaaggcugaggaagugucuggaguuaggaagagagggcaggagaaggaagagcuagauguugaagaggaggaagcagagggauuggcuguccuaagagggacccaagccuguggaagacuuuaaaguggucagcacacuuggguucccuuagcaacagagagacucucccucauucaucaauaagaguggauuuauucacugauauguagacauuaaaaaauuguuagggugacauuuuauaaaaaguaagaacucucuuauauagcagaucuauaaaaauuagugugcuaacugggcuuagcaaaaguugggcaaauccuuccuaaaacacaguuaauauuuguugaauuccuuuuucaucaaaauguuaacuuagaguugaaaugcaaaagaagagauuugauaaagcauuuugacauuuggcauuuuaaaguaauuucauuagaucaucaagcuaugaauuauuaaacauuauucuacuguaaacaguuuuuuuccauuaucuuucuuugaauuagaaacaaguugcaugccauuugccuagaagaagauaaauguauuaugcacuaaaauauacaaagauuuuggcacuguuuuuuuucugcuuuuuauucauuaaugccuuuguuuagucuuacaucagaugaauuggacaaauuugggcuuuguauggcuaaagccaggaacaaaauucucuaacaguguugacaaaauucacuugaaaagucaagucaucauucaggacgagucauuuucaauuuaauuuccacccuagcacacuugagaaaaguagagucaucuguuauaguggcucccaggauagugauuccaguaacuuccagaggggacaguuuugcucacuggagcaccuccaguguuaacacaucgaagguguccaagaucccguuguugucuggcugauuuuccguggagagugaggagguguuugacaaggcccugcaggggauuucccaucccaugaggcaauucauaaccaaaacaauucaguauaaaccaaacuaacaauuagccuuuucaaaagugcucaucugugcugcccaaagaguugauuucuuuagaaguucuucuaacaaaccaggguaguccugaucuuuauucuuauagguuaaaaguuguaggaguuaaagucaaaaugcagaaacauuaugcuacagugugaagaaaagguaugucugagggccagggccuuuuuaagaggcagucagaacaauggcuggcugcccaaacauagggagccaauucugugaugugguugccauguuccaguauccaccuggcacuaaaugccuagaagcccaauuucauuaguauauauagaggguuugggaguccaagguugacagacucaucccgaccucacaagaaaacugagguuugaacaaaaauguuaaugcauucuuuuccaguaaaaacuguacaugucaaguaugcuugcaucugccagccaaaucauugucucccuugcaugcuugucugugggaaagccagguuauaguaggauacuugcauuguggacauggaaccuggagaggggaguuagcugaugagauuaaugucugauagccucaagcucuggugccaguugcauccauuuuggcuguaggagaggaaguuucauucacaaacucucaccuaugacaggguugagccaugcugccaguugugucuuuccagaguuugcuuuucuauagauaacauacauacuuuuuguaaaaguaccguuuaguugucaucacagccuagucuguucgaugugggguggucauagucucuugggccuuuucuauugguagaucauccucauccccacauuuugguuuucccuauuuccaucuuagaguuuguccaucaguucaguucaggggauaccauguuaccugucucauguccugcuuauggauacuuuucugucuguucauugauauaacuucucugacuaaaagcuaaccuccuggagauaaauuuuuggcacaugacuugauagugguauuuaaaaaaaaguuuaacugguauaaguggaauauuuuaaagugcccuguuuauuuaccucuaugauuaaacaguuacuaaaauauaaauuauagacuuugaggguuuuuuuugaauuuugauacagagaucauuuucuuuugaauaaaaaauaauguguuuacaguuaaggggaaaauauccuacucuuaccaacucaguuuucccuuucaauuguaaaagggaaauagacuguauaucuuuacaauguagaaaagagauguggaauauccaagacugaagaaacaauguuuaggauaaauaaacaauauuuaugcacguagcaacuuauaaaauauuauuuucucucaaauuauucuaugagaaugauuuaaaagacuaagagucugucuaaacuaucugguuuguuaucauuuuuguaucuugaaacaagucaguaaaaacuaugaucucauagagcuacuuguuaucugcuaauuugucaauuuugcuuuuucuuuuacuugaaacaaagaaaugcaaaccaagaagguagugauuaaauauccauaugucuauaacuuuuaaaaaauuguauaaauauauauuuauuccuaggguuauauuuuucaaaaaaucuguugcucauuacagaaaaaaaaacugauacaugcaugcuaagugaaauuuuuuuuuuggaugaguuuuuuuuuuuuuuucuccaaguuaauuucagcugcuggugguguuaccuuuguccuccauuuagguagcauugcucuguguuuacaacuuuccaucuuaguuucaguggauauucuucagagagugaccuuaugcucaaauaacacuuaaauguaggacaagaagguggcuuuaguagaaugaccuccuaguaacagcuaagaaacacuaguaaaugacauuaacagagauguacuuaauaggcuaaugcuuagaucaaaccuuuguauaaacuaauucaaaaugcauaauguaaaaaucuauaaaauucugacacaagaaaaacugguuaaauuaaacuaucuggauauuaaaaucuuugaaggacauuuaaacacagauaggcuuauugauuuagacuuggaagauuuagacuuggaagaaauagcacgacugaaugugugcuguggcacaguuaguucucuucuauuguuuuaaugaugcccuuaauccauacugggacagggcuuaucuaggaugugauuuaagguaugaaguuacuucuuucaggaaguuuucuuuuuugugauuccuuggaaauuucucaaaauguuggaagagugaaacacauugucauuguaacacauuuugugaccuaguuuuggucugaguauacuuuuuuacuagcaagauacccagaggauuuagacuuuacucugacagcuaaaugaacucaaauguauacugaauguaaauugcuuugaaggcuguggaucacaaguuaauagauucuggaccuuguuuucccuuucaugagccaaacauuccuuggauuuaaggguagguuuaaauuaaaguguagcaaauugcuucccucuuuggaaauaagcaaaaucacccuucugauaauaaaauauuucuugaacaugucaagacaguuacugaggaaagaaagcaugaggggaaaaacgacaauaacuuuucagagacuugcucuuuaggaaauggaauauguuuaguaaaaggauaauugccuuaucccaugugacuugaaaauaaugagacaaagagaaaaugaaaacacuccauacaagaacuuauaugaccaaauaaaucuggucccaugggaagcaguccaguuuuucuagcccuacuuuaauugagcaaaacauuuucagacucuuuuggaauuaucuucagaaucguuuuaugggccaaagaaucaacaucuuuauuaucacaccucuuuuuggacccaaaagaauauuacucagccugaucccccacuuaauuuaucagacuugguucaggcuucuuccaaaaauacaguacacucucuuauaggacaacugaauauuuuucuuaauucauauuauauauccauucagcaaucauggcugagcacccccaaugagucagguauguugugguagcacagaggaguccuggcugugggagagggaggguggaaggggagacaguaaggauauggagaaugugugagcauaaucuuugaagaucaguagggacgucaccagauggacagagaaaaagagagcuuucuaggcagcaguaacagcugguguugaggcacagcacaaaaaucacgcacauucuagcaacuguaaguauuuuuaggauccaauaaaagaugaggauggaguggcgaguggggcaagaucacgagugaccuaauaagccaugggaugggguaugcaguguuuaagagugaggguucucuugcuugguuuucugaguacaaauccuggcucucucauuuacagucuuuaggaugcugggcaauuuacuaaacuucuauaccuuaauucuucucaucugugaaagagaugaugguaccuguauuauaggguaaagagauuuaaauacauaaaacaaaauuauuagcauugugucugacacacaguaagcacucaguaaguguuagcuauuucuucugcuacuuuguccaguggauaaaagacaauagaaggauuuuaaagagcagaacacacuucuuuaucuuauauacaccauugaccacuucuuucuucuugaaacugacucuugccuugauuuuuuuaaacagcucuauugagacauacuugacaugcaaagcaauucacccauuuaaagcgcuugauucaguguuuuuacuauauuuacaggguugugcaaccauuguuaaacagucugauuuuagaaccuuuucauucucccucaaagaaaccccauacccauuagcagccauuccccacuuuuccccaacccccacaccccuggccuuaggcagccacuaaucuacuuucuguuucuguagauuugccuacucuggccauuucuuacaaaugaaugaacauuuuuaauuuugaugaaucuguagugaucuguucuuucuaauauugcuuauguuuuugguguuauaauuaagauauugccuaacccagggucacaaagauuuacugcuauguuuuuuucuaagaguuuuauaguuuuagcucuuacauuuagguuugugauccauuuuaaguuaauuucuguguauauugugagguuaggauccaauuucauucuuuugcauguagguauccaguuaucccagcaucauuuguugaaaagauuauucuuuccugagugaauggucuuggcacauuuguugaaaauucauuuagcauaaacaugaaaguuaauuucugcacucuaaauuauauuucauugaucuguuuguuuaucuuuaugccaguaccauacugucuuagguacuacagcucaugguaaguuuugaaauugagaagugcgagucuucgaacauuguuuuucuuuuucaagauuguuuuuugcuauucuggguuccuugcauuaucauaugaagucuaggaucagcuugucaauuuuuacuaaaaagccagcugggauuuugauguggauugcauugaagcucuagaucaauuuggggaguauugccucuuaacaauaucaagucuuccugauccaugaauacggauguccuuccauuuauuuagcucuuuuauuucuugcaauauuguuuuguaguuuucacuguacagagaacucuuguuaaauuuauacguauuuuguugcuuuugaugaugccauacauugaauuuuuuuuaauucccuugauguuuuaugauaucauuuucuucaucuauuuucuugcucaccucucugauucaucuagggaugcuauucugcuuguuuuauguuuugccuccaagauuccgucucaucuggaggcugauaacuucccaaacuauugcuugacuugugucuggagcucugagaaguauauguuuacaguuguuuauuggacuuuaccaccugaaugucacagacaucucaaauuaaucuuuuccagacugagcucauuaauuacuucacucaucuuauuuucaucucuucuuauggccuuuggaaauaguacuaucaucuaccuugucuaaaccaaaacgugaaacucauuucaaacuucucuuucaacuuguacauucugguagguuaccagaucuucuggauuccaccuccuagauaucacuaugggaguauaaauugguacaaucuucugucaggugguuuggaucaagaacuuucaaaaaauauauauauuuugauucagaaaaaguguauaucauuuuauuuuuaaaaugccacuucuaggaauuuaucauaagauaauaaugagccaauguuacaagaacagggaaauggucuaauaaauuacauauagaauauaauuuagugcaaccuaaaaauggagauagauuugugaaagugguugguacacuuaaacuuuuuuaauugcaaaacaugauucaacuuuguuuaacaacaguagaaaauaaguucuaagagagcagggaucuugccugaugauccugauagacagcugaagaguauaaugugcucagucaauauuuguuaguuguauuggucucucucugcugcuacuauuucuguaaccaaucugucuauauuuuuuaccugggcuuuugcagacacuuccuacuuguuuuccucaccuccaauuuuauucuccuauaauccaacuuccauucugcaaccagaguaguauuuccaagugacacauccuaccauagcauuguucauuguaaaaguccuuugcuuuuuucccagugcccauaagauaauuuccagacuucuuagccuggauuacuaaacucucauaauuucacuucuguguacuuuuccagcucuucucuugccauuuuccaagauaaucaccaaaucaugccagacuauccgcaauuccccaaauaugaauuuuucuguguaccuacauaccuuuggacaugcuguuccuucugccaggaccaugccaaacuuccuuuguuuaucuggcaaauuccagacuguccuaugagacucagcuccccagccacuuccccucgagguauguugaaugccucuucuucagggccuccaacaccauuugaacuuuuuuacaauucuuaauauauauacauuccucuagggcuggagaguuagccagggcaagccugucuauuccuuugacuucaacucaucaucuuacugcugcacugacuucuccuauauucuaccucagggcuuugcaguguuggucugaggccugguaccaauuuuccaucaucugugaugcaauuagaaaaauagggcccugugguaaauuuuucagaaagcuaaaucuauucacauuugggauauuaaaauaugcuuuauuuaugaagugauauugauaguagauaguagaguauauuaaugucuuuaguuggcaauguucugucagagcuguaaaguuguuggaaaguuuccaggccucugaaaaccaaagaucugggaacacugcuguaucucaugaggguggcaccaaguccccaaagucaaaagcaugugagucauccuuggcuucuccuuccccaucccuccacccccgccacauuuagacacuuagcaaguccugccaacucaaccuccuaaauauuucuggaaucuguacucuccucuccauccuugcugccaauuccuuagaacaggccuucuuuacuuucccuguacuacugcagcaacagucuccuuacagguggucuuaccacacuuccccuuacccaugucaucagauugggcucuuugaaaaccauaaaaaauaguugcccacuuuccagaggaacaaaguucuuuguagcauacaaaguuucucuccaauggggcuucuugcggugcuccugcucacacuuucuuugguuucaagugcccuuucuuugccacuugcuuggguaacucuugauacucugacaguuaaauugucauuucuucuacaaaguuuuccuccacauauggauggguugcuucuuuuaucauuucuuaaaauuccauagguauauacauaagagacagaaagauguauguguaugugugugugcggauuugaauaaguauauguguauacacuuauguguaucuguguauaccgcagacauacauaccucagcauuuacagaauaguugauacuuugucuacuuuucccacuagacucugaauaacuuaagaaauuuuauuuuacccuuugauuuuucuauaccuagcaucuaaucuaaugcuuagaaaauaacaaauauuuaauaaacguuugcugguuaaaugcauuuguucaaugcuaucgaucagauuuuuacuguggaaggcucacugaccagaguaggggaugaguacaaagagucucagggcauuugggaaacaggauaaaggcccuuuguagaaaacuggccaaggguguugagugccugagcucagggaaguggcaguggauggaaaaauauuuaggugguggaauuggugguugauugaacauguggggaaaugaaacaaucuacgauuauuugaaggcuucuggguuuagaaaauuauuuggaugggggugugauucaccaaggggaaugaacuguguucuagacauuuugaaauugagauguucagaguauugguugaaguuguccaagagauaacuggguauggaguuuggagaaaguacuauuuuggagagagaaguuggagauuuaccaaccucuagguacucuuugaagcugugaccauaaaggagauaacugucaucuguugcugauuagauugucauagugguggugguacauuggggaagaagagaauagguccaggagaucuugauauugaagguccagaucaagaaggagagaggccugugaagguuucuaauuuaaaucuugguucugccucuugucucuguucuaugaugcuugaacaaauuauucuaugaaucuuagcuucuucaucuguaaaaugagaguaauaguauauacuuuauaaggauauugaaaggauucaauaaguuuccauauauuaaaucccugccacagucccaggcucacuguaggggcucuuaagugguaaauucaagaaaauguuccucaagauaugagcaguuucaaaacaaagaauuuuuuaaugguuaccccagagauuacaauuaacaucuucaacuuauaacaauccaguuugaguugauacuauuucagcuuuaauaguauauaaaacuuuuuucuguacaguucuguccuuucuccuucauguuguuauugucacaaauuacauguucauacguuguguggccauuaacguagacuuauaauuacuguccuaugcauuuguuuuuuaaaucauauuuuaaaaguuacaaaccacuuaccuauguaguuaguuaccuuugccaguguucuuuguuucuucauauggcuccauguuacugucuaauguucuuuuauuucagccugaaggacucccuuuagcauuuccuguagggcagaucuauuggcaaaaaacucccucagcuuuuguuuaucugagaaugucuuaauuuugccuucaucuuugaaggaugguucugccagauauagaauucuugguuaacagauuucuuuuuucuuccagcacuucuuuauuuauuuauuagaaacagagugucacucuuacauccaggcuagagugcaguggugcagucauaguucacuguagccucaaacuucugggcucaaaugaucuuucugucucagccuccugaguagcuaggacuacaagcaugugccaccacgaccaguuaauuuaaaaaaaaaaaaucuuuuguagagaugaggggguucuuuguguuacccaggcaggucucaaacuccuagauucaagugguccucuugccuaggccucccaaaguguugagauuacaugcaugagccaccaugccuggcugcuuccagcacuuccaaauugccaucccacugccuucugcccuccauaguuucugaugagaaguaguuguucaucuuauugcagaucccuugugugugaugaguugcuucucucuugcugcuuucaagauucucucuuugucuuugguuuucauaguuuaauuacaaugugccucauuguggaucuuuuggucucaucugcauguacuuaguaaacacucaaauaagugaucauaauaauggugcagaauuaaaugauuauaauuuaaugguaacaguaaugaccaugaaucaucuaccaguuaaacauaauauugugcuuaaaaagucaagaaaauguucaaugcauguuaccaagaauuccacuaaaacuuuaauuuuaaaaaauaguuuagggaauuaagauggguaagaaucaauuaucuaaaauauucacuuacaugggacaaccagaugacuaacagauuauuaguauaugagguguuccugugguucuuugcaaaagaaaacgucugccuugaaauagauaaacuugcaguuacauuuacaaauuaucucccacaguuuucauuaccguuaacaccaugaaacauuuuccuuauuaucugagauacuucuagaacaaagaucaaacucuaaaauaaaauggacuuauagaaauauagcaaaucauaauuuaauuuuuauaaguguuugcaccugaacaaaacaacccaauuuuagauccuuaaguuuagaaguugguagaaauaccaguuuuuccagcuucuccaacugcaguguguuuucuaauauuuuaauauaguuugccauuggugaucuuagaauauauuucuagcauuuuucuuaguucucaacacaauaauucccagaaauuuugcucuaauagaucuaauuuaaaaauauaagauguuauauuuuaauuuuuauaaggaucuuuauuuuugaccaagcuuuauuuugguugcuugcaccuuguuacguuacaaaggguacugaauucuaccauguaggauuuuuuuucuugguuuauuuaagaaacauuagaguaaucugaagacuuugugagccaucguuguuucucuuuuguuucgugguagucuguuacuuugaccuuuuucaccaaguaucagaaaaauaauuuuuucucauauucuuuuuuguagagucacuccauauugggaggggauugaaaagcacauacuuuaaugcggcaguaaugcauacauauuauuuuuucucuuagaacaauauuuuaagauuuguagagauuucaggaaucuaagagaacaaaacauaaacaaaaaauuuauauucuaaguggacaaacauaaacaauucuaaauacaaaagaauuuauguuuuuacauguuugauuuuuaaaacugcauuucaggauugaugauuaggauuuccucauuaauucagaggaacagauugaagaaaaguacgugagugguaggagaaaaaaaucugaauugaaaaauaggcuuuuaugauucuuauuuuuuaaauaauuuuuuuaauuaaaaauuaauagguucucacaguagaaaguuuagaugagcaaauagcagaaaacaaccauuccaaaaucuuaucacccagaaauagccacuggcuacauuuuuuuuuuuuuuuuuuuuuuuugugauggagucucacuuacucuguugcccagguuggagugugguggcacaaccucugcucacggcaaccuccgccucccagguucaagugauucuccugccucagccuccugaguagcugagauuacagacaugcgccaccacacccagcuaauuuuuguauuuuuuguggagaguguuucaccauguuggccaggcugaucucgaacuccugaccucaagugauccaccccccucagccucccagagugcugggauuacaggggugagccacugcacccagccacaucuugauuuaucuuucuaccauuauguuuacauauguggaaucauacuguacacacucuuuugaaacuugcauuuuuaaaaauaauauauugugaaugucuuuccauuuucaauaaagauguaucaguaccauuauuuuaagagccacauuauauauauauacauauacauuauauaucauauauaauguguauguguguguauauauacaauauauauacacacacagagccagauuauuuauauauauauauauauauauguauacacacacacacacacacagagccagauuauucuucagaaagguuuuuaucaguuuguauucccacagugaugugggcucauuuucauaaacaaguguugugcaguuuugucauuaaacaaguuuguuuuuaacccaguuugaaagguuuaguguuucacugagguuuucauuuguguugcuuuaaguuacuaagguuuaacauuuucuucuauguuuaugaucaaaaguuuccuuaaaaggaacuaacuucagugauuguuuuauuagaucaguaccuaaucauaaguaccugagugaauuagugcugggaugaauuuacucaccuauuaaggaugugauuaugaaagguuuuuggcuuacaguguagguaaagcuugguuggcuuucuucuaagacacagcagacagucuucauuacaggcggcugccuaguuuuggcugcuuagucauuuuuccucaagagaggcccaaagcuggagaacagggcuuucacaggucagaaauggacagagaacuaaauguugaaaguuguccagaauguuccacacucuaucugacuuaagccagagcuguucgcuuugcuuuuaaaaauacacuuaacucacuuauuucugagaucagaaucucuuuuucaagcucugucgggugaauugaagugugccuuuuuucuaacuagucaagggaaaaauguaagaggguuugggauaucagcagucuucgcuuuuuaacauuuuuccugugaauuuucugaacuucuuuuuuucagcccaccauguaaaguauguauugggaucuuuuaauuuaccaaaaacauuuuggcuuuggcauucccacaaugccugucagcaggguaucucauuugucacaaagucuccccaucacugaccucugcuucacugcagcuccaaauggugugcugcauucagaggcagaauaacagagugguuagaaaaucagauucuggagccagacagucugauuucaaagcccaucuccacuacuuacugucuuuguacuuuaggcaaaguauuaaaccucucuaccacuguugcuguccauuuuuuguuuuuaaacagcuuuauugagauguaauuuacauaccauaaaaugcaccuguguaagacuucaggucaguauacuuacugaguugcacagcuaucaccaugaucuaaauuuaggaaauuuucaucacuccaagaagaaacccaguacacauuaucaguccccauuccuccacacucucccacugcucauugucccaggcaaccacaaauccacuuucgauuucuauagaucuaccugcucugaauauuucauauaaaugaaauaauggaauacauagucuuuugugacuggcuucuuucucuuagcauaaucccuuuaagguuuauccaugucauagcauguauuuguucuucauuucuuucuauuacuaaauaguauuccauuguauggauauaccacaccuuguuuaugcauucaucaguugauggacauuuggguuauuuacaguuuugggcuaucacgaaugaugccgcagugaauauuuguuuaccuucacugcgucaucauucagugaacauuugugucuauuucuucgucucuaaaaugaguaccaucucauacaguuguuaagauuuuuuaauuaacuaguaaaugcaauauuuuaguguuugagucuucguuuaacagcaguuacaaaaucuggcuuacucagaaugccacgcuuuccuaaugacaucuugaaguauccucacuuuuacuuuauuuuacuuugacuuuucccuaaguuauaauuuagaaaaauuucauuuauucaauaaauauuuauugaacaccuauguaucagacauggcugugggugccacugagaauugaaagaaaagaauaagcaaaacgcaaagaggcaccacuaguuuaaggcuaucuuuaguuugcuacucugucaucucugaccugccaguagggcuugcgacuugaguuccccucaccccauccucucaccaaaagccacagguuuuggggucucucaguccauucacucuuguuaggcccuuauuuuguccaucauauuuauguuuuuggaguggcugauugaagguaacuguuaaggaaagacuaaaaguucaucaugucuagguggagaccucaagagguaaacagugcccuguuccugaucuauagcugagguuggugaauuguucuuuauacuaaucuagaccuaauaguuccuaauuuucuccauuggcaggucgcuucuuuuuguagaguuggcuguguucucuuugaacuuccaaaucuauuuuguauuggaacuggacucaccaaaauuaucaacugauuauuguuuagcugccuacagaaaacagcuauuguuuagcuguuaucuuucucuugucuuuggggagauaaugauccacaugguuagugacuuggaguucacuuaauuccaaguaggauuuugccccugcuaccauucucuucccugcaagacaacaaaucgcauuuuaugauaugccuucuuuguggcagcucuaaagcuuuuuuuuuucccauaauagcauguaguuagcauaacagagugaugcuacagccuuacucuuuucucugccuuucauucagauaaaaugcauuagcaguuugaauaauuguguuugaugacguagaagugccuguagugcuugcuguauguaggacuauggaagaagcugaauucuauuauuuaauguccaguucaggaauugaucuggaaugaggagagggguacauaggcaucccauauacccauuaagccauccuaaauagcuuguuucaggcccagcuaguaguacaucaguucuguugcugaucgugugguaggaauguguuuccauauacauaguuuuacuguuugcucuauuuucaaaauuuacuauagugcaagagucacaucuuguaaacuugcccaguuuaggggauucccauuccacauguaaaacauuuuuugguuaacagauucagaagauauuaacuccuagagccacagugccaggucuauauagauagaagcugaaacuagauuaauagcaacucuaaaguuggaaagaagauaaacaaugaaacuuucuuaugaauacucucuuaaaggcuguaggaauaaaaugauuuaguaaauaagcaauguugauuuugccuucccuugucagauaauagcagccauaaacuuaacaguuuaaauacaaaggauuucugugcuuuagaguugguuugacaucccuguccuuuuccacuuuucagcaacagcuagugggaaagggguuguuuaauugaaggcuucaggagaacacaccuugcacacuggauucaaccuuuaaauuaauugaacccuguaucuuuguauuauuuuuaaguucuuuuuucuccuugcuuccucuuaccauugaguucuuuucuacucuauguuuuacauuccuguuugugauaaacuuguccaucugucuucuuccuucugugcuuuccuccauccagugucucuauggucagaucaggaaccucaaguagggucugagaggaagcugccuggcuccuugggaaggauggauugaucugguucucugcugucggcuacuuuugcccaguggacaugcgaauggaggagccauuuaaggugaauagauucccagccaagucagagaacugggacagucacuuugaggacacugcuacuucuuuugugcuugagcuucacucauugugucuacucuguaagacguauuugaggccagauauugacauuuuuaagucauuuaaucauuucaaaauauuuauagaugucuuaggacaauuuuuuguugcaaguaauaaaaacccaacucaagcuggauaagcaaaacacugacuuuagugacucacauaauuaauaaauccagggguagaucaaacacacugggcccagguguggaaauaaugucuuccggaaucucuugcccacugucccuuguucuggcccucuucugcaucccauaguagguucacuaaaaugguggcaaagacagccaucaguagcugcaggcugagacuuugccaguuucauaaucccaguguagaguuuuacucucccagaaguccuagcaaaauuucugagacugauuauuaugcuccuguccaccucugaaucauucaucaucacucaauccaggguuguucacaugccauccgugggccccugcuguuaaaaccagauugccagauucuaggacaggaguaguuccucaacagaaaauaaggguguggcuuccaggagagguaaauggauggaaaggcagagaccaucugugguuuacuuaauaggauguagaauaaauuuacuugaugugauauauaaaguuguacauaguguuuauagaauuuauuugguacuaauacauagccauacaucauuaccugcauuuuuacuuguaagucuucuuucccacaacuagauaguaaagcuuuuaaaaacaauaucugucauaucuauuggaaacucuaaaacugaguauagugccugcacaugguaggugcugguaaauguuuaugggugcugcugaaaucgcaauuugcuucuagcagcaugcacauuauuguugguggcaaauacuccuggagcuauaccauuuggugcugguugagaauaagugcacacagaguccauauuuaaugagcaaaaaagagaauacaguggcccauauccguaguguagggcuagugagaugugugaacauaaauuuggugcauacaagacauagucacagaauaugcuucaugcacuuaagaggaggagauuagauauuuuuaaaaauucuucucgauuccaaauacuggcucuaguucaagcagaauuuuguuguggcccuuagguagcugugccagacaucucucagcucuugaacuauuugauguccaaacauugaagagaaugggggaaaaaaaagugaccggaaaaaaauccucauagaacuuccugugaaugggucaaaguuuaaucacagcaaauaagacagauuucccuuuuauuguaaccacaauagaaaggcagggcuuguguuuacaaagcauguuguuugggagaccuuuguaaauuguaaucuuuggaaaucccaaaccuauuggauguaaucccauccauuagaugaaggcaacuugccuaugcaauaguuccagaagagcaaguuaaauugagaacaugaacaggaaguagucauuaagaauuacaauggguaggaugcagaguuaauucagagagauauuuuguuauuagauaauuacaucacuaggacagcuggaaaacugagugcugugcuggacugcaagccuuguucucugcccugcagcuggcgggucaggacaauagagacagcaagagaacuuacuuugugggagaguuaggggcuuggccaacuuaauugugaaaugauaacgaccuaucugccuuuuuuggauugcauuuugcacagcuaaacugaaggcauagccuuaguuaaugccaauaaccaguuugcacuuugacuuuuugaacauucacuuggaucacauuaugcuaagcucuaauggauaaauauuuaaugguaauuuuccuuuccuuuaaaagucaucugagauauuuuguucauauucaauacauugugauuacauuuuucuuauggaacugcugucauguaauucuugaaaugguauuuuugucagguuacagauuagcaaaaauuuuuaaaaaaagguuuuagaaagucuuaaaauauuggucaauauaaggaaucaugcaguuguagcuauuuuccaguuuuuugggguuuuuuugguuuuuuuuguuguuguuguuguuuuuuguuuuuuuguuuuuuuuuuuuuuuugagauggagucucgcucauugcccaggcuggauggagugcaguggcacggucucggcucacugcaagcucugccucucagguucacgccauucuccugccucagccucccaaguagcugggacuacaggcgccugccaccacgcccggcuaauuuuuuuguauuuuuaauagagaugggguuucaccguguuagccagguuggucucgaucuccugaccucgugagccgcccuccucgggcucccaaagugcuaggauuacaggugugagccaccgcgcccagccuauuuuccaguuuuuacauucaaguguucagaccugucuggcucuuuuguuuugcaaguguaaggguucuagguagccuagccccauuccuuauugauuuauauaaauacauuacagauuguuuaccucuagccaaauaccagggauuuuaauucaugcuuagcucaguuguuguauaugaaacucauuuguuauauuaaaguuucuggccgggcacaguggcucacgccuguaaucccagcacuuugggaggccaaggcagguggaucacuugaggucaggaguucgaggccagccuggccaacauggugaaacccauccuuacuaaaaauacaaaaauuagccaggcaugauggugcaugccuguagucccagcuacucgggaggcugaggcaggagaaucacuugaacccaggagguugcagugagccaagauugcaccacugcacuccagccuggacaacagagugagacuccaucuuaaaagaaaaauaagaauaaaaauaaaguuucuguuuucucuuuauugcccaccaaagugacuauuauuugauuuggggcaauuccagagggagucauuguagacaaaaaaaagcaucauaaauauuauagucuagcauuucuaagauuaauguuuacaaccauugauucaaaaugcauuuccuacccauugugacuaauauaacuguuaauuuuuaguacaauguuuacuaaccauuaaucagacauaauuuaagucagacaaaauuucauaguuuugggaagagcaauauuuccccagaugucuuccauggaguacuaggucuguaggauguggauggcuagccagcacuggagccaaaaaagagaguauccuacaggcacccuuaggacucugaugucccuugaugcccuuugugaaugucugagaagucucuaauaugcuccauuuccugaaugaaguuaauaauaauggcaccuuaaaaauuaaaaaggauuauuuccuugaaccuggaggagucacuucuaccuaauaccauuuuuuaagaauaugcaaguauauacauuaaaauuuaugugaaaauguucugcucuauggacuauuacacaucucuuuaaaauuccauguuuuaaaaacuaccgauugaaaugaguccuuuuuucuccaagguuuaucauuuaggacaauuaguaguggcuucagugagcucaccuuucguaucuugagcauccauugaaacugaggccuggaguccaguugcugcagguggcaucagugagucuuaauauuuugaagagagcaguauaacucugaggaaagcaacuuggguggguuagauguuauuuuuaaauugugucaugcaaagagugcuugaaaacgguuucagugagaugaagcaacagggcauacugccaggguuguuagguaacuucuaagacaacgguccagggggcagaugacuuuuuguuucagcaguauuuuaggaucacuuuauucuccaguuaugcccccgucagaauuuuuucucuuuuggaaauuacuauaauaucuuauauauauauauauauauauaugauaaacuauaaaugcaguaagaacuggaguuacuaaaauuacuauugauuccagguagugguaagcaauguaauuuuuucacuaaauauauuaauuauaaugggaaauauuuuuaaaguaauguuucagaaacacaacugaaauggucauaguaugaaacagcucuguguuuguauuugacuuuagggacaugccauuuuugguucacugcucuuuuauuuuauuacaaaaauacaagcaacagauauaaagaaaguuggggauuguggaacuccauuuucuuuuucaauaggaagaaaagagugaaguuguccaaguauguggauuuaauagcaauaagcuggcuuaaaaaagccugugaauaguuguaguuaucuugaauuaucaaggcaaaagaacuguuuugauaaauuuuccacauauuaaauccaugcaugauagcaaucauauuuuuagagugugagacuuaauaugauuuaugguacuaucuuuaauaaaucuguuaagaguuuuuacuuuauuggaauaauuuuccagaauaaguaacauuaggggaaaauauuaaguuuaggaauggauauuaaaacuuaaaaaccagaauguuuagaaguagauaaaugugaggaaaaaauuuucaauggauucugguuaauuuuaauggaguuguauaauucaccccaaacugcccauaauuaaaaagaagcuuggaucuggcuaugaagcauguguaguuguugguguucuguuuuuugaccugccagauuuaaccuaauuacaguggugggguuuuuuuguuaaguguuuuuuguuuuugguuuugguuuuuuuuuuucguuuccuuuaaaauuuaguauagauucacagagaaguccaaaugugggguccauaaagcccagaaaugcagaaggaugacauggugaaccagcaaggcauuaaaaguuuaacagagguccuaggaauacaacccaaaagggaugugaaggaccucuuuaaggagaaccacaaaccagugcucaaggaaauaagagaggacauaaacaaauggaaaaacauuccaugcucauggacacaaagaaucaauauugugaaaaucgccauacugccuaaaguaauuuauauauucaaugcuauccccauccagcuaccauugacuuucuucacagaauuagaaaaaacuacuuuaaauuucauauggaaccaaaaaagagucuguauagccaagacaauccuaagcaaaaagaacaaagcuggaggcaucaugcuaccugacuuuaaacuauacuacaaggcuacaguaaccaaaacagcaugguacugguaccaaaacaaauauauagaccaauggaacagaacagaggccucagaaauaaugccacauggcugggcacgguggcucacaccuguaaucccaacacuucaggaggccgaggugggcaggucaccuaaggucaggaguuugagaccagucugaccaacauggaguaaccccgucucuacuaaaaauauaaaauuagcugggcgugguggcccaugccuguaaucccagccacucggguugggaguaguacuuggcugaggcaggagaaucgcuugaaccugggaggcggagguuguggugagccaagaugugccauugcacuccagccugggcaacaagagcgaaacuccuucacaaaaaggaaaaaaaaacaagaaagaaugacacauaucuacaaccaucugaucuuugacaaaccugacaaaaacaagaaauggggaaaugauacccuauuuaauaaaugauguugggaaaacuggcuagccauaugcagaaaacugaaacuggaccccuuccuuauaccuuauacaaaaaguaauucaagcuggauuaaagacuuaaacauaagaccuaaaaccauaaaaacccuagaaaaaaacuuaggcaguaccauucaggacacaagcaugggcaaagacuucaugacuaaaacaccaaaagcaacggcaacaaaagccaaaauugacaaauggaauaaaauuaaagagcuucugcacagcaaaagaaacuaucaucagugaacgggcaaccuacagaaugggagaaaauuuuugcaaucuauccaucugacaaagggcuaauauccagaaucuacagggaacuuaaaacaaauuuacaagaaaaaaacaaccccaucaaaaaguggacaaaggauaugaacagacauuuucucaaaagaagacauuuaugaggccaacaaacauaugaaaaaaaagcucaucaucacuguucauuagagaaaugcaaaucaaaaccacaaugagaugccaucucacaccaguuagaauggcaaucauuaaaaagucaggaaacaacagaugcuggagaggauguggagaaacaggaaugcuuuuacacuguuggugggaguguaaauuaguucaaccauuguggaagacaguguggcaauuccuuaaggaucuagaaccagaaauaccauuugauccagugaucccauuacugaguauauacccaaaggauuauaaaucauucuacuguaaagacacaugcacacauauguuuauugcagcacuguucacaauagcaaagacuuggaaucaacccaaaugcccaucaaugauagacuggauaaagaaaauguggcacauauacaccauggaauacuaugcacucauaaaaaaugaugaguucauguccuuugcagggacauggaugaagcuggaagccaucauucucagcaaacuaacacaggaacagaaaaccaaacacucauguucucacucauaagcgggaguugaacaaugagaacacauggacacagggaggggaacaucgcacaccagggccugucgggguggggggguuaggggagggauagcauuaggagaaauaccuaauguagaugauggguugaagggugcagcaaaccaccauagcacguguauaccuauguaacaaaccugcacauucugcacauauaucccagaacuuaaaauauaauaaaaaaaauuaacggagguaauauguaagcaggauaauugauagucaacccugugcaucaguuauuggacucuaugcacauuuauaguuucuuugaagaaggcauuuauucaauuuuuuuuaaaaauuaaaguaauaugaauaguauuuuauuagcuuuuucuuaguauuuauauuacauucuuguuaagaaauguacuuacagcuuguuuauggguaguuuaauucuucaaacauuuggugagaaucuguugugcuaaauaguguacugugguugaaacgaaaggaaauuuuguccuuuggcuugaauauucuuuugacuccugaaggcuuaguuuuuaaaacuuaaauuuugucuuauuuuaagauuuuuauggaagaaacuggauucacccauccaaaacauuuguuaaucuguugcuuuauuauuuaagggcaauauaguuuaccaaugcaggucccccuaccccugaaaaaaaaguuuaaauuuuacaauguugauuaacaugguauuggaauuuuaaaaacuaagaauguaugcccuuuccagggaaugauuugacucagcaggaugagggcugucuuagaaauaaacuaaauuucuccauauuccaucauauuuguuuucacagacaugguugugacaccuuaaauuccaggaaaaucuugauuacaacauucagcaucuccaaaggaugcucaaucuaucucuaguaauucucaaacugugagcuaagaagaaacauauuuugccuagacaucaaguuuuugaaauuauccccauuggcaaguucuaucuaagguccuaacuaaggaaacucuccaagcguucuugugcuccaagcgcguugcuuucucauuguuacuauagauguucucaugcuuaaccgcacacucugagugccccucuccugaacuucauguuguuauuaaaguaucagaucucauuugauaucuuuacauaugaucacaagaaaugaucaacacuggccuuuuuuuucuauuaugagaccaaauugagcgauauguauaaaacauacagguuacuucuuugcuuauugccaccuacuuaaccucuuuguuuuuucuucuagguuguuugaugugugcacagugucacgaacagacagagaaaccaaacuaacuuuaguguuugaacaugucgaucaagacuugaccacuuacuuggauaaaguuccagagccuggagugcccacugaaaccauaaagguaucaagaaucaucuucaugucuuaucaggcagucgacuauuauagucuguuaagcaauggcuuucuuuccuuaugaaaauugccacaauuacaacuuuuagaauucgguauauaguuaaaaaaaucaaagaaaauguucaaagauugggauauauuccaguucaucaacuaagugagauguucaaaguacagacauauguauucuaguucauuaauuuuagaacuaaguggaaaaaaaaaccuuuaguucuaaugcauauuaaaauuauuuaaaaauacuuaguuguagauugucuuagaccuuaggaaacauaguuuaguaaguauagcucagucuucuucugaugguuuauugucuaugagagacauaauuugaacauuauucaugagcacauuguauauuaugauuguauaauaacuccgggacaaccuaugcuaugugaaucugaaauauuacuuguuaggcccuccuucuuucuucauuuuucuuauucauaaaacguuuauagggaagccuaaguaaccagauacuaugccaaacuccugggauucaaagaugauugagacaugcuuucuauccuuagaggucaguaaacuagaugcaguauauugacuggaaguucuuccuaccuuuaagucuaauggaaaaugcugcugauaaaguuuuguuguuauuugcauucugcuuaacugaacuuccccguagaucuuuuagauuuauacacaucaugugcgggucuucaugaaaaccuuuuugucugugugaauuagguagcuuaaacagacuccugccuuaucauucguuguuuagaaaugaguuauagaauucaccaucauucuagauagaaguuaauagcuaaaaauaguuuaucuucucaacagacuaagaaaugucuuuagugauagcuaaaugacguucucagauacugacugauacauuuagaauuugacauacugaaugauuuauuccuuuuguuuuagauuaauauuguauuuuuucccaucuggcucucauuaaagaaucuggugcuuaacaauagucccauuucuuccugagcaguuucaaggacauuaaggcccuccaaauguagguaugccugauaguuaccuguucuuggccaucuucugucugugcaccccucuuuccucuggcauucuauuccaccccugaagcuuuaguucucuccuuuaugaguuugucagaaacccuguguucagcaugcagagcagggcauaguccuuuuucuuauacaguuuucuaggcaaauuggacugcucaucauucucuugguaugaucugugauuuuccaccuugguggccuuccuucucaugccauuucuuuugcuccuucucaccaggcuaucuaccuaaauuuuucaagugccgucucaaaagccauuugaucaacucuuauagcuagauguaaucucacaugccuuauaacacuuguucugcauaucucuaccucuuuaucuuguuuucugccuuuaauugggauuuuuuaauguacauaucucauguauucagucauccucauguccugacagugucuuacacaaugauuuauacacauagguacaaaguaaauaagacacauugucaagcuuucuuuagauguaaguauuuucaaaauuauuuuuaaaaugacuuucaaaggcuuuaaacauagacuaucaaaaaaucauugacauuuucugauacauuucuaaguucaaaguuauuuggggaguaucuuuuuuuuaaaaaaacagacagaugaggcaaccauauauuuuauaucuuacauuaccaccuacauagaucuuuugagcauuauauuaaauuauccuaguauauuggaggcuacugaguggaaucauuugcaaaggcaucugugcaguuaaaauguugauaagccagagugguuuacuagacucagguuugaucaggcaggaguagaaaugaauuggaauggggggaaucucaagggugaggguggaggggcaagcaggauaggaaaaggaacaggcagaaggguggucaccaaaguaagaaaggggaggagaagacagggggcaguggcugagccaggauggagcuggaggcuugcuagaagggggugauuguugccagaagcucuugaacaaggugacauuaaaaguuaauuuuuuuuuuuuuuugagcuuuuugucuaucuccaggaaagggaaugucacuucauuccguguugaacagggauuguccuggaggcuguuaaauuucuucagccauuaggaucagcaccccuugauccaaauugucagauacgagguggaguugggggcaaggggcucuaguuauugaagguuuguggcuaauguuguauugauguuuucauaguaaaauaaaccauagucaaaugaaauauuucaggcaguuaacuuacauguuagugguuaaucaaacauuuuuugcuaacuuaaaagcuaauuagaagacucuuuuaucuucauucuuaauuuaaaaaaaaaauucugaacuauacuaaccuacuuuccuuccuuauuaaauauaagguuuuuuaaaaaauaauuugaguguuugugaugcuuuaaggucauuguugaaaacuugaauaaucauuuaaaagcauaauaaaaccaucaaauggauaguuuuaggcugaauauauaacugauacaaaauuauuuuuaaucaacacucguaucuuuuguuucugugauugacuuguuuuuaagaauuggaaugcagaauaaacagcugcuaaguaggagaaucugaauucugguuaauugaaauuuuaaagcacacagccagagaacagaaauauuuuguuguuauauaggcucauuuaugggaagccuuaauaacuagaucaagcaaauauuguuauucugaacaaccuauugggaacacagaaauugauucuuuauauagaaugcucuguuggaauaagagcuucucugacuauacucguacagauauuuauugaauauucacucugugcagggaggguucugugcuaggcaguucagggacacaaaauugaauuaggcaugagaaagagaggaccugcucugaaggaccuuuagaguauaagagaagagauaaaaugcaaacacaagccugugguacacauucuguaugguuauuuaaguaguuuagggguauuuucaagucaagaacagacuacuuauguauaaguaagcacagucuauauugugccaaacuauuuuuuaaaauacuuaaauuuaaauuacuuuucaaaggauccaaaucauagguauuaauauugacauugucuugcauagauuaaaacguaucauguuguuaaauaauuauacauaucuaagauauuuuuauuuuuuuuugagacggagucacgugucuaagauauuuuauuuuuauuuauuuuuuuuuuuuugagacggagucacauaucuaagauacuuuauuuuuauuuauuuauuuuauuuauuuuuuuuuuuugagacggagucaccaggcuggagugcaguggcgcgaucucaacucacugcaaccuccaccucccagguucaagcgauucuccugccucagccuccugaguagcugggauuacaggcacgggccaccacgcauggcuaauuuuguauuuuuaguagagacuggguuucaccauguuagucaggcuggucucgaacuacugaccucgagauccgcccaccucuuggccucccaaagugcugggauuacaggcaugagcuaccaugccuggccagauauuuuaacaugaaauauauauaaaauagaaaaucaaaacaagaccucaucuaagaucauuuaagcucaggggauuuuccucuacccacuuuccucuacccaguguuguguuuucuguggcacuguuuaccaguuaacaggccacugaaacucaggauauucuaaugcacauucaggacauaaauugcauuaguugggcaguacuuggauaaaacuaggaugcuccauggugucuuacuagauaucauagggguaacaucauuuugcuuaucauuucaucaacacguuuguuagaaaagagcccaugaugaucuuacuuuucuagcuuacuuauaucaccuaacaguuuuugaagugcacuuaagugccauuuguuuucgaaaaauaaaaaagacauuaaaccacaccauaagccauaaguacuaauaaagguugauaguuggguaaacuuauuggggaaacucuaauuauugcacggugcucaugugggacuuuaauaaaguacauuaagaguauaggccugaacugaaaauuuucauugagaaguucaugagaauaaaauaaaaucauaggugauucuuuccaacaucauuaaauauaccuuauucuaaaaaaaaaaaaaaaaaaaaaaagcauacauagaaaucacauucauacuucaucuugggguuuucaucacauuauuuaaccucuuuucuugauguccuuuaggugcauccauucuugguugacaaugacauuugcauaaagcagccuguuggcugcuguccugugaagucaacagauauucuaauuuucccucauagacuuauuguugacauaucuggcuuuccucuuucuaauucaggauauuaucuuugggucuguuuacuuguggaggaguucagugccaucuuuauuaaauuuuuauuggcucauuugagauuuaauauugccuuccuggguuuccaugcugagauuuaugaggcaauaauugacaccuuaaugauuguguuauuuuuucuuuuagaguacgugauaaauucagaguaucuaugcuuauauagcaccuuccauuuauggagcuuuaugagaaaaaaaaacagcucucagauuuuuauuuuucucuuucaugcuuucaucugccauccuaugagagagggucagaaagaacuguaaagaaauuugcucaccauuuuucuuaguaauuuguaacugccacccagaauaagaacuguacacugcaagauacagauggagagagacucuuauguaaaauauucuccuguacaggcuuuuccaaauguaaugcccucuuuuacuaaaucauucauuugguauuuagucuugucuguauaauacauuaaucuuuccuaggauaugaccuggcuucucaacuauuuuauaaacucuuugaaaaccuaaaauuauucuguggacauucugugcaugaaacauguuugauaaaaaaaaauguuugaugcaauugucaauauaguuucacaaguuugaggcacugaaaggucacacaaaagaacagcagccucuaaaauaggacaggguucuuugagcucaagaccauauggccucuuuugaugauucaaucuuggaauaaaauuuuuuuuauuuauguaucuuuaugauaaaugaauucuauagagcuugagagggccagaaaagcuccagguucaugucugugugggucguuuucucugugaauuagauuucauuuuaucuucaauugaauguuucuuagaguuuucuauugguuguaauauuuuuaguaagagauaaaacacacuauuagguuuauuuuacaaaacccagacuucagaaacugacacacacuguuaauagcaccuguuuuuugccucugggaaaugucuguuuucaugaauaauaucugcuugcaguaaacaguggcucugaugucaguaugggaugcccagggcugauucaucuuucucaguuugacauaaugcaaagugacugacuggucccuguacugcagaugaggaaagccucucagaucuucuucucuucucacuccuaaaggaaucaagccauggccccucucagcuccugguggucuccauuuugccugaauuacgagcaggugauuugucucaucuuugcaggacacagagcaaauuaacaugaaaauaucgcuucccagaaaacaaggcaggcuugaaugcccugucgcugcuggucauuagccaucugccaccgacacucauacucuguuuaucacauuugaaauucagagcagauguugcauaauaaggugaucccaaaaacaaggcaagaaauucaaagaacaaauacucuaccauaaugauaaagaucuuggaaggaaauuuuuuucaaucuaauaucauagcugcacuaauugaauagaccauguuuuuaaaaacacacacacaucucuccugguauuugaugcaaacuacuuuucauaguaacaggaaauaauuuuaaaaagaaaguacauuugugaaagacaccugagaggacuguucaauaaagucucuuuaaagaagcaaagucgaauguuggaauaacauaguucugguuuaaaagaccucauagaucagugaugccaucuuuuacuguaagaugggccuuaaccuacagcaauuugacuuaaaauaguucacuccucacaguauaguagaucuuucaaggcuuuuaacuugcgaacgugguuucccaguuuauuuucuuuuuggcacucaagacccuguguuuucuauauccuuuguuuucacuguuuaccccucuacaaacucccaccaccgcuaucagccucccaccuucagcaucccuugucucuccagaacucugccccagcuuacccuggccuuaggcucucuccaaccugagucccaagauucuuucauuuuuaguucuucugcccuucuccauuaauguagcuuuuuacaguauugguuauuauaauguuuuaccuaguugauuuaugcacauuguagacccuuauuaugccuuauucaaaguauaucacuuauaguauauuaacuaugguguuuagagacauucuguuuuuuuuaaaaaacaggcauccaaacuuuuaccaggaaugugaccuauauucuguggaagacgagcuuuuaauauagucuuuugacuccaaagaaauauuuucuccacagaaaccacaacuuuacugccccuccccacucugcaccccucugcccccacacauacugagaguuuugaaauuugggguuuuuuuuuaaagacuauacugcuaagcaaaaauuaagcagccagccugagaguagacagggggauaaaucaaagcagugccagcagcugaccacugaguggaauaggagagaugauuugaaggauggaagaauagugagucaauacugaguauauuccaaauucagggggaaauguagagugagugagcucuaacaacugugggaguuuauacuacuaaagucagaagcccagaucuaaaguguagagagaaauaaaaucuucaguguaaccuuucuaauuaguaagauuucaguguaaucuuacuaauaauuuccauuuguuucccucugcuccaaucaggaacauacauauugugcuuucaaguaucuuucauuccaagggaaaacucaguaacucaagcaacuucuuaaaggagaacauuuuuaugcagucuagauucugaagacucucagaaauaaauccuuuugcaaauuccuaacccuuauaguagcugaaaauaucagaagagaaagaggacagaauuaugcauguguauguauccuaacaaaaaauauaacagcuauuuaguagguuuuuuaaaaucuccaauccuauaaaaagcuacauuaauguaaaagagcagcagaacuaaaaaugaaagaaucuugggacuuagguuggagacagccuaaagccagggacuaaaaggaagcuggggcagagcuaugcagagccaagggaaccuuuggugggguacaggggguugauaguggugguagggggauaggaaauauggguuuaagaaaagcuaguuucuuucuaaagguacuguaagacugacucacuaaauaaauaaugacucacuaaauaggcaaaugacacuuagauucagcuaauaacagauaaguuagaaucucuuuagaaaaugcuuccucacccuaggcauugaaucuguuuacaaaguccauuaaaacuugcagguaguauauacccguuuauaucaccauggcaacagauagcagagugcucuucugcguagaaggaaggcuauuucucaucuaaauuuagccugugcuaaacuccuugguugcagucucuuuuuuuggcucuucuuccucuaaacaugggaacauccaaggcuucacugucagccuucuucuuuuccuuggcuacacuuucuaaucaagugaugucauuuaguccagaaucuucaaauaccuauucuccagccugacgucucccacaugcucuugguacagauagucagcuaaccauguaaaacauugaccgagaauccucugccaaacucaagccuucccuaucugccaguuguuugagccccaaguuuaggcauaauucuugauuuuuugcuuuccuucacagucuucauccaauccaucaguaagugcuuuugguguuauccccaaaagauauccccaaucugacuacuucucaauaucuucauugcuauaguucuaguuuaacccaucaaccagcuuccuaacucaacacaccacuucugcuccugccccuuuauggaccauccucuguauaacaaccagagggaccuuauuaaagcagaaauaaaauuaucuaacuucccuacugaaaacuuagcuccagugguuucucaugaccuguagaauaaaaucagaaguccuacaugaucuagugcuccccacccccugccuuucugaucugccuccacucuuccuugggcccacgguucuccagccacaguggccuucuuucuguuccuccagcuugcuucuagcucggcauuuguccgugcugauuuuucaucuguuuggaaugcuccacacccucuagcucaugucaugucuucaucauuccuucucugacccucucagcuacaacuccacaucuaguuauaguuuaucacauuacaccacauuauccuauuuuaucuucuucuucauagcacuuagcugaaauuaucucauuuauuuuuuauguuuguuuuuuaaucuuucccaacuagaugagacuuuaagucaagacucuaguccauugcacuagcuccagggccagcauacugccuggaacauaggggauccucaguaaacauguguuuguaacuguacuagguguuuaucuucuaauuaacucagaaauguaugcaucaauaccaccauuguacaagccaggaaaugguacuuuuucaaggauaaaauuuuuaaauauuuauauuacagaaaaauaagcugaagguauguuguaucuuggcacauucacuuugcacuugcgcauucaguucucuguggugggccgggauucugggauuaucuguguuguagcuaagaauauagcuugguuuagaaauagucuaaaaccaauaacugauccuaccaaaacuauaagauauauucuccuuaaaauaguacuaauuccaaaaauacuaacugaauuccagaaauuguucuuccccggggugggacgcuuaaauauguuuuauaccaaggauggagaacuaagcucagugaagagacggauggaugucaugaauuuuagacccuauucucguaucucaggaguauauaucuaaaaaauaauuuuguagugauacauguuuuucauuuuaaaauuacuuucccuauaucccaauuguaugcugucuuccccauucccaucacgagaacuagaagcuucaaaggaauaaguuauuuuuuuaaaucuuugaaguacuauacuauauuuauucauuuggauuuuaucauucuuacccagaaauuucagaugcccauauauauuaaguugaaaaaaaggaccauucuacuagagcaauugccaacaauuugcaauauugucauuacaaaauuuuaaaucagugaaaggcauacaaaguagguauccaucaguuaucugagauaguaucuuauuccucauuccuaagcaagguggaaaaaauuaaacaaucguuucauugcaguuaaguaaguaauuacugguucuaguaaguaauuguugaaugaauaugugguuucacaaaaaguuguauaaugaagccuugcaaaccccauagugccaguuaugagaaucuggugucuucaguauguagaauaauguuguaguuacugucauucuguucuuccucuuccucaucaucacccucuagaagcaaaauuguccugaaagauugauucuuacgguaaaucaagugaggaggagagguuggccugaauauggauucauauauuuaauuaaggacuuagcaucugggcacugugacacuuggaguuuagggaguaaaagagaauuccuugaaugucagaaaugacaaagugggcugggcgcaguggugcacaccuguuaucccaacacucuaggagaccaaggaggacgcaucacuugagcccaggaauucaacaauauggcaaaacauggagaaacccugucuugacaaaaaauacaaaaauuagccagguguuguggugcauaccuauagucccagcugcucaggagacugaggugggaggauugcuugggccugggagauucagguugcagcgaaccaugaucacaccccugcacagcagccugggugacagagcacaagaccuugccucaaaaaaaaaaaaaaagacaaauaaaccuuggcuacuaccauguaaugguuagauuaauuaggaugccuggaaaauggacuaaacccaacagguuuuuuuuuuaaacccaacagauuuugcaaaaaugaguaacuaucuaauaaaggguugauaaaggcuuuguaaacacuaugcuuuguuucuccaaguguggucagugaaucaaccaccuggggugcucacuuaaaaugacaauccugcccuaacugauuccucauugucaaacauagucucaggagggaguuucuaauaaguacccucuggugacaccagacacugcagcuuaagacauacucccaacccccgcaguaugucauaugacacaagugggaaauggaaaacaucucccuuacauucugagaugacucagacaucuggaauauuugcuugccugugcauugguaaccccagccaaucaguagguuuaggcaaucuaagcccaggugaagucagguguggugcuuuacuaacgucauugauauguaggaaauuuguuuaaaggcacugaaguuuuauuccuuaaaauguucuauugaaaaauacuuacucauuaauaggagauauaaauuaaagagaugcuuaggaauaggagaauuccaacuaaaaauuuuuaagccacacaaaaaucuuuccuuuaaaaaaguguucaucacucauucaugauuugaccuuugaaaguugcuauuuguuucauauacacuaaugauuuaacaguucucuagggucuuaaauuaguaaaccauuaccagacuugcaaguguaaugggucagaauuccuacuccuguuuuauugguaaggaaccaaaacuauauuaaauuuaaauauaucauagucauagguuuuuagugcugacaccaauguggcuaaaccuaguacucugaggcucauauauugaaagccaugaguacucagaaucuaauuuucuucuaauugucauucuaggccuuuagcaaauuuaagcuagcaguuuugcugauuuuuauauuaccaguguucacuguugucacuggccauacuuguuaauuuuuuauuucuuggccaaaaccaaagaaaauauuuaucauucuacuguaguauagucauaccacuuuuagauuagaauguuaaaccaaauguagcaaagauuggggacugcaaggcauaaaauaauguuuaggaacugcaacauuaaaagauaaguuuacuauuaagcaaucagauuuagaucaaucuggaaauagcuauccucaauuuaagauguucuaggccgggcgcgguggcucacgccuguaaucccagcacuuugggagauugagguggguggaucacaaggucaagaguucaagaccagcuuggccaguauggugaaaccucgucucuacuaaaaauacaaaaaaaaaauuagcugggcaugguggcacaugccuguaaucucagcugcuugggaggccgaggcaggagaauugcuugaauccgggaggcagagguugcagugagccgagauugugccacugcgcuacagccugggugacagagcgagauuccaucucaaaaaaaaaaaaaaagguguucuaugaauacgguuaguauggaauaaacacuuguuaaaauuuuaauuucacuaauauaucauauguuaauauuuaagucuggaacugagaaauucaccauuacucauagcugaagacuugaaauguuuguugagacuaagaugguauaaaagcuaugagugagggcccugcuucccucugcuuccuuccucuaccaaaauauauuccgggucgggaggaugggguucaagaauagggaagaaauagguuggugaucacaggaagagaauugguugaaugagucacaaaaaagaaggagagauuuauuuaccauaaauaaaccaaaaagaaagugcuuuuuuaaaaagcaugugauuaugcugaguguaagugccugaaacauuacauugcuaauucuugucccccccauuaugauuauuacucugaucauagcaauugaucuuguaaaccucaaguccuuuaauauuucaaccagaaacuaaagaugaguugacuuauaucuuuaguacaaaacuauguaaauugaaauaaacaccacagaaggacauaaauaucaguuaaguuuugucuuugacaucaucuuuucuuaauguugccacuauacuaacagcccaugauaugcaucuuaucuuugcugcaaaauccuaauaaaaacacuugggaacuuggaaggaaguaaaacacaaauuacauuagagugaauuaagaaaaagaguugcauuuugguauccucccaaguggggagauuuaugagagcaucacacaugaagagaaaggacuucuuuuuuguuucaacuccaccaucacuuucuccacaguuucacuggacuucuuacuuuauuuaucaccaaguucuauaauuaacauaugguucauguuauugauuucucagguuucaaaguaaaauaaauugagcuuucuuccacauuuagaauauacaguuuuuuuaaggaacucuaaacaaaggcacacauuauuuguaaguuggagagcagcugccagaaaacagaaaauuaggaauggagucaugagugaaauaauggagauacuguucagagguaacccuuuguacagcaggaaauuuuccuuagaaaagaagacagcugaguuugcuuguaaauuuugcuagaaacaggccugauuuaguaacauuuagugcugguuaggaggcugaagacaacacuuucagcuuuggauaccaaacgaguggccuguuuuauauuuuguacacagucuaaauacuuuauaguuucaaaagauauguguguaggagagagcuauuauuaauuuuuuaaaugauauaauaauauguaaacaaauauuuuucagaucugguaguagaguuuucuaagugcgaaacaguagaaaauaucgcaaaggaaaugauucaugcauuagacuauaaaaauuuuagacugaaaauauuauaaauaaaacuaaaaagcaaaugauaaaauauuugcaaaaacuauggcaaagguuuaauauccuuaauauauaaaaagcucuuacaaaccacuaagaaaaaggagauuacccaguuuagauauggauaagaacaugaacaaauuugcaaagauguacauauauacagaacgcugguagacaugggaaaugcucaaccucccaaauaauuagagaaaugaacaauaaaaaaauguaccauaggggaugauuaaauacauuaugaaaauuuaucuagcaaaaugaauacaucucauaggaugauuuuucaaaaaaucucauauuguugaagaauaauugccuaaagaaauacauauauacaauaugaucccauuuugggaauguauuucaaauacauauauuaaaaaacuagcaugaaauuauuaacaguauauaucucugucaggguauuauggguuccuuauaauuuauuguuuacaauggguuagugccauacaacauuaaaacccuuugacauucccaauaauugacugguuuugcccuacaaaaaugacaguuucauauaauucaacccaauauuuuuauaauccaacaaaaggcuguuuuagcauacaucuuauuggggaaugcccucuauuacagaaaaguugaaguucucacaucugaaucuuuauagcccaacauaagaauuaacaacauagugucacuuccuuugcucuuaggcaacacaaagggacagguuuuguaaaauaaucaguguguauacauuaaaaacauucaguacauguuuacugaugaugaugauauugauaaaauagcaaacauugaaggacuaggaaaaaugauaugauaaguuuucuaaugagauuuauugacaccauuguuaucuccuuuagucuuacaaacauuuuaccauuaaauaguauaauugggcuauggagaaauuucacuugauuguaaauggaagcaauugcugaugagaguaaauuuuuaaauuaaugucuguguacagaauacaguaaaguugcaagccuauuuuuacuacaaugacaguuacugauacagggauuucuguaacaaucucuaggcuuucaauacuuuuaaaauccuggauuagcagguacagggagauuguccgugaauagauaagauauuaugaaugcugaauugguuuaaugaagcaguguuagaugucuuuccauuuucaguuuuucuugaagcaaaauauuuaauuugagacuugaagugcuaacagcaaucuucauuguaugugcauggccauacagcaacauguuuguauauaacuccacuguccacucaaggacaauauacauuucuuucaaauuaaaugggauaaaaggggaaagugaugccaaacaaagggaauuuguguguaugguuuuuuuuuaagcuuucuuuuuucuuuuuuuuuuuuuuuuuuugccuuaaagucuguuguuccauccuacuguggccuuuugaaaguaugaaggugaaaauagaccaguauggauaacaguaaaugaaaacugcugaggacacaucacuugcagaaagauaaauacccauaguuuugguaaugccccuguuggauuuagaaaacuggccccaccacacacauuuuuuaaaaaaaauaacuuuuaucccagaccaaaucauuucuauaguagcuaaaauugguguguuccagacucguccugugagccuauaugccaucaaagcagauacacuuaagguggaggcagcaagcccugaugcuaaucugaaacacagguuaaaggagaguccuauuucacuaagacagaaaccacuaagcuuuuuugccuccagccaaaauaacaaaguccuagccuuuggugauugaugagcauguugccaggggaaauggacuggaaaaucaucgccuugucuuuuacuugccacaggaaagccauaacagagaucucuauucuucuuguucugauaagagaccuaaggaagcaugaagaagggcuaagaagccuggguguguguuauauucagcugcuugcuggauugccuuuuaaaauacaauuuguaguucccuaacucacaaauagaacauggauaguuggcuagccuuugacaagccaugcagcuuuuuaaccacagcuucagcaaaguuuugggguauaaaaucaguguaccaaaaucguuagcauuccuauacaccaccaacagacaagccaagagccaaaucaggaaggccagaucccauucacaauugccacaaaaagaacaaaauaccuaggaauacagcuaaccagggaggugaaaaaucucugcaaugaaaauuacaaaacacugcucaaagaaaucagagaugacacaaacaaauggaaaaacaucccaugcucauggauaggaagaauugauaucauuaaaauggacauacugcccaagacaauuuacagaaucaaugcuguuccuauuaaacuaccaaagacauucuucacagaacuaggagaaaaacuauuuucaaauucauauggaaucaaaacagagccugaauagccaaggcaauccuaagcaaaaagaacaaagcuggaggcaucaugcuaccgaacuucaaaugauacuacagggcugcaguaaccaaagcagcacgguacugguacaaaaacagacacauagaccaauggaacagaauagagagcccagaaaugaggccacacacauaugaccaucugcccuuccacaaaccugacaaaaacaagcaauggggaaaagauucucuauucaguaaagggugcuggaauaacuggcuagccauaugcagaagauugaaacuauaccccuucuuuacaucauauacaaaaaucaacucaagagggauuaaagacuuacauguaaaacccaaaacuauaaaaacccuggaagacagccuaggcaauaccauccuugacauaggaaugggcaaagauuucaugucaaagacaccaaaagcaaaaauugacaagugagcucuaauuaaguuuaugagcucugcacagcaaaagaaacuaucacagaguaaacagacaacacccuacagauugggagaaaauauuugcaaacugugcaucugacaaagguauaauauccagcaucuguaaggaaauuaaacaaauuuacaagauaaaaaaauuaaaaagugggcaaaggauaugaacagacacuucucaaaagaugauauacauguggucaacaagcauauuuaaaaaaagcuuaauaucacugaucauuagagaaaugcagaccaaacccacaaugaguuaccaucucacaccagucagaauggcuauuauuaaaaagucacaaaauagcagaugcuggcaagguuguagagaaaagggaacacuauacacuguuggugggaguguaaauuaguucaaccauuguggaaaucaguguggcgguuccucaaagagcuaaaagcagaacuaccauucgacccagcaaucccuuuacuggguguauacccagaggaauaaugaaucauucuaccauaaagacacaugcaugugaauguucauugcagcacuauucauaauaacaaagacauggaaucaacguaaaugcccaucagugacagacuggauaaagaaaaugugguacauauacaccauggaauacuaugcagccauaaaaaugaacaagaucauguauuuugcaggaacauggauagaacuggaggccauuauccuuagcaaacugaugaaggaacagaaaaccaaauacugcauguccucacuuguaagugggagcuaaaugaugagaacuuaugaacacaaagaagggaacaacagacacuggagucuacuugaggguggaagguaggagaagggagaggagcagaaaagauaacuguucaguacugggcuuaauaccuuggugaugaaauaaucuguacaacagacuccugugacacaaguuuaccuauauaaaaaaucuucacauguacccccaaaccuaaaauaaaaguuaaaaaucaauauuacaguacuuuguuaucagaaagcacagauccuuaaagacuauauuggcagugaacuuuuuuaaaaggcucggguugcauuauauaguauauuuuggaaauguauuuguuuaagagauuagcauuuccaauuccaugacuucuuccuuuguguuuuuuuccaggccuguguuucaguucuggguuagaaacauuuuaaaccuuuccuaaauucaguagcucucucacaaauuauauuuagaaaagaaaagccccaccaaaguuauucccagaucccuuauccaguggagguggguaugcauacuccguuucuucccccucuggucuugcgcuucuugcccaauugaaauggagaauuuuguuaaucccauuuguuauuggaaagauagauugccugucccuuuaacaggauggccaaagaaugacaauccugagcccaccacucuaauguugcauuggaagaguuccccuggaaguagaagcauacaucuuccuucuauuaauaccaacagugaaccugauacaacucuuuaaguuauugcagucucuucucuuuuauucuccaacaaaugagagcccugucuaaccuagaucuaaaccuacauuguucauugacugaauucccuggcuucugugaggguuccuuauuuucccagaaacuggguaaagccgauucacaucaacugguuaaaacuuugaauagaagaaaaagugaauuaaauagauucuuguuuuuaugagcuucuccacuacuucagagcagcaaaauuucacuacaugccaugcccagccacaaaauugaggagccuguuuguugugccuuuuugaaauggccuuagggcuucccaaauuuguuguaaaaaucuuaccaauguaauuuucccauuacaccuuucccccuuuucuccuuaaacuugacuuuugaguuguacacaagaucauaguuaggugaguuuuuugcugggucuuuuuuucuuuuuuuuuuuacaauuuuacaugccucuauucacucaucugugccuaaaucagcagggccuaaucuauaacagagccaccuuuuuaagugaccgccagcugaguuugaucccuuauuauauuaaagggagaaaguggacuuugccaagguuggggcagauucuccaaccuugcaaaacguugugggcaauuaaugggcuugaacaugagguucuuuuguguguguguuuguaugugcacuuguaugugcaagaaagagugaaagagauacccaugcauagaauuuuuaaaccgggcagcucugugguaguuagcuagaggcaagagauacccuguuggcucccagaccuuccuggaagcugacuguuggaaaagacuccuuggagauaaaucucaugugguucccuuuugccugaaugguauccgcaccccaacuuauaccuuaggaggcuuuggaagaggaauacuuuuuauaucuaaugcacuuuggagauuggaguccugcagcaauuugccacucaggaaaauaaacuagcauauuaacucccagcaaaugccaccuccuugguuugaagcgguuuguaaagcauuuucuuccugguuugugcgcaccacauuguuucagcuccucucaucacugaccagcuggcuuguuggugaauagagcugugggccccucgccauguuucaugugaggucuuggcuggguggcaaacaggcagccuguagccagugucagcaauucaggaggaauuggcacagcaguguccccauuaauuucugcuugucacauacugucaugcaaguuacaccagagaggaaaugaccguuaaaaaaaaaagguacccuuguggcacuggguccccuccagacguuccccgagguuaaacaaguggauacaauuagcccuacacagacagcugcggggaaaggaaagccuagaagugggccccacagcaaugugucuuuccuguuagcaaggagugucggcuaucaacaucugccauauuuuaacccuucaaagggaccaguaaauuaaggggagcuauuaucccacgcucugcugaucauuaucaaucauaaugccuugggaaauuaccacagugcugcugccuugguggcagguuuuguccuuugggggaucguuuuuauguuuuugcugagagcagagaagagugguagggccaagagggugaaaggaaauggacucuguuaauuguugguaauuuacugccacagggaaggggacuagagcggcaauaaacuccuccucagcucaaacugaaguaguuaaaauuggugggcuccagacggcuuccauuuccagaaagauccaucuugcugacugucaacccuucuuuaccacaagcuauggugacuuuuagggagcacaaacaagaagagacuuugggaaaugagaaccaguuauagaggagaaaggcaauccaagaugagaaaagaaacucuaaaauacaggcuuccaaaaacuguuguuuuauuuuuuaaagauugaauuaagcugcuguuauccaaauagaguccugacuaaccuuuauaagcacauacugugcuuuggaguggcuuugucuagugaaauucugauuaccagcacagagggaugggugacugagaugguccugugugaaauuauguuuguuccaacuuacucaauugaacuaaucauuaaaacuguuuacagaaagaaugggggaaaagaaugguuucuuaccauguuuuaacuucaacagguuuugcguucauuuauguagaccuggaacuuucuccucugaaaagagaccauuuugcuuugggggcauaaaaaugacaggaguucugaaaaugaucaauacuaaugaguacaggaaaaugagcugauguucaucuaaaugauugcaccaaagacaaugcagugcagggaauaaucaucuucugauuuuacugagaugcuuccugaauguuacugaggaagaugcuggcaccauuuaaaauauuuaagugagggauagaagcaaccauuaggauaauugaguggaaguaacaguguuacuguguuuauugagacuucaucucuuccuguguggaagaagugacaggaucaccaagcagagccuggagagauugucagugaugaauguuagggcuguucccauccuaugacauuaucuagucugagacccucauuguauauguuagaaaacagaaaucagagguuagggacuugucuaugaucucacaaugaagcagagguggaacacaagguuuccauucccaggugaacuguuuauaucauuccaugagcugacucagcacaggaguuaugaccaauacuagcagcaacaaagggguccuccuaccucauugaaagcagggaguaggaaugaaccacaaaucugagguagaaacggcuuucuucaauacuucugccaugaugucaggcaggaaacuugaggcaccaguuuuaguuggcccucuuagagcaagagaugccaauuucaaaagguagucuucuuacuagcugggcgugguggugugcaccuguaaucccagcuacucgggaggcugaggcaggagaaucgcuugaacccaggaggcagagguugcagugagccgagguugcaccacugcacuccagccugggcgacagagcaagacuccgucucaaaaauaaauaaauaaauaagauaaucuucuuaugcaauuuuaaguauaucuaaaaauugagaaauaaaaguauuucucaaaauaauguguagauucugagaaauuugccucauucgguauuuauaauuuuucaaauguuagaucacaaaggaaaaucaguaagguacacauaaaugcgagcccucaugaguaugggcucaaucacuaauuaugggaucucuggucuuacagauggguagacuguaaaugauuuuucaucuacucuuguugcugaucucugauuuuaggggaucaucaguaauugaauucuauuugagauuaaauccacuucugaacaucagguugugacauuuauuaaguuauuaaaucauaugcuucaguauucacaggugaagcauauaauuuaauaacuuaauaaggucacaauuugauguucagaaguagauuuaaucaccauaaaguagguuguuucuuugguuaaauaugaaaauauagagaaaguaaauaaauuaggcuugcuucauguuuaaaaagcauuauuauuucagaauuguuucuuuggccuaauuucaggaucugucguauaaugucaggcuucaguugaagcaguuaccugaagauuguguagacucuagaggaauaccagaggauuggaaauaggaauagcagagaaaauaccaauuuagugaacaaugaugagccaauuagacaaaaaaaacauuggcuugaacuucaugggaaggcaccgaaucauuacuaacuccugugguauucagaauaauaacaucaaucaugaugaacugcuuugguagucauaugucuguauguaauuccauaaaaauucucuuaguuuuggcauuaauuaauagugacuguauuuuauaaaauggcguauuucauugaaaacacuuacguuuaaacaugucaucuaagaacuugaaaaucuuuccuaacaugcauuaaaaugauaauuacugaguucucaugggaaaaaguaguuucucauuuuaggucccaaaguuucaacagcauuugguauagcauuucauuucacuugugguccuaaugacucacugcauucuuuucaccagaacuuauccccuguuuacucucagaguucugucucauguagacacaagccuaguagugaaucaauaacaugacuauuuucaugaacaguggaauaguucaaccucugcaaugccauuggaagacauugucuagucugcaaguuuaaggaaauuuaacauuuccuauaccuuuauaucuugauuggguuuggcuuuuuuuuaaagauuaaacucugagggaaacuucucaaagcugagccuaggacauucucaugcaguugggaagcagcacuguccuuauuuuacagauggaggcagcuggcauaaauagcuacuuaaugauuugcccaaguucacacaaguauagagccaggagcuagauuugugacucuugcacaacccauuagacuguuuucauuucaucuaagucaccauaguagaauuaaauauaauuuuuauaucuuugucagugcucuuuaaugaguuaacuccuacuuaacauaaauguuuuagcauuuccgugcccucugggccauuaagguaauuuauuuuuauaauuuuaauuauuauaauccucuuaaguguauaaaauaaauucagaaaugaaaugaagacauauauuuaauuguauuauuauuaaaccacaugguauaaaugauaggauucagaaauaaaaguuuuucauuagauuuuggccauucauaaaauauauuguuguuugcuuaacaucccuaaaauuauuuucagaguuaaggagaauauacucuuaucacugcauauuuacuuuacaaccauugaggaauacauacugugugcuuuacaaagauacagccuaauuuauuugcaaaaaguuaauaaaacugcguaugugauaacaguuuuuaugcuguuuccucacagaucucuguuaauuguuaccuguuuaugguuacuuuugcuguauuguuaucauugaauuaggauagucuccaguuaaauuaucuucucuccaaugaaaaaauccugcuuaaaaaaaaucugaggguaugauguacaacuuuuacacaugauacaugaacuuuaacacaauugugaauuagagcccaacuuaguucaagacaaaauguaucucgaacacuucuuuucuucuuaaaauaucagcaauaaucuaguauccaaaguaggagauucaucaucaccuuaagacuucuuagcaguuuuucuugugugacaaaauauuuuacaccuuuauuugagaacaaaggaagauuaugagagaccacuagaaauggaauuuuagcauuucgaaggaauuuuuauaugacguuguuccucuuggcaauucagaaagcacuccaggaauuugucuaguuaguguuuuguauauauuagaaucugugucuauuuccuuuguaaaaaaauacgaagaccucccaagucauaacuuuuauuaucaauucuuguaaugaucaaauaugacgucuguacaggaaauaaaucguguaguaguuuagcugguaauccauguucugccucaaaaccuaggaaugaauggcuuauuagcuguugaaaacucugucauuaaguaucauuaaauccuuuuuuuaaaaacuuccuuuaugccagguaaauuuuuauauugcgaaaacugaauuaagccaaagaaaggcuugcaaaaaccaauucagaucacacugugacuauaacaagacauuuucaaaaccagcauuccaguuguucugucaggucauuccaucaggucucaaaaggugacuaggaugcugaaaaagguuugccuuccacauugugacguaaauucauuuauuuguguuacuuuuguuuagaaauggcuuguuacaauaagguuuuaucacugugacucauagaucauguaaagucagcccauucccguuuuacucuuucuuguaauuuucaaaauauggcguaguggcaacccaaauugaaaucuugagaagcuggcaagguugaucaaaguggaauccacaaauuaggauuguaaccaaaacuggaggaaucauuuuuaaccuacucaggaggccauuuuagaguccugaagguaucacuuauacacaaaucagugaaauuauaacauuuuuagaguuggaaaauuccuuggaauauauguagcccagccucuccccacuuuauguuuaaggaagugggucccgaagaggguggugaguugcccaaagucaugcaguuaguacugugcuaggacuguaaccaaguuccuauuauucuaguucgguggacuuuccaaaagccauauaaauguguuuuucucacucauguagaauuauuuccuagaauaaagaccuauauuuaaaacaucuuauuacugguuugaauguguuacuauacuugcuuguacauugcucuaaaaacaauguuaguuugaacuuugcccucauuugacugaccuaccccagaaucaguaaugcucucuucacuagaacuuucauucuuaacauuuuauucuccucaacuagagccucauuccaaguacaguauauauuuuuucuccaugaagaauuguaaucauuuaugucucugcauuucauuucaguagugcucacuaugcacuaucaaaguuauuauccuauuucccugguaaucacuugcguauuugucaaauaaggguguauguugaauaaacauguggcuuuuauucaauuugguaaacauuuauugcauacccucacaggacuaaagaaggcuacaaaucaguacagcagaaugccuucaaaaacuuacaggacacacccaccaagugcugcagagcagucagaaguucccuaugagauauaaguggaaaagagguucagaggaucaaaaauguacaugugauuauaggaaugagaauuugauaugaauacccugaagaauuucagguuugguuuuggacauuggcaucuguuuuuucucaguugaucuuuuguuuguuugguuuugguuuuugguuuguuuuuguuuuugucagacagagacauuuccauuacucaggcuagaaugcaauggugagaucauagcucacugcagccuugaacuccugggcugaagcaauccucccaaguagcugaaacuacaggugcacacuaccacaccaagcuaacuuuuuaauuuuuuuuguagagacagggucucgcuauguugcccaggcuaauuucaaacuccugggccuaggcaauucuccuggcucagccucccaaagugcugggauuucuuuuuuuuuuuuuuuuuuuaggcagagucucccucuguuacccaggcuguagugcaguggugugaucucagcucaccacaaccuccgccucccagguucaagcaauucuccugccucagccccccgaguagcugggauuacaggcaugcgccaccacgccuggcuaaguuuuguauuuuuaguagagaugguguuucaccauguuggucaggcuagucucaaacuccugaccuugugauaugcccaccucggccucccacaugcugggauuacaggugugagccaucgcgcccagccguguugggauuucaggcaugugccaccaccccuggcucacuugaucuuaaguugcaaaaucacauucauuaauucuauagguguggauggggaaugggagugggauaugaguagucauauauuugccuuccauggggccucaggaagcagugccucaacuagauuuaaggaaguacuguaguacugagaggucuuaaggccaaaagacaccaucugcuuauuucauuuuauuuauucuauguuaugaaagagagucccuagcaacaagacaccugguuacuagccaugugacuugagcaagucacuugacuuuucugagcccuaguuuucuuauccauaaaacaaggauuaaaauaugcaagucaaaugaguuaaaauguagaaaguauuuuguagacaguucagcauucuaugauauaaaggauggagauucuucucuuguguauuuucuaguuacguccaugugcuuuucaacugaucauagaacuauaccaagggucugaccaguaauaauacuggcauaucaaaauugccuaaagugaugucagcuagauuuugcauggagccuuuaauggcccgccaaaaugacuugaucuacuuggugucccuaaaggccuuucuuccuucugguuugagcguuuguugacuauaaaaugccuuuuuugcauuuccugcuccuucuugcugaugauauaauaguugcuucuugaaauacuauugaaaaucuucagauucucuggaaagccauauucuguaaccuguuaucuguaaaaguucugaguauagaacaugcaguaugccauuagaacacacaauaaguuuagagauuuaauuuuaagaauuuuccauuguguauugaaacacuuaaaaaguaaaagcccugggaauaauauaguauauuaccaucugcgcauuuucccucaauucuuuccugaugguagcugaugaaauugaaaugguaauuuuuagaauguucuaauauuugauguauuuaaaauacaucaccuuuuauuggccugcuuuauaugggaacaagaaagccuaccuagcaaagaaauacaaccuaguuuuauaucuuauuuauucuguaaguccuugugcagcagcauguuaauguggacacacagcuuguagauaauuuaaaaucuagaaagggagaaugagauacauagagaaauagccaccacauaaggcaguuuaugacgaauacaguguguuacaaaugacaaaagccacaggaauucagaagagggaaaaauaaggacuggcuuccuaaagaaaguggcaauuuuuuuagaauauugaagcuguuacucugaggcaugagugacacaagccagcagaagccagagauuugaagucuugcucaagauuugcugguuuccacuuggggaaagacaccauuaggcuggguacaucuggagagaugagugcaagaagccaguuaagcaggagagaaguggacuugauuguggaggcacuguguuucaaacucaaauuaggcagcucuuggguggguggcugauaccauuguuguguuuucagcugauuaaucugguagcagugugcucguuuaggagaaauuacaacaggagaucagucaaagagaaugguccucugguuugggaaugaaauaaucagggccuguaccuggaguggggcaaugaugauuaauuggaaggaaaugagaaauugagaagacuugacaggacuugguuacucauuguccggaguaaaggaaaagcagaaauagguaaguuaauuaucaguuuggggaaggugauuauauaguuuagucuuguugaauuuggccuggaauaggaagguauaucucagggcacugcaauaacuuguggcugcaacuucugagccccauguaaccuuugaggagucauggaaucuaggagaggugccacaauacuagaagugagaaauauucuguguuuuuuuaaagauaggaaaaagauagauucuacaaaauacaauccagcaaaauugauacugauuuuagguuauuaaaauaauaaguugugagcauauagaaaaauaacugguuaagaaguaugaaaaaaugcccaaaucucacuacaauaagagaaaugaaaaguaaaaugauaguaaauauuucccccaucauauugaggcaagcaaaaaaaauaaaaaguuuuauaaugucagguguuggugagacuguuaagaaauggauagucucguacaccaacuguugggauuauaaauuggaacagauugaguaucucuuaucugaaaugcuuaggaccagaacuguguuuuggauuuuguauuuuuucagauuuuggaauauuuguguauauauaaugagacaucuuugggauaggucccaagucuaaacacaaaauuauuuuucauuuaugcuuuauacacauagccugaagguaauuuuauacaauauuuauacuucugugcaugaaacaaaguuuguguuaaguacuuaaacguggaauuuuccacuugugacaucauguuggcauucaagagguuuuagauuuuggagcauuuuggauuuuggauuuucagauuagggaugcuuugccuuuaaagcauuuuggagguaaucuggaaguaucuuuuaauauuaaaaauacauauguucagcgacugagacuucucacuucucagagaaauccugguacaagggcaaaaggaggcaugaauaagaaaauuugcuguagcauuaauuauaauggaaaaaauggaaauaaucuaaguucauuaguagagggauggcugaauagacugcuauguauagaauacuaugugacaauuaaaaagaaugacauagaccuauaagaaauuaucuuuaaggcacaguguugaguugggggaaagccauuuuuuggacuguagguacggucugguugguuccauuuaucugaaguacauguauaucucauauaauucacagaaccaaaccuggaagaauauacaacaaacugauaauagggacuaccucuuuggaagagacuaagauuaggguaggugauaaguuugccagauuuagcaaauaaaaauagugcuuaguuaaauuuucauucuuuugcuguauauucaguguuuauuggauggcuggauugauaaauauaguaugaagcagauuuggggcccaaagugaaaaagcagcagacuuaucagcaacacagguuccuggaaauagcggcuacauuuaaaauuuuuucauggaaaguuauuuucaaacucaaauacucuacccucaaccuuaucuaauuuaaucuuuaucauauccugugaagauaaauauuauuuuauuaaagagguucaaagagcgaaguaccacauuugaucaguucuaagaugcccauuuuuucacaaaugggccuuugaaaacagaacacauuuugaagucacuguucgcaggcaucaguccugauccaguggugauugccugcccacgugccugaaacuugcagaguuacucaauggcaggcaugaaaauccucgaggucauaguagaguucuacugcucugucaucagugcccuucaugggacagaagacaaaauuguguggaaaacacagacaucuaacaacucugaguagaaaaggaugugaaagagcaggacucugaaugugaagaaauucuuggaauaccuucaucaaauuauuucauuucaaauuuaauuuuuaauguauguucaagaaugauagauaaaauccaaaugugaagaagucugcaagagcccuuuuaaugggcauaauuaaaacuucugaaugauaagaaauugugucaugucaguuugacagucauuugucuuuuuuaguaguacauuaagauuuagauucgauaaaauggacauguuaauuagcuugauuuaaucauuccacaauuuauacauuuaucaaaacaucacauugcaccucaugaauauauauauaguuauuauuugucaauuaaaaauaaaauacacaaaauuacccaaggucgcccagcgagaaagguaagaguuaggaccauaaagccuauaccuugagucucuugcaguguacuauagagugaaaggaagaugacuauacacuuuuugucuuacuuacaaacuuuccacucuucguguuucaagaaauugagaacuguccagggaguuggcagugauaaaaauguuacauauuuaacauuacuuggagaaauuuggauucuuccaaaugcuguaaaauaauaauguguacauucauauaauaguuuuacuuuucaaagcaguuacacacaugcauauuaccugauuaauaguguaugagacaaacauaguauccucccauuuaccaaugaguaaacugauguaaauggaaauuagguaaaguacuacuaagaagcagcaacagaucccaaaggaaaacugaggucucuguuaugguuuggcuguguccccacccaaaucucaccuugaauuguagcuccuauaauucccauguguugugagaaagacccguugggaguuaagugaaucaugggggcaguuucccucauacuguucuagugguaaugaguaagucucacgagaucugaugauuuuauaaggggaagcccauuuugcuuggcuuucauuaucucuucccugcugccauguaacaugugacuuuucuccuccuuugccuuccgccaugauugugaggccuccccagccauguggagcugugaguccauuaaaccucuuacucuuuguaaguuacccagucucugauacgucuuuauuagcagugugagaacagacuaauacagucucugugccaguccaugaaacaucuaaugauuagccugccagggagguccugaauagcauaccuguacugaauaacuucccagauuuggacaaauauuggaaagacaauaaauuuuuuuuuuaguugcagaauaagagauguagaauaaagugggugcacuaaucucaagcauacaguuugaugauguuuuacuaguguaaccauccagaucaagauacagaacauuccagucuuccuuaugccuuccccagucuauaacucccucccccagauguaaucacuacacugacuuauuucauauaaaaaguaugugcuuuuuguguauagcuucuuuuacugagcaucuugucugugagaugaauuuuuguuccucucucugccaaaauguuucccaaguggauagaccauuuguguuucaccaucaguguaugugacugcucuccaucuuugucaacucuugauauagucaguuuaaaccauuguaaugauaucuuauugugcuuuuaauuuucaauucacugaugauuaaugagguuaaccuuuuuacaagcuacuggacuuuggguuuccccuuuugugaagugccuguucacaucuuuaacccauuuuuaaauauuggauugugugucuuuuucuaauuuaguugauggaguucuuucuuuuuugagacagaauuucgcucuugugugucuuuuucuaauugaguugcuggaguucuuuuuuuauuauuauuuuuauuuauuuuuauuuuauuuauuuauuuuuuucuuugagacagaauuucgcuuuugucacccaggcuggagugcaaugccaugaucuuggcucauggcaaccucugccucccugguucaagcgauucuccugccucagccucuugaguagcugagauuacaggcaccugccaccacgcccagcuaauuuuuguauuuuuaguagauaugggguuucaccauguuggccaggcuggucucgaacucaaaguagcaggaguucuuuauauauugugaguauaaguccuuuggcagauacaugcagugcaaaaaucucccaggauguagggauuugaaugggauccuuccccucucucuucaccgagaaagggcagcaaacuaauggucuuaucacuuggaccucucuucuaucugagcacuuaaaaaaauauagagagacaaaauguuucccuacugccuuuuagccuauuuuagcaauucauaauauggaacacaaacaucccauacuuguacauuuuaagucuccaguaaaauauuuuuaacugcgaacucuaaauauguuacagauaaugaagccucauagcuaggcuuuuaaauauuaaacacuuucaauuuccagcaugcauuuuaucuuccaaaaaaguacaaaagggguguguguguguguguguauauauauauguauacauuuuauacauauaaaauuuuaacugguaaauucagaaaaaaaagaguuuacaaacuuuaaagaagaaaaacaauuuguuuagccuaccauuguacuacuuugugaaugaagagucuaagguuguguguguauguauauuuugggaugaguguaaaaacuguauuccucuuagauauauaguuaaaguacaaaauaaaaacaaacuacauucaaauauaaguguuaaagaaacaccagauagcacuggugagccugauaccucuuggcaaaccagcaagugucaugucugacacucugagaugaccccaaaaucugugcuaaaaaguugccugcuuacagccuuagcagauaaaaaccuucagaaaacauuuuugaaaggugcugugugcugauucugacaaacauaacagaagaacagaagcagagauuggaaauauucaaggaaagaaaguacaauuucuauuucaaaagaaacuucuuacuuaggguauuuaccuugguuauuuugccuuuaaacuuuugauuaagcuuuucacucucaaccuaagcaaaguucaaguuguucugagaggacauuauugauuuaguuuucauucuaaaauauuuuaaacaaacugaguaaaucuuaaaaacaacccaguacuuauuuguaucauuguuugucucuaaaaugguucauuuuauugucugucagcaccacuucuagcuuuuacuuuuccaauaauuuuaugcuuuaaauauuaaaagcauaaaacuuauugagcaccuauucuucccuagaaucugucaggaaguggcaguuaagaaaaacaaaacaaaacaaaaaacccugaauaacuuguacuuacuaucuucgaguagcuauagucuguugaggacauaaaacagugcuguuuauaauuuagaaaguuaugugccauuacuuagaaaacucugaaguacuaugccgucuguuucuguggaauauuuuuuuaaugguccuuagaggauuuauuucacaaauuuuaccagagacuuacuacauuuuuuuauuuucuaaagacugcuggcuacuaacuuaaaaaguaggguugauuaaaagaaacauuaauauauauguauaauuuuaacugguaaauucaggagaauccaaaaaguaaaaaucacccauaauccuaccauuuucaacaccugacagagguagcaaucuuuaacuguagcuauaucucuuuccaaacauuuuuauauauauucagacuaaaauugccagauuuagcaaauaaaauaaggacauucaguuaaacuugaauuucgaagaaacaacaaaugauuuuuuauuuaaauaugucccacauauugcaugggacacacuuaaacuaaaaaaguauuuguuguuuaucagaaaugcaaauuuaccuuaguguccuacguuuuaucuggccauccuaaugcaaacauagccacacauacauaaaccuguacauauaucucuuguuuugucagaauagaaucaagcuguauauaucacucuaagccuuacuccuuucucugucgauuuaucuaguuuacaugucagaauuacccauguucuuucuaauugcugcuugauauuauacagagagacacaucaucguuuauuuaacuauuccucuaauuguggauauuuuagcugucuucauuuuuuuacucuuucaagcaaaacagcacugaaugucuuuguauugacucauuguaaacuuguugguuuuguagccugaauuccuagaaguugaauuacaagguuguagcauauuuuuaaagcagcauugggucauuccuuucauacuuagugccugaggcuggagacuugaggaguugcagaggggccacguguaccugggcacgaggugaggaggagcuuagguuucugaugauaugggccuuguguguguuaggcaccuuucuggcuucucaaauucgguuucccgccuucacuguucgcuccaugagacaaggcauccuuguucuccagccugccacacaaguuggcucaugauacaaauguagaaugaguaaaugaauaugaauuuauucaagggguugcugagaaaaauaaaugaaauaauguaugcagaguaccugggaaaaaaauaauguauguaaaaugccuaggaugcuucuuuauuuuucucaucccacccccauuuccaguuacuuucuuagcaucaggaggcuguaaucuagggagggugacauuacaguuagaguaaaguggaauaaguucugugccagaacuaugcucagagcauugugagauuauacgaggcgggcacauaaccugugccuguaaggagaauugcccaggauguggccaaaaguuacuuaaaguaagccuugaaagacaaguugaaaggagccagacagacaagauguguauguuggaagauguguguauaucgggggauaggacaauggagcaagcauuccaggaaaagcaaauagcauugcaacagaacagagauauaauagagcauguuacccucagagcauaguaacagggauguaggaacagcuggaaauuaauccagagauaguuaggaagcagacguuaaagugcuuuagguaacaaucuaaguuuuaccuuugucuuauagugaacagugggggacuucugcaugacucagauuuaccuuuuaggaauaucacuuagggcuaggcaugguggcucacaccuguaaucccagugcugugggaggccaagacagaagaguuacuugagcccagguguuuagaccagccugggcaacauagcaagacucugucucuacaaaaauaaaaauaaaacauuagcugagcauaguggcaugugccuauagucccagcuacucaggaggcugaggaaggagcauugcuugugcccaggaguuugaagcugcagugagcuucaccacugcacuccauccagccugggcaacagagugagauccugucucaaaaaaauaaauaaauaaauaccacuuagugcaguggagaaaagauuaaagaugcaaaaaucuaaagacaggaguucuuugugucggaacaccauuguaguaauccaggcaagagauacugacuacuuggcaagggccauggagaugggagagaagggcuuauuugaaagguaauguaggaacuauaauuaccaugauuucgugacuuguuagauauguguuugggaggagagaaagaaucuaaaaugucugucagauuucugaauugaucauuuggguggauggugguaccauuauaccagauaagaaauacagauggaaggacagguuuuggugggaguaaagaaacuguauuauuauuuuggaacagauggagauuacaguuaccagggacuauucuaaaaaacauagcaggaagcauguguacauuugcacaugcagaaguuugcacaucuggagcuugggagagcagccccagcugccuuaugacuggggaugccucagaaugugacuaaauguugaagccacaaaugaaugggagaugagggguggaggcagaauuuaaaauuuaagacagucuugagaaguauaauugcaaagguaauuauggaaacacaaacaaauggugaauguuuuugguagccauuauagacaauagcaaagggagcuuacuagagacccagagaaggcaguaccgaaagcccagaugaaguuagagaccaugaugugcaaccacuucagacuuguuaugaacauuuucucucagcaguccuaauuguagagaugugcaaauuguucugagauuaggccuuagaggaccaguauaagaaaaaguggaagccaauuuuuggugccuggaaaaagaauaauaccaaaagcugacuggggguuuuaggugggccaggaaaaguuugaaggcaagaggcgcacguuuaagaaaacaacuaguucaagacauuuuagacagggguaucccuaaaucagaguagcacugaauacauaaauuguauuugcaaugcaaaaacuuggauaccuguacucuauuaugcugaacacuaagaguuucccaucuauagggaugcccauguuucccugggcaauuccuauuguaauaccaauuuuuuuuuuuuuuuucggagauggaguuuugcccuuguugcccaggcuggagugcaguggccggucuuggcucacugcaaccuccaccuccaggguucaagcgagucuccugccucagccucccuaguagcugggauuacaggcaugcaccaccaugcccagcuaauuuuguguuuuuaguagagacaggauuuuaccauguuggucaggcuagucucaaacuccugaucucagaugaucugccugccauggccucccaaagugcugggauuacagacgugagccacugugcuggccugugauaccaauuuuaacauuagcuggauaaauucuucuuuguaagagucauuagaucguuaacccaguucucaguuuugccuugguggguagcucuucaguuccauuuggccugaagaucccccuuccucugcaccuccaugcuuuuccugacuaguugugaccacccagauccucuuccuccagcagauugaagaaguuguuagugaggaguacaugguccuccuuccacuggagauacauuggcuaccucuaucauaacugacuucaguuuaaaaagucaguccuugcaacaacacaaaauaaaaaauguugaagucccaccucuauggaguccccauaagcagcugugcgugcaacucuacccaaaacagauaauaugcacagauguguuuaugggaaggaggcacaaggacuuucaguguguuguuuucaguuucucaccacuacaaggguuucuuuucuuuuucaaggagguacauugugguaagcauguuuuaugacccauaauaaaaacccuuguaaagaccauuuuuugaccaaaugaagcuaaguguucuuuucagaguccuuguuugcuccucucccccucucuguauuggaaugcacacaguucagcauuaauggauaacauaaggaaauaaugucacaaauucuaguucuuauuuguuaaguugagaaagcaaccagaguuaacuauguaagaaaguucauuuguaauguuuuucccguuuugguaguagcuucagaauauauauguugauuaaguaaaaugguauauuucaugcuuauaguauccgguuauuauccuauaaaaagcaccuaaggacaguuucgggaaaucucaauagucagagaggccuacagaaaaaucuguccagguauagggaaaaagcaacuuaaaaccauuuuagcaaguugggucauuuacaaaaugaaacauguaauacauucaaugaauaauaacagauaauuucuaaggaccuagacuuucaaaauuaagaacagaccacauaacauuugauuuaauuaaaacaacagauauuuuaaggauuauauuauaaguuguguuuguugaucuuaauagaguguuagggaagauagaaggcuauccacauacuaacuggggaaaauucaguggaucugaacuuauaguauuaucacagccucaucuucauuuaguggcaccagugcugaacccauuacccaaacugggagguuuacacauuguuuacccaaacugggagguuuacacauuauuuuuaguucuuguagccacccuacaagaaaguguuguccccauuuuacagaugaagaaacgaagguuagaugcuagcggagggaagauuaaauaacaggcccaagaucacacagugugcaaccuggaaauguagcggagcucuccaaagaugggccauuaaaauugaacugugagaacaaauauuaauauaucacauuugucucuugaauugcuuuuccccuugcuuuuuguuucaauauucuaauuuagaccuucucuaucauauguucagaauaguaucauagccuccuuacaccaccucccauccauuauguaugcuaaaaugucaauaauaacaugccaugguuuuacacauuuuuacuacuuacccacugaauauaagauaaaacacuauagacucccuguguccaccagcaauaaaucccuuugcaguguggucccauuuagcagugugcccucuuuaggacccugccugcuggagcuauagcugguguacaaacacguaagcacuuccuccuccucuauuaguguccuccaugacagaugcuuccccacaccaaaacuaauaccagccuuccucccagauuggcuuagaugcugcucccuccuuggugcuuacucagugccuagcgcucuugugccauuugugguccuuggcacauacugacaugaaguauguagguacauauucuuuucucccugcuagaguaagagcuccuugggacacucuauucaggugcuuccguguagcaucaccugacacaaugccuuacacauaguagggacuucauaguucuuuugaauaagugguagcaauuuauuauguguaugaacuuuacaauaaauaaagugcuuaagcauaauauccuaugucauauauauaaccauaauacacauaaucauauauaaauauauauuacauaaucuauaauauaucuuguuuaaaucuuuuuguggggucauuuucucaaaaauagaugugaaaagcaaggcccacgaaaguugcaagugacuugucuuagauuaucuaacuugcaaguacaaauuuggauccaaagcuuuuagcucaaaacccagugcucuuucuuuuaaaucauacugccuucaaaaauggaaauuuacaucucaugucuaagugacucacuuagguuuauacguacccaaaagaaacuuuuuuaauacuuuuaugccuccacuuggcaagcagucaguaaauucuuagugaauaaccaauaagccacaaugcaggauuauggcuuuuuugcuaaagaaagacucaggaaucaguuuaaucggugagaauguucuauaacuccuguacacaaaaccaagagcaaaggucacuauaauucaucuuaaugcauaucuauagacuauugggugauucauccaaucaaguaaaaccaaaagauuucuauguauaacgugccuuguucgauucuuggagaauauaaagaugcauugcauuccuguuccucaaggaauuugcaaucuagcuggauagcgcuuggcaguuuaaaaaacaaaucaaaucuauaauauaaaauaaucaaaugucuagguucucuccacaguucuaugacagaggcagggcaggauuuauucugguuuuuauaagugaaaaccugaggcuccaaaaaauugggacuucauagacacuggggacuacuagaggagcggggaagagcugaaaaacuaccuauuggauacugugcucacuaccugggugauggaaucauuuacacccuuagacauacaaagguaugaaauauaccuuuauaacaaaccugcacauauacccccgauucuaaaauaaaaguugacaaaaguaaaaaaugaaauaaaaaaucuguacuauuacaaaaaugauaagaaggaagguggaacuugcuuaaucaacugacuaguggcugaguugaacggaacuuaguaacacuggaguaagagacuguacuuugagaaacucugauaugaucauaugaaauuaaaguaguauuaggggauuuggccaauaguccaauucugcauccaagugaagacucaggcaaagugauuugaucuguggaauacuucucuuagagaugggagaggauaagguacuuaagcuaguccuaccccaagcuguggaacaaugugcugaaauccaugucucuugaccccugggcaaguugcuucugaaagagaugguaagauaggaagcauccuucauuguuuuuguucagugugucaguguucauuauagucaugggaguuuuauauuucuaaaauaaugagcccaaagucucaacacauaugaacauguuuuaauggcuaaaagguacgaauacugauuuauaugccaugccucuuuugucccuaucccguaauccaaaccugcucuuucugauuccccuggaguuuuaucgcauuccuccuaaaaggagucagugaguucuuuuuaagcuaauggccuucauagauuucauggucauuuuuaguuuuguuugggcccucacuucuuuaugaaaacucauugagcauuuauugacacccauuaguacaauguggugggaggccaauaaaucuagaggaagagcaauuuaagcaggacccugccaggaguuggggccauggggcaguaaaugaguaaagauggcagaaauccacagaguaccaggaggcagggccagagagcuaggugggcuuuggcugagggggcugaagcaggagaauuaucugauaggaucagguuuacacuuuuaaggguucagucuagacagagaguacaagauggauuugaggacugagaucaguggggaaaggcuagguaaugguauaugugaggaaggagaaggcggaccagacccgcuauagugggagccucagagguguaggaauuguauuuaaaaagacacgacuuuacugaggagcccagaacaagacuugaguaaaugaagaaaaggaaagacucaauauuguaaagguaucuguuauccccaaaucaauuuaucaauuuuuaaaaaucauugaaaauacuaaaaggauuuuuggaaggugugggcacucaauaaaaugauucugaagucaguucauaaucauaacauauaagaauauccaagaaugccagacacgauggugcacaccuguagucccagcuacuuggcaggcugaggugggaaaauaacuugaggccaggaauuugaggccaaccuggguaacauagaccagccucuaaaaauaaauaaauacauauuuuuauuuucaaaaaauauucaggaauguuuuauaaagaguggaaagagaaaacuuucccugcagauguuaaaauuuacucuaaauauuuaauaauuaaaggagagagguacucuaaacagagccagaaacaaagagcaaaaguccagaaaauaacuucaaguaauuuagaacaugagaaauaguggcauuuaaaauugguggguaauuuaaugacugcuuaaacccuuuugcuaaucauagaauauaaauaaaaauagaaaaauauagaaccauuaaaaauuaagcuguagaucuacauugccaauagaucuacaugcaaaugaguucaguauacagcaugaugugaaaaagacaguuacaaaauuguaugcauucgcauuccauuuagaaaacagagacuaaccaucugcaugaguauuauguagauggcaaaaaugggaugagguuaaagaagucaaaguucugaagcuaauauuagcugggcauccuagugauguuggaguccugcaggaagacguugagugugggguaaacaggaugagccaugguuccuggggaauauagagaguugacaguaaaugauagugauggcaaaggcgauauuauaaacauuaauggaaggagguacacaccucaaagagaaaaggauaaccaccugaaagggaugauugccaacaggaaaagaauguugguacaggccccauugggucuguaccucacccuggggugaaucaugguggcuauaaaugaaagauaauguucauaacauauuuaaguuaauauaauuuuaauuaaguuagauuuguuagaauaauuuucagcugcaaauuacagaacacucaaugaaaaguggauccagauaagggcauuauuauauacauaacuacaaggcuggaggcagacagcccuaaaguugaugcagcuauucauugaugucaucaaagacccagacucuuucccuguuuacacucuggccuuuuauguguacagaugauguuucaagaugguugcuacagcucgguagcauucaguauaagacgugggugaggaaugggagaugaggaaguacagcagagagcauucuacugugcaccucuuaucaaggaggaaaaugcuuccugaaacucucuagccaauuugcccauacaggacugggugucauguucaucccuggaucaauuccuagcaaaaggaaaugugauugccuucauuggccuggaccaggucuucauggcugacaaccagcaguaucuucuauaucacacaaauaauuaucuguucuacucuuguggaaaaccagcuccucuaagcauuaccucauuugaagaggaaggaaguacagagugaggggaaaauucucaaaagagggaauugagaggaagaauguggaaagauaagaaaguauuuuguccaauugcagccauuagaaagcuuauuaaaauuucuucuucuguuuuugagagcugucgcccaggcuggggugcaguggugcaaucacggcucacugcagccucaaccucccaggcucaagugaucuucccaccuaggccucccgaguagcuggguccacaggcaugagccaccaugcccaacuaauuuuuuguuuuuuguagagacagggucucccuguguuguccaggcuggucucaaacuccuggucucaagugauccucccaccucagccacccaaagugcuaggauuacaggugugggccaccacaccuggccuaaaauuucauuauagaaaaguguguguugaaauggggaaauauucacagcacauuguaaaauguuuuuaaaagccucacaaaacaauguguauagaaugauagccacuugggucauuacccaacaaccuaggaacuugggcuucauguuuucuuacuucuuuacccagugcugauuuuuaucuccugcucugaagaaauuauguuuagcauugcauauuugcaguuucaguuccugaugauuuuccacaguggguuaaaaauagccauuaugaugagguaaugauuuauucuuucauguuguucauuuaagucauuacauuguuccucaaacaccaacauuuucaggcuugguggaaaugacuuauuaucuuuuuuuuuuuuauuuccaguuaguugagacugauucuuuaccuucucagcauuaucaucacuuccaggaaugaauaaaaaguggguucuguucucauuucagaauacauauuugauuauuaaaauuuacaugcaaugccacuuuauuacacuuuuauccaguugccuagaagcaguaaaaauuagaagccaguguuuccauuuagggcccaugccuuuguuucuccugaggggccucgaggugaugugugccugacucaucaugcacaguggcaaagagacggguacuauggcauugcuggacuaugcuuugcuguggaacaaagcucaugugugacucuuuuagcuugccaguuaauggcuugcuuugaauucacccauuacaacuuuccaggugauauggaaguuuuaaggaauccucuugaacccuccucuugguuucucagaauuuguuugucuuguucuuugugauuuuggaugaagcauucuuuggguccuccugaggaccacagugagaaguaggggagaccuguuuauaaacagccuuugaagcucauuguucauugcucauugcaaauugaucaaugaaagcacacgggaacccugucagguuuugaaauagaguagaagcuguauacauacagcaagcuugauguggggaccugcaguguagauucucccagaaugcagacaaaaguggguggaaucuccaaggagugaaucaagccacuuggcuaacgcuuuaggaccuuaacacgaugcuguuagucacuauuucauugcuuagguagcaacaauauaccacauuuuaugggagaaccaugguuuuaaaacauucugggaauagauccagcaauuccacuucugaguauauauccaaaaaaauugaaagcagagucacaaagagaucauucuacaccuguguucauagcagcaauauucacagcagccaaaaaguggaaacuacugaggugcccaucuauggaucaccagauaaacaaaaugucauauauacauacaauggaauauuauuuaaccuuaaagaggaaggaaauuaugauacacaccacaacaugaaugaaccuuaaaggaacuauguuaacugaggcgagccacucacaaaaagacaaauccagugugauuccacauguaugagguauguagaguugucagauucauagaaacagaaaauagaaugguggcugucaaggacugaggggagggguacauggggagacaugcgagagaaguuauaugcaggcucaggugaccuuucccucuguugcuauaaucguaacccucaccuuaauucaacauguucuuauugguuuaguguuaaaaaaccuuuguuauaugugauacauuuuagucuguggccuccucuaacacacuucauaggaaacagacaaaccacuauggagagaguucugugaaaacuugaauaacaaauuugaaaagacugagguuuacagaguauaaggagaaaaauagauuaucuuugccuacaaguuggauauguccuguuuuuaauuuuuaaauaaacugaggauuauacauuuuuggugcuaaaacuuugaggaugugaauauaucacaagauauaucccuauauccagaauugucuauuuaaaguugucauucugugacuuaugauaugacuuggguguuuuuagugucuuuuggaaauaaucauacuuucuuguaaugagaaaauaaggcccaggccaggugcaguggcucacaccuguaauugcagcacuuugggaggccaaggcggaaggauucauggcucgaggccaggaauucaagaccagccugggcaacauagcaagacccugucucuacaaaaaguuuaaaaaguagccaggcaugguaacacacaccuguagucccagcuacucaggaguauuguuugaaccuaggaauuagagguugcagugagcuaugauaugauggcaccacugcacuccagccuggguggcagagcaagacccugccucuaaaaagaaaagaaaaagaaaagaaggccccaugaucaaccuuuucccauuagaaaagccugaagucguuuuuuaguuugcuuguuugucuugauuuuaaauaagaggauuagagcucuggaacaccuaagagaaacaauuacaagacuucaaggauuucuuguauucagaaagguccagagucuuuuuaggggcauugccaagauaaagccccaccuaagaucucucggagccagacuucauuccacaaugguguccuguugaaacaugcuugcgagucgcauguuuuaaaaagauagagugagggucccaagugacuguuuaucauaaguaugacuaaauguucaaacuuuuuauaccagacugugccguauaacauaaaaagggaaacuuuuaaaccugcguuuaacugaaagagccuuaauuggugguaucuguaguuucauugcauugcaucacuaggguuacugugaaauauuugagucauauaugguacagaauaauuuagauuaaaaucuugagcuaauuuaagaguaugccucacgauacuauaaacugagauagaacagaucauaagcuuacguagagaguccuuugaaaugucuuugaugaaaacacuucuugugauucuguaggaaagguguuuuuuucuuaccucauuuaauguuguaauuuauuuauuuauauaauccucuggaauugggacuauaucuuaugauuauuugggaccagaguuccugacguagcugaauguacuucaccuuugaaauuagguauugcaauaaagguuggcuaaagacugagagggguuccccagucaugcuuauuacagguucacaaugcccaacaaccuaacucgugguugaauuacugaaggucaugagauguugggcaagauuuuguuuuuuaagucguuaacucaguguucauugguucagaauuccaauugugucuagauauuggagauuuaaaagaaaagccauuugcuaaacaaaaaaaaaauuuaaguagccuaauaaaaucuaaagaauggucauucuuauguagaaccaacuuacaucuauaggcaucauacacauggaaucaacguuagugcagucauguggauucauacugccuaacccaugcuuugguaugauauuaacaagcccuuuuaaucuacucuaccuuuaaacaaacaagaacuagaccuguaguauaagugccaaaguaacacaacuaaaacugaauaauaauaauuauggcaugucccagggugaaaaaccaugcagccauuaaaaaucucauuguauaaaaaaagucauauugcagaauuuuauuaguggcaaaauguugauaaugaauuguuacauguuuuuaaaagagcuacaaaauaauguguacagaauaauaaccacuuuuacuuaaauauacuuauacauccaaauauaauaaaauacguaauuuuuaaaagacagacuaaaaagacacaaaaaaaguuauauuaacagugaaguuuucucuguucuccaaguaguggaauuuuuuagugauuuuucuucuucucuggauucuuaaaacauuuuauuaguuucugcauuaagcaugcaucuauacaucuuagcaauuuuauaauuaagaaaaacauaguguguguuauaacacaaauaaaaacgaugugcauguuuuuaaauuuguauacugcuaauuggcugcuaaaguuguuugaacacugcagcaugaaccaaacagauuuauucuuuauacuguuuuaaaugagugacacuuaacuguauagaggcuaaagaugaugagccaacaggacauuacuuuagguuagucaugcuuuuuaaaauucagugcuuacaaguugugugcauguguuuccaauaaagacuuauuugccaaaauguuccuugaacauuuugugcuacauuuucacacuccuguuuauucauuacaacuuauuggaccugcagugcuucucaagucuugaagggcuuuuccuccccaaugcagucuucuccaggguuuugggaagcuuagaaggucaccccugccaguucagaauauucacucagggggaucucagaaaugauucuagaucacugcauacccccucuaagugcuuuguucacaccgaccuuguagcaguggucauguuuucuuuuaguuguuugugaaucagucucccccagaaaucaggacacuuaucuuggcaauaaucauccuaauaauuacuguuugucaagugcuuaccauaugccagaaacuguacaagcacuuggcauacauuacuucauuuagcccccuuaauaguaggaaaaguaaucgcuacuuucuccacuuuauaaaaggaaaaacuaaggcuuugguuuugaacaagcuaaaauauaaagacagaacuccgaacucuaaaggaagaaccaaaaccauaaaccaguaaccaaauauacuguucucgaugagaggauucagugguccggccaaugauaaguguauccucacagccccuuccagcucugaaauccauggugguacccagucauuuuucuaacccuuguauuaacaaaacagcuccauccucccuuguauacaccauucuuauaauauuugggucaggggaguaggucacucuuaauuuccacacauuucagaggauuaugacaucauggccaaugucuuaguuccuaccuucagacacugucccugaguauuaaaucuuguguauauuuguauugguccuaaaauuagaaaaagaucugauauugguuuauauccugaaugauccgcuccuccauacugguuaauaauaacaguaauaagcgcugccauuuacugaauauuaacuauggugcuaagugcuuuacaaugauccuaugauaaagugggcuuuguuacugucccauuuuacagacagggaaacuaagccuuagagagguuaaauggcuugccuuauuuuacguauucauuuguucauugauuugauaaaggaauacauuggagauuugaaucgagguuuuccagacccuaguuuaaaucaagacucuguuaauauucuaaaacaguugauuaagacugggcaugguggcucacaccuguaaucccagcacuuugggaggcugaggcaggagaauagcuugagcccaagaguuugagaccagccugggcaacauagugagaucgcaucucugcaaaaacuaaaaacauuagccuagcaugguggcaugcaccuguggucccagcuacuugggaggcugaggcaggaggaucucuugagccaaggaagucaagucugcagggagccgugaucacagcacugcacuccagccugggcaacagagcaagauccuguuuaaaaaaaaacaaacaguuaaucagcacucucuugcuaguaugacuuugggcuaauuaguagccuacaucuguguaucaguuucuugaccuguaaaaugguguaaugauauuauuuaccuaaauguugugguguggauuaaauuauuuacuaaguggacaaugcuuagaauagugcuugauauauagugaguguuuaguacuaggugcuauaaaauaauaaucaccauuaauaacaauauuauuauucacuggauuuuaauuguugaaauggcacauuaaacaauagagaagcaaaaaguguccccucacgaccuccuccuuccucuccccagcaugagccacugaaaccaguuuggcagauauccuuccagaauguuuccuauuccaucaaaaacuauuuuaaaauuguccuuucauuaauaaaauacagguugagagugaaauuuuuugcaguguucuugaaagugugggaguggaaaggcaggaagggagacaauucacucauucagccaauaccugucaaaugccugccgcaugccaagcagccacaaaaugcuaaggauucggcguccagcauagcaaaugcucaacuuccguuuugaguguuuacugauuuucuuuuuuuaauuuuauuaggauaugauguuucagcuucuccgaggucuggacuuucuucauucacaccgaguagugcaucgcgaucuaaaaccacagaacauucuggugaccagcagcggacaaauaaaacucgcugacuucggccuugcccgcaucuauaguuuccagauggcucuaaccucaguggugagugagagagugcuguccuuuuauuaaacuuauuuuuccuauuuugaaugacagucugucccucuuccaugucucuaauguuaguacugcccaugacuaguugguggauagaaugucuuugcccauuuuuauauggcaguggguaggcagaaagcauucugcuuacagcuacagucacauccagccugggcuuguuguggacaggauccauugcagaaauagccuguugcaucuuagccacuggacaggaaucaguuacaaguuuccaaaugcuuucugccauaaccacuguuuucagagcuguauguacaaugccuagggaacacacagcucaaggucagggaagaaagagcacgagcaacguugaccugucugcagcaucaugguuuugagaaacagagugccuacacagguuuguuaaugcacucaucugaagcuauggugccagcuguaaagaagaaaucaaauucacagugaacuuggaugaugcaugaacguagagcaccgccaugccaggugaaggcucauauaacccugaauagaaagagcgaacccaacggcccuguuuuggcaaaaaauaacaguuaugauacccuguuucuuuuugccauucagcugcaaaaccauaauagcuauugacauugguuagcuucuauuucuccauauaguucauuauuucucagauggauuuuugugaaauucugcaccccaaauacaaaaagagcagccuggaaauagguauuaauacccuucucuuugaaagaccuguuuugcauacaguaaauucaugccuuacguacaguaaauuaaauaaauaauauauagcaaauuaagucuuaagaaaaagaauuuuaaaaaagaaaauaucuuuguauauucaaagaaauaaaaaaaaauaauccguauuguccaucuuuagccucaaagugguucucacaucagggacagcauggcccuguuguuaaguaaugauuggcaacaucuuuggucauucugcacagcaaaaaauuguuucccuaaauuucaguaauacuacagcugauaaguagaaauucaagagaggaguuagaaauucucugagacagauaacuugccuuaggaaaaaauccaauuuauaaaaguguuccccacccccugcccccagucaaaauaggggugcuaccaccuagacacguaagaccaguuacuuuccaaacauuauagacuuuuccuagggcaucagaacuuuugaugcagaggauuccuuggaaaauguugccauuguuagaagauaaauccuacucauuuccucuuugcccagcauacaccauugcuuuagaggagaaauggcacgaguugauguuuaaaagauaggccucagcuuugagcacggucaagcaagcccuuguauucuuauguaaucacaccagaaagggcugagucuguguauuuccccagugggaagggugagguaggcuuugaguuucccuaggaaguuguugcgcauguuguuuuggggcccuggggagaagcuugaauaggcuuugugauccagagagucaucaggggaguagauggaaggaacuugucuccuuggguacguuaauugaaggaaggauaagcuguaacugagauggacgcuuuuauuuuaauccccccaaaugggcacuaauaaccauaaauaaaaacaggaaacccaguugguuuguguuugauuuuuuuuuuuuuuuuuugcuuauuaaauuugagcuugugcguaacaucaauuaacauuccauucuugcugaaaguugauauguucaaacaggaaaauguagacaaauuauuucauagaggaaaaggagaaaggcagucauaaauacacaauuuuucaguaucuaguuuauacugcaugcuuuauauuuccuauagugacauaaguaaaacauguuagcagcugagaaggauucuaaaacaaaaaucagacuuuauuggaaagagugacgguuggaauuuaaugguaauaauaaaggguauguuccuacaggguacugcauuuuaaaauuuccccacucuuuuguauuuuucuauuuaaaggaaauacccauuuaauauaguaaugcgucgauuuauauacacauggugacauaaaaacuuggaaucauaguuuuuuagacugaacugguauguauuuuuagugucucuugaagagaaaaagacuacacuccucuuccuggaaauacacauuuuuuaguggguuaugucauacaggaacugagaaucaacuuaauuuguggaauguuaaaggaauuacaaguuaacugauucaaaacugacaucuuaaaacuaugagaaaugcuaguauuuuacuuaccuugcaaagccugacuccagagguacccuuucuaguauccccuucagaaauuaauuucuuuuuccucucuguuuccagaguaauauuuuggguuuuuuuguuuguuuuuguuuuugagacagaguuucacucuguugcccaggcuggagggcaguggcccuaucucagcucacugcaaccucugcccuccgaguucaagcgauucucgugucucagccucccaaguagcugggauuacaggccaccccaggcuaauuuuuguauuuuuaguagaggcaggguuuugccauguuggccaggcugguuuugaacuccugaccucaaguaauccguccuccucagccucccaaagugcugggauuacaggcauaagccacugugcccagccuauaauacuguuuucugucuuguuuuuaguuauuugggaauuuuauuuaucaggccauaaguuccucgaaggcagaugcucaucuuauucagcccuaacacacagugccuuguuuauuuugauaggcacucaggaaauauuuuucagugaauaaauugacaaaugcugacuugcagauauaagcaguugagucauaacaggaauagagaaggagcuauguuauacauuuaauggucucauuugaugugugucaauauuccucauagcuaccugguaauauuaagcugaaggacuuacuccauauaccuuaaaauggcugaguccauuuugcacccuaguccugauugauuuauuggcagcacauaucuguguucaaaaucaugaaagcuauuaauacaugcuguagcucaaucucaaguuaggagugaaaaguugacgcaaacccaaguucacagucuguguauuguuuuuaucauaauccuuucuacugccucaggaacaaauuacauauaugaauugaacuuccuguccugaacagaaagcuguagagauagaggaauguagcauuauuguaauuuuacuuauuugaagacuuucuuuagccccuuguguuuuguuauuaaagcaaguuuuagaagaggagucauauucuucuaagauaauuaacauccucuaaaugaaagaaugggugaauuacuagacaacuuuuacuaucuauguuaauauauauauauuuacauaauaaaugauauuucuauuugaacaauuauaaaagcuuguauuauuagcuucuuucugaaaacuucaaaauguucuuacauauagaacuuugagggagcaguuaacaguauuuauuuucauuuuaaguucaugaucaccugacagauccugaaguacuacuucuccuuaauuucugagccaguaugcucuaugccaguauucaagacaaggcaucuuuuggauuaauugagaaauuaguuguucuagacagguaagcuuuccaggcaucuuaagguauaacccuuuauauuaugaucuuuauuauuuuauuuuucuagugaaaacaaguuucuuguuaagaaacacgaguuucauaaguagaauauacuucauauguuggccuuugguagaaauuaauuuaggacaguagccuggaccauaguuguagcuguaggugguaugcaacaucgggcugaaugacuuaucuuguccucaucugauaaauugaggacuaaucaaagaguuaaaugucuuuugccuaacuuugccaggcugccuccaacaugacauucuggugucuuuaugggguauuggguucuugcugcucaauauagugucuuguaugcacauguacccauacagaguauuauaccuuuuucuuuaaagguuguagaauuaagauguggaugguaacaguguuugccuugguccuaggcaagaggggccccugaccuggaucucaugcuuuagagaagccuacacuggcccuacuccagccuugucucccuucauggagcacacaacccagggugccaaggaagcaugucucuugagaccuccaccccugccccauaccgcacacaggacauugcaauucccugacuaaaugggaagggcaugggcucauccuuccuccuaauagggauuuugccacuuguguguucacuccuaagccuaggggcagcuguuugcagcauaugggcagagcuuggacuugcagacuggaguguccguaagcauguguaugaggccccuugugguucaaagaaggaguuggaaaugugaagagaaguggggccuguuauauuuaacaccuggcauggguuauuuuuaucagaaaaguuucucugaaaccaugaaaaauuaacuucucugaccucuauugaacuauuacauuuguucucauuggaaaaccaaugagaacagguuacagggaaguucuuuccauuguacauagcugauagguaaaaaucaugacaugugaaguuauauaaugucucuggcaaaaguguuucaagaauauacaccuguucgguacaaugacuguugugacuagcugaaacuauauuuagagucacucugaagucaacauuucuaaguccuucucaugugaaauguagugcauggugcaacuuauuuuugugaagauaagggaaaaagagaccagccacucagccagcaauuucaguccuaccucacugugcacccgggucugacaugucuuagagcagagccaggaacaucaucagcagcccuggugagggcucugacagucaugaagcacugugaccagcaagcucaggaagggagcagucuugucuucccauuuaugaugcaaaaucuuuaauuuuuuuucuaaaccuaaucauacagcuuggagggugauauuguugccauuggauuuggugcucuuggaacucuuuaucaaccauuucauuuugaaaaguggggaaacugccauucaaacaggcagugugaccagcuuaagucugaauuuaccaaauagauuguaaauggcuuggagaauucuaauguuuauauucuggcucuggcccacuauccccacuccucuuuucuccauaccaaaaauucaguacccaagaggguaucaaacuguguucuguggaacucucagauucuacaaaggguauuuagagguuccacaaauguuuaggaguccauuuuuaaagaauauuuuuuaagucuuguuaaaauaauaaaaccaaaaacagacaacuagcucaugccacauuuugacacagugaggaacacugggucaugaacuggugccuccugguuuucuuuuuuuauguagaccucaauaaaacuuuugccacauugugcaccugaaugucuuauaaaaguaucauugcuuaggaaaaaugaagcauucucuugauucaguccuaucuguguccucucccuuaaaaucacccaaguccauaauugcaacagcacauucauugugcugcucucaguguacaugggaauacuguaaggaccacccaaggcaaugccaguauugauguuuuuauaccacaggugauugccaacacccaggcaguuagagccagccacuccccaggacagccaucauaaagccauccguggguagagagaaguguacccuaaaaugaggucauucuuuuugguaccucaguaucuuuguauuuuuggggccuuuauacaaucauuuaaugcuauucaugaaguuagcauuuuuccuucaaaugccugugccaaacacaccuguauaguuuagagaaacauuccucuuuguaccauaauggaagagugggaguauguucccaucuuuuuagugacuuaauaaaauucucacuaagugaauuauauucucuuucuccaagaaucuuuuuuuccauauuaccuucacuaauaaaagauauacauguucugaaaacacccuuuauuccauagaaauuacaaaaagacaacaaguaaauguuaaacaugagaagacuuuuauucgacagcuguacaaaguacaaaacuuaauuuuggaaauuuuuuuuuaaaucuguaacugauaagauucccaauauugcuuuauuugagaucauuaacuuauuuaauaccagaaguauuacaaaaauugccagggaaagcaucaggaagaauagcuaaugaauacuggacuugauacccaggugaugggauggucuguguagcugaccaccauggcacacguuuaccuauguaacaaaccuguacauccugcacauguacccuggaacuuaaaguugaagaaaaaaaaauuacuuacauccccuuccugugccucugaugauauuccuuccuuacucugaccucaguguugauagcauuuaguaacacuaacggaaccucguggauucagaaacuuugauaagccuaggggagaaaaucaaugaaauggaguuguggcuuucagucaacaaauaauuacugaucacuuucuaugugcagacgcugucagugaagcugagggaugauggugaauggaaauggacaaggucagagagcuuacaagcgagauggagagauagaucugaaucagauagucacacaaagaaaugucuaguuagaaacagagauaaaugcaauaaaggaaagggauaugguuuuaugaggccauaugauaaggcucaagaaccugccuaggcuaagggccagggaagcccucccuccuuacccaggucaaaaugugggaugcuuaaagaggucaccagcauccuccuguugaacgcgccuggaugugggcccugugaaugugcgcgucaugcaauucgugcuugggguguguguguguguuuggaauaacucauuccacggcacccaguuggcaccaccaagugacaaagugaagcaggaccagagaucggagaacaaugucaucuuuuacaggagaaaauaaauuguuuaugcuuguuuccucuucgugcguguuguauuuacuauggagaccuggcaggguuugugccucggcuugggcagccgaguagcucccacagaagccuccaaaagcugccagugcauacugaauaaaucaaaccaagaacauuacaugaguauaauggaaaaaacccaaagccccgucgccucggcaccucagcgaaagugcaggacacaccucugaagcaggaagggcuccugugacuccuuccccucucaacaucuugccaugacacaaccaggucuguuuuguuaaaacauccaguugccaguacauauuucauaguuaacaauggaggguuugugccgguuucguuuucacuuucaccagugagggaaguggaacacaaugggggcagugcacagagcugggaacaggacacguuuucuuuaggauucccagggcuggguacauggaaaaugccagagccaaaacaaacaugaaaacccauccagauucuccacugcgcguucucagugguaauaaaacacauuugaguuaccaucugauagguuagcucugccuccacggugaaggcaaauaucgaugaccacugugagaauuucugccauguagaaagagaauguauuccauacugcacagaaagcugcuguuggugcaugugcaugcauguggcuaucuaauugcaccaaguggauuugcgaagugaaucaaaugacugauucccuuguuuauaaaagauagucauucauuugacucaccuaauucuagcuccuucauaaguggucacuguugcgaauuaguucuggacaaaaacaguucaacuguaaugcuacugccuggaggauguuuuacucggagaaagagccagaaguuccuugcuuuuuuccuacauuuguucagccagcaucuaucaggguaugauacagagaaucugguugucugucuuucuuucuuucuuuuucuuuucuuucuuucuuuuucuuuucuuuucuuucuuuucuuucuuucuuucuuuuucuuucuuucuucuuuccuuucccuuccuuucuuccuucccucccucccucccuuccuuccuuccuuccuuuuuccuuuccuuuccccuucuccuuccccuuucccuuuccuuuccccuuuccuuuccuugaccaggucuugcugugucguccaggcuagagugcaauggcacagucauagcuuagugcaggcuccaacuccugggcucaagccauccuccugccucagccucccaaguaguaggacuacagguucacaccaccacgcccagcuacguucuuuuuuuuuuuaagagaugggggucucauuauguugcccaggcugaucucaaauuccucaagcaauccucuugucucagccucccaaagugcugagauuacagacaugagcuaccaugccugggccuguuuuucauacggacacccuauaugaugccauucaaaaucucaaaagccugaggccaaacuggauauaaagacuaagcauugucuuaagauuaaugagaccauaugcuucagaaaguuuuucaaguaaagggcuucucagggauccagaagaugaaaaaacauuuugccuccuacauuuaacauuuuugggaauaugccucugugcuaguuuaggggcuucucugaagaguucuauuuaaugagauaauuccaucuccccuaaauuugcuuaacucaacgcaaguguuauauucauacucauaggaguaugagacaugguccuuggaauugaauauaaagcaacauuucaauaauuuggauuuuuguguccucuuuaauucuuuggacacgugagcugcuuguauuuuagagcugucacugcuuccuuuuaaggaaaggagagguggcaauauuuugcuuaggcuuugauaauaucauaguguaaguuucugagucaagauaauguuucucaaauucuguaacauuggccauauccauuuuuauucacucaguccaaauaauguauuuuagcauuuccuacagugccuuccuugcacgaggugggcacuugaguacauggugaaugaaugaaugaauccuuacgauucuccagugccuagagaaugaacuguaacucuacagcauggcauacaaaguuuuuugaagcucagcuccaaccuaccuuucugucuuuccaucgcuucuacccaaagugguaagcacauaacauaagcacauauucuuuaucaguuuuucacuauucuuugaacuuaauugcuuucacaacucccugcuuuuacaaaugaaucaaugaauggauuuccuacucugcauucuccauguugcugcuugugucauugcaucaucaauuauaagcauccaaaaaaauuuuuuuaauuuguuuuagacacaacuuucaacuaaucuucccaauugccugcgucacuccuugauaauaacuugagcucugagggaguaacauuuacacuuugaaugugugucugggcagccauucauaaccuucagauaauuauugugcuucaucccucuuuauuugagaucacaaaccuugccagaucuccugacuugugcacuuagauguucuguauguuaugcuuuuauuuuaaagcuaagaucccuugggaucuuuggagaaaccauagugucccaagaagggguugaaaaucucugcauugcaguuucccuuagucauuuuaucuaguccauuuggguccuugagaagauuaaauuuaugauccuguuaucuguguaggucucuccaaaaguugagcucagacuuuuauacaauuacuuuguagugccggauuuucugaugcauuuauugacuuuauugcuaaucuucccaaugcauuucuaaaugauagucuuuggcugcugaaccauuccucuuauugcuccugcuuucugcuuucccccucucuagggauugaaacccagggugagugacauuguugcacccagcaucuaucuacaaggauacugaugauuuuuaaauccuucauaaauuugaauguugaacuuuacuguuggcuguggaggaauaaucuaccuucaaaucucagggaaacauccaaaagagaaaaggggaaagcguaggagaauuuacuuuagcgcugcucauauauuuauuuugaaggcuggcagaaucuaaaaauggggcuguaaauuuaacagcucaaccauaaaaaccccaaaauaagggagaaaaagcucuacuacuucagguuuggauacugauauaaaguuacaagauucauuuuccucuucugucuuaaauucuuuuuaaaaaauuucuagcacuguccuucccuuucuuuuuucccauuucgauuuuuaauaauuacuuuuuuaaauguuaccaaugcuuugaaauguacggaaguguuuuauaaauacauggcuggcauauuucaguugauagauuucauggugacguuaaauacuaucugcaccuuauguaacgcuggaugauuucagugagguagggacugcacaugguaucaguucuugugggaaaauaugcuucaguggcuuacuggcacugguuuuggaauguggcauuuaaaaguaccuuuuuacagugggaaagaauucugucaagaauaaacagucugaccuuguuaaaugggccaaagucugucuguaaccuaguuccagaaaacuagcuuuuacuaguuuagaaaaagcagauuagaaaaagaaaaaaaaaaacuguaaaacuuuuauaaaguaaagcauuuaaaagcuacuaucaagaaugugaaauaaauuccuaaaaugauggucuucacauauauucaugagaauguccuuaccugucuauaaaaucccauuuuugcagaauggaugaaagaucaagacuacaguuagucagaaaaggagauuuucuuuuuccuggaaagacaagacuggcauguagaagggagcugugggaacagccauacaacauggaccacugugggaaacaagcccguuuggggaggugaaggaguaaaaauucccagugacuccccauugcccacacacucaagucuguauacucugagcuccggaaugcagcagucaacuguuccuaaccuuucucuccauucuugcuuucccacccacaccaaacccaucuccacacacccuaugaucuugcuauccagaccuuuuugcuccuucuugaaaaaucaugccauuagauuuuaugcuuccgugucacuaaacauucucucugcuuagauugccuuucccauucccagccuaacaaucuccuacucauucuucaagacucagaugccaucucugaagucugcccaacuccccaggauaaaguuaaguaccuacccucccgugcacuuuugauuugccuguaauauaguaguucucauaugguaguauccccauuuguuugacuucugucuucuauuuuuaaaagauuaacauugcaaaauagccauuucagcacuucagguaacaacacacaggcacaugguagcugcucagugaguguuuauagaguauaugugggugguaaaauaggagguuucugaguagaggagguagaggaggacugagguugggaagggaugcuguucuuuaaauauugacuucccugaaaggugccauugugguuuguaucugcauccaucuugaaauuuaaacaccaagaauuaaacuuauuuuguuagucacuuucauugcuaaaaucuuguguuuauauuuagaagauauucuggaaaaccaaaguuacugcauuuuacacaaaugcaugacuagucagcugguuggauauugucaagagugcacaagaucucagugauacuaguucuuuuuuuuuuuuuuuuuuuuuacuuuuuuuaaauuuugaggacuuaaaacaaauugacuugguauuuaaaguuauauuucuucagcuuucaguacagagcaacagaguaaauggaagcuuaaucagugauacucauucuaaucauaaccacuuuuaauguuaaaugacuaauuuaucaauauuaauuuaagucagggaacauuuuuaauggaguuguaauagaaaccaaaucuuggguucaaaaaaccaauauagcuuuaauaaaacugcauaaauguuuuaaaaaucaaauauguaaaaucaaguaauuugcauaugggcuuuggcaaaguuuuucaaaagcugccuaugcauuuaaaauaugauuuacuagauuaagaugcauuuuaaaagacuuuacagguuuauguauauuauguaaaacuacuuauacugucuggccacuguaguuuuuacuugauauacauucaaaaauauuguauuaggaaaagccacagauagcccauugugaauuguaaaguguuaaugucaaccgggcgcaguggcucacaccuguaauccuagcacuuugggaggcugaagcaggcagaucaugaggucaggaguucgagagcagccuggccaauauggugaaaccccgucucuacugaaaaaauacaaaaauuagccaggugugguggcgcauuccuguagucccagcuacaggcuggggcaggagaaucgcuugaacccaggaggcggagguugcagugagccaagaucacuccagccugggcaacagagugagacuccaucucaaauaaauaaauacauacauacauacauacauacauacauacauacauacauacauaggauuaaugucuaaagaagagagaaacucacauguucuuauacccaaacuguccacugucaugccuuuuauuggcaaguagauguuaaaaauguagcacaauauuuaagauuuugacaagauugaauaguccauuuaaaguaagaaaagcuuucaagagugaccucagcaauuuuacacaaguugaaauaaaaucuugucuuuaucuuuucuuuguauuuauuguucuaucuuuauuucuauaacgacuucuugguuuuaggauguggggcugaaaaacugcauuuaaaggucauguugcugcuacuauaugcacaguacaauuuguauuuuccaucagcuuaucauuuguaauuuuuguacuccuguuuuuaaaggcaucaaauuuuuucaauagucgauuguaguucucaaguauuguuagucccauaauauuuuagaaaaauaagauauucaucaauugcuuuauuuuuaauucacaugcauuuacucaguaauuuuguuuuuagaaauuuggucuuaguagacaauuuuuuagagagaaauagccccauuuauaagauagaguucaccaaauccaguggcauuuuuugcagguucuuccacauucccuuuguagcauuuguauaugcgaguccccgcucccuuaaacucucaugguucuuuuuuuuuuuuugggacggagucuugcucuuucacccagaccagacugcaguggcgcucucucggcucacugcaagcucugccucccggguucacagcauucuccugccucagccuccugaguaggaggcuaauuuuuuguauuuuuaguagagacaaggguucaccguguuagccaagauggucucgaucuccugaccucgugaucugcccgccucagccucccaaagugucacgguuccuucuucaguuuuuuugucugcauucuuuguucauugcuaaaauuauuuuaaaauuugaacauuccaccaguguggugguuaacgcauguaauuccaccacuuugggaggcugaggcgggcagauugcuugcacccaggaguuugagaccaaccugggcaacaugauaaaaccuugucucuacaaaaaauaaaaaaauuagccaggcauggugguaugugccuguagucccagcuacuugggaggcugaggugggaagaucgcuugagcccaggagguagagguugcagugagcugagagaucaugccacugcacuccagccugggugacagauagacacucuaucuuaaaaaaaaaaaaaaaaaaaaaaaaaaaaaaauuugaccauuccagguagguaaaaaaaugaaaagggaaaauccucaaugauccuuccuuccagaaaaaaagccacuauuaacaguuuguuaaaugaacuuuuauauuuuuugcuacuuguauacaacccucaguaugggugugcaugaggguggauguggaugugccuauaauaguauacauacagguuuucuguuuguuugggauuucuuguuuacuuguuuccauuuauuuauccuaggcauuuuguccauaucuaacauauauuagccuguuauucuuuuucuuacuuucacuguguaaauuuacauaauauuuuuacccagucucccaggaugaacacuugggugguuucucauuuuuuggcugcagugaacaucuuugggcuuauguuuuuuucacugaaauacuaauuucuuuuaggauaauuauuuaagaaaugguacuaccaggacaaaggacaaagaaugcacauucaaaaauuugauaaugccaaauuguucuccaaaaggguuucagcuccuacuccugcacuccuuaacugaaugugagagagcucacugcuuugucucuccugagugccucuggccauugccuuugcuggcgcuuucugcucuuccuguccucuaauaaagcauccagcauguucugacuucagcccuuucugugucugacucagguccauggcuguaacuuucaucuccgugcagagguguccaagucauccgucugcccgggucuccucugaguaucagcccucaucucugcuuuuccccaccucuccaucugguguuccauggcaguagaaacagaucauaacaaaaagaucacucaucagcuucuccuuuccuaggcaauucugcuuuggucuccuuuguuuaacuucauuacugguaaucaccaaagcuagaaucuucagauuuuuuucuggacccauuuauagcaucauauauuuaguuacaaguacaaaauauccaaucaaagugucuugaauaauaauaacguuuaaaucugauauaagaagucuggagauagguaauucugcaauuggugcuguugcuugaugguaucaucuugguuccgauaaccgaauauugggaaaauaccauuccuucuucuuugguuaguugagagugucaucccucagggccucaagauggcugccacaacuucaaaagcauuauaucacauacaacaguauucuaagcaguaggugaggaagcaggggccaaaaaggguuuuauugucucuuuaaucagggaagacaaucuuuuccaaaagcucuuuucaaacuuccacuuuagguuucaucacucauaauugaaucccguaccuacccauugaccaaucagucuguagauaagcauauugcuacccaaaagaaaaucagguuaugcuagccaggaaagcaggggauggcuguugggugaacaacgaauguacaggcccuucauuagucuagagauacacccccaccaaggcagcagggccacuguauagguaggaacaucugcuguugguuucuuucagaggcgcacugauauauucaccaaucucuaauaaaauguuuuauaaagcacagugcauuuuuccuuacgugcuccacauauguugaaagcagaaagcuuuagaguuucauggaaauguugauuagacuaagaaugauugcuuaccacacccaccaggacuaugauuccuuagauuccuuaauaauagcaaucagcaaacacuuuuugaguaugagccaucuaucagcaaucagcagguaacauucuucucaggcaaauucaggaagcuaaggauugcuuuuaaaaacagugaggcaauaagaaaaauuauguuaaacuaagaacuuuuaaaaagaugugaauuucauuaauauuauuuacguaauuuauauuacauaaauaguauguuuguuauuaauauauucauaugauuaaaaguaauauucaguauuuggaugcauaaauaaaauacauauauguauauauguguauguuuuuuuaguuacauauauguauauguaaaucugaaguugccucuacaacucuuaccuagccagauaaacccuggugaaucuaggagacaagcauuguuagaucuaggagagucagggaaggcuucucaggggagcuaauuuuugaggcaggcuuacaagugaggaggaguuugccuggcaaagcacagggaaagguguguucuagguaugggguugagaaacaucagcucauguucacacacacaacggcaaagcagcaagaaguauguggguuguugagcagagugcuuuaaaaccuuuuuuacccuaaaaaaaagcagucuacuacaaugugaugaguggauugguagggaggauuuggugugaauuaagaaauugauggcagggaaaccagcguggaggcuguuuuaagaaagaugugugacgaggggcuacgugagagcaagaaugagaugggacagaaacuggaggcuguuaaauguagauccggggaaaacauguucaugucaaaaucugauaugaaauuuacuuuaugagauaaauaagaaauaaaaauauauuuauuuaaaucaaauaagugucucuggucauaauugccuucauacuguacuguuguggauguguccugacacaugcucagaacauaguagccacuacugauguaaucacuacuauuuuuacuggcagugguauugaauauguauaguaauuucuccugguaugauuaacauuuucauucaaaacggaacaaauuguauaaugaagaaucucuauaugacaucucacuaguaguuguauaaaucagaaauuuucuagugguuuaauguuuaucccaauuguaauucagaugaaucuaucaugaaaugacuuuuuuuucuuuuacaaacagagccuuuuaaaaaauauauuucuuuuuaucaggacuuaaaugauagauguuuuacuuuauugggccuaaagugccagugacaugguuauguucuaauuaauuagccaccuaucuuucuguuucuccuuuuuccuccacauaauccagauuuugcuaaaguuggcaaauuguauaccucacuuguggucguuauaugacuaaacccuaaugaggguuauguaauguaaacagccacaaaauaccauaauuuacuuuuuuccuuagacaacaagcaccuugagggaagaaacgggcgucacauagauuaugcucaccaaauagcaauugguaaugaugaugcacuuugaagcuguuuaugucuauuauaaaaguaauauauacucauuauagucaaauuuguguggucuugguuuaucuccauucuccauucuugguucaccucauccauucauuucucuaaaaugguaacacagauuaguuucucaauuucaaaagucagauaaucaaacugggguuucaaagaaaguuguaaauuaguaaagaaaagcgucaaauuuuuuuucagcccuuuuucgauuuuucucuccuuggggcuaauuaccuucauucacccgucuucccucacuauuccuaaagaauaacaaguuuagaaauuagauauuggauauaauccaguaagagucuguucaguuugaggauuuuuuaaacaacuaaauaugccuaaaaauuucaucaucaccacugugugucuuccuccaucugcucaucugcugcccauaauaucauacacuugauaauggcuguuucucuuaagagaauaaugucauguucuugaggccagagauuguuaaguuggaagagucugggaagacagcagaauuuaaaacauuauauaccuagcauucuuucuaauacuacauuuauuuaucuugugagagagaaagagacugugagugugugugugcgcaugcacgcacguuuucuauaucucaucagguauuugugaauaaauaguucacacccuuccaagagaauaaguccuuucuuuucuuuaaacagugacuccauugauguuguuuuagaauuucuucccuuguuucucacuuccuucuuggcaacauuguuucugaagucuugaauugauucaaguguuccuggaauauuacuuuuucucuccuaccauuuucaaauauaggcaaagagauaauuuuuuugaaaaacauugcuuccuucaaaaagcaguauaacggcuauuauacacaguauaauaccacaguacaugguuaaagggacguauucuggaaccagaucuuuuauacaaaguuauuuugcaacuuaacaagcugugugaccuuaaauaaguucuuuagccucucuguauccuggguuucuucucugcuaaaauagagaaaaugacaguaccuaucuuaauaggauuguugugggaauuaaaugaguuaauacaugaaaaagugaaguccuauaauuaaauuauguaauaguaauacucaucuuugaaccugaauaugaagacagguaaagaaaugaauauaaaccaaugaaaccauuuuauuacuguuaaucaguuacuuagaaaucacuuuuacuaaaguuuagauuacuaacaucuuagggagaccauucucucuuuuuucauuauuauuucucaaaagagagaguguuucugguauuccugaaaugauuaugcugaagaaaucuuuccauuaucaguuauuuaaacaauguugaagucuggggaaaaauaaaauguauuuuuuccaaggcuacacacguaucuauucuucgaauacaggaaauugaaugcacaaauccagacaguugcagaauuuucacugagaaucuaagaaugaaucaguguguuauugugaauggacuguauaggcaguauuaauugcuuugcuuucaggcaccauaucucagugugagaucucagagucccagaaauccagugguguuucuucagucuuuguuccuugcuuacuuucaaccacuaggcaaguaguugaggauggcacagaaaaauugaguuguggcccuggagcacagaccuucaugguugugcuuuucuucuuuaccacccacaggacaaauucuacaaagacaagaaaauuguuuuucacgaaggacauuuuguguauuuaaucucuauagaguggaaggcagaugacuggaaaguaacagcucauuaauuaugaaaguaaauuucuuucccuacuguagucaaaauuagcuuuuuuaaaaagacagggucucacuguuuuguccaagcuggaaugcagugguacaaacacagcucacugugcagucucagccuccugggcucaaggccauccucccacuuuggccucccaaaguucugggauuacaggugugagccaccacgcuggccaaaaugagcauuuuaauguuauuucuguacugagccauuuuguauuccaccgaucacuuccucuugggaauaggugguaguuaauauucagaaagguucauuucccaaauagguuagauuauucuccagugaauaagugacucauuguacuauggauuaggaauuaaugucacagauaacauacacuucuuucacauagucugcuuaagaugugucauauaagaacucuuucagcuauuaaccuuucaagaaaguuaaaagaaauuccugaggcuuucagcccagcccuuguauaaccugcacugucuuguuuuguuuuacaaagccaugcaggaaugccccccauucagaaaaggaguugguaccuagacuaauaacugaguagcacauucaaccugcaauucuggaaaauuuguauuuagcauuucauacaauugcuuauucucuaauuuagucuuuaagaacauuugucuuaauauugcucuuaucuaucuagugcccaauucaggauucaguuaagccacaguaccaucuccaaagaaaacguacccuggcuuuuuucagauucaagguaaaggugugguuuggccacauaaguaguguuguguagaaacauaauucaggagcuucugcaacaugaccugacugggauccaccuuucuuuggaugcuuccugcucugaaugcccacagcacuucuuaagccacccaauucauccuuuacaugaaaccuuucacucucuacuuagguuucaugugauuuccaaguuuuuuuaaugcugcucaaagcucuuugagaccaggaacaaugauuuguguuugcuaagcaugccuuagcauggacccaaaacguaggagaagguugguuacuuggugaacaacuacuuguuauaugcuuccucucuuggugccugaaggacaucguaguaaaaauacuuuggauauucuggauauuuuguuacuauuuuguguauauauggaauucuaaguacacaguauacuaaugagguaaagaaauuuucacagaagcaaaaaccaagagaguuuaccacuaccaagaauuuucuaaaggauguacuucaaaaagaaagaaaauaaucucaaaaggaaugcccgagaugcaagaaagaaugucgaguacauagauugguaaaaauguccaaacagauucuuaaucacaguaaauguaaauggacaaaacucaccaguucgauggcaaagaauguuagauuagauuuuuaaaauauuucucuaaaaccaagucuuugcuuuuucaagaaacaccuaaaacugauccucuguugaagggaacauaaaaugauacucuacuuuagaaaauaauuugguauuaacuauacaguuuaacaugcuuauaccaugaaacccugcaauuccaugccuuaaguuacauaccuuagagaaauuccugcacauguguaccaagagucauauucaggaauacucugcagcauuguuuguaauaccaacacuccaaacaacccaacuguucauauacaaaggaaugauuaaauugacacugguauauucccacaauagaauuacacagcagugaaaauuuaaaaaugaaugagcuauagcuacaggcaauaacauggaugaauauuagcaauaauauugaggggaauaaaacaaaaaugaagaaaguuauaaagcauaugaaauauguauaaagcaaaucuaaauauuauuuagguauauuuauagauuaacauuuuuuaaggaaggaaaugaaaaacaugagacuuaggauagugguugccuguggggguaaagagaaguaaagaagcaagggaauagaauuagaaauacagaagaacaaaagagagaggagggcucugagcacccaaguagcuaucacaucauuaaagccuuaugucuaccucuugaguucuuauuuagauccauacucuuauuuaaaauuucuucaaguuuugcuauaguuucugcuggccagucacugagcugagaguguagaaauuaaugauauauauaaaaucuccccucauucuugucaggaagguguaugauaaacaaauuaauauauuagauaaaaucucuggggcccagcagugcaauagagugcgauacaccgggaaucuauuuuagagggggaggguggucaaagaaggucuuuugcguaggagauagggacagagcauccuaagauucaggagagcauucuagucacagggagcagugaauucagaggccccaagguaggagggaguuuggucuguccaaggaaagcaagaaggucagugcagcugaggcagaguaaguaggaaggagagaggucagggcugagaucagggagguagucugaggccccucugugggggaccugauaaauguguuugaauucauuuugaaguguaauagguccauauuagaagcagaaacuagaaaaggaguuaggcugauaaacauagggaucauaacagcaggaaaaaggcaauugauaauaagacacaagcaagaaaaaauucaagugauuaaaauaauacacuugcagagcuuacaaagagaaauguaaguaauccaggaaaucuaguuacaucuaagucuucauucaucuuaccagauaaaugaaauguuaaaauuuuaguugcuugcauacauaacacacagauauucuuuuauauaacacauucaugucauaaaacaugugauguuuaucuagagaauugagaauacuuguuuugugcuuuacuuaaccauaggucauauuauaaugauuaaugaggucauuugaaauguauuuuuaccuaucuugagauuugcaguauguguaugaaacaugucauaucauuaguuaugcaguauaaaaagagaauuuuuaaaaauaugucauugcuuaugacuaaaauuaugaucagaaguggauuuaucugugucuaaugaguuuuaagcuucagagcuccucacuuucagcucccaucgcauaccaagguuaugggagaggcucuagcaauauggucaucugguguuuuuuuuuuuaauuguggaggugagcuauuuuaaaugcagcugauuaaccuuccaccucacccaucacaguucucgugucagguggcaauggagugaccaugggcauuuuugagaucuggcuaaggggauguugaguucauuuggguuuuauaagcucuauaugggguucacugguuacauauauaucagugggucucgauuagggaugauuuuaucccccaggggacacucaucgaugccuggagacauuuuggguuguuacaauaugggggagagggauguugcuacugacauccaguggauggaagccuagggauaccauuaaacauccuacaauacacaggacagcccccugcaguagagaauugccuggcuccaaaugccaaaagugcccagauugagaaaccccuuaacauaguuaugccuggcuacccccguguagaaauggccuccaggaauucacuuccaccagcacugugcugacuuaccugggauucagaggucauuucacaauaugaccauguccuauggucucuggcaccaaagucuguggguaguggaggagaaacaagguuugaaacauacugagccaaaggcuagucugaggagaauucuucaaggcaacagacauguaccuugaaagcaaauguuucuauucucaucaaugccuaguuaagauggaaguuuuuucauaauaagaaaauauauuugaggcugaccaugguagcucaugccuguaaucccagcacauuagggggccgaggcagguggaucaucugagcucaggaguucaagaccagccuggccaacauggcgaaaucccgucuuuaccaaaaauacaaaaauuagcugggcauggugguacacaccuguaaucccagcuacucgggaggcuaagacaggacaaucacuugaacccaggaggcagagguugaagugagccgagaucaugccacugcacuccagccugggcgacagaguaagacucugucucaaaaaaaaaaaaaaaaaaaaaaaaaaaaaagaauauacuugauaaugcaacauauuuaaugauagaaauaaccaugcaauuuuucuucuauaaggaaagaaucagccuuauaagaaucagccaaaauagauuuuaucaauauucuauuugauuauggcuaaaaccuguagcacuaccaccaacagugaucacaugugaagugacauguuuucugcaucacagcuguugauaaaaauaaucuuugaucaaccauguuaucuuccuguagaaaauauuucaaaaauugcugucagaugaaagacagucaacgaguaugugcucaaaaauaacacagggcaagugaguuuccuaguggagguguccguuuauuaaucaaaauauugugauuuuauuucugcauuuugugguauuugucagcuuuuuaaaagugugugaggugcucgcuucggcagcacauguacuaaaauuagaacgauacagagaagauuagcauggccccugcgcaaggaugacacgcaaauucgugaagcauuccauauuuuuuuuggcugggcgcgguggcucacaccuguaaucccagcacuuugggaggcccaggcgggcggaucacaagguuaggagaucgagaccguccuggcuaacacggugaaauccugucucuacuaaaaauacaaaaaauuagccgggugugguugcaggcgccuguagucccagcuacucgggaggcugaggcaggagaauggccugaacccgggaggcggagcuugcagugaguggagaucgcaccacuacacuccagccugggcgacagagcgagacuccgucucaaaaaaaaaaaaaaguguguaagcuuuagacuucacaaaccagagauugccccuguuaaugauaauauuguuuguauuuuaaucaagugaauaaaccuuugaaugugaauuccaucagugcaucucuacaacauauacuugcaaauuaaucuauauuuuucugugcucaucuucacuucugagucuguagccuuggagucagugcucuucuaaucucacuaccugggcgcuugaucccauccacuuugauccucuccggauccugguuccaucaugucuuugcugcccccaugccuucaagcacagucuguacccacuauuuuccaaagaagccuuaaaggggccagagguucugggcagaguuagaggcaagugggaaaggcaugguaggcagagagagcagcuucaguugucucugucgucugccucuuuucuucuguaacuaaggacuucacucuggaugucauuaacccuucaauuuugugcaggcagccuucugcugccaucauguuaccgcaguggauauucuaaagaccucaccuuguuuggcaucuucggguacaugcaugcuucucuauucguuauuucuuguaaauauccaccuugacuucugugacaucgugguauccugcuuuuccuuccacgucucucacuccucuccacugauugcccaccucugccuuccucaaagguccugcccuauggcacauagccuguacaugcuaucuccuucaacagucuccuccgcuguggagguaauccuggaggcagggaacucauguauguccaacucgguccacucccuugagccccagacccaaauaucuuucugaauaucauccuaaguagcaagccuuccagucauucccuucugggucccuauucaggcugauggccucaccaucuaccuggccacccaggccagaaaccugggacuuauccuagauucaguuaaucuuucuuucuccuucauuugacucguuuaaaguuauucuuccugccuuuccucuccuacugcugugguuuuauacaucuuccucccagagcaucuggaucauugcagccuuuucauugagaucccugccuucaggaucaucuccaauuucaauccuacacaguuaccagaaugcaaauguagaauaaugcauaucugacauacacgcccugcauaaaacccuuuaguaccuccccuucuccucaggauaaaguccuagcucugucaaguaacacuugggguccuguuaucugguccaugcaguuucauacuccucaacuuuugcucauguugcucucucuaccagucaugcccuugccccuccucgcugaagccucuaacacuagauaccccuauccugcaccccgccucaccccuguggaguugauguguauauaacauuugcugauagcuaaaguuuauagagccaggcaccugcagaguacuuuauguaccuuauccauauaauucuccaguugcccuauuaagcagguacuaugauucuccaucuugcaggugaggaaacagaggcauggagagguuaagcuauuuagccaaggugauguagcucauaaaagaggagacaggauuugaauccaggcuuuuaaauuauuuacgucuaccucgcacagagcuugugcaauugguaaguuacaugucugccuccucugcucagcugugagcuuuugagaacagauaugaugacuucaucaucugugugucaucuuugcaacugagauccaaugcuugucaccuaguaggcacauuuguauauguaugaaugaaugaauuaauuguugaugugacauuguaaaugucucauaaaucucaugagaagugcuacuaagaauaugugagaguaguacagauauaucuguauuucacccaccauguguauuguccaugaggacaugaaauaaguaaaaaugauguuacugccuuugaggagaauuugguuuaguagaaaaauguaaauaguugaaagaacuuaaauauggagcuuuuagaagccauucugauuccuguuaccaagaggcauuauuaguauuuauagaaaucaacuuaucuuuuuaaagguucaucaugugcuaauagcuaacagcaucagcaguuuaauuauugacuuaaucgaggucuagaguagaggacuuccuaguacuuugggaacuccuggccacuuuucaugucagccuugcuuuaaaagggauccuaaaaugugaaagcuuucugucucucugauagugaacuaaguuauuaguuaaaauuuaucagcccaguugaaguuggcaagaugauucaucuuacauacaucaaauucaugcaaaaggaagauaucaguuacuauuuuaaaugcaaaaauaauaugcuuaaaauauaguuaugggcauacugugguuucuggaauuguccuccuggagaaucauugagacauggucucugauguucuuuauaauaguagcaugcuuauuucauaagccagagcccauauaggaaaaagccuuuuuuccaccaugcaaaggcuuauaacugaaugagaaaaaaauaaauuaauuacaugaauauuaagagguuacuuaucuauuauaacauugggccacaaguugacuaauuaaaaggaaugcagguuggaaagcugccacaaaucugcuccuuucauuuagagggccacaggcugaagccagugauugugcgugacagacucugggaacaauggugcagugcacagaccguccagaugaagcaugcucgucugaauuacaccgacgacaggguggccuacaggcaaacaaaaugguuaaacaauacauaaucaaguuuuuauuugguauuuccugcaaggcuguaccaguugccagggagcguacuguauuuuuucuucggcuguauuaauuguugaccauagcuggcagaaccccaaacagggacagauaagggggaaaauggcaucuggacauuaaagccucaaguguacugggggaaaaaaaagcacaaaaaauuacagcauauaucaggaauuuuccagcuaacgaugugcggaugugguagcgcgagggaaaaagagccaaacugagcuugcuuuguucgcuaagagaggccccccuguaacauuccuuuuagcugugcauauuuuggcuucauuuguacaguuuuaacuuuauacuguguguggaggaguucaguuguaacugguggugccuaauaauucuauugcaauaauuaaaguucauggagagcuguuagguuauuaguucauagaagcugcuucagaaaacggagucuaagcugaaaacuuuuuaagugacaugucauuacuguaaaagauggcaacaauuauuuucuuugauuucacagcaguuuuuuuuuuaagacaagauucauuuauggagacaaauaagaaacaacaucuuaaaagcuuuggguaggagugaggggcccagacugggaaugaugagaauauggauccuguagccugugaauaaaacauuuuccaacuggcuuguaaaacaugaaaauuugugauagcauaauuucaucugcuacuuuuagauuccauuuaaaaugugaaauuaauauauaaauguuaguaaaucuauugcagaaaccaaguauugcagcuucuucaccucugauagaagucauaugugacuuuuaauucaguaauacgaugaaaaaucuccaacugaacacagccuccuucuuaaaagauugacaugccuuggaguccccaauaaaauaguaauugcaauguacaccaauugguuagagcugugaaauauguuucccgggggcuucucugcagugguagagggcugucugccugcaugguugucauacucagugguuacuugcagacucuggaguuagaccuggguuuggauuguaucucugacaaguggcuaguugugggacuacuguaguuauuaacauguuugaauaucaguaucuuaccuaaaauauggguaaaaaauuaugugccuaucucacaaguuuuuauguuuaaguaacauaaaaugugugaaguccuuagugaagugccaggcguacggaagacucuugauaaacuucgacuguuuuucuuuggcuaugucuucucuguugugcagcucugggguuucuuugagcuucucaaaacauuccuucuagucaguuucugcauuagaguaaaauauauuuacuuaaucaccauugacuuccacaauagauaacaaggaacagguuguuuggucuguaaugaaagccaggccgauaguuaugauuacuauuaagcauucuucgagaagcugaaauguuauuaacugucuuccgaagcacuuauuaagagccaauuauuaguccugaaaaacaguucucucaaauauuccuaagaugacuuccagcuauaguauacauguacuuugugacauuauagauggcugccugguaacguagaggccaggcuucaucuccaaaugugaagagaaaauucucucucucauuccugucucauauuugauuggaugauuuuaguaagacuuaaugacuuuuuugcgaaucgguuaaauuuucugguguauguugcuuuucauuuucuucuccagaaaucuuaauccucuugaagacaggaaauguguuaggaguucauagacucugaauauuagaauugcacaauucaugaccccaggauuccauaugcuguccauucaauaaaggggugacacuguccaugaugaucaauguuuagaugacaaacaucuuuaaauccacaaaauuucucauagaccaaagcguuuguucuagucccugacauaucgaaccaguuuuuucaaaguaaaucauuugaucuggucccugacauaucaaaccaguuuuuucaaaguaaaucuuguguccugaaaacauuuugaggccuuaaauaauaccacucuugaauaucaucauuugaguaacuuaguaaagacuauuaaaaaaauacacauauaugguaagauuuuguaggaucuucuuagcauuaagaauaaaagauuauuaauucuuuccccgugaaacaacaacauauaauaauaagcuaaauguggucagcuuugauuucauaacgggaaaacucccuuuucauuuuuacaauugguguuuucucuucagcugcuuuuuaaguuggccuguuagcaauuuagccugucuuuaauuuuaagcaccauucuucuagucaggagaucccaauaggaagcccacucuuguagccucgccucucauuggcuagcugggaaaagagcauuucugcauaaauuggaugcuuccuucuccccuggagaccaaauaugcucauguuucacaauccccugguuuauaaccuugaguccauugccuaaagcuggaaacuuucacuuuguacaacagagcacacuccgaaacccagauccaauaccgcugacauguccgugggucugacagcagauugaauacaugcuucuuucuuaauccaguguuucugagcugcuccaacugaaaucagaaaccgaugugcgugagagagguguccuucaaagaaagguauuuccuuugugcagcuccagugcacacagaauccaagggguuaacgugagagcugcuuugaaaacagaggcgaaggucacuggcggcaacagcaaagacuuuuaaagccugccguccugagccuuucagccugccuuccccacccaggggauuguaaacauuggcucccagccaccucgucccaaagcacaaaacuucucugugcuuucagcauauacauuuaugcuuuuuuauggaaguugaagcagaggcgcauuauugcugugagcccagagaacaugucucuguucaaugaaaggggaggaauccuguccugccagaaugugaaagcaugcagauacgcuuauuuagcggggcuucacauggaacuuagccgcugcucuuagucugacuuucucaagucaaaagaauguguagaaugcugucacuuaaucagaacccagaagagcucuuuuaucugccauuuguuuguaacuugcaauauuguccuuaucucuuuguccuuuagcuugauccagugcccucagauaugagaacuggaaacaugaaagcacuuauuaccuugagcauugcuucuugauuuuuguugguuuuuuucuuucuuucuuucuuucuuuuuuuuuuuuuuaccucagggucccuuaaucaccaacaaagaagcuaugagacuuuuucccccuaauuucugccuuaguccuaggaucauauuuguuugguaauauuuaaaagaaaccaagaugauuuguauauuuacacugccauuuauaccugguucuuuaaaagucuauuauugacauaacuuuguaucauuauaacuuucacugaucauuugcaugaaacagaauggaauuuccagagauaucauguguagcuuaaauuucucccucccaaacuuuuuaauaugucguaggagguuaauauccuucugucuauaaguaauuucagucauuugagaucaucuuuuucucuuugguaauuucuaaagacacgaaccagagauauauuucaauagguaggaacagaaaaauuauaucccaugucauuccuuuuugcuguggucuuuuuauauauauauaauuuucuauuucagagacagacaugucuucugaaauggccacucugagcauauuuuguaauaaauuuggaugcuuaccuaaugaagcgcaaucacuacacauuucuguuugaacaaugaugcuugauucugaaaagaacacgagacagacaacagccucucccauguuacaugacaugcagacaugauuguucucuagccuguagcuacauugauaagugauauguggcuuugccuuuugccacucaggcuaaauaacucuuaaagguucuucacaggcucuucuggaauuccaauuuugcuuuauggaaucacaaauuauauugaguaauuauuaauguucuuucaguuuuccucuugguuaaaguuugauuucuguaaaugucaaguuucugugaacagcaucacugaccuggauguauugguacacagugcaauguucagauggugucacugagcauguagaauuuauuuauucuaauuauaggauucuggaguuggaaagacuuuagaaauaaucaaaugugacuucuugauuuuguaguugagaaacuagggccuaacaauauaaaauuacuuuuuugcaaaguaauaaauauacaaagguuauuuauaacuaauauccagagguauaucuggauauaaauauuuauuuaaaacuaauauccagaguauaucuggaacaaaaacucagauuucaaaaucucaaucaaggacucuuucccuuaguccaucuagucacauacccccuauacugugugguguucacagaugacuaaagaugagacuaauaaauggccgauauuuagaucaucuucagcaaguagaugaccacauaaaugauuaugaacagacguuuuguacacugagcaugaggcaacauggggucuuggucuuuacuuauucccaaggguaccugguaacugacauuucaaccauucagcuuaucaacuugccauacuccaauuucacuauaaacuucucacaaucuguaaaaucccccuuuucucuugccuauuuaauguguaacagugacuucacaugacaacagugaacucuacaucaaagcugacaauaugaccaaagcuauucacagaggcuaauucauagcacuaacugcuuuuaugacuggaaaagaaagauugacuguaaauguaaaagccuucaauccaaguagcacaaaagaaaaagaauucuuuucaacaagcaucgauuguauuuacauauuacucauuaugaaaaauuaaaacauguuaaaguauauaaugaugaauuaauuagaauauaccuguauaaacuaggaugcaggaaaaguuuaaagcauaaaugaauaaauuagaaaacagauaauaaaauggaaaaauaaaccuaccaguugguccugagagucaccuucuagaucacgccagcccacuuugcuacuagguaauagagcuuuugaaagaacuuguggcauaugagacaggaucacauagggcugggagggagugcugaucaggguuucucugugaacucagcccauauccaguuauucucaagccuaggcacccccauuucuuucucuacuuguaucucuuucucuuaacccagguaagaaaaacaaauaccuccuauuuauacauguuauagguucacagguaaacaaaagacagggaaaauaguaaccugcaaaaaagagaguuugggccugugcaaaacagacauuccuauuaauaauuuuccacuaugcagauuauguuuauaguuuguuugguaggugaaccaaauaugguaaaaauaccaacugagaaggguacaagaaguaccccgugaagagcaaagaugaaaaaauauuguggauguaccagagaugaaagugaguaaaaauacuugguuuucauucagaaaauuuuucucucucaauuuuuucuucuacacgaggaaaaucaaagaaaggcuuaguccuguguaguucuguuaaaaaaugaauuuauuguaauauucacaaggaauuuguguuccuaagguaguuguuuuuguuuuuuguuuuuuauuuuugagacacagucuuacuccauaauucaggcuggagugcaguggcaugaugaucacggcucacuacagccucgacuucacaggcucaggugauuuucccaccucagccuccagaguagccgggaccacgggcacgcaccaccacacccagcuaauuuuuuguauuuuuaguagaggcaggguuuugccauguugcccaggcuggucucgaacuccugggcucaagcagucugcccaccucggccucccaaagugcuggauuacaggcaugagccgcugugcccagcccaagauaauuuucauacucuucauagguagcaguuucauagccuuagaaauucaggcagcaagguacugugauugguguauauggacuuaucuuuggaguaaaacaggcacucaucagauaguagcucuugcuaauuagcacauggacuauugaaauuccuuccuguuaaugccaaucagucagauuuugcuacagaacacauuuuacagaacuuucuuucuuucuuucuuucuuuuuugagacggaguuucacucuuguucaggcuggagugcaauggugugaucucgacucaccacaaccucugccuccuggguucaagcaauucuccugccucagccucccaaauaacugggauuacaggcaugugccaccaugccuggcuaauuuuguauuuuaauagagauggaguuuccccauguuggucaggcugguuuugaacuccugacuucagaugauccgcccaccucggccucccaaagugcugggauuaccagcgugagccaccgcgcccagccuacagggcuuucauaugggaaaguuaauacuuuucaguccugugggucucuuuaaagcaauaagauggcauccuucaguuuacucagugguugcucuugcuuuuacgcuuacauuuaaugaguuuuaaaaguacaguuaaaguacuucccuguauuugacaucugugucucaguacucaaauuuucuuuuuuaucaaaggcauucuuuacaucugaagucuuacauuucuccauauauacuucagucuuuucuuugaagagguuuacucccucugcuggcucuaacugugaaaugaaagcacguguaaucuauauaguucugauuaccaaucugagggauugcuugcauaugaugguauugccuuagacuuuuuucuaaaauguaaaauuaaacuuuuguuuggcucccucugauucugaauaauaaaauugcccaaaaaucuaagaaauauuuuauauuccuuuugagaacaauaugaaauucuaugaaacuaacagugauuugauaauuaagaaauucuggcaugcacauuuacaauauguaauaggugcucaauaaauauuaguuucuugauugcagucauauuuuuauuguacauagacauuguguguguacuucauuguaggagcaauaaaucacccauucuguuuaaugaagucaucuguguuucuguagcacuuucucaaugccuuauuauacuuccagccacacaguauuacaguuauuucuuuuuacauuugccuagcuugacuaugaacucuuccaggacagacaugauauguuauuugucuuuauagucucagcuucugucuugguagguugauugcccaguaauuauugaugaacuucaacauuauacuacaauaaaugucuucucauuugcuguacagacagccagaaaguauaaguaauuagaauuuguucugcacucuacuuuuaucgugaaaaaguaauugaaaguaaauaagauauuuauucagaaaagccacuaccugaaugugagcauaucugaacuaauaaaaauaguauaguuaauacagauauauagcaagauguccucaccaucuacaucuguaauaauauauagugguaauugacucccauaaugguuauaccaaagcccugaaggauucuuaacuuuuacuuucauuuuuaaugcaaaaccagguuuucauauauuuugcuugcuuaaagcaagauauacuagcucuuauuuuucuuacuaaauuacaugcauacauauauuucaaauuuuauuuuagauuauuugugcucaaccccauacguugucauagaguagugcuuuucaacucguuuuccaaggaucacuaauucuguagaauguuaauagauguuaugugagggggagaaagucauucagcuuuguaaaugcugaauuaaauauuucuuuuugaacaaagcuggaggcaucaugcuacccaacuucaaacuauacuacagggcuacgguaaccaaaacaucauggcacugguacaaaaacagacacauagaccaauggaacagaauagagagcccagaaauaaaaccgcacaccuacaacugucugauuuuuaacaaaccuaacaaaaacaaacaauaaggaaaggauucccuauucaauaaacagugcugggauaacuggcuagccauaugcagaagauugaaacuggaccccuuccuuauauacaaaaauuaucucaaggugaauuaaagacuuaaauguaaaacccaaaacuauaaaaacccacaaagacaaccuaggcaauaccuuucaggacauaggcacaggcaaagauuucaugacaaagacuccaaaagcaauugcaacagaagcaaaaauggacaaacggaaguuaacuaaacuaaagagcuucugcacagcaaaagaaacuaucauguuucuuuugaguaaacagccuacagaaugggagaaaauuuuugcaaacugugcauccaacaaaggucuaauauggagcaucuauaagaaacauacaaauuuacaaggaaaaaaaacgauaaaaaagugggcaaaugacaugaacagacacuuuucaaaagaagacguacaugcagccaacaaucacgaaaaaaagcucaacaucacugaucauuagagaaaugcaaaucaaaaccacaagagauauuaucucacaccaucagauugcuauuauuaaaaagucaaaaauaacagaugcuggugagguuguggagaaaaaggaaugcuuauacauuguuggugggaguguaaauuaguucagccuuuguagaagacaguguggcaauuccucaaagaccuaaagacagaaguaccauucaauccagcaaucccauugcuggguauauacccaaaggaauauaaaucauucuauuauaaagacacaugcacgugcauguucauugcagcacuauucacaauagcaaagaaucauuuucuuuaucauucauguauuucuuuauggguauuuggaaucaacccaaaugaccaucagugauagacuggauaaagaaaaugugguacauauacaccauggaauacuaugcagcuauaaaauaaaugagaucauguccuuugcugggacauggcuggagcuggaggccauuacccuuagcaaacuaacacaggaacagaaaaccaaauacugcauguucucacuuacaaguaguagcuaaacgaugagaacauguggacacauagaagggaacaacauacacuggggccuauuggaggguggagggugcgaagaaggaaaggaucaggaaaaauaauggauauuaagcuuaacaccugagugaugaaauaaucaguacaaugaaccccugugacgcacguuuaccuguaaagccuaugagccuuguaagggcaagaaccauacccuagaauucacuggcacugaguguuggccaccaaguagcacucugcaaauguuuguugacuuaaaaaaaauaauuccuacacuaauucagaguuucuaaacuacaaggaaaaaauggcagcauguguacacugauuauuguccuucagccucccuccgccaaaauaguugcugugguuccccauuuuuaaauucugugcgugggugaaugggaagacucacaacaaauggaaaugugacugcgugaccucuuuagagggaaugugguuugccccuuaacuaagcuacagggcuauaaacugacaaauaugguucuauguuuaguguauaaugauguuucagaauuauguccauagaagaaaucuaguaaaaacuacuauccaacagcuucuaaaauguuuacauuauuaauguucaaacaaacauuucagaauacuaaguucaguucuuuuucaaugccuaaauugucuaagaacucugugugugugugugugugugugugugugugugugugugugugugugugugugauguauauguagucuauacaccucaagaggaggacaaacagaugcuuaaagaguugggaguuugcuaaguccgacauagaagggacaaaagucagaaaaaaagccuaauauuuuacaguugucuugaacuacugagucacacaguaguuuaagacaauuuaaaauguuagucacaaaugacagacacuauuuauucugucauuaccaagaaaguccaguuagugcuuuaauaaauccagauuauauuauccuuuuagaauacaaauuauucagucaaaaguauagaaaguaccacuacacacuaauucgaaugguugggaauaucaacuguuggccaagaugcggagaaacuguaacucucauacauuucuggugggaguguaaaaugguucaaccacuuggaaaacugguaguaucuacuaaacguuugccuacucccuguauauacccaagagaaaugcaugccuguauccaacaagagacauguacaaaaauguucaaagcagaauguuuauuuuacuauauccaaaaacuagaaauaaccaucaacagaaaaaauugcuaaacaaacucuggcauaaugaugcaauggaauacuacacagcaaugaaagggagaaaacuauauacugauaacuacaacagcauacacaguuuuuacauauuaucuugagcaaaagaagcaaaacacaugauuccuuuauaugaaauucaaggagcagcaacauuaaucuaugguuauauaaauaggggugcaggaaugguauugcuaggaaaaauacaagaggaccuucuguggugauggugauguaaguauucuauauguuggucugagugguguuuauauagguguguacauguguaaagauacaucgaacauguuaagauuuguguacaccucaguauaaauagauaaauaaaugccuuaggcaauuauacauguauaugaaccaaugccaacagaggccaaaauuauucuuuacaagaaaucuuuuuuaagcuauuauguauaaauuuuauucuauugccguaguuguuaaucuagaacacuuuucauaccuucagaauuacacaaacacauggauuuuuuccuccuuguuuugauuugcugcuuuggacagaguucauuuuuuggaguuugggggcaaauuuggaagaacuucuuuaucagaaaagauacuuuucuuggucauacauuuaacaaauagucauugaaugcuugccgugugucagauauugcacuaagcauuggggauccaaagauuagcuaguaaaccccagucccugccacuguagcauucaauuuuauggggguaacagagauggaagcagauucuucuggucacaccagaugucagcaagggcuguaagagagguguacugcaggaguguggaguaggaaucugcuucgucucucagaauauucuggaagacuuucacagaggguaucacgaggcccugcuucuauuuuugccauaugucagaguucucuuuuaaguaucuacaauagugauuuaaaaguacuuuucuucacaaucuauacuuccaacaaaggacuaauauccagaaucuacaaggaacucaaacaaaaucagcaagaaaaaaaccacaaacauuccuuugaaaaagugggcuaaggacaugaauagacaguucuccaaagaagauauacaaauggccaacaaauauaugaaaaaauguccaacaucacuaauuaucagggaaaugcaaaucaaaaccacaaugcaauacugccuuacuccugcaagaauggccauaauaaaaaaaaaaauggauguuggcacagguguggugaaaagggaacacuuuuacacuguuggugggaauguaaacuaguacaucacuauagaaaacaguguggagauuccuuaaagaacuaaaaguagagcuaucauuggaucuagcaaucccauuccuggguaucuacccaaaggaaaauaaguuguacgaaaaaaauacuugcacaugcauguuauagcagcacaguucacaauugcaaaaauauggaaccagcccagaugcccaucagucaacaaguggauaaagaaaaugugguauauauauauuucauuauauauauaaugaaauacuacucagccauaaaaagagcaaaauaauggcauuugcagcaaccuggauggaauuggagacgauuauucuaagugaaguaacucaggaacguuaaaccaaacaugguauguucucacucauaagcaaugaggaugcaaaggcauaagaaugauacaguggacuuuggggauucagggaaggggcgggaggagggugagagauaaaagacuacacauuggguacaguguacacuacucaagugaugggugcaccaaaaucagaaaucaccgcuaaagaacuuacucauguacaaaaauaaauaaauacauaaaugagaaaaaaguacuuucaguuacuaaaagauaguuaaaauauguaauacauguuuuucuuagauaucacugugaucacuucugugauuccaacaaauuuaguuuaaagaucucaguuggcuuuauugcaauucuagaaaugggcaacaccacauucuguaaaauagaguaaguguuccaguuagucaaacaaaggagaguggcuuuauagacagaaaaggggcagaagaaagcagaaacaaaagaacggaaagcagcuuggucauuucaaaguuacguccauguaagggacagggagacagaacaauagauaacugcuuaacaucagguuacuucaaguuacucuauuguaaagauuaaaacagagggaacuucauugucaugcugauuuaagauagaaacuggccuguuugggaaauuaggcugucuuucucuuuugacuucucugucucuccugauuuacccaguuuugguuuggugagcauaagugacuccauuuuaacuuuuaguccagucuguuggggccuagugcaggaguuuagugcaaaauaaugguaugcuauaauuuuuguggaauauuucuuaggccauuuugaaagcccuaacaguuuccaggauaaaagaagcuaccugccacagguuucuagaaagcaguaacauucuuugaaauguuuauaaauggaaauauagcguuucuuugaauuaguucugaguuagaagccaaguuuuacucaaacucagaggguuacuuuuccuuucaaguaguguuugcaugcagcaaccacacugcccccaacacgcaugcagcaugagucccugagucuaggugagaagccuuccgcugguuuuuauguucacacauguaucucuccugacagcggauauaccuagaaauacucuguaaguccuugguauuagugugguucuuccuagaaacugagacaauuuuaagaaaagcauuguggcucauuaagagcaaaugaauguauauauucuguaauuauuuaaucaacagaacuauauucccuuucaaugauccuuucuuucaucucugcucauagaagagauaugaaaugaauuuuagauuuugaggacauuuaaaauucaguaaguacagcaaaacuguguuauaaaagaaagaggaaauuaaauaaagggcuaggacacauauuacauauuagaccuuuuuuuuuagcaacuuugaaaucagaugguaaaaucuagauaaugucgucgaguccauacaauugcacuguguucaaaaccaaagaauucuuaugucaaguaauaugauuuuuuuuaauguugcuuagugacuguguuagaaaauggugggucauaguauuuagguucccuaaauuguguauuuuccuucucuccuauuuccacagcucuagucuucugugcauuuuguuuuuuuguaaacaagaaggcacccuuuuuacacuacaucugcauaaaugggugaggggugauuuugaggaagagccugacaugggcagcuggugagaugguggucucauuugcagagauagaauacaaaaggagaaaauguuagggaggaagggugaugccuggucuucagggaagggaucuagggaacagcauagacaugccugugcacacagugcccgacuucuggcuccugugcagaacauuguggguaggcaaaccuucccuacccuccauccaggacccagucauuugcacauccaugacccugaucccucaacuggcagcuaucuuggugaaaucccuuggggucccauuaucuuagaaaaacaacuucuuuuguuuuugucagcuuuucugguaaacugcauuacuauggaaauguugacuauucuggaaauacaaacuuuuuuauuguaauuaggcuuaagaccaaaaaagaaaagaccugaggucauuuagacuccacagugaggagaaugaaccugaguucaauaagaccugcuucagauccugguucugccauuggcucuucugugauucucagcuuccuuaucuguaaaaauagagucguugauacucgccucacaccauuaaacugaagauuauauaagacaacagauaaaguuaauucagcgcaguacauuacaucuucugugcuuuacaaauguuuccuuucucuccuuccguagcccccuacuuauuuacacucaaaauaaaaaugaaaaguuuuagagaagagaaaacauuacaaggccccacaguaauccauucugguauuuaacaguucuuauugucagaaaauacuuccuucugucuaacacaaauuccuaaugcugcaaucuaaguccuucucucagauguguccuccuuuucuguuugcaguuuuaaucuugcuaaaugaacagcaugaaacacccuaaucuucagaagcauauuuucuuuaugucuuuccuuuaauagcuuaaagcacaaaauauaguggggaccccccccccaccacaguccucuguagacuauaaauucauuucugguagccuggauuacugggaaauguuguggcugguuuuauuuuccugcaugcaucucgaugacccauuucagaugggaguguuugaggaggagagcguacugcagaaugagcugaaugagcuauaccuucaugacugcuuccaccugacaaucugcaaauccuccccauuuaaggaaggcagugcucauggaauuuuaaaauguugaagaaugugugugccugaacuuggauuuuaaaacuaugcuuccauuucccucaucacuugcacuaaccauauaaccugcuaguacucauuuaguagguuugcuugcaaccugugucaaaaggagcauaguaaccaaugagaaagaaggcacggaccuuagaggcauuugacuguuuccauagcaaggaaaaacccaauuuuuaaauucuuuuacaaaucugaguaauaauguggccucucaaagcaaauagauuuccuuaagaguuaaaacaacuucuaagaggaaacaaugagcccugcagccugccauauccuguguucagaauaauuuucauuucuacuuaucugugaagguugaaggaaugucugcaaauauuugcuugguuucuauggugaaagcagagggagaucaaauguaugauuguuuagugucaaaaucaaaacuauacuauacuguacuucuacaaagagaaugaguuuguuacuuuaaacauaauagacguuuaauaagugguaacuauuuuaaguuucacgaguucaagaggaaauuuaaacagugcagccugaaggaaaacauaggcccuucaggcauuuuaaaacuucauuuuacaaaaauaaaaugguccuugcacuuuauuaaaaagucaucuguugacuaaagaucauguugguggacucucagaaugccugguguggacauggggacacaacuauggccuauaaaauuuauacuauaauagaaacacucuguccugcccuguguuaucccuccuuauccuguaacucuccauucugcugucuucuggcuacccauacauuuguuggaacauauguuuauuuuaugcuugcuuuauacaacacucugcgagggacugggauuaaaaguccacuuagaaauacucucuacccucaaagggcuggcuuugggccuaguagaccguaaggauacaaugauugagaugcaauguaagugcugcaaucauuuaugcuugcggaggacuaggcagggcaagguucacaggaauuaagaaugggguugugaagagggcauuccagagaagggccuaugggaagaccacaugaggcacgacauagcacacauguuuaaagaaccucacggucucugacaaguuaaagaaagccuucaucugaagggggaacagacaaugaaggcagagagugggugggaaccagauuaugagagcauuggagguaaauuagaguugagcuugacccugaaaucuccagagaauggaugaaggauuuuaagcaggagaguggugagcacagcuucagaugcaguaaagaagacagaguggcagggggcauguuggcaggaaaagaccacagaggaagcuauuuggaccauccaggagaggacaugcucucgauggaauugucgggaucugaugguggcuucauugaaagucaagagaaguagggaaacuggguagguagcgauuuugcuuacagagagaagaaauauaggaaaagcaaguuucagaggaaugacaaugcaugcauuuugaauuugagauacugguagcagcacuaaguagugauguccgggagacaguuggauuugugggucagagacugcagaguucugaauacagcauggauuggagcggggguggggacaggcacauggagugcuccacaaggauugugcuucauguaagaaaagugacugccugaggaugucgccuuagauuaagcaauaauuuaaaagagacaaaggcaggaggaacacuaggacaggaccguagcauucugcacuuaaauugcuacacagacaccaccccucccuccaacccaguuguacuucagccaacucauuuaacucauugcuuuccuaauuugcgaccacacuguccaggacuaacaugguaccucacagaguagacauucacaugaugaauugacuggaagcuuacuuugaccuaaaggcuugcugucuaggccuuuuguagguagaucugcuuagacauagauaaaaugggggagagguguacgacucaguaagaaauggcaagugccacugauaucacaaaaggucagaaaccuggaucccugaauucuaccuuugcugguccuucagugagucauuuucaucccuccccugacacgaguacacagccccccuguuuacugaguggcucucuucccccaagaugccuuuccucucuacuuggagggaacacccauucagcucauuuucccugugccuuucauugcccugugagucuucuuacacaaucucugaagcuaaucagguagugcucuucccuccacaggaucauuuccucuguuaaagauacaugauuacucaaagauauuaaguuauuaugggacaguauuguccucauauucuccagucuaggugauugccucuauccaucuucagcacugccacugggaguuuccugugguuauugauguaucuagcuaucagauaauuacugagcaccuuccaugcaugacacuguaaauguauuguggccaagaaauggaaaagcuauaaugcaagauagaaagggucaaguacuauagaagugcaguggaagcucagagaagagccauuacuuccagcugggagaucaggaaaggcuuuguggaugaagcaauaugugagugaggcuugaaagauggguaggaucuggaccugcagagacucagagaaagagaaucccagagagagaaucagagaaccacaccagcaauagcaggugaugggacauccacauaucuaaagggagccaguggccccaugugagccaaggcagcuguagaugugaggaaauacagcccuucugcugguaauggaugcaucagagcagaggugaggacaaaguuauuggcacagcgcucccugcugugagacucucaucuuuguauugaccucagacauuuuuuugccauaugucaaaacaucuccuucuagcccuuagauuacaaaugggugaauuugagaugacuccauuauuauuuuauggguauuuaaugcuuuuuuuuuuuuuuuuuuuuuuuuuuucugagauggaauuucacucuuguuggcccaggcuggagcgcaauggugugaucucggcucaccgcaaccuccaccuccugaguuccagcgauucuccugccucagccuccugaauagcugggauuacaggcaugcaccaccaugcccgacuaauuuuguauuuuuaguagagacgggguuucaccauguuggucaggcuggucucgaacucccaaccucaggucauccgcccuccucagccucccaaagugcugggauuacaggugugagccaccacaccuggccaguauuuaauucuuaauaguuuccauaaccaguuaagguguuauaaugagaagacugugcuuggcagaauuagaauuccaauucuuuauaauauucuucauuuaaauauguaauuuugaagaacuaaauuauggccgggcacgauggcucacaccuguaaucccagcacuuuaggaggccaaggagggcggaucacuugaggucaggaguucgagaccagucugggcaacauggcgaaacucugucucuaaaaauacaaaaaauuagccgggcaugguggugcacgccuguaaucccaacuacuggggaagcugaggcaggagaaucacuugaacccgggagaccgagguugcagugagccgagaucacaccacugcacuccagcuugggcuauagagugacacucugucucgaaaaaaaaaagaaguaaauuuugcaccucugugaaaagucagugaaauuaucacuaguuuugauuuucacuucacacaaccauacuaguuuucuauagggagaaaaacauauguauuagaaaguuuuauauugcucugaugcaaauaaacagauuagagcacaguuuagaaaaccuucacuuugacaaaauaaagauucugaaguauuucaaagauuauauuuauauuccugauaaaccauuaucuauguuuguauuugagacauguuguugaagugggcccgagaaggagaauaucaccacacuggaacacuccauaaguaauuacuaaaccaaaggacagcaaagauauuuaacgauaacguuguuggguccauaaaguauauauguuuuuuuaaaucuucauugccauugccauaucauuuagggagucuuaaaauguuaacagaggacaccuuauagauuacccaguccaaacaucuucuuuaacagaugagaaaacugaaacuuggagaagaaguugccacccacgcugguuucuccaucuauaaacaggauguaucagccagggucccaacaggaaauagauggcacacucaaacucaaguaguucaaggauuucuugacacaggcaugauuugcagagaugugggcuuaggggaacucaggggauggugcuaugaccugagucuuacucgcagucaguucauuaccauucccaggcccuagaagaagaggggaagcaguuacuggaauccaggaggaagaaagcaaguagagcaggcuuccugagauggacauugacuuugugguggcaacacagucaguucuagacagcuuugcugggaggaaaaucaaagaguugaggauccugaccucaugcuucuccuucucucugaauuccugccgagacuucccauuggccaaagccaguaagaaacuggaggcauauggcagauacagguccauuucuagggcagagacuaucuggggcaacaaaaagaagacauccagcacaguguucauaccaugcuuuucugccauuguggccauauaaugaggaugaaucagauaacaucuaauuuuuucaagaccuuggugaaaggguacaugauaaaagauuguuaaauauaacaucaagugagagcgguuuacucugaaauguauuuuaagucagaguuggccuuggcuguacuuuuucuuauacuauuauugaacagguucaaaaaaaugugaauagagaucaaagcaguuuaaacagauacauccacuuguguaaauauccuugaacuccccccugccuuccgcucccccuccuguugccacauccauucagcaccucuagaggcuguuaauacauguaaugauuguaauaaacaugguauuugcuuugguuccagcuggcuccaaucaccaaacucuguccauaauuccuauugucuuugcuuacuagacaacugcauuguuaccauuaguagcgacuuuuguuacggauuucuaaauguugaucuuuauauauugcacucauuguuuuccucaacauguuuuaaaauuuaaauuuaccauuauauuuucuuuuuaaggauauuuagaauuauuaaacagaacuucugguagaauugauuauauuguugagaacuuucacgagcuaaaaccuugaaacaauuuuauugauauuauucauucuuuauaaagcuuucaaauaaaaauaagcuucugcucaugcaugacuuaaacugguuuuaaguucagcagucuuccaucagaaguuuuuagaggcacagaaguauaauaaugucuaagcaaagggaauuuauauuuuacugucaggaaaauuuguugcaauuuguucucaaaaacuuggauccagauuuaguugcaguagauauuuuaaauccuaugaaauuacagaaguugucauaauuugagauaauuaaaauuucagugacuuaauguagggacugaaagacugugguucagaaauuauagaacagccaaguaaauuaacaaauuaaaacuggggaugcucucuugauauauagaauaauauuacauaaaccaggaaacaacuauuagaaaaugcuauucuuuuauaucuauugcaaaauauaguaguuuguuuuccuuuuuuuugagacagucuugcuuuucacccagacuaaagggauacaaucucacugcaaccuccaccucccagguucaagcaauucuccugccucagccucccuauuagcagggauuacaggcgugugccaccacaccuggcuaauuuuuuuuauuuuuaguagagacaggguuucgccaugcugcccaagcuggucuugaacuccugaccucaagugauccgccugcuucagccucccaaagugcugggauuacaggcaugagccaccacgccuggcccaguaguuuguuauuuuuaaauguaggcccaggucauugaugggguuauuuuauuagagaauuaacuagaaauguaagucuugaacaauuuauacuuucuuuuggaauugaauuccucaaagauugaaccaaaaaugaugucucuuuagacagauguugauaguuuaaaauagaguguaagcauaaaguuagucuaauuucacucucacuugguuacaaugauuuacacagacuagagcaaaaucuuaaggauaaaaacgagauaucuaaauuuuagcuuucauugaacuuauuaaaugugaagugaugaguagaugucauaucauauagagaacuggaaaguaauggaaacgcuuuucuuucuuuuuuuuuuuuuuuugagacggagucucucugucgcccaggcuggagugcaguggcgcgaucucagcucacugcaagcuccgccucccggguucacgccauucuccugccucaggcuccccaguagcugggacuacaagcgcccaccagaguuguaaauuuugcaacucugugaaaagucagugaaauuaucacuaguuuugauuuucacuucacaaaaccauacuaguuuucuuuagggagaaaaacauauguauuagaaaguuuuguauugcucugaugcaaauaaacagauuagagcacaguuuagaaaaccuucacuuugacaaaauaaagauucugaaguauuucaaagauuauauuuauauuccuuauaaaccauuaucuauguuugcauuugagauacugggggaaggaaaacagaaacucaacucucuuuuagaguuugacaaaugaaguauagaaaaauauaaguaaggauuuauauaagacaaacccuuaucaauaaagaacuuuacaaagacaguacuuccauuacacucccagaacaaaaaccaaguauauacaucauuuuaaagaaaacaacaauaaauccuaccaaguagaaauuguacagaucauagucucuguuguaauucaauaaaaguagaaauucaaccauucaaagauagccauaaauaaccugaccauauggacaucuuaaaacacuuuucuaaauuaaagauaaauuacauaguauuuaaagaugagcaaaaaugagaaaaguuuaucuacaaauauguaguuagcauuuuauuauuaauuaaaauggaaaagaaaugagcuaaauuuuaacucaaaaaaaaacucaacaacaacaaagaaauuaggagaaaauuuuaaaagauaaaaauagaaaucaacaaauuauaaaauaaaacaauaauccucccaaaauggaaauaaaauuaugucaguuuuuuuauauaaauaauauggcuaaacuucugacaaaccugacagauauaaagagaaaacaaaaauuuacaacauuaagaaaaagaaaaucaguauaaccaaggaaacagaugaaauuaaaaugauuauaagaaauacuauguucaaauuuaagucaauacauuuuuaaaucuagauuaagaauguucguaggaaaauccuuuaucauuacgaaaauuggcuucuaaagagguugaaagcugagcagacuaauuaccaagaagaaauucaaaagaccguuaagacacacugcuaacaaagauccagacagcucuaugagcgagauuguuugacccucaagaaacugauuauucuucuguuguuuguacuauuccagaauauaauaaagauuggaagcuugaauaucccugauaacaaaacaugaaaaauuaacacaaaaaagaaaacuacagaucagccucauuuaugaauauaagucaauauccugaauagauacuagcaaauagaauuucagagugucuuaaaagaauaauacacaaucagaaaugauuuauuccaagaaggcaaggaugcuacaauauugggaaaucuguuaauguaacuaauacgucauuaauaaaacaaaggcaaaugauuauauggucauuauuaauagacauuuuaaaaagcauuugauaaaaauucauucuacauuuugagugguaacuaaauuuuaaaaggaauagagggaauuucccuaacauaucaauauuguuauuaugauuuugacugucuauacauuuauuuaucauaauagguauaacugacugaaguauugaaaaugaagacagucagccuuacuaaaguuuuuuaggauggguaaucaaucagaaaccaguuucuugcugagcacaguggcucacaccuguaaucccagcauuuugggaggcugaggugggcagaucaccugaggccaggaguucaugaccagccuggccaacauggugaaacccuaucucuacaaaaaauacaaaaauauuagccaggugugguggcgugugccuguagucccagcuaccugggaggcugagacacgagacucgcuucagccuggaagguggacauugcagugagccaagaucgcaccauugcauuccagucugggcaacagagcaagacccugucuaaaaagaaaaaagaaagaaauaauauuuuccuuagaacagcuuaaaauaaggcuguauucagauuaaacuuuucuuuuuauguugcuagacuuuauuuugaauugagguagaaagauaagugugugccuucaugauaucuguguauuucugucaaccacucaaguggaaccuuacagacaguuugcaccugcaguuuuguuuacagugugucagggaagcaaagaaguguuccuccagcuagaaauauuaauaaagcagaaacaaguaauguaacuaaaacuagaccccaguauuggacacucuucuuagcaaaaacaauaccuucccuuuuggaaaugacuggucauugaauuuugcccaguuaucuuucuaggaaugauugccuuaaaaggauuaauuugauagguguauaagcccuuauuguuguguuuacaguacugugauaggcauuuacagauauaaacauagauuaaggcagggccauguccucaggaacaaaccauauuaugagcuauguuacaagguaugauuuucagauagcagcuggugcugcaacaggguggugcuggcaucuaggcuaggccuuguagaauaggugaaauuuacauauguggagaggagaaagaagaguugcccaggcuaggaaaaugauauaaacaaaagcauggagacaagagcgaugggauaugcuugcauaaucuagugguguucaaacauagccaagggugaggauuaguugaagaacucaaaaaaaaaaaaaaagaagaaagggggaggcgcaguggcucaugccuguaaucuuaucacuuugggaggcugaggcaggcagauugccugagcucaggaguucgagaccagccugagcaacauggugaaaccccgucucuacuaaaauacaaaaaaaauuagccgggugugguggcgugcgccuguagucccagcuacucaggaggcugaggcaggagaauugcuugaacccgggaggcggagguugcagugagcugagaucaugccacugcacuccagccugggcaacagagcaagacuccaucucaaaaagaaaaaaaaaaaggaaggaacaaaagaggaaaacuccaacccaaaaaguucagcccacagaaagucuaauucaguggcacaagauaagaccuauacaccuaaguuuuucuaaaaccccauggggauuuugaugaacaggcaggguuaaaaaccaguggugcaguauagaugugacuaggauauaaaggcuauggaaguucuaugggaggugaugcauugauggaaaauacucugggaggugaugcauugauagaaagauauguuggggccaaaugguaacuugaguaacauuguuucaguauugucaguuuuguguuuuguuuuuuauuucuauuauaucacaaccaucccuccauuagauaucaaccaguauuacuuaaacaaaacuugacccaugugugaauucaaagcaaaauauguuagaugagauauagagggggaaccugucaagaaucuuuuuccaauuugauguugccauauaaucaucuaaagacuuaaaacggucauuuuauuaucacucauaaucuugucaguugaccggacucagcuggcaguucugcucugugugacauugucugggacugcaguuauaugggaggucaguuggcuugaauguccaagauggcucauucgcaggcuuucagcugagagcucaacuggggcugucaaccagggcaucuucaugggcuucucacagcaugacagcuggguuccaagagguagcaucucaagagaaaaggccuaggcucaggcuucuuaugaccuaacauugguagucucagacauuacgucuaccauauucuguaggucaaguaagucacuaaggccaacucagauucaauggaagaugaauaaaauccaucccuugauacgagcaacagugugugcaaauaaggagagaaggaaauugauggcagccgccauuuauugagacuugcuacugcaaucuuagcacaccaaguaauauagcaucaaaauauauaaagcagaauuuuagaaaauuuagauagacauccauaauaauacaacuagacaaaacaauaaggauaaaagggaucugaauaauauaaaauucugacguaauagauuuauauucugaauuccuuaucugacaauaaagaaugcaccucccaggguauccauagacuaucugccccuucccccacaaaaggaaucacuugaacccccccuauguacucaaaucugcagccuuaacaugauaugcuuucuucagcccucaaccuggcaggaaaaauuguuguguuuguuucaucuauuacuauacgcugcucuguauuaaaugaguuucuugucuuuuuggaaucccuuccucugcuuggcuuuuucacacaucauaugaacaauuggguuacacauucucucuuaaguucuuccccacuuuuuacuuguuuucugaaaagagcaucauggagagggguuuuacuuugauuccccaagcugucacgguaagagcaguuuugacauguccuggguguuguguagacuucagggacaccauccagcagcccuggcaccaucuucauauauguguguguguguguguguguguguguguguguguguguguguguguguguguaugugucuguguguguguguguguauguguauauauauauauauauauauauauauguacagcuuuugggguacaagugguuuuggguuacauggaugaauuguauagugaugaagucugagauuuuagugcccccaucacccagguaguguacauuuuacccaguauguaguuuuuucuccuucaccccuuucucuacccucccccuuucugagucuccaaaguccauuacaccacucuguaugccaucaucuucuaaucugccaauaaugcuggccuggggauugagcuguaauuguugccaucaccuguuuuccauguauuauuuuuuaaaggcccuuaaagggggggagaaaaaaaacgguuucuaaguuuaaaaaaaauuuuuuuggucuuugcuuucugaaacucauguuauuaugccauccuaguuagacauagaguuggaggugggaacccaguuuguggggaugauguaauuuccuggccugucagugaugaguccuauuuaccuauugcuucuagcgcaguguccuuauaugauuuauaggaguucuuucugaacuacaucuugucauuaaaccaccagguuuagucaggagucuaagccaacagccaccuucucaguaacacuuggauccgcuugccauugcaggucgucacgcugugguacagagcacccgaagucuugcuccaguccagcuacgccacccccguggaucucuggaguguuggcugcauauuugcagaaauguuucguagaaaguaagaaauacauuuuguuucacucugcuuuccuugaaaagagacuguggaucuuugugaauuugaguggcagcauggcauuucuaucauuaggggucaugauggccagauccaucuaccccaggcuaccacuugcaagccuguccugaaaccgccuucucagugcuuacaguguuguuuuauaugacuguagcuugcagcuucuggaaacucugccugggaaggaauaccccacuguucuuauaaguuacauuguuuuacuggugaugauaggacauggugaaaauaacacauauuuucgcauuuuuuuagugaagaaauaucucaaaguggacuuuauccauaggaggagaaccaaggcuguuaaguguaugaaaacuuuuuugauggaauuuugauagugagaauaguugaaaaaaacaauauuuaggcugaaaaagaauaggcaguggggaugucagugcuacuucagagcacuuuaaaugcugccguguacaggagagauuagauauauucagguacuauagaggacagaaacaagaccaaggauacagaaauuacaaaaagaaagauuuuuguuaaaagggguagaaaucuaaugauuagacaguuaucugaagaguggauugggguuugugagaauagugaguuuucauugugugucuaagaagaggcuggaccuccacacauuggugauguuucaguagcauuuauaggguuggugcguaggcuagaugcccucuaaguucccucuaagagagcaugugauucguuuguuugauuuucaggucacaagaaauagccaaauaauauaauaaagaucugccaggaaaauaauccauaucuggguacuaaguucagccuagucuaaauuaaacagagaaccuaaucauaaucuaaucuuuuuuuucuuuucuauuuuuauuuccaugggaaaagguaaguuaggaaacaguauauucccauuguaucuuuaaaauguagcuccaugguagcucacaaggaaaagaaguggucagccauugcuugcuuguuguuugguugguuuuaaccaaacaaaguuuugugcauguaacaaauuuuuggaacuguugcuaguacucagcaaauucaucuguggcucauaggauaggagaucaucacaaggagaucagaguaaacagauguuuaaugcagccauaccaugugccaaguauagugucaaaccucuucuuuuaugcuaccuuucuuaguccuaccaauaagaacaaacugagauggagugguacauuuauuugucuaacauuaggcagcuaagaaguagcagggguaugaguccaaaggaagcuugcaaguucuauucugguguugcuuuuuucccaaggagcggggagaaaaaguaauacugaaaucagcugcaguguuugccaaacaggcuaaauuagugauuuugaaaguauggucccugaaccaggaaccucagcaucaccaggcaccuugcuggaaaugcaaauucucaggccccaccccagaccuauugguucagaaguucuugggcugggagccagcaaccuguguuucaacaaguccuccgauccuaauacagccuccaggauaagaaccccuggguuggaugacaguaugaccagggaugggcagucuuuaaaagucuggcucccaggccucucccuugagauucugauucauuacugggcuggggccaggaauucuuauuuuuaaaaguaccuucagcgauucuuuucauccaacaaguguagaagacauuggguuaaaggcuuaugguuagaaccaagaauaauuuacugucaauagagcagaguaggaguuaagacagucauucuacuucaucgcaggaauaacucgguacagccaagaguugauuacagaaaugcuuauuggaauuaucuuuaugugucuagaauagucucaacuguaaagacagaguccuucaacaauuacagacuugaauacuagucaugauugaugcuaaaagucaauuuuuuuaagauguuaaaagaaagauaaaauuuuauauauguagaauuaaguauucacuacuaaggaauuugcuguauaggcaaucuccauuuguggaacaaauuuuauuuuaaaauguuaaaagcauuuuccacugaagugauaaguggucacuggauuccaagccuagcuugcagaauccucuacgaccuggaacauauacaaaacacccauugugcuaauucaucaaaauuuuuucuucugugggaaaauucauucuauguuccaauccaagacuagaggaauacuuaucucuccaucucagcauugggacugagaaguaggacucaaauauuggaggcucaggggaggguuccuuugaugauaguggcagcagucugcuucaguuugcuggaaaagugagacauuggguagagauccuuuggcacuucaaaugugcacauaagaaaguacccuuucuccagaagccuugcacaaaaauaguaauuugagaaauaauugcuugaaggaggaagcaguaucagaaaccagguucauaugccuuuaaggcugaaaggagagugaaucaaggccaaucauaccaucccuccuaggguggcuacccuguguccuugguauuuccuaugauaccccccagauauccaugugucaugcuucuuacuuaugccagaugaguucugggguccaucaccagcuugaccugguucugacuugacuccugauucaguauugacccaguugagacuucacaagccauaggcucuuaaagcagacucauucauugcuuuaggcuaauccuaaaucagggaauccuagcaucuuuuauuuuuuguagagaugggggucucacugugcugcccugguugucuugaacuucuaaacucuggguacccacuugaugcuaaggcaguaguuaccaaauuuuguccuuucuuuaucaccuucauuguuuuugccauauucuuaugagacugguacuauuauuuacguagguuuuuuuuacuacucucugucaguuuacuuuuuuauuuagccucauccuaaacaaaaguacagucauguguugcuuaacgacaggguuauguucugagaaaugcauuguuagacaguuuugucauuuugcgaacauugucgaauguacuuacauaaaucuagaugguguagccuacuacacaccuagguuauaugguauagcuuauugcucuuaggcugccaaucuguaugacauauuaucauacugacuaccauaggcaauuguaacacaaugguaaguauuuguguaucuaaacauagaaaagauacaguagaaauaugguauaaaaaauaaaaaaugauuuaccuauauagaaugcuuaucaugaauaaggcuugcaggacuggaaguugcucugggugagucagugagugaguggugagugaauugaaggccuaggauguuacuguacacugcuguagacuuuauaaacacuguacacuuaggcuacacuaaauuuaucuaaaaauauuuuucuuucuucaauaauaacaaccuuggcuuacuguaacauuuuuacuucauaaacuuuuuaaauuuuuuggccgggugcaguggcucacgccuguaaugccagcacuuugggaggcugaagcagguggauugcuugagcucuggaguucgagaccagccuggguaacauggcgaaacccugucucuacaaaaaagacaaaaauuaaccagacaugguggugugugccuguaguuccaguuacuuggaagacugaguugggaggaucacuggagcccaagagaggcagagguugcagugagccaagaucacaccacugcacuccagccugggcaacagaaggaggcccugucucaaaaaaaaaaaaaaacuuuuuaaauuuuuuaacuuuuugauucuuuuguaaugacacaucuuaaaacacaagcaagccagaugcaguggcucacuguaacccaacacuuugggaaaccagggcaggaggaucacuugaguuuagaaguucaagaccaaccagggcaacauagugagacccccaucucugcaaaaaauaaaaaauuagcugaacaugguagcacacaucuguaguacuagcuacuccggaggcugaagugggaggaucacuggagcccaggaguucaagaugacagugagcuaggaucaugccacuacacccuagccuagauaaccuugugucuaaaaaaaauaaauaaauaaacacaaaaacauuauacaucuauacaaaaucuuuucuuuauauccucauucuauaagcuuuuuuauuuuuaaauuuuuuauuuuuuuacuuuuuaaacuuuuuuguuaaaaacuaagaaacacacagauuagcccagaccuacacagaaucaggauggucaauaucacugucuugccuguccacuucuugucccacuaggagggcuucaggggcaauaacaugcauggaacugucauccccugugauaacaaugccuucuucuaggauaccucgugaagggccuggcugagacuguuguacaguuaacuucuuuuuauaaguaguaguacacucuaaaauaaugauaaaaguauaauauaguaaauacauaaaccagcaacagagucuuguauuagcaaauauuauguacuguauauaauuauaugugcuauacuuuaauaugacuggcagcgcaauagguuuguuuacaccagcaucaccacagacaugugaagugaguaaugcacugcacuacaauaacguuaagauggcuaggagauaggaaucauucagcuucauuauaaucuuuuaggaccacccucacauaugugguucauucauuguugaccaaaacguuauuaugagggucauggcuguguauaaaaaucagagauuugaccgguuauuuauuugucugauacacauuagaauaaauauauaaccacuaaaacuauucagaaaguucaugcauguuuauccccuaaaucaucucacaugucaccaacaguaauaugucacauguuggaaacccuauaacaaguguuccauucaguccacaauuaacuuauggagugacuguuguaugccaggcccacuucuagaggggugacuuaaauccuaguagagaaaaaauccauugccugcacaauuaguuaauuaaccagaggugggauaaaugcugugaagaaguguagaguacugugaguggguauaaugacaagucuguuuuuggagagggaagauuucucaguggaaggccagcaguugggauuaaccuucuuuagaggucgcauccuaguuguuuauuuaaaaucuuugaggaauagucauuuaugugucagcgaggcucaccauccuccauaaccuagggagaagaaaagaagcaaagggaguuaccauuugucaugugacaggcccaugccuuggcaguuggggguugggggcaccuucaugugcauuaucugcuuaaaccccuauucugaagacuucuuuccagagcuuacagauaaugaacuagaccuuccacaaggagggugaauaacuugcccaugggcauacaacaaucaaaugacagagccaagaccccaugucugccugacucgaucgccuuugauuuuucuacucugcuggguuucugccauugcuguuguuugaccuacuaggccauauuuuuuucuguaaugauuuguguauuacugugauguagcagcaaugauauuuuagaguggucaagaagcaaaucacacauguauuuaauagcuuugauuuagaaucuguccuguauuggaaagguuggccaauucucugucauauuauuaagaggugcaugucuuuuguucaaaaaugaaauaccuaggaaauauaaacucaguaaagagagucauagggcagaugguugacaaagagccagagaguuuaaauaucaucugucacuguuaucuggguuuaauaacugcccacacuggcccacagaaguauucuacaaaauggguaagagcuacauuuuuuuaucuuucuccuuuaauucuucauccagaguaacccauccuuacuccacauugaauuguauuuuaauacuaaaaaaaaauuguuauaaauuugguuaguggccaacuagucagcuuaaaggaugagauuggauggauggauggauggauggauggauggauggauggaugauuggaugguugugauagauugauuuuuaacuauacagcaaaauaaauucacaguauuaacuccccagguaucuauugguugccuuguaauccuaguuagaacugucuguaguuugaaaguuaugggguuuuccagguuacagcaaagucacauaaaaugcacauuuagaaaauaaaacaugcggccaggcguggugacucacaccuguaaucccagcacuuugggagcccaagguggguggaucacgaggucaggagaucaagaccauccuggcuaauacagugaaaacccgucucuauuaaaaauacaaaaaauuagcugagcgugguggcaugcuccuguagucccaccuacucgggaggcugaggcaggagaaucgcuugaacccaggagguggagguugcagugagcugagaucgugccacugcacuccagccugggugacagagugagacucagucucaaaaaaaaaaaaaggaagaaaaaagaaaauaaaacauguuucuuugaauacgaagauuguggcaagcagauaguaauucuuagaaguucugaguugccagcucugccaauccauagcuaagaaaugccaaaugccaccaggaagaauauaacaaauagagucacuguuagaaggaaacaaacaaggcuuccugauuugucauauauugccucuugucugguggccucucuaggcuugucgucauugauuucuaugaauuaaacaccaguagcugagaaacugacagugaaacuguccuuugugggucaguggucagugagcaaaugucuuuaaaaugucacugacuaccuugccaauuuucccauugguuacuguguuggugccuccccauaguugagcacccucccuagugacauccaggaaaugagguccuucacaagcugaccugaacaccagggugccagaaggcacgcccuagccugugagaagaaacccaucauuucagguuaggucgaaacacgugcauggaaaccagggcacuuuagacuuucagauuucuuaccuuuuguuggauauuuuccuagacucuguuuuuguuuuuuuuuucuuccuuuaaagaaccagccaaaugggaagaucucuuuuuuuuuauuuuauuuuuuugaggcagagucucgcucugucacccaggcuggagugcaguggcacgaucuuggcucacugcaaguuccgccucccggguucacaccauucuccugccucagccuccugaguagcugggacuacaggcgccugcccccgugcccggcuaauuuuuuguauuuuuaguagagacgggguuucaccguggucuugaucuccugaccuccugauccgcccgccucggccucccaaaguguugggauuacaggcgugagccaccgugccuggcugggaagaucucuuuaaaaagcauuuuuaugagugaggaaauauccaagaugguacccaggaaaagguccaauuuugguugaguaaugcaaacaagguaguucuaaguaagaacaaauuaauacuuugguaauguuauuaauauugauuuuuuaaauucuuuuuuuuuuuuggagacagagucucgcucuguugcccaggcuggagugcaguggugcaaucucggcucacugcaaccuccgccuccuggguucaagcaauucuccugccucagccuccugaguagcugggacuacaggcacaugccgccacgcccagcuaauuuuuuguauuuuaguagauacgggguuucgcuguuguugccuaggcuggucucgaaauccugagcucaggaguucaccuuggccucccaaaguacuaagauuacaggcaugaggcaccgugccuggccugauuuuuuaaauucuugauguguacuuuaacaugaauuugaaaaauauauuuguuuucaugacauauauugagaagccaccaccagaccuggccuuucccuguggcggcaucucuugguccuccaccuucccacuccagggcaccuccauucucauauccuaggucugccuguucugugaucuuuaccacaaaccagauuuuaucugcuuagucuucuucuaaccauucuaucacauaucauauaccacucuaccauucuuucuucccucuuacuucccaagccauugcuucccucuuacuaacaacugcugguuuauuacuucuucccauguucccaucccuguucuuagcccccaauaccuccccucgcugacucucuacuucuguuacuccuuucaaaucugacucuuggaauccuugucacauaggaagaaguuccuuucuuccccaaacuuuuacucacaaucuucuucaagguaacuaaaacccggccuuuuucuguaggugcucuauccccucaagaagggaauugcaguguuuuuagcuaucugcuucuugggggcacaguuccgccaaagccucccaacuucucuuugcaauccucuuacacuccugucuccccaguccuaauggcaugaccuggagauuuucaggacccaugauuuuccagcaaagagucacuacagaguaagaguaaauguuacugacagaaguguuuugcaaauacguggagacagagcaguuugagggucuugauugacucagcagcugcaucacucagcuugcacucucccugucccccagccuauacacaagcauuuagugacccccgugagaauuaauguuuucuucucccuucucaugacauuguacauuagggacuucaucauccaaauguuccaccacugaaaagaaagcucuacuuagagacagaaauaagagcaacuagagcacacgugcuuguuuaacacuugcaucuaggcuuuuggugggcauguuuccuccccuccagcuccccuccuuuggucugagacccacuuccaugcuaggauucacuucucuucccauccccacgauccuuaagccccaaccuacuuccacacccccaacccaacauucagccccaucuccaguuaauuaagaugagugaagcccucgaagugaguuccuuuucucuuucaguucaaaaauuucucuuuaucuucaccuucuccuuccuucccuccaguuucugagaaggaugcauucucccugcuuacaaggcaaaucucccucaacccuugcucuuguuccuacccugcuucuagguucucacuucauccaucaucccuuucugacuugccucguaagagucaaaucaugcccuugucucuccauucuggaaaagauucucauuccccuuuguauuccccuagucuuucuccuucccuucaugcccagacuucuugaaagaauagugucucuacauguagccuccacuucuucuucacuugcucauuucuucaucccuucccaucauaaaaauaauagauaacauuuauugcacacuuacugugagccacgcucuguacaguugacccuugaacaacauagguuugaacuacacagguccacuuauauacagauuauuuucaguaaaaguuacagcaagugugccugacucuccuaucucccuuuccaccaccuccagcucuuccaacucugccacccaugagacaacaagacucaccccucuucuuccccuuuacccucagccuauucaaugugaagaugagaaagaugaaaacccuuaugaugauccacuuccucuuaaugaauaguaaauauauuuucucauucucaugauuuucuuaauaacauuuccuuucucugcuuacuuuauuauaagaauacaggguauaauacauacaacauaccaaauauguguuaaucagcuguuugcuauugguaagguuuccagucaauacucggccauuaguaguuaagucuuaggggagucaaaaguuauacauggacuuuugacugcacagggggucagcaccuuuaacccccauguuguucgagggucagcuauauuuggugcuuuaaaauacacaauuucauuuuaaucucagaauaacuuuauaaggggcacuguugucaucccuauuugacagguaagaaaacugaggcccaagaagaggcuuugaaccaggauuauuugacuucagaguccuccugacacuuaagcugcuauauuagagguugauggugaccuccucaucauugcauccaggagccuccucuccauucucauuucauuugaugucugcagcauuugaaucuuguggccacucacuccgugaaagccucccuguccucacuguugguaaaaagcacacuucugggugccucugcccauauccccuuugcuggcucuucaucucccuucucccaaaccuagguguuuacaaagaauucuaucuagauaagauauagaugacccucagaugggcuccagggccaaacugcaguuucuuaauggacugacucuuccaccaaccaccucacagauacccuuucuucacugaacccaucuaaccagcuucucuuaccuucccuuuuucuguuaauggaacccucaucccgcagccccccagcuggguccucagagucacccuggaaucaucuucauccuucuguauccaaguccuguggauucugucuccauggggccccuccaaucuggcccauuuccaucaugaccugcaucucauuaauugaggcugccuuuaacagucacccaguaaccugccaaucugucucccuguuuccugcccauucauguauuuaugauaaauuaauauucuuauuaucacuguuuuucaaaaucuugcuaagacugguguaggauccuuggcucucaagaccuuuugaaagaaggcuccaacucuauucuggccauugcauauauuauucuccaagaugucacuauuagugaaagagaccuaccuuuuggccccaaaacaugccucaaaguuuuucuccuuagaacccuugcucuucucuuguccugggugcccagcugccucugucaucuuucaaagguaaaucuagaagcugcuucuuuaacgaagaggccugaagcacuguacugugcuuacaguagccccauagcauugugucuguaccuaugucagagcacuuuccugagccacuaucuuuccaugcacacaaguuguccaccauaggugcagcaaugaugucaugcagagcacgguguuguuucuuaggaaccagacaucuaagaauggguuccagcccuaccccuaccagcuuugccacugaaggcaaaccaucaaccucuggaacuuagcgucuuuaccuauaaaauggagaggcugaaauaccacauccauggaauucaaacugugcuucagaguucuuagauucccuuccuaugcauaguccagagauuucucggcccuucuuguucccacacucagcuuuaaucagaguaucuugcuuucaucuuuuuucuauauugggcuucugagauuuaaaaagacccuaaaacacuggaauggaugauguccaagauucacuccaacucugauauucuuugagaaagccauaucuuggucauuucugaaacucuuacuaugucuaauaugacuaauguuaauauggaaguauaaaaugugaguauugucuuuccuguacuccccuccaaacucccaaagauaucccccuggauauacuuccacuucuuccuuauuaugaauucaaaaguguguguguguguggugugugugugugugugugugugugugucaugccuacuucucuacccugcuauuccuuuuucugaacauuugcauugccauguggaauaucuauaaaaguauaaaccagcucugucugggagaaauguaaugagagccacaaauguauuuuugaauuuucuaguagcugcauuuuaagagguagaaagaaacaagucgaauuacuuuuaauaauauauuuuuuuuaccacaguacauccaaaauguuaucauuucaacauguaaugaauauaaauauauggaugaaugagauauuuuuacauucuuucuuuuuacuaacuguucaaacuccaauguguauuuuacacuuacagcacaucucaguucagacuuuuuucagcacauuucaagugcucaguagccacauguacugauuggacaaugcaggucuaagucaucaaauaaaaggauaaauuaaagaagaaacagagacaacuugccauuuauugggaagaggggagaaaauaagucagugcccuucucauugaagucucauucuucugugucccacauugucuucuuuucugguuguguaggggcuauagauguuggggcccuugcauguaaaaccagccaagcugauauugaugcagcugccuggccuucuucuccugaauuaauggugcuugagcucaaacuugcaaguauaaaguguuuaucgacacuaguggaucauccucaauauguccuuacuuuaaaaaaugcuugcaccuggggagccucauugucucugugaucuuucacuccacgugacacuuuaagaaacaaaaauugcuguacgaaggaucaaaguaggagauuuccaugccuguuaguuuuauuuaauuuuaaaaaaauuuaaacgaaaaaguaaaauaacauagucugguuguaaaaacaccuaauguuaauacagaaguauaaaaugugaacauugucuuuccuguacuucuccaaaacucccaaagauaguccccucgauauacuuccagaucuuccuuguuacaaaugagagagagagagagagagagagagaaagagagagaguuuauaaaugcuaaaauacauagguacacauguacauauguaaauuuuucucacagaaaugggcuuacccgauacucuucuguacauugcuuauucgcuuuauuuuaucauaauaugucaguaccuagagauuuaacucauuuuuaaacagauuaauaacugucaguucauuuauuucauaauuuaauuucuucuugauggacauuuagggguuuuuuggucaaaaaauacaaacaauauuuacugcaaacaguguugcaguaaaaucuuugugcuuauuuuauggagcauucguccagguauuucuguacaguaaauuccagaagugaaauuacagggucaaaugacaugcaaauuuuuuaaauugugcuagcuaaaccaaauuacccugcaaaaaguuucaacuaaacucuguuuuuagcuugaggugggagguaggauugagauucucaaagaugaagaaagguugucaagaguaaagcaagaaaagaacucuuauguaagccuugcuaccuuuucuaccacuacauuaaaacaauaucaaguggagguuggccauggugccuuacaucuguaaucccagcacuuuggaaggccaaaacaggagaaucacuugagcucaggaguucgagaccagucugggcaacauggugagacccugucuguacgaaaaauaaaauuuaaaaaaaucaucugggcauagugaugugcuccuguacucccagcuacucagaggcugaagcaggaggaucacuugagccugggagauggagacugcagugagcuaugauuacacgacugcauuccaggcuaggcaacagagugagacugugucaaaaauauuaaguggaaaacauaagugaauaugguaauuuuauaaaacuuuuguuaaguuugguuugaugcauaagagacaucuuucaacuguaaaauucacuguggguuuccuuuuuaucaguuggguagugauagggaaggaaucaaccucauuuugucaguuaaaaaaaaauuaucucagaucacaucccaagcaguuuuucagaccaguuuuuuuccagugcacaggcaguucaaagauuauucuacagaauuucagaagugccuaggcuugaagaauaauguauauugaguuaugauauuccuuccaggcagaauuuaggugcuucaugucauuuuuccuucuuagucaccagugcucaugcaucauuacuuuggaugccuucuaggucuacuccuuggaauaacucuagaagcuuuuccaucagcugcuuacaauaggaaaauaaucaaacuaguaguuucaagucuaccuggucauaaagucucaggucuaccuggucacaucuuucagccauugagucagaugaaaauauucagcuugagguccagaagccacccacuuuugauuauaaaacacagagacagucacuauuuuauacauugaaagccaauucuuuuuuuuuuuaagagaaaaacauacacauuuauuuaauauguuuuaugugacaugggagccuucagaaaugaagacccaaagaaacagagacaacugugcauuuuuauggacagucaugcagaaguguggccggaagaccaaggguaugaucuaaugguaauaaacugggggaaaccuggcaaggccugcuuguucaggugcauucuguguccccgggucuucagagauaagaaugcuccuauccuccagguguagggugggcaccucuggaaugaaaguuuuauggccaacucuaaaggaaaauuguguccuggauggaaagucaguucuuaccagucuaaucuuuagucaguggcaaacuuaccaucucauuuuucucaugagcaggagguacuucauagcccuacaaaauaaaaagaaccacaccugcacaaaauuauucuagcuggggcuuggaccuccaaucugaguugagucuggccuugguaacuccuuuaaagugugguguaacauuuacauuuguuuuauuguguuuaugcaaauuuacuagacaauaauaaauauaguaaauaacuucagguaaauguagauugcugagauuuuauuguaugccuacauaauuucccaccaaacacaaccaaggcgcuaaauuacaacaaauaguaagaugugucaaaagauucuacuaggucuuguacuaaaaugauaggggguagugacaaaccaaguaacuccauacgggcccuugcuguggaguggucuguggcugucugauacccuugcucuuuuguuuugcgcugagcaucuaccucccaucugguguuccuaugguggcugaaggagcuggugucugauaagacccagcacuugguuuaacugagaaacauuggguauauucuuacagaaauaaaagauauuaccuagcuucuuuuauccccucccuucaucuucuuucucuucuucccucccuccacgcuccuguucuccuccuucucuuccuucucuuucccucucucccuuuguccuucucucccucccacuuuaaccauaggaaauauagagcauuccgcauggucuuucgccuuuaaccuucucuggaaauacaugauagaauuggguuugugauuuauugcuccaguuuugcuugccaaauuaaauuuacagguauuagaauguacucauagauaggauuguuuaagaguuguuggcugcuuaggagcguguguguaugugcaaaugcacauacaugcacuuuuauaacaggaaaaagaaaggugugacagacagcugcagacauauggauuguacuuacuugcuaauugaaacauugcaagggacaauucaagauggcagauuucuaguggagauuagauuuuaccaugaacugaacuggauacuaccagcucuucucuuaucacuggcacagaguuugcuggacauucccagucuaaaacuugggaggagauccaauacuuugaaaguugggcaacaagagcgugccaaauguguuugcacuguguugcccaaccauuuaauuguaauaauuugacaugcuaauauuucaauauucagaaguaauuuggaagccaauugcuuuaucuguuuugcuuaucagagucauauugaauucucuaggcaucagcaugcaauaaacuuguuuucaaaggcacucuguuagguggcauacagcccugauuaaaaacagcacugaacuuagacauguuucauuuuuuucucuaaccuaguaccuuuuuuacagauugcauauuaacagcuuauuuuugcauuuaccucuguaaacccucaaucaaaauuuauuuaaaauauugggagcuuuuaguuuaaagugauaccuacuggccccucaaaacauccagcauuaaaaaacuaagacuggcagugaaauaauuaucaaaauuauaggaagaauuuucauuuagccagaacugaauugaaaaauccauuugguggccaggugcaauggcucacaccuauaaucccagcacuuugagagaccaagguggacagaucacuugaguccaggaguuugagacaagccuaggcaacauagggagacucugucucuacaaaaaaaaaaaaaaaaaugauccaggcaugguggcacgugccuguagucccaccuugggaggcugagguaggagaauagcuugagccugggagauugaggcugcagugagccaugauugugccauugcaacccagccugggugacaggcuuuuuucugucucagaaaaauauacauauauauauccauuuggugacacagguuuguuaugugcaccuggaaauagguagaucuuuauuccccucccucaaguccccuuguuucagaaacacaagguugacuucgguucagaaaauggccagcucuucccacuaccuuuccuguugagagcuccauagugcuguugucuuaccuacuccacaguauuacaucuuuugcucucucggguaagacgcuucaaauaccagaaaacacauacaugcaaaaaggaacuaggggucuggaggugagaagaaugggauauuuaguaaguggggacagagacauaagaguaauauuagaagaaacaugguagauauaaacaucuaagcuacucagagaccauuaaauauuuacagaauaaguucaaaguaaugucuacauugcauugacuacaaauugucugguuagauugcuccucuuagaaaaugaaaaacaacuaucuaaaagaaaaaaugauuguaacuuuugaaaaaauacuacuagauaggguaaaguaacacuucccaaaagacucaaaaaaccaaagaaaaaaauucugaaagugauuagcuaaaucagaagaaaauuucuaaaagucaguagacugagaagaaugcuagaagacauacucucuaaaacagaaaaaaaaaaagccacaagaauugaacacucuaaaaugugaaaacagcaaucugagauggagagaccaaugauaaguggaauuguaaggaaacugaguauauagcacaguuaaaaucugauaggaagcaguaaaacauagaauuaauacuguaggaaauggaaccauugacauaaaggaugauauuggaaguucucacaaaauacugagaaaaaaggaaaaaagauuuauaaaauggugagaaacugacaaacaugaaggauaaagaauagaaaucuggccuaagaaauugaugaucuugaggccgggugcaguggcuuacaccugugaucccagcauuuuggaggucaaggcagggggauugcuuaagcccaggaguuugaaaccagccuggacaacacggugagacccugucucuaaauacgaaaagagaaaggaaauugauggucuuaaaaugcaguaauaaaagccauaauuaaagaaacauguuccuaaacugaggaaaaacuugaguacacaaauuaaaagauccuguaauauuugggggaaaaucauuaaaaagagacauuaguacuugagaugcucagggcugugaauacagaaaacucauucuggauccacuaaagaauaaaaaacuuguugacucacauaaacggugauuccagagauaggugagcaucaggguuggcuuaauccagaagcugcagcuccauuucucuaacauucccuuuucuaugucuuggcaucuucaaaggcuguuuucauucauuggcaaagcgguuacaguaguuccagguuucacaucugcccugcaggauacucagauaaagaguacguucuucugugucaggauuucaaacaggagcccugagaugcauucuuagggcugcuugugaugugggccugcaguggaaccagugacugagaccggaacaaaggaauuugcuuaucagauagaugguagauugaagaacaucaguguugugcuacaaggugaaaggggagacaauccauggaauucacuccaaagauugacguggagcacauuuggaaaaauguuugaauugcagggagaaagaaaagaaccuacaaggauaaaauacguuucuauuaaagcuauacacaaaggaaagaaaaucaagcuggccucagacuucucucuuguugaaccaaagccagaggagaauagggaaaauucuacaacuuuguugggggcuaagucuauaacccaagaacuuuauuuucagcuaaguugucuuaaugugugaaggcaacacaaaguuuagugaugcaaggauucaguuucuauuuguauauuuguuaaauacccauugggcauuuaccugagcugagaaggauaucaaaauccauacaucaagaacaggaugccauacuaugaaaggacugguaugaaaggguugcccuguagugauacugucacagaaccaacauccagcucuucacagaagcucugagaacuaugacuucagcagaccucaccuguuuguacuggccguguuaaugacccuauaggaaugugguuggguuaguauauuuuucacaacagcgucuggaugagguuuaaaagcaaauaauuucauuaugaauuauuaguucuuauuaugagacuagcccuguaauuggaccucagaaauuccccccugaaaagcuucaggcagaguguaccaucagauuuaaaagucuaauuaaguaugacuaaaauuauguuucauuuuacccuaccuuugacuagaaagaaauggucucuaaagaccuaaaaaauaaauauaugaaaggcuauucaaagugaaaaaccaaagaugaaauggaaagggagaugaaugagauaagaaagaauuauaaagacguaaaauggaguagcuaaauuacaguccccuuaaggcagacagcaaauaacaaaauugacacuuuaggagaauugagaaagugaugcaaaggcaaauaggguuaaacucucaggugggugauguguuccuucugauaucaugucuugcauuuuucccaauuuucuuaacaugcauuucucuacuugaagaugaucuauauuaauacaaaaagugaaauuaaucaaaauguucaguauuuguggaacugcuuaauaaauaacaaucuaucaauacguuaugaaauguugaaauucaaaaguauuugugcuguaguguuccucccuauaagugagcguguugacucucauucauguuauuggauuacauuuccaauauucaguguuauaaauauuacugcaucccuuacccauuguuaaaauauugaugugcuuccagacccauugguaaagagccccuccuuggagugccccagcucccuggaugccccugccccucuccaagaucccagggccucccuaagauuccaccacuagagaguuaacagcugacaccaguguucuuccaugucaaaaaaaaaaaaaaaaguuuuuuaguauuauuucagguuauagaaaugcauuccugggaguagacauuugcuguuauuccuguauucucuuuaagcccccugaagucacucuguuucuggcagugguuucuuccagcuaccacuugcacaaaugcuggucuagagcaauucauuaugcuccuuauaauaucaaagaccuucuacuccuagucccuaacucacuucugaucuuuauccuguuucuuggaccuuaaaggcuucuggaaauggguaaaauuuagaauuuaaugucagugaaauucuucuuuugguuuuguuguuguuguuguuuguuguuuuggggcagauuuagcauuaucauucaccccuguuagccaucuuggcacagaaauguucaccugaagugguacccagaaugguccccuaauauaucuacacccuaaacacuaugaauuuguuacauuacauagcagaagggauuuugcggauguaauuaagguuaugaaccuuaccauagggagauuauucuggauuaucugagggggcccaaccuaaucacaugaguccuuuaaaaacagaacuagccucgcaccguggcuuacgccuguaaucccaacacuuugggaggccguggcaggaggauccccugaagucaggagaucgagaccagccuggccaacaugguaaaaccccaucucuacuaaaaauacaaaaauuggcugggugugguggcgcaugccuguagucccagcuacucgggaggcugaggcaggagaaucacuugaaccugggaggcagagguugcagugagccgagauugcaccauugcacuccagccuggcaacagagcgagacuccgucuaaaaaaaaaaaaagagagagaauuuucucaggcuagaagcaaaagagaugugagagagagacuccaaguaugagaaggaucaaacaugcuuugcuggcucugagacguagcagccacauuaggaaccagagagagaccucuaggaacaaugggcagcccccagcugucaacuggcaaggagacagggaccucagucuuacaaccacaucagacugaauucagccaacaaucacguaugagauuggaagcagauuuagccccagaacuuccagaauggaacacagcucugccgacaccuugaugucagcuuuguacaacucuaacagagaaccagcugagccaugccauacuuggacuuuugaccuacagagcugugagaugauacaugaguguuguuuuuuuaagccacuaaauuggugguaauuuguuacaacagcaauagaaauuaauaugccaacauguaaaauaacagcaacaacaaaaaaaaacaacaaaagaucguggaauaaacaauaaacauugcagaaaacacaguucugaaugccuguugucgcgcucuggcugagaaugucuacacaguaaugagcaccaaaucugaaggccaaaagcacucaguaggagcuuuauucucugcacuccacucacaacauacaaaaaggauugggguuuuagggggaaacaugaguguguauguaucuguguaucauuuuugguaagaaaaauauuuuagagaugaaccauuuuaacaaaguggccuuguuguagugcuguaauuaaaagaggguggguguauuguuuguagcuucuuguuuguuuacuuaaagucaguauugcauauaguaacaaauuggugagaagaaaaaacuauacaaaggggagauuguuuuggcaaugguacaugcuguccuauuuguauuuuacuucuucugguacaauuguaaagcuuagacaagcuuuucaagauguguuagcacaaggucugguuguuauuuaugguuccuaagcucugaaggcuacuuaccuaggcucaacccaacuagaagguaaagugaauugcuuugugguaugaauuacacugguaauguggaaguuugcugacauaugcuguaauuccaaagguaguuaagcacaggaguugauguuggagccagacugucuggguuuaaauccuagcucuuccacuuacuagcuguauagccuuggccaagugacagaaccacccgugccucaguuuccuuuucugugaacauggauaauaaaacuaccucucucaugguuuauugugagaauuuuagaauauaaagugcucaaaauggcauuguagcacaucaauuggaagcaauaaauguuagcuauaacuaugauuguuauccuugccuuaaacaugaaaauauucaugaaauuggggcauucgggcuccuuggacacaagaaacaauuaaucccaaggauccccccaggugaagauggcccaaccaccuguaugagagaagcaaaccaggacauccagucaccuguuaggcccuucuguccccacuucacugguguuuuuaacuucaaauuagugaggcuuuauagauaauguuggcauuauagcaguccuugccauaaaaaucuucauuuuuuaacaauugacaaacgcauuucucaaucugcuguuucauggaauaguguuucaugagauaauaaugggcaugcugugaaaugaucggucaauacuaaaaauuugggaaacacgagcuuaaagguuucugugacucagggcuuaucacagcccucauuauuaauguaaauuuugaauuuccaaagauauauacauauagugcauagcuccucaaauauauuugaccgugagacuuuuuuuuuucaagauaugccucuuaaaauuuccuggaaguguucuucacauccagcuugggaaacaacugcccuaaaauaggagcauauuuuaccauuauuauuuaacauuuaugaauuaagaugauuaugaauuguagcuuguuguaaaggagauuuuuauacuuacauaucccaaauguauauguuuauguauguguauccauaguaaaaacuaaaacuagauaaagcagugaagagucuauuucucacuuuguagauuaaaaaugguccuuguuaggucaaauuaaugauuuuucccaguaguucuucucugacacagauaaugagaucaucuuauagauggucacuuggcaaacacucggucauccaauacguauugaacugggcauucuagguuugucauccaucacuuuagugaggccuuuuauaaaauaauuuguaguuucagccagcaccauuuauugagaugguaaguucuauaagguuaguauccuguaugugaagaaauuccuuucuauugacauaaacuuaccucucucaaacaucagggauucaucccuucacuugauauucaagacuggugaauacaaccaaguuuacuuuuguugauuuuauauacuucagccuuauccucuaccccuuuggucuuugucuuucucaacuaaaaaguccccauuuuuugguuugucacuugacucaugucaagaccugcgaaggaugugagauuuuuccccuauuugcagguuaacaaauuagucuaccacaguuucaugaaugcuggcaaaagacacaagacucuuggguuagagacaaagccuaguuuauuacucacagcaauagcaguagcuacaguaucagcauuugcaccagauucccaauucccauaggaaaauaagaaggggggcagaugacaccugcaagcacgcacgaacacacuuacacacacacauacccacacacacacacggguuguguuacaaaaacgaauccccaacaugaaucuuuuauaauggucaguuaagucggccuuaccuuugccccagcagaagcuauuaucauguuuaagagcaaacaaaccugcucaugcuauagagggagacacuaucaucuuccaaagcaguuuacuugaaaaucuaauccagcacaaaugcaguuagugucucuacuugcaagaugugcagaaauacaaagggcccaugcagaauugucucccaacagggaacagcuguccccugcguccacuacaccacuguuccuuccucugagaccuuucaaguuucauuauacacacaucaaggucuguagccaaaccugcaauauuuagaugaaaauauauuggugcauuuauuucuuacuauagaacuuaaacuccacagggcaaggaucuuugcuuuguuuacuuggauaucccagaggcagagaacuauauccagcacauagucagcauucaauaaagauucguugaaugaguauaugaauuuccuguauucuuauuuggauccauaaguuuauuggcuuugcugugcagaagcagcaguuauaucggucccuucaagaaacugccugcagagauuccuggagucaucugccuggagcauugcccacucaccuccucaacucaccuccuggcugcuccacgucauucuuccaaucucaucuuaaauguuauuuccuuaaagaaaccuuuccugacccagaguaaaaucaguaccuucggguauucacucucacaacaccuugacuuuuuuccuucauagcacuuagcacaguuugcacuuauauuuauuuuaguguuuucuggcuuaaaaccuguuugcccuaucacucaugaaacuauaaaccagacccucucuauuuuacucaccacuguauaacuaguaccuaacagagcauggcauaaaguggcuacuaaguaaaugaauaaugaauaaaugaaugaacauacugcagccuguaggucagagcccaucacucugugaguagcucuggcauaaaaugggccaaaugcaucguuugcuccuugccuuuuucaaaacaguuuucccauguuucucuucagucacuuagucucaagauuuuucuucaguagaguuuagucauuuuuuuauuuuauauucccagaaagcacuuaauuuuaaauucagagguuuuaugucauuuuacuaaucaaaacaguauaaacauauuaagucaauacugguccuagcauuauuccuuugguaguucuaauguuuacacuuaauauauuuaacucaguugcauaauaaggaaaugaaacuuacagaagaaucccaugggauucuucucucaauuaaugaaugagcaaauauucuuugaaaaccuaccaggugcuggccaggcgcaguggcucaugccuguaauccuagcacuuugggaggccaaggugggcagauuaccugaaauugggaguuuaagaccagccuggccaacauggugaaacgcuaucucuacuaaaaacacaaaaauuugccagaugugauggcaggcaccuguaaucccagcuacucgggaggcugaggcaggagaaucgcuugaaccugggagggagagguugcagugagccgagaucgcgccacugcacucuggccugggugacacagcaagacuccaucucaaaaaaaaaaaagaaaaagaaaaagaaaaaagaaaaccuaccaggugcuuacaaucauucugggcacuguggaagauagcaaaaaccugaagacugagccugaaggagguuauaacuuacaugagcaaauaaaaaugugcaugauguguuagcauguaauaauuagcaaacaguaucagaccaggcauauguaagugcugagccacaugguacagauuuuuaaaacuguuaagagcuuagaaaagucagauauuacccugaacuagaauaauaggggcuuccugaaguuaguccugagcuggauuuugaagauguuugauuggauauuuaacaagaacuucauuaggcaagccacaaaaauagcagugcauucauucucagaaaagcaagaccuggcuguacuggaagguauaaguugggaaauagugucguguaugcacaaucaccguuggauuauaugaaucacacagucuuuaugacuccuuuuccauucaauucaauaccauacagagauaaagccacaccuuuggacaaauacagccggggugugagccgccaaaagauggagccuuacuaaggaguauccacgaaguaaauaaacuccgaaggaaagacuuggaaggucauccaacauacucauaaauuccagcuauugccaaagaugaaagggaagugagagccaugaggaacaauaggaaggagugccccugcccccucuuaacugccuguuuacaggaggggaggagcagcagugcugcccagauggcagagccaaaguuagaaugaagcuucuuccucacccuaagaccucuuuaggaaauccuguuugugacgguggcuucacugugaagucaucaggagcccccuccccggguugcaggagcacacuucuggauugaaccaugguuucuaaugcugcuuggaaaucuuauuaucaugugcacucagcaagauagaaacugcauaucaggugaagcuugggucagacuuuauuuugcaagcauuuacuuaucuuucuuguacgauggaaaugcuggcaacacaauagcuuaaaaacaagauaagccucaucuuuuuuccuguguggguauguuagggaaugaugguuuugauggccuuuaaaaagcaggaaagggcaaagcccugugaugccauuucuuuggcauuucauuacuucauuaagagaauuauccuaaaagccugggagcuguaauacggcuuaaaaacugaugagagcugagugaaaacaccauagacuccaaaccaaauuaaccagaagguucaucccaaagagacccgcuuuuauauucgcaccugggguguguacuuuuccuucugccacucaagagcuuuugcgugugggggugaacaauuugcuuuccaugccaaacccgaugaaaugggauuugucuucccucucagacagguggccaagcuguaacagagagggcucugccuggcugcuugccucuuuggacaugcagcacugucagugcagcgccaggccccauaucugacccuguggccucacaaucuggaggcccacauuggcagccugggguggugacagcuucggucaguuguuguggaguuccacuggcagacaaagaagaguaggcgagugugcugauccagguuccuucuguaugauagaagaaaccucuaagguccugguaaugugugaaccaguggaauaccugcuccaauaauuaaaguaugagcuuuccuuccucuuuuucaggguggaccaggccuugggaaaggaauuuuggccuucccagacuguacacauuacuuaauguguccuucuacacuuauuacaugcaucaggagcagauuucacaagccuucuuccuaugagacuagguuagucacuaggguuaauuauucaguaguuaaaggaaauauugugauggagggaaaaauagauuuccagaagccagggaguagagggccucagaacaucaaauugcuccaugaagagaguacacagccauuuuuauuucagucuuugaacaugagauaguaaucgugauuugaauucucuaaaccucaaaaauauucccuucuuagcuguaaauagccacuugucccaaccccauauauccauggggagcuucuguucucccagagaaaaugcaguuaauuauagcaaagaaagggacccuaggucuccccuuccugccuuaagaguaaucuccaguaucucuacucaugagauaauaaaauguaucauuuucagaaauuugaagaagguaggucaggacucaccagugcuguuucaaaagccuuuugguugugagugccacaucugaccacugcacagauagcacugagaaagaaaauuggacccaguucucugcuuuugccuuccauucucccuguaaggguccacgugaacagcaaguuuggccugguuuccuuaggucccucugggcccauuucuuuucuuucaucaucuuuccuaaagcugauaugacaauuccauggggaagaaacaaauaguacacuuggaugaacuuugcgaaacacaaagaccuuuccucuuaucccugauucuaaagggauuuuucuguauuuaauaaguaaauaaaugagaacaguuuuagacugaauaguaagugucccauuuauaucauauuugugauguuuugaacagggugaaggaaaccauucgugauaaagcacauggauuaaaaaucgugguugacuuguuuaacagaacccaagucauaaagcucccuugaagaguacucaaaaauucuagcuacaaccaaagaugaaaagaaagugaauagaccucagcaggccugccuccucuguuucauccuuuagguuaaaugucaccuccuuaaagaggcuuuuucuauuauucuccaccagcauaucuuauuuucuucauaacacuuaccacuuauuuaaugauuuucuuucucccuaaacuguaagccucacaagggcagggaccacgucagucuuauuucuguguucccuacacucagcauagugauaagcacaucacagacuccaaaugugcugaaugagugaaugagcugcugaagcgugcuauaauggcaaaccuguuccaaguucuucauggacuuacagacuccucuggaucaccucuuucuuuucuuagaaccaacugaagaauacuacuuggucucaacaucaggcuuaccaguguuauucccauuaguucauuuguauuuuuuaaaacccgggauuuggccgggcgugguggcucaagccuguaaucccaacacuuugggaggccaaggcaagcagaucacuugaguccaggaguucgagaccauccugggcaacauggccaaacccugucucuacaaaaaauuagucagguguggugguacaugccuauagucccagcuaccuuggaggcugaagugggaggaucaccugagcucaggaggucaaggcugcauugagcugugaucacacaacuguauuccagcuuuggugacagagguagacccugucucaaaaaaaaaaaaaaaaauucuuuuuucagccugagucucaaguccacuagcaguuccguagucauagccaaacgaugcgauguagugaaguggucaugagagccagcuuuggagcaucuaguugucucuaucacuucuuagcucaaugaugaugaguuaucauuaaccaucccucaaccucaguuuccucaauuguaaaaugaggauauuaauauauaucccccacauagcauugaucugagguuaaacaguauguauaaagcacuucacuuuugucuuuuugcauuguacauguucagugaaacuuagccacugaacuuccuguucauaauguuaaauuaccuugguguaucacuuuucuagaacaggauaaaggauggcuucuucucagagguaacagaagacauuagaagaauucagaaucaaaaaaguccaaggaccuggaguacugggauucuagacagaaccucaagcgugggguacacagcaugaacugaggucacagugggcugggcggcauggccaaaugacucaauagugaagugaugacuaaucauuguagugcuccuuauaucucucccccuauaucccaccacagucaccacaaaggccagagcugguccuagagucuggcaaaaggcugagcaugaaagugaguuuaaggaaacccaucuaauaagauuaaagaaacuaugcagggcucuggggucaaggcguggggucagcugacuccuccacaaggaggaguugggggcuccuacuuggucuucccuuguuuuccauaguuccucacagaauccagagggcaguccccaaggcucucagagucuuacucugagccacaggaagaaguaccuuacgccagcucacaggggaacuccaaacagucagcaggaagaaacucagucacucagaugaaaaugauggugucucaccauucuucuaugcaguuuucuaaggggcaagacagagacauuuggcugugagacauuaauuaaucgaacagaauguacuuuaacuguuaccuuucuuaucuaaggcuguguggccggcucacugguuuuagucaaguaaagagcaaugacuuaugcauuuaaugaucucacuagacauaauuuccuuucauauugguuuguaagacaggugcuauccucucccaucucagguggagcucagaaggcccauuuguucuaauauuccugaaccauguaggaucagcaaucuggacuguuuuuuaaaaaucuuauaaaaaucuguauaauguaugcaucuuauguaagauuauuuuuuaaauaguauguauuauguucuuucauuuaacaaaaauauacaugguuguuguagagcuuuuaaaauacgaguaaagaguauaagucuauaguaucuuguuauaccagaaaguaagaaaaugcucaaaaaauaugggaacauaccagaaaggcacagaauuuagcuugaaggagccacuggacaaauauaaaacaauuugggcaucaaaauacauaauuauaguaaaggauuauaaccuccugaauaaaauuaaaauccaugaguccaugcugauauaaauaaagugggagaaaagagagcuuugucuuacaguagacugacaaucaauaauaacagagugaaugauggaguuagaaaaucaucaauggaugaugcuaaaacuacugaguggaaauuucaucaagagauuuacguagugucaaaauggcucuuuacaagauacuuacuuuaaaaauaaaaauaggaaaagaaagaggaaagaaaaauaaaccauaaaccagugaccaagagaugaccauuacuaaugguuuaauaguuaucuuucaacuguuuuuccuaugcauuauaacauuuuaauuuucuuguaaaauuagaucaugcuuuuuuguaaucugcuuuucuuauauaaaaauauaucuggaucuuauuuauuuguauuuaaauauucccugguacauaguaggcauguaguaaauauugguugagugaaugaaauuugcaagacuuuaaggaaagcugugaugcacauugguguaaguaaaguuuuuuucauucucaugauuauuccuuuaggacuaacucccggaaguggaauagugauacaaagcauauucaaaacccugagcccuuugauacguggagccaaauugcccuccagaaagauuuuucuacuuuauuuucccuccagggguguauuaaaugaaugucauucaauacauuuuuaaggaggaagauugggauuaaaugugugugaaauacccagaguagacccagaagucgucagucagaaaguaauagucauccaaauucuuuucccuguaucuguagguuagauucugucaggaccaaaagcugggauuaguaagaguugucaaagccuucagucauagaaaauggaguuuuuguugauacgggaagcuccaaguugggauagacucuuauuuucauuaagccagucauauaccguauaaugugcuauaccauccuucuuuuguaucuauugaaaaauccuaucagcugcacuggaccugaagucuacuaugucaaaguaaaugauaaagagaaaaaccugguuccuguuuaugauaggcuagcauugaacaucacuguuaucaacacagaaccuccaugagggcccccuuccauuugcacuuugaugcuggcuacuuagcacacuuaacaccagcuguuuccagugccguugccaaaggugggcagagcaaggugcaggauacauauacguuccaugggcagcugagcggcgugcucucuugugcuagccagugccuguggcaacccuucccuccugacuucagccuccccacuaguugcagccaggugguguauuaucuccugaucuauauauacauuaaacauauuauuaaggagaacccagaagaagauauuuagagagauagauacccuuggauucaaaagaugagcaaucagaaaaauuauaccauaauuugaauuugcuuauauuuuccuuuuuggcuuucacuggcuagcauguucucaagugaugacaguugggcugauugagagccguuagucaaauccaguaacaguauuaaucugugguuggaaaugacuguuaaaguaagugccaggcuauucaguugugguuuuuauuccagcuuccaauggugccaggcuuccagcaggaggaauagaggcugugguaaaggaaaccguuggcaaaugaaagaaaccagaaacugucacuacccauaacaacgaaacaacaaaaaaauuuacagaaaaggaaggggagacaaaggaaauuguuuaaagugguugaagccuguacagucugaugugaucauuaggcgugagggugccgcagcaugguggugccuaagacacugacuccaauuuuccagugagaacaggaaggcuuuaagcaccaaagccaugcuguccaguaauacugcugagcaagaaagcuuuucuugaaggaagagaauagcguuuaauugagacuauuuuugucagucuccuaacaugcuccucagaccacuaauaugcaaaagaaccuaaggaucuggucaccaaguuacgucaaaagaguuuaccccauaguccuuuuuacugccuuuugcagaacaaacguuuaauaaugucgcuauuguucauugguuaucaagaaauaacucauuguaacucagaagugcuuagcaaagaaucuaucucauauguacuuucuuuauuucaagaacuuuaaggaggcagguuuucuacguguguucaccaaagcgccaagauuuuuuuuaauauuuugagaaaauauuuucaguaaaucuguauucauugaaugaaauauuaaguggauccauaaagaagcagaugauauaagucccaggauaacaucaggagaaucugaacacaguguagcugaagcauuucaucaccccccaacaagaaaauugcuauuuugccaacuauucuaccacauugcaguguuucuaagaucuacauuuuuuucacauuuauuucuaaaaaucaaaaugugaauugcagucaacuggugacaucuuagaucugaugagauauggugguucuccuggaaaagcaaaaguuaguaauuuucagcauaucauuggcauccaauguuuaacucugggggggucaaaagacaucuucaagcacuagugaagaagacauauuuaauuugaggacauuuuuauuauaauuuaguagguaagugauguuccuucaaggcauucaaggaacccacucuggaauagacuaaagagacucugagucaguuaguguugcccacgagggucacagccggucaauggcagaccuggacugagguuccugcccagucuggagggucaacacaggguguguuguccugcuaccugucagagcaggcacaaagcaagacucagugaggcagaccccgauuugcucugaagcauccuucuaucugggcauuggcagaacucccaaaugaguggguaaagguaccaaaaaaguucagccucaaaugagugggucaguaagacaugagacagugaaacguuguucaauugugggacaugggauuggcuuggcagagucacucugcuccaugcucagccugcagccuccucccugguaucaaggccuuccuacuuccagguucaucuuuugaaauacaucauuuauuuucaaaauauacugauguuaauaaaaauaaugccaaagauauacuaaaaguuuauuuucuauaucuuuuggaaaauuuauaaauuuccauauaaagaaaaugaaaaugucuuuuaaauuuuuuagcaugcaaaaccacaguaauccaaaguauacauuaguuaugagcuaaaauuauaccaucugaaggugcauuuuaugagcaaugcauacaaugucuauuaacaaauuauaccaacauguuauuuguaauacguuaaauacuuuuacucauaaugcuuuguaagcuuuaaagggcccuacuuaauuagaugggauaaaugaacacagcacaaacuuucauuuuuuuuuaaugccuuucagcaagugaucaaauuuugaaauuuaucucagcguucucuuuuuuccugcuuccccaaaacaugguaaucaccuuguauguauaccauuggccuugucguuggcuguuauugcauaguagauguugaguuuuuaaauuugauauuugaucuugacuuaaccuaagucucaguuucucccuuugaaaugaggauaaugauauuuacuuagcagaguguuauuaggaguaaaugagacaacauaugugaaacaaagcaaagcagccccuuuccuguaauaaguguucaguaaauugaauuuauuauuauuauuagcuguugauguugaagaaaaguuauuuacucaacacuuuuuaggucacacugguuuuuaucuacuuaauuucuuaaaaauaaugaucuuaaggugaaauucucuuacauauuuccuuaaaauucauucaggauuuuuaucuagccaaaagugaucagaaguuauuuuauaguuugaaagaaucugaauuucauuuucaaggaaaaugugucccucaguuacaaugccaagacuacgagugaugaucaagaagucuaacuggucaguaauuaaacuuuauauuggaaguagacauuuauuugcuuaauauuccaaaaucugacuaaauuguuuucuaaauucaaaaggaguuuuugaguaaaacagucaguugcuauuuaacccguaggucuguaaaaccuggcagcccucuguggccacauagucuuaaguacaguauagaagaaauaccucccaaggcuuuuguuuuaugucuacauauucaucucuuucuaaaaccguaaguguagcaacauguggcugcauuuuuaacaacuuuuauugcacuuucauauuaaaaagcaauauaccagcaaaauuuuugaaguuuucauuuaggaaaauacaaucgggcugggcgcagugguucacacaccuaaaucccagcacuuugggaggccgaggugggcagaucaccugaggucaggaguucgagaccagccuggcuaacauggcaaaaccccaucuccacuaaaaauacaaaaauuagucagcaugguggcgcaugccuguaaucccagcuacuugggaggcugaggcaggagaaucgcuugaacccaggaggcagaaguugcagugagccaagauugcgccacugcacuccagccugggcacuccgucucaggggaagaagaaaacauauuucauaaauauuuuaucuuuuuuaacauauauuuuuaccaaaauguaauuauuuauuccuguacaugcuguuuuuuaucaaaugcuguuucauuucuuaugagugacauaaagccuuugccggugauauuuuucucuuauaguuauaaaaucaaaaauaugacagagaguuguaccucucuagagaauguauaaugcaaauggaucuuauauauaaucauauccccucagccuucucauucuuguaaguucauuugcuucauaaauaaacuaaauaguuuguacugaaaccagaaguugaccuuaauauuuguguuggcugggcacaguggugcacgccuguaaucccagcacuuugcgaggcuaaggcagcagaucgcuugagcucaggaguucgaaaccagccugagcaacauggcaaaacccugucucuacaaaacaaaaaauacaaaaauuagccuggugugguggcaugccccuguggucccagcuacucaggaggcugaggugggugaaugauugacccagaaaauggaggcuucagcaagcugagaucacuucacugcaccccagccugggcaacagaaugagaucuugucucaaaaaauaauaauaauaacaaauuuaaaaauauuucuuauaacuuuuuuuuaaaugugcuacggauagauugcauuuaaauacuugauaaaauaguauuguuuagaaaucaugauuagcaaaacugauuacagcuccugcucuuaucacgucccugacuaugucuaaguuacagaaucuucucagccauaguccucaccuaaauaaggaaacgcauuuauccccuuauuugucauuuuccuaacuucaucaucuauaaaguuuucuuagugaucuuuuuaaauagcacagcacgguaucauggguaaauuaaaucuagagauuugggccaaagauaggaccaaaauaacagcauugaauuuuccuugcauauuuagucauaaugaaacaaggaaaagaaaccacaggacagagaaaaaggagaaggaaauacaguauuaagcaaaaauaaauaacuuuggaacgaguaacaguucauucuauuuguucuugauugguagccuuacuuuuacugagcagguuaauuuuauuucucagcaguuuuaacugcuucauucacaugguuuauuauuuuguguuauuuucuuccaugauauggaguacgacagaagcugugauaucuguuuuuuagcagaugagcagagauuaaguggccugccugcacucugggauuuauuuguuaaucaguuacagagccagcacuaagagcuggaucuucugucuccuggucuauacuccuuuccauaacaugugguaaagugcuucucccuuguucugaagaaaucccuacagggaaccuaacacugcccugaucuggaaacaacauuguuaccugacaggccgguuugccagggugaccauucuuaaguguuuuagggagcuaggauuaaucuuuuuuucccaagaggaaguagcaauaaacugugcaccaaaaauaacgcuuuagcugcuaaauucugcuuaguaggugguuucccaaagaugauccaaugcaaugagucaucccucugagcacuuacugcacauuauuucuuuuuacuaauccucggugcuuuugguugcauguuuuuuaaccuuuagagcccuccugggagguucagagucuucucacuaugaauauaaaacagacucuacuacauccccccacaugucccucuuguccuuuacuuccuauacuuuucaaaucuaagauaauccaucacuuaggagaacagucaggaucauguccaaagauaaaagaucagcaguaaguuucuccagaguuagcagcagcuccaucucauucccaguauaaaaaucaaaaauguagauggauguaagucaauguguagaacccauaucaagaaaacuauaaaacuugauugagauacauaaaaaugacuuuccuagauauagagaauauuugauuauuagaaagauauuaaauauuccauuuuccugaacaggaagauugaauaguuguaaggauauaaaagguuuccaaauuaauucauagguuuaugcaacuccagucagaauuccagugggauuuccugaaaugcauuuggaagaguuaaacuggugaaaauagccaagaauuuuuuguuaccaaaaaaaaaaaguuaugaagagaaacuccugcuaccaagcacuaaaauacauuaugcaacuacaguaauaaaaauaaugugguaccagcagaagugacagacauuaauggaacagaauagagaaugagacuugaaacccuaauuuaggaagugaugcaauuuaucauaaaucacaaaucugggaggacagaacggcauaugcaacaaaugagaauaggguaauuggucaauuucaugggggaaaaaugguaaccugauuagauucucacuauuccucaccacagagcaaaugacagauggcuuaaagaguuacauauuaaaagugaagccauaaaagaauaaagaaacuauaggaaguaucugugacccuagaauggagauauauuuucaaagcauuaagaagucacaaacaaaaauacuaauauauuugauuauauaaaaauugaaaacuuuuguucaucagaaaauaaaaacacugccaaguuaaaaagcaugugauaaucuuggagaaaaugaaugaauaugacaaagguguaauauccuuaaugaauaaaagagcucuuaaaauuaauuggaaagccacuagcacaccccacuguagcuacacuacauuccuaucacacuguguacauaucacagugcuaaaucauuuuauacucauaauacaguucagaugacacaagacaguauuagaaauucagaucuuauuuuccauucacauauucuuuguccaaaggcaguuuaaggaaacuaacacauuacauuaugcuauaaauacuucagaacaguuuguccacauugacacuuccauuuccuaaaaugaaacccucgcuggcccacagagggaaaaaaaaaaaaaaaaggcuagcuuuguuaaccagcuuuauuucaacaagcacauccacaugguaagaacuuccucugaugagucauccacaguugucaaacaccaacuuuccuuuguuuggcccaugcagaaaucaggucuguggaagcacaguucaagagucugaaucauuuaauuguguuuuauucauaucugaauuugcaucugucacaaacccaauguguccaccgugaaaaauugcauccuucaaauauuacugaacaaaaaacccuauucaaauaggucuguucugucuagauugucugugaaauuucugaggaauguugugggcucuguuuccuguaccaaauuguugaguuaucacacaucauuggauucuacccaaagugugcuggauaggcauauuauauucagacaggauaccaguugucuuuaccauucauaaaggaaaaagaaaagauuacuccugcucccugccauaagauauaaacuaagaagugaaaauguguguacccauaguuuuuuuaauguguccuugauuucuuuucuucaccaagauuugaguuuuauucagucauagcuuuguuaugcacuuucuugucacccuguacuuguucaaaacuaaggacuauagucaagacucagauccugcccugggauuggugccaucuuagcuuguuuggaaaaaaaaaaaaaaaaaaaaaaagaucuuuagagauaccaucauauccauuuguauauaaaaagagaaaagaauggaagugaugcuguguaauuuauuuucaucuauuuacucuauuuuccaaauuuuccacaaugcguauauauuuuauaaucaagauaaucuguuacuuuuuaaauuuuuuauuuuuaauuuuuguggauacauaguagauauauaugggguacaugagauguuuugauauagguaugcaauaauuuguuauuuuuaacaguacccaugaugaaucauucaaaauauaaauucaguaaauaagcuuuuugaaaaaguuaaacuugcuguugggccaguaaaauuuuauucugauaaaauaaaugcuagcuuuuguugauuaaucaccacacuaaacucacaauacuagacacugguagacaacaucacugacauucaagggccagagcccuuauuuauauguugagcacauuauaauuuuuuaaggaaaaaaugagaaaaucagucuuucaguguuuggacuauuuuuaaccaaugauugaauccaauuugagaauauuuuuagaucauuuguaaugcuuuaugacugauacuuuugguuccauuuugagcaaagcuucuuuuuuucuuuuuaaagaagccacuucagccaacagacacuuccauuucagaaaaugucuagugauuauuuucccccaaaggcaacaugaaaaccuucagccucagaaagaugucauuuugcugacauccggcugaugucaauauuagaguuuuugcaagagaaaggugugugagcauagaggugaugauaauuauauacucaaagacacacccacaacagagcccauaagacucccuuuggcaaaaaauguuguauugaagacaaaaccaguggauucagagguuaaaaguaagaaguaguuuugagagccacauuuuaguuaccguaauguauguaguauuugcuguugaaaugucucuauuagacagacuuacuuuuguauuuucuaauuuuuauuccuuguaucaauguugcuuugaagucagccuaucaugagagaaaacuugacucacuuagcuaguucauuuucagagguguguguuacugauuaauguagcacucucucuugcuccaccuacacagcacuucagaaucauucucaacccagcuuacagccuaucgcuaccaaccagacuggaugaaaucuccuugucauccuauauguguagguagcuccaccccagugacccccuaguugugguugccuccuuagauccagcacuuccugcagacuauuaauuuaaccauguagaccuaaccauaggcaaugcucuuucccugcaaaagaggcaaggugcguauaguuuuacgaagucauuuacugaaagagagaaauaacaucuugaauugugguaugaggaggggacuccccccagucuagucccuuauuacacaguagcagugaguuauuaggaaaaaagagaauaaaaccugucugucuggaccacuuucauucugauuguuuugagguaugcucauuugauuuuuuuaaacagccugccccacugaaauaacaaagaacuuaauuuuuuuaaaaaauucugucuucuacagccucuugcucugagucuccuggauagggugaccaaccaucccaguuugccugggacagagagguuucccaggacacagcauuuucaguacugacacugggacaaucuugggcaaacugggcucguugguuacccuauuccugggcccucuccuacccaaaugaccagguauugaagaacaacagugcuaagguuccuacucaugaacgaauucccugguaaagcuuuuccuucucucccaggaaggcacaguauaaagcaagacugggaguugugagacagaauaaguuuauuaugugguauggugagguucuaauuuggucgagugauaucucuaguucagaguucugcugcagagugaaggcaauugauaagcccugagcccaguuaauaaucagagccucacuaauuaaucaguggcacucauuuugccaggugucccugaucgucucuaaucaucuauucugucuccacaccacaccaucacccuugcuccaaaugaccuuccagcauguugucauuaaaguuuuucaaugcuaagcccaauuuaaacuauagugaguauuaaagcuagaauuuccacaagggagcagaaggguuauccaagcucugugguuauaugaagagacagaagacaguauuccccggaguguugagccugcgauaucugacuauuaaagaagcccauagugacaggagugauuccauggggguaccauauccuugacuugccuccaauuuuuuaauaauacuaauauaaagucuucacccuugugaauuauagcuuccgaaguuugacucagauuuauuuuccugguucuaaaacuuucuuucauuugcaaaguuuuucaguacuugcuagucgccuaacuucaugguuagagugagaauuaaaaugcaauaaugcauuaggaacccagcccuuggaaagugcuaaauacaucaucauuucuuucccagccuuaagaaucccccugaacagugugauuggagagcaagagauaagggaggcuuuggaagggaaauaaauaaauaaauaaauaaauaaauaauguaauuuggcaagaaaaaauaucaaaaaguauauaaaaugaagaguuggauccuagucacagaaagacaaaucacauuuauugcugcuauaguagacaagaaugugccagcccagcuuuuuaauuuuaaaauuauggaagauauauuacauucauuaauaugaagaaggacguguuacugacugaauguuugugucccucccaaaauucuuacauugaagcccuaacccccaaugugaugcuauuuggagauggggcuuuugggagauuauuaggauuaaaugaggucaugaggauggggcucccaugauuggauuagugccauuauaagaagagacaccaaagagcauacccucucucuagccacgugagugcauagcaagaaggcagguacaagccaggaagagggaucuuaccagaacccuacauuguugaguuaccaugcuagcacccugaucucaggcuuuccacccuacagaaccacaagaaaauuaauuucuguuguuuaagccacccaguuugcaguacuccauuauugcagccugaguagacuaaggcagggagagaugacacugggagaauaaaaaugaaauuauuugaauauuucagagaaguaacuauuucuuggaaaugggagauacccauucaauuuuugucauagugauuagaaaugacuuuuucaucucaacgaccgcuuagucuuauuuuagucauauguaaaguugacucaguaaauauauuaauuuaugaguuuuguaauguuucagaaaucugaaguaguuuggugaguucuaguuuaauuuuaauccucaauuuugaguugaaaaaugguaggguuugucccucugcucucccucucuuucuuucucuccaucucuuucucuagaggaaguuacucauaguccaguaaauaugagcccucuguggauaaauaaauuauucacaucgguaacaaggaaaaauuaauucagcuauuuauuuuuaaggaaauuaccagacucauagucccuccuauggacagggaugccagcacacucucuaacuuguguuagagacacaagucuuuccucuaaguggcaccucccuucccuggcagagguuuuuuccuaucagucugggucucugugacggaacuucgucucagauucuucuuucugccacggucuuuccuugucauuacuugggcuuuaaauuguuuuuuuccgugcucuuucccaccagcccuucucccuuucuggaccgguuuuacuucaagugcgucuuuccccuccccacucuccuuaauccuauaccguuuugccuuugcuacacuuuuucucaacacuucucuuucuuugucuuccagggagaccaucccuagccuucauaccuggcugaagcaagcacuggagggcaaaguuccuauccugcuugccucuugcugcuucugugaagguuuucgcaagguuuuggauauaggagaauaauugucagccagccccaguuuuuaaauacacauuauuugcaggcagauauugucuggugccacaggcagauuaaagcauaaacagauacaacaauauaaauuggauuuggaguuggcucuugguguguauacaucuaaucguauauauguaccucugcagauacaccugcuugcacuugaauuacccagagaugaaccaaggaagugaauuuugagacaggaggagcugaaguugaagaaaagaagggacagaaagccuucuugcaggggggagcaauaaccacucagcauguauuaauugaguuccaauuauagccaaacugggcaguaaauucaguacucugaauacagaaucaagugaggguuggcccuguccucagagaacuuccaguuuguguguagaaaucaacagguaaacgaauauaauagaguugccuuaguauuaaaguagggaaugaagaagugaggugaacagaucauauaugugcaguguauggcaagaggcaauguugucggguuuuuuuuucuucugauuuuaaaacuaacacucauaaaacgcaguauagaaaaguagaaaaaugcagaaagcaaaucauucaucaucucaccauccaaagugaaguauaagauaauaguuucauaccagugccuuuuuuugcaugcauagacauuuuugguuuauuauuuaacccuaaucugauaaaucagguguuuggaaagauucagaucauaacaauagauuaucaaaacuugcggagcacaugucuccagacaaguacuugauugaauauaugguaaaauguuugucacuauacuuuaauaccgcaugcuuaaagccuuucauauauguagaccuaacaguuuuccuagcaguuuuuuuuuuaauuuauuuuuguguguauguggaugguuuccaaauauuuagcaguuuuuuuacccuccuccugaauccguaauguuugcuuggaaauauaauuucuuaaccaccuuuuuuaacagcucuaucaaaauauaauugauauaaccacacaauucaccaauauaaauaguacaauucaguguuuuuuucaguuuagcauauucacagaguuguaccacuaccaccacagucgauuuuagaacauuuuuaucuccccaaaaagaaacgccauacccauuagcagucugucuuacucagcuugggcugcuaacaaaauaccaugaacuggauuggcuuauaaacagcaaaaaguucuuccucacaguucuggaggcugggaaguccaaggucagagccaguaucuggagaggguucauuuccucauucauugaugaucgucaucuugcugugucuucauauggugaaagggacaagggagccuuccagggucucucuuauaagggcacuaaugccuuuuaugacauaauuaccucccaaaggccccaguuccuaaugccaucaccuuaggaauuaggauuucaacacaggaaauuuucaggggcacagaccuucagucuguauacagucaguucccucaaauccccuagucccaggcaaccaccagucuacuuucuguucguauaaauuuacauugucuauauaaauggaaucacauuaugugugguuguuugugacuggcuucuuuuacugagcauaaugguuucaaggguccuccagguagucucaguauaucauucuuuuuaugacucagugauauuccauuguaaguccauaccacauucuguuuauccauuuaucaguugauggacguuaggauuguuuccacuuuuuggcuauuaugaauaaugcugcuauaaauauucauguacaaguuuuuauguggaccuguauguuaaugcuuuuggguauauacauagguaugccaaacuaccuuuuuugcauauuauucauucuccaauuucagugaaauguuuuauauaauuuuauuauacaaggaaaauauuuaaaacuaaaucaguuaccuucuaaucuccucuccccaccaccuccaucuaucucauucugccagacuuuacuaauaauauaauacaaacuuaaaaucaugcuucuccucucaagucauguucacauuuccaucaaguucugaucaucuucuucuaaaugucuuugcaucucuagccauuuccuugucccaccuaguugaggcccuugucaucuuacuuguacacugacuucccaguugaccuccuuggcuugguuuccaucccuucuuauugacucaguaaaccccugccaaauuagucuuucuaaaacacuuuuucuauauugcuguucauugaagucagacaaaucagcuuagccacuuacucaucuguguuuccuuagauguuacuuuacuucccaucuguaaaaguaaguuaaucaaaccacuuccuaacauucuauuaagaugaaacgauuaccgcgacuucugucucccacugguaaaaugagguaaacuucuauucggugauucugcauuuguauaucuugucuccuugucuccugcuauuaauguauaaauacauauuauauguauaucauaugacuuacauuauauguauauuacauacauuauaauuauauacuuugaaauguaauuuauauuuuuuauauguguauuuuuuaguauuucccagcaccaauuacagccgcauguacuuacuggguaaucagucaauuaguguguacuaaguagaucaguuaauugauuuucugcuucauccaguuauuugaauaggugguaauuguaaggugauaaguuaacaauuuuaacuuaacugauaacaacucuagaauagaaugugguaaugaguauaaaauaauagauauucuccaguaauauuuuuuugaaagaucacuuuaugaacauggaaaauucuuccacuaaucaagaaaaauagcugucaaagcauagcugcaggucaaauacagguuacaaagguguucuauagguuaacccaugacuuccuugucuuuugaguacaaugaaauuauuguaacuaaaugaaacuuucauccccuguuaugcaugaaucauuuccuuucuauaacagacauaccaguauacacuucucaucuguuaaaaaacauacccaacuucuaaauguuguuugccacuguuacugagauuacaaaugauaucuaugcauuuuugaguuguuuuuuuaaaaaggcauauaaucugaaacuuaguccccuugguaauuugaccugagaaaauuuaucucacugauagacuuaaauacuuggugagguuuuugguuuuuuuuguuuuguuuuguuuuguuuuguuuuuuuuugcaaaacugcauacaggaagugauauugccaauucagaauuaauuaauccuuauugaaaaauguggcauucauccuuuagaaaauucuuuucuugauaaaguuguaagagcuguaacauguaagcaauauuuagugaccccagaggaaagacuguuagacuuaaaugugacuuggaccucaccacaugguggcaaaugguuccuuccuuucuacuucacugugugaaauacuuuacaugauuaucuguauaauauuggccaggaauaagagagguguguguguguguguguguguguguguguguguguguguuuaguuaccacuuaauuguaacucugcuauaagcugggcauucuaguagaugagauauauucauaaucucacuuaguugauccuaugagguaaguaucauucuuuccauuuuacaaaugaagcaacuaagucaaagaaauuaagagacuuuccuaagaucauauaggaagaaacagcuaaauagagauucacucccaggacaguccaucgccaaacagacccuuuccccagucaaaaaaaaaucuugaaaaaucagcauguuaacuaaaaagaaauaaaaggagaggggaauauuaugcccuuaauuaagccauguaacaucuccaguacucaguuuccucaucugaaaauagggauaauuguacuacuacauuucuccuggaauuuuugugagaaucaaaugagauuauguuuggggcacuuggcacuaggccagauacaacauucaugcucaauaaauuauaauuguuaagauuccauuuuuugccuuuuuuuggaaguuuuagaaaaaaacuuggacuucucaccuugucaucuuuuaagaccugucaagaugucuuucagagcgcaacuucgugauucuuuaugaauuuggcugcauuagugauaugcagguggcuuauauuaguuuuauaggacugcugcaacaaaauaccagacuggauugcuuaaccaacaaaagcuuauuuucucacaguucuggaggcuggaaguccaagaugaaggugucagcagguuugguuucuucugagggcucucuuuuaggcuuaccuucucaugguucucacauguuuauuucucugugugcaugugcaccccugaugucucuuuguguccaaauggcuucuucuuacaaggaaaacagucagauuugauuagggcccacccuaucuuauuuuaauuacuuguuuaaaggcucuaucuccaaauacaguuaaauucggagaucuugggaguugggcuucaacaugaauuugggggaaaaaaauucagcccaucaccuugcaauaaguaaauucuuuuccacugcauuuggaaaucauuauuuucaggaauaguaacauucauagaaaguaugguugagaaacguuaagguguguucuaaccacugaaaugcuaugacugcaggauucuccauauauggccauauauagugaguucauuuauugugcacagaaaauauuuaagaggucaaguuuaaggcuguauaauuugauauauaauauaaaaagagauaugauaccugauaauagacuacaacuauuuuaguacauuaauguugaaaauuaccuguuuauggcauuuguugaggaaggaaucagggaacguuuacuuguguaccauagguguaugcaaaaugaaauaaaauguuuaguaacugcaucugucagaguaaagcucuauggcagggauuuauagggaaaccuagagaagucuccucccucaaggggcuacuugaucuucuuggagaaaugccagaaaugucacaaaaugaccuuuuuuaauugccaguuaaaugcucaauguagacaaggaaggcuguguguuugaagcagacacaauugccucuaaagcccagaguuaagauuuagaacuuguaaugguuagcugccauaauauugggaggaagaaaagugguauaauuagaaaaauagacccagaggugguucacugcagcauugaggacaaaugaaaggagagagacccaugaggaaguacucugauagcagaguaguauggaaaaagugcucugagaaauaucaaagaaucucaccuauuuaugguucgagacuaggauggugguauguuccaccuuaucacgaaguuaagcagaucuuugaaaccuggaacugaauuugacgguagcacuguuguaagaaugacugcaaacagaaugcccgugauuguaaaacauggaauucaucuaccaccagguauucaugagagauccuaacccauacaugaaaugcagggaaaaccuucacuuaccaaaggaaaaaugucucaauuuuuuuuacuucuucccaacccauaaagaauauuuugcuuccugugaaacaaugauaauggcaaauaugauugaaauguaaucugagaacauuucuuauuuaaaauguaucuuuauucuuuuaggccucuuuuucguggaaguucagauguugaucaacuaggaaaaaucuuggaguaaguaauaauuauaauuuuacaccaguguccauagcauuaaaacauuuacagugacuuuccucugacaugcauaucauguguuuaucucuugucuuucuuacuucaagcagcugcugcagacaguguuacuauuuguguggugaguggagacaugguagaagugccguuuuaugcagagcccuaacugcucugcucuggaagcuuguauguugcuuguguggaucuuuuugcugcuccucuuucuucguguggcugagcuccaguucuuuuaguucaaauacauuuucugcuuguggucauuucaaaagcacccaccaucagagaugggaugccuggugaccaaguacccauccuuguccagugagcuuccuguccccacugaguauccuuggucacccagguugguucugcguuguuuuguuuuguuuuccugggcgaaggaugguaugcuacacaucucauuuuucuuuggagcaccaaaauagaaaaugagaacccuaagucuuuggcaaaauaacucugcaacuuugagaaagucauuuaaaacaccucgugaagggcuuacacagugccuggcacauaguaagcacuuuaaaaaguuaucuauuacuguuacuauuagaguucaucauuaauuauuuaaccuuuuauuuccuuaacuucaucugagaaaugaaacucugacuuaaauucucuauaagauccuuucuugugcucaaauucuuugguuucaguuacaucgcuccuugaugauuuacauaguuucauucaugucugcauguucaugcauguaugcauucauguuucuagaauguaacuggggcacuucuucugacaaagcaugcaguguggcauccuuuuuugguuuuuuguguuugaaaggcccauccaaauuggaguggaguaggaaaaaagugggaguucuagaccaaaaauagcccugaucuuuggucugugacauuuuauaggaaucccagugauuuuuaugaaauucgaagucuguaagacugaaaaaaaaaaaaaaaccaccccuaaagaacagauuuucauaucagcacugucuacucaagcgugacugcuuaaaacaguuaauaaaacuggaaccugauuuuguucuuuuagugacuagaagcagcuagacuucuguuaaugccagugcuacugcugagucagaacauaguagcuuuaaggccugaauaacauuugcuaguuuuuuaugccugggggcuuccuggguccagggcaggugaugcuacugcuccuacuacugaccacucuguacaguggauaaauucaacacaaagccuucauguuaccccugcuucugaauggcaaguuauuuaaucacucgaugaacucccaucuauuuuuccccaugacuguugaauauauuuugugugcaugugaucauaaagaggaaacuagggaaagcagacauacugaugaccuucuguuaaaaggaaagagaaucuugacuaaagucagcuugccaggacuugaaagccaucaccuucuuucccuuauuuauacuaccugacaguugugucuaccuccagcacugaugucugcaaucuuguuaacauuguuagugcccccuuaguacaugaggccagugaaauggaccagaaggaacauuugaccggcauguuugaccugcuuccaaagaaaagccaguucugcuuuuggcaaaguccugacaaucguagguugccaacagcaaagaagcuguagaguucuaugguuugugccuuuagauuuuacuuugugguuucuggcauugugucaucaaaauuauguucuguuuccucugaaugcauuaccuugccagagaaaagggacaaugcugcacccuagcgucacugcugaaguacuugaaaaaauauuucugucuccuccaucacugccauuuauagauuuugugcccuguugggcuugccaauauaaaugucaacuuuuaaggcuuauauucagcaguccaaauaguggaauuaagugcaagcauuuuuaauggaccuaucagaauuucacaacacauauuugggccauaaaaguucauucuggacaugaaaccaaauuuuuuuuaaggaaagccauauucacauacucuuuuuuauuuuuuucuuuggagacaaggucuugcccuguuguccaggcuggaguacaguggugcgaucuuggcucacugaagccuuggccuuccgagcucaaguaauccuccuaucuaagccucccaaguagcugggacuacaggcacagggcaccacaaccagcuaauuuuuauauuuuuuauagagauggaguuucaccauguugcccaggcuggucuugaacuccuggggucaagugguccacuugccucggccuuccaaacugcugggauuacagccaccccaccugguccauguucacauacucuuaaagggaaaaacauuucuguguuuaggaagauuuaagccuucaaguaauagcaaguauuaaaagugaaacaauaguuuuagccugugacaucuuagagcauuuuuaagaaugaugucauagcuaaauggaaauaaaauauuggaauagagagaacggaacucacucuggacucugugacugagcuugcuaucugugacuuuggcaguucauuuuauuccucauucucaauuuccccaucuauaaaaugagacuaauaacaccugacuuacaugucuuaggaaauuauuacaggaaucagaggaggugauagacuuaaaguuuuauauauauaguuauguguuuguuuaaaauuuuauauaaaauuauauaaaguuauuuguauauguacacacauacaaacagagaugugcuguuccucugaaggcuuuuggcauucaguugaucauauacuugcaagauguaauuagauguagauacauucaaagccacaaauaaaaaagauuuuaaauauuucuaggaguuauuaauauaaucaauuucuagcugacuggugaauauacacaaaaauauugauacacauagaccugacaacuaaaaaggaaugaaaggaaauuuuuaaagcucucuaacaagcauuuuucauucccuccucugcccugucccauuguauccagacacuuacacgugcauuucuuuucauaauuaauagugguauuuuugguuuuuuucuuuuuacuucuauuguaggcuguacuauugaacaaaucuauauauugcucauugucauuucuauuuauugcuucuaguaaauauguccaugaaucugucuuugccucaauaauguagcucucucaguaugccugauagaggccgaauuacagugucuuccccagacacccaggcagagaagccaugaugacaggguuaucuucccagcugaagucuauggccugggcuccguguaggugagggaaggggaaaugaagugcuacagaucuugagaccuguaccacaucuuccugaaaucuggaaguacauucauaagaacaccucuuccugggccuuagucccaacaaguagaggccaagcagaagacccuaaugugggccagcacaauuucuaacuguaguuaaaauuauuuguuccaguauuugaauagcuauguaccccguccacuaaacuaugauuuuauuuuugguucagaguuauacagucugugugagaaagaagucccugcauccucugauuuucucuguucaaaccuacuuacgaccuauauguaaacuauaaauaauaucuauacaauguauaaguuauguaaguccauugacccauuaauuuuuuaaagaaucuuaaguuauacauagauacaagcaguucauauuuuaagugugguagugauguauuuccuaugcaucuuguauuaauaacauuuucuaauuauaauaauaguaggcaguguauugauugauaauugacugugugugauguauaucaggugcugugcuuuguacuuuaaauuauaaauuuauauauuacuauaaauucaaauaaaguauaacugauccucauuacaacuguaaguuauuaucauuguauacauaaagacacuaagggucauagauguuaaguaauuuguccuuaccugccaguaaguggcaggugcaggauuugaacccaaaucugccuauuuccgaagccugugcuuaucacuugcuguucuuuccacauuucugaucccagaaugguuuucaggggaaauauaaauaauagucuuuuaauuuacuguuugcucacuuuggaauaccacagacuuccuuuuauaaaaucauguuuguauaaugcaggacuagcacguuuuagccucauuuuuccuucugauucuaauguauauauuuaauauguagggaauugcucuuuaaccaaaaaugcaaccaaauugauauguuaauaaaccauguuggaugagcaucauaaaaucaugucaauacugggguguucgaucaaaacacaaaaagcauucuuggacauaaaggaagauauguaccaguaugggucuccucugaauacaauaaguccugcuuugucacuaagucagagcuuacugccugguaauauauuuucuauuucuacaucaucccuuacauuuagugucugcuaccagagcaaucucuuaucuccucccacugaauuuuacaauucuucugugagauuacccucucccccauggccaccauauugcaguaggacagagauaaacagagacccugccagugauaaagugaaggucuccugggacucugccccccaugucucccccuuagauuuugccuuucucuggaaauugaugagaaaacagcuucugcauaguagcuaaugcuuauguccaugugugguucuuuuguagcgugauuggacucccaggagaagaagacuggccuagagauguugcccuucccaggcaggcuuuucauucaaaaucugcccaaccaauugagaaguuuguaacagauaucgaugaacuaggcaaagaccuacuucugguaaguuuuucugaugucaagcucgucugcacugugccagugagacaccugcucuacccagacuggguggugggcacaaauaucaguucaguagcugcuauaggcaucacaugccacagccacauggagcaggaggcaacagucccuccagagguuucauuuucacacuuguagcagcugguggcuuuugauucuggaaugucuuucugauccacauuuuuuuaaaucugccaucuuugaauguuuauuucaaugcagguuuagaagccucucgauucacuuugacauauguuucuuuagaaguaaauauuauguuuccuuucuuacaguuucaugcuacuuuaaguaauuuguuugucauuuuaacgugccuuuucuuaaacauucacaacuuuggggagauguuuuuccaaaagaacuauauagcaauacuucuucuaguugcugauuuauuuaauaaguauuuagugugccagggacauauaaaauaccucacugaaaauaaggacuucugugcucugagacucuuaaugcucaaccauauacauaauuuccuauacuuggaggccagaacaauagguagaaaaguguaccuguugggcuguucuugaugucugaaacccagugaguaaugagugucugcuuuaccuccugaauuaacagccuuugauaucugcuucugcccgugggugaagcacaggucuucuccaugugucucaugcuggggcccaugccagagaggcagcagcucccuggggcauguuuuucucaugauagaagguaucgaugcuccagaagggcaagcagaaauaugcaaugccccugaagguccauacuuggaagaaguacccgccacucugcccauguuccauuggccaaagcaaguuccaugccuaaggccaacuugaauggaggaaagaaugcucccccuauggugagaggggagagaaaagagggaauauguacuaaaaguuauccaaucuaccauaguauccaacucuugacuaaguugugauuccaaaagcucauuuuauaaguaaacuauuuggcaauuaaacuaaauuuucuugcagaaacaauauuauuaacacaaaguuuuuuaauuaacccucaaccuggcaaccuuguuccugaaguagagcaauaauagaacuuaaacaccuuuuuuuuaaccauauuucuauaggacaaaauguauuaagacuuccaacgugagauucucccacacccccacauuuggcuaagguguucuccuucucuccacccucuucccagcuuuaagccaucaguguagcugugaggaaagggcuuccucucacauaauccucuagagacaugucucuguauugugaauguauucccacagcucuuuucucuucuuuccuauguccuggagauuaaaugccacuaccuaauuuucuccuucuugggcucugggaaaagagaacucaggcucaggaauuuugccccugcuuuccgguccuuugggaauucagcccuugcaaagcuuuucuagagauguuucuugcuguuagagacaguuggaaccuuucuacagacaagcucuuucuuccacuugcccuuuagcucuugauguucagaagauccuauagggaggcuagcaaccauggacugauggggaucucaggauaaaucagauuucagaggacccaagaauuugccugaaauuacacauagaacuuucuguuuguauuuguuuuucuaggucaguagccuucgauagaauauuagagaggucccuaauccaguuggaaccugacuaggacugugagcaggaguccuauuaauaucaugguuaugcagaccucuuaaguggaagaggucuuccauuaaccaugauaaugugaagucuguaaauuacauagaagacuggaaugcauagacauuucauauacccaguucacuuuaggauggagaagccaguguggcuucccugcuacuugugagcuccuguggcaaugaggaggucuuacucaucacuaauuagugcuugccaccugcuaggcacccagcaggaggcguugauggaaggagaggaggaggauuugaguaacaagauuaccugagguagggguggaaaugagacugaaauuagggacacauucuaacuaauuuagguauggacaguuugggaauagagauugcugcuacugcaaagguuucccuuucccuccuuucaccuucuaccucaguagcucagccaaacugcccaaaccacuugacuaggaccaggagcuucuuaagcgcaggcaccagcucauucaccuugguagcccuacacuugagcugucagccuggaauagaguuuagugacucgaacugaaucuaaugguccccugagagagcuacugcuagccauguggcaccuugguauuaauuaaaaggaagauagcccugccucugagugguguagccuugaggcaggauaauaaguuacggugaagucuccgacuguagcacuaaguuugcuagcacuggaagaauuacuaaauaaaguuauaugcauacuuuaauggcuuagugagaaauccugggcaggaaacaguccauaggcacccaaaagggucuucuccugagggacauuuuauacauuagggauauauaugaguacugucuccauauuauuuagugucccuuuaaauaaauacucauucccacuguagaugcgcuuaacauaugacagugaauaaagggauaacucuguaaguacauuauuuacauugauguauuguauaucaaccaauuauuuuuuucuuuauuacagaaguguuugacauuuaacccagccaaaagaauaucugccuacagugcccugucucacccauacuuccaggaccuggaaaggugcaaagaaaaccuggauucccaccugccgcccagccagaacaccucggagcugaauacagccugaggccucagcagccgccuuaagcugauccugcggagaacacccuugguggcuuaugggucccccucagcaagcccuacagagcuguggaggauugcuaucuggaggccuuccagcugcugucuucuggacaggcucugcuucuccaaggaaaccgccuaguuuacuguuuugaaaucaaugcaagagugauugcagcuuuauguucauuuguuuguuuguuugucuguuuguuucaagaaccuggaaaaauuccagaagaagagaagcugcugaccaauugugcugccauuugauuuuucuaaccuugaaugcugccaguguggaguggguaauccaggcacagcugaguuaugauguaaucucucugcagcugccgggccugauuugguacuuuugagugugugugugcauguguguguguguguguguguguguguguguguaugugagagauucugugaucuuuuaaaguguuacuuuuuguaaacgacaagaauaauucaauuuuaaagacucaagguggucaguaaauaacaggcauuuguucacugaaggugauucaccaaaauagucuucucaaauuagaaaguuaaccccauguccucagcauuucuuuucuggccaaaagcaguaaauuugcuagcaguaaaagaugaaguuuuauacacacagcaaaaaggagaaaaaauucuaguauauuuuaagagaugugcaugcauucuauuuagucuucagaaugcugaauuuacuuguuguaagucuauuuuaaccuucuguaugacaucaugcuuuaucauuucuuuuggaaaauagccuguaagcuuuuuauuacuugcuauagguuuagggaguguaccucagauagauuuuaaaaaaaagaauagaaagccuuuauuuccugguuugaaauuccuuucuucccuuuuuuuguuguuguuauuguuguuuguuguuguuauuuuguuuuuguuuuuaggaauuugucagaaacucuuuccuguuuugguuuggagaguaguucucucuaacuagagacaggaguggccuugaaauuuuccucaucuauuacacuguacuuucugccacacacugccuuguuggcaaaguauccaucuugucuaucucccggcacuucugaaauauauugcuaccauuguauaacuaauaacagauugcuuaagcuguucccaugcaccaccuguuugcuugcuuucaaugaaccuuucauaaauucgcagucucagcuuaugguuuauggccucgauucugcaaaccuaacagggucacauauguucucuaaugcaguccuucuaccugguguuuacuuuuguuaccuaaauaaugaguaggaucuuguuuuguuuuaucaccagcacacagauugcuauaaacuguuacuuugugaauuacauuuuuauagaagauauuuucagugucuuuaccugaggguaugucuuuagcuauguuuuagggccauacauuuacucuaucaaaugaucuuuucuccaucccccaggcugugcuua

SEQ ID NO: 21398 - RNA, 30661 nt, Homo sapiens
agggacauagauaaaugcugcagacaucaguaguuuauuguuuguuuaguccaaacacauucaauauggaaacucaaagaauacuuuccaccugaaacaauuaaacuagauucuacuagcauauaaugcuuaacacauuacagcaauaaagaugguaauccauugucuucuauaccuacuaaagccaagaugguaaagccaauuugguugcaauagugucauaaggauagaauauuaccaucaaaaaauaaaacaaaaucagcaaauaacaguaaugguagaugaauauuuuuacucuguuucacugaaaagaggacaaaauguuaaaacuccacaguacugcaggugaacaaucaccauguaaacuucuccauaugauguuuuaauguuuuauucaugguauguaaagacugaagcugaauggcucuuugcucuacuuuucuauuauuacacuuaacauuugucauuacuuuuggugccagaacaguuuucauggauggcagggcaauauccugaauuggaaauuauauauauauauauauauauggaaacagaaauacaagaaaauaugcuugggggaaaaaaaacauugacaauaaaacaacugcuucuuuaaaaguaguauuaauaaaggcuucaaaacuccaaaguaauuuucugguaagaauuucaaguacuauaucagaaaguauaaaacuguuucaaacagaaaaaaaaaaaauccuuaagccccccaaaaauggaaacuaugaaaaucuguguccccaaaauauaugcaauagugcaagacuuucccucaaacauggaagaccucauucaaagggggaaaaagggacagauuuuacucauauugcccaguacaugaaaaacaaaauacaugcaucauuugcuaguuuacuaaauagcaaacaguugcauaauucagaaccaauuugcuacuaugucaagugcauaucuugucuguuuuacaaagauagaauggagaagucuuccaugcuaacgagcagcuuuaaguggucacacuuauuuaccccacuccugccugaaacaucagaaacugguauguacugacugcuccaagcauaaaauuggauaagcuuugccauacuugugguuuacuggaacuugcuauaaagacagacaauaauccagcagcuacaaacuuugcucacagaauuguuuaaagauucauguaaaaauaaaagaugucgucccagacuuaaauucaggagccacucgggugcugacaucaguucaagaauugugcaaaaugaaugacaguucccugccccccaaauagaaaaugcaaacacuuaaagagcugcuguucuuuucuccgaaaauugcaguauccucacuucaggcuuacuugccauuuauagaaucugacugcuuuuaaaaugucacuaaaaauguacgucaaguugacugacuuuuccaagcccugaagugauauguuucaacguccacauucaggcuaagagaaaagucaacuagaggcuuacucaaauaacugacuuccuccuucccucuccccacaaacacacaggacucccucccucccacagagaacacaaaguuguuaacugaagaacaagauaaauaauaugcuaguccauuuuacugauuuuaaagauacugcaauuuuuauacauuucgaugauuuuucaacauuuugcagcuguuuggcuuugcagcacagcaauucauacacuauacuguacaaaauuaccagcaagacuggaaugauguauuaauagaaggcaccaucaugcuuauuacauuaccagagaacaaaaauacaguaaagacaauuuucacuguacacagcuuaaagaaaggaaaaaaggggaggaggaguguguugagcagccagccaucccuguacugaagaggggcagguagaaaaaucuuagauauggagcuacuaaaucuggucuaauagucaagaccaucgcauuugaaguucuaauuuuuauuauuuaguucauaacuaaaaugauuuccuucuggaauauacuuguagucuuguuaagguuuauguguacacacgcuggucacagcaagcagauaaaaugcccucaucauuucacaaacuauuuucuacuggaaaagaagaugagauuuuuucccuguugccuccuguugcagaugucaauguuaaugaguucagaguacccauuaguacauuuugaugagugcauaacaaguuucuguugguuuguauuuuuggggggagccaagaaaaaaggcaagauucuccaauugcacaaauugcacuauuuguguucccagcauuaacaggcagaaacaguaacacuuaaacaaaaugugcagcagaagauuuuuuuuuuacucaaaggaccugaauucagugggcauguccuuuuaaguucacuuugucguagauaguuuaagauauggucauuucucaguccuuaauucuccaagucuagauuuauaaauuaacaaugugaauccuguugugaaauuggggaaauaauguccaccucaauuuaacugauaaccaaagaugcuuuucacaucaaagaaaugaucaaaaaggcugugucacauuccaaagccaaaaaaaaaauuaacaagaaugcaaacacgaugaauaauguaccacugccaagacuuugccaacaguggagcuucagcgacgcuguccugugaagcggcccuccauuugcccgguuccucuuccagagccaaguuucugugccaugccaccccuuggaggagguccucuuccaucacgaucacgcaucauuccaccacccacaauuccacguggaccaccgggaccucgaucauugcgccuaauaucccugcgaucaucaccaccaccucugguuucucgcucucuugcagcucuuguuuuuuucucuuccacauuuaaacguacuuccccucgaaacauaaucggcuuuauaaaagagaagaaaaauauuuacaugggcagguuagacagcaauagaaaugauuacucugaacaggucagucagauaagcauaaggaauaaaacacuuuuaucagccccccaccccccagagauagggucucagcugucacccaggcuggugacagccaguggcacaagcauggcucacugcagccuugacauccugggcucaagugauacucccaccucagccuccugaguagcugggauuauaggugucuaccaccauggccggcuauuuuucuuuuuuuguagagacaaugucucacuguugcccaggcuggucuugaacucuccugggcucaagcaauccuucugccuuaacuucccaaagugcugggauuacaagugugagccacuauacccagccaaaauucuuaacaugcaaucuugcaaucuuucccaccuucuucagcaaagcaaguaacaaaauuuaaaaugaucugcaaacuaacaaaucuuuauucuuugcauaaauaccauuuaauaacuauuuuuagcuuuauuauuaaaagauuuucuaugguuuuuaaauaccccaaauuaauauauacaacagaaauaauaaagucuugaauuaugcccuuuaaaucacuuacuuuugcaauuaagauucucugaacugguucagagucaucaaaaaccacaaaaccaaaauuuggaagcuuucccccaacacccuugguauugaugcgaaguuccacaacguuuccaaaaccugugaaaauauacauuacaucaaggguuaaauauuuuuaacagaauaccuugauggcucuaauuguucaggaugaauaucguuaucuccccgauccauuuuaaaauaaaacucgcaagcuucuacacacagugauagccaagguacguuuacucaagcaggcaauccccuaagauaccaaguagccugcccgccugcuguguuaccuuucugcaucuuugguaguccuuucauaaguaaaguuaacugcauaauuuuggaaagacaauguauuuucuccuaauauauugacccauuugccaaaugaauccuuuaucucugaauuuaugacugauuuauccagcuguuucuucuaaacacuacugagccaggccaaaucaacacuaagcagucacugagaaacaugugagauaagucaucuacucccuucugcacaauuaaggugggucugguagcuggacacaguauaaagagagaaacauuuaaaaaaaauaguuauuaaaaaagcuccauaugccucuugcuuaauuuaaaauaauuuaaaaacuccaacagcaaaauaaaucacuuacucaugaagaauuccuuuagcucauuuucaucaauaucauguggcaaguuaccaacaaaaaguugaugacuaucuggauagcgaauuauucuacgguugucagagucauucuguuccauaucuccucugccugagaauagaaauagagcagauacuaaaguuuacaauaucauaaaaacuacuucaaaggagugaauguaaaaaucacuuaauauugauauuccuguuuuaguuuaauaagacuaggugagcuucuugaaaaagaggcaaaaguacuuauuacuaguagguuagaaaacagcaugacacuaaaauguaaagugaggacaaugacuagguugcuaaaauagcuucuucuagaucuacuggauuauacaaaaaucaaauauuaguacuacagguauuccuccuuaaccaaacuguugccaucacccaggaaccaagcagauuucagauagugagguauagcuuacuaaauauuugcuuaguuuuuugaaauucaaaauucuuuggcuuuaugacauuacagcaaucaguaaauuuuaacagcaaucaucacauuuaugcagucuauacauauuaaguguguauguauauagauauacauaaaaucuuauuugauucucccaauaacacaaggaacacagugaggaaaauaggcaauacaagaauaauuuguguaauauuugacauaaaagaagcucagaauuuaaggguuucacucaagaucccaaguuuaaucacugacaaauuuaggacuucuaguuugguaacauaucacuuuaaaaauucacauuguaaaugugauauauacuaucuccaucucucccaucuccuccccaaagcaaucuaaacauucuuacagaguucaaauaaaaguauuacauguguagcuaacaagguaaacaagucaaaaaucauggcaacuuacuuaauaccuaagaaucaaaaugggcuuauuguuuaucuguaaagagauaagacugcuaagagaguagguuauuggcagcuugguuuugaacucuuaaaaccagugacuaggccgggcacaguggcucaugccuguaaucccagcacuuugggaggacgaguagggcagaucaugaggucagcagaucgagaccaucuuggccaacauggugaaacccugucucuacuaaaauacagaaaauuagcugggccugguggcgugugccuguaaucccagcuacuugggaggcugaggcaagggaaucauuugaacccgggagacagagguugcagugagcugagaucacgccauuguacuccagccuggcgacagagcaagacuccgucucaaaaaaaaaacaaacaaacaaaaaaaaaaaacaaaaaaccgugacaauaaccaaauaagacuuaagucuuuuacaccuucaaaauaugucaccauggcaugucaaccaauccucccuaaaaauugguuauuuggccccagacacuauuuagcagguugcucacaucacaucuuuaagcaauuugagacuauaugggucuguguauagaacgcaucauaguuuuuuguuuaaguucagucuuuuacagccuuacaaauguuaaaugcuaaaggcuauaaaggagcugacucaccuggucuugguccucuaggaggaaaaccaggucguucucuaggucguuguucacgcacacgagguggcugagauugaacuucugguuuagcuucgacucuuggcuaaaauauaaagaaaaaaaaacauuauaaaaaacacuccacuggagaaaaaccaaccaaagcaccuaacgacaagucacuagcagacauaacaguaguuuuaaguuuagaauguuuuuaacauaguguccuauguaugagaaaaauaaauuuuuaucaagauauucuguaccaaucuaggacuguagguagcuuuuguuuucccacuuaaugcuguguaacucacaauaaguugcuuuuuacagucacauuuuuucauuaaaguuauaucaacacugaaauagcauaaaagguauugcuaccaaaaaaaaaaaucacaaaaaugcaagaugaaccacuccauguaaauacauaaacaaaauuaaaagccaucuucaucuuagacaagaauacauaacacauaauuucugaaaaucuaauuugcuauccuucaaauguaacagugcucaguaguauugccuaaaucucugcccauaaccuuaaaaucaguauuuuuauaguucaaaguauaaaaauuagcuugcucuaacaccugaaauugcuaccuguaagguuaaaaugcauguuaaaaaaaugacagaaacuuauaggaacuuguauguagcaucucaaauaguuaaaguccuuuagcucccuacuguucuuccuuaugagaaaaauaugcauuugaaguauuggucccaacgauuuuccuuaacuaggggucugggaguaauaggacaguuuaagaugccucccaaaaguuucugccaacugcugaauuaaacauauaauuauuuuuaaaacaaaauuacaucggcgucugcuauuaccuuuuccucaagacaacagcauuuucaguauucccaaccucuucagaccuucuacuacccaaauauuuaugguccaaggagagacaaauauaugagccuacaaaggaugcugaaaacacccaacaggauauggagaacauguccucaacucagaaagcuaguaauuucagucccaucuuuaaagauggucaucuccauguaaucccagcacuuugggaggccaagcugcgcggaucaccugaggucaggaguuugagaccagccugcccaauauggcgaaacccagucucuacuaaaaauacaaaaaauuagcugggugugguggcaggcaccuguaaccccagcuacuugggaggcugaggcaggagaaucgcuugaacccggaagacggagguugcagugagccaagaucacgccacugcacuccagccugggcaacaagagugaaacuccuucucacagaaauaaauaaguaaauaaauaaaaaaguggucaucucugaggaccucaguccaugcagcggcucaaacucuuuaaucauuuauauaacagauauuguaauuuacaaggacaaauucugacacaaaaaugcuuccuucagccaggcacaguagcucaugccuaucaccccagcacuuugggaggccgaggcgggcagaucaccugaggucgggaguucgagaccagccugacuaacauggagaaacccugucucuacuaaaaauacaaaaucagccgggugugguggcacaugccuguaaucccagcuacuagggaggcugaggcaggagaaucacuugaaccugggaggcggagguugcgugagcagaucauuguacuccagccugggcaacaagagagaaacuccaucucaaaaaaaaaaaaaaaaaaagcuucuuucaaaaaugacaauuuaauguaaaugauuucagccacuguaaccaaaaggaauauuaacuccuaugcuaacaguuuaaccaaguuugccugccucuuccuaaauucuguuuuccucuaugucaauguccuauuucccucaagaugaaguugcuuaccauauucuagaauucuacuaguuauaaaaugaauauuuuuaacucucuccagguuuuguuguuauuuauauguauuuacuccuauaaagucuguaucuuuuauuuuuuuagagagacacagucuuacucuauugcccaggcuggagugcaguggcacaaucauagcucacuguaaccucaaauuccuaggcucaagugauccuccugccucagccucccaagcagcugagacuacaggcacgccagugcccaaggcccauaucuuaacuuacuuuuacaucacccaaagaaccaagcacagugcuauuagacacagauguucaguaacuauuuguucauuuaaauuaaauuacauuuuuaguucucugacccaaaacaugcaggauaauguucuaugucugacaaagauacguaagugacagcccugagaccaccgcuaucuguauuugggguuuaauucuauauaauaauuugaugcaaaaugugaugcugaaaaaggcaguuauuuagaaacuucaacuaagggggucuaaaggcauacuucaguaugaauauaaacagaauuagagaauaaacguacucugucaaaguuuaauaaagugaguguauuacuggcaauuaauaaaaacacuaaaugcaccuuuauuacaaaauuuaagaaaaaccuuagacucauucaauccaaauguuaucaaagaacuugaggcccuggucuugacugauuuaaauucuuuucaaaacagauuaucaaaacacgaguaacuacaaguagcaaaauaaaguucuuccuuauucuuuaaggaugaaaauuaaaaacagauaaaguuaaauauuaauaauuuccaacaucuuacaaauaauucaugccauugauuuaggaaucugacuuuaaguagauaucugaugaugccaguuuaagaaaaauacaagaacaaaaagcuaacacugucccuuucaguaacugauugacauauguuaacuaagucagcugcauacuuauaauucuucaggucuccaguuucaugauuaaaacuaguuuuucugaacagauaacauggccaauaugccacacaguagagggccuuaaaauuaauuccaugcaaccagaaaguaugaucaaaugacaaacccacaaaugaaggucaaacagaauaugaaguaaguacagaaccaucaaaucaagucaauaaaagcagguauaaccacaaauaauaagcccuucaauuaaacauaagcuuuguaggugaacuagucaauuuccagacaaaauauuuuauucaagaaauuaacuuaccuacuucuaaguuaaugccuaccaauacccuggaauuaacuuccuuuuaucaauaaucuauguucaaaguacaaggaaaugaauacuacacaaaaguaacaaacuaaaauugaaggauuauuaaaucaaguagaaauaucaugaauccauuuuaaguauagccuaaagacauuagaacguucuuuuaaaguuuaaauucuaaacauuuaaaauuuuuguuuuauuaaagggguggcauaggaaauacaacuucauuuccuacaacuaacuuugaaaauauauuuaaggcaaacuacuugagauaaauaugaagguauuuuucugggcaagagacuaggauuuaaucaggcaugucuuaagaguccucuuugaugcaaauacagauaagauacaugacucugcagcaaggugcuggagaauugcauaagguuuacaugaggcugggcgcaguggcucaugccuguaauccccaccguuugggaggccaaugcggguggaucacuugggucaggaguuugagaccagccuggucuacauggugaaaccccgucucuacuaaauauacaaaaauuagccaggcgugguggcgggcaccuacaaucccagcuauucgggaggcugaggcaggagaaucacuugagcuggggagguggagguugcagugagcuaagauaacgccacugccacuaccacugcacuccagccugggcgacagagcgagacucugucucaaaaaaauaaacguuuacaugagccacauauggacucaugucccacugcaugacuucaaagcccaacccuacuauguacauaaaugucugugaguuacucuagaccucaauuuuuugaucucuaaaacagaaacaauaguacccacccugacagggugguugugaggauucacugaaaaugaacaaaaagugcuucacacaaugcuuggcgcauaucaaaggcauaagcacuagcuauuuuaacuuuuaacuguuuaaacucucugaaaugaaauaauccaaagguuccaaauccaaaucugauaggaaaugaagauuccaaaagaagggccaaaaguuauuuauugggucuucauauggguagaaaagcacaaaacaauacugcacaaacuaauuuccuuuguuaagauggaacucugggugaccaucuuacauaaggguaaccacgcauugccugaauacccaaaugaaaaaaaaaaaaaaguaucacgggcguauucuacuuuuauguagcugauuaugugucccaacaccaaaaaacuaaaaauuacuacuuuuaaaaccucaaaauuucacugcuuagaacauauaaaagauacauuuauauacuaacauuucaaacauaaauuuucuaguggaaugaaguuuaaugcaaaauguagggaaaaaauuggacacccuuuauaugcugauaaacuuaauuagaauuuaguucauucuaaacuaaaucuaacaaacuucuuagguaggcagugucuuauuuucacauuuuugaaagcucugaaauggguaagaugacaaacagacaaaaagcagaauacuagaaugaucaguuaaggugaacacuacagucauaaguugguacaggcuucaauuaaguggugugaaccacuuacacacugagagcuuaggcagcguauguuaaaaaguuuccugguuuuuuuuuuuuuugcuuuaaaaaaaaaaaaaaaaacaaaaacgauucuuuauuacgccacacuacuuugugccucuccgaauuucuuaccuaaaauauuuuugcuaaauagaauuugaagcuuuugaaaaaggaacauucuuuuuguuauuuuaagaagccuuuuaaaugacaauauuauauacugguaaaaaccaacuuaaucuguauuucacacacccaaaccccaaauaccaccuauguagaugaugaauggagauuugacauuuaaagugggugcacugacauauaauacaaguuuuuuguauauuuaauccauaauuucugauugacucauuuuuaaaaguauuuuaaaaauaagcaauuggcaauguaacaaggauacaauccaauguguucacagauugguuaccugugagacuggugcuuuaacaugggguggaauuccagaggaagaaacaguaccacuaggaggcagguuuuuacuggucacugaagcccaggagaaagccugcaggaaaugcaacaaaccuagacuacuaaucauggaaaaccaccaacauuccuauagggaaacuuccaaauauauauuuucuuuucauuucuaaacuauugcucuauauuggaagacuccuaaaagaaaggcacacacacacaugccagucuaugugccagcuuucaaaaucucauuaugcaagcuuauuuauaacuuuugucugacuacuaaguaaaaccauaagcaaguuccuacguacucuaaguagaugagcaaguggcaaacaaaaccacuaacaaacaugcuagaaaaaccugaaccuaauagaaacaauuuauuuccccuuuggggguaagauagggugugugaugguguuaacgggagagggaaggauaggaaagaagagaguauuagcuggaaacucugacauucacaaauugaacaaagaaucuccuccuaucaccacucaaauauacuuuaaccuuugacuuugaagaaagauaaaagaaguuucagguaggcuuacaugauacacuaaggaugucacucaucuuuccaagauaguuuaauugguguagaaaggaaacugaucccauuuaaaccacaaacaacagguaucucuucuuuuaauuauagaccaacuuguuuaaguugggaaacugcaugauuccuggugcaucugugcucagagaauuuaauacagaaugaaagaacaacugacagcucuauacauggauccaaauaauuucauauaaguuacuaaacaaugcauacagacaaggauucaucuuaaguuauaaguuucacucuuagagggguauuuugcggggcagggaaacaauaacauuuucucagguaacaaacaaaccccacagcuucuuucauauacauaaaauaauuuacuaaacaauuuaacauaauagaaaaaggucauacuucauuaacagcaccaaauuugaacaugugauguuguaagucuaaagaguucuuugaucuaaccuuuggugguucuuguggcagagaaacagguucugccggaggaggaguaguagauuucuccucuaguucuucuaaguucuucuccuccacuugugguuucagcucuucagucuuuguuucagauucuggcucagguucagguucaugagaggauucuuccaaaggcuccucuaugccauuacuacaauaaaauauuuaguucacuuuuuaguaggaguucaaguaagaaaaaauucaauuucucucuaauccaauggguguaacuaguuauaugccaauaacuuguucuagaucuacaaaguauucaaagcaaaauuccaaaaagagcuauaagacagaaggaauaauacucucaaguagcaguucuuuaaucccaccauuucaaaacugaauuacuaagaauguuuacuuuagugcuaacuauaaaccuuaucuuuuauaaaaauaaaaugcuuacucuguguugucuucaacacucuacauuaucaguaaggaaccacuguuuuggugcaagccauguucaauuuuuguauuaaauaaaaccauucuuuccaaauuucuugcauauacacaauagguacucaaauacugacauaauaggugguuuuaucaagaauuuacuuucaacaauaauucuaggaacagaaaccaccuugcugacauaguucagaccaaauuuaaccuugcaaauaguaugcuuacgucacagggugagcuucauaguaaccacuguuagcauuuucuugcacagguucaggagaugguugucuuucuucuuguuccucuucuacuucaucuucugauucugaaaauacauaauacagcacaucuuuuuuaaagaggcuucacaauuucuaacggacauauuuuuaacauguuuaaggaagugguaugauagcaaaaaagaaaauuugacaauuuucuuuccuuuuuuuuuuuuuuugagauggagucuuguucuguugcccaggcuggagugcaguggugugaucuuggcucacugcaaccuccgccuucuggguucaaacgauucuccugccucagccucuugaguagcugggguuauagguaugcaccaucaugcccagcuaauuuuuuuuuuuuaaguagagaugggguuuucacugcauuggccaggcuggucccgaacuccuggccucaagugauccacccgcccuggccucccaaaacacugggauuccgggcaugagccaccgcgcucggcuccaauuuuuuuuuuuuuaauaacaaaggcauucaacuacaauauccccuguucucucaaaaacuggagagcaaggaugaaguuuaauauuuauuguacucuauuagaaaaaaacaaaucuuucaguaaaaggaaaaaaguuauauuaaagccacaauuuagcuuccuuuguaacauauauuuaauagagcaauaaugauaaagaaacuaaccacuguacaucaauggaagaucaauuaaauaauuacggcauagccacaacauagacagccaacaaagacauauuauuacauuaaaaaaaaggaagcuuugagucaguguaauuccacauuuauaaaaauacauguugccaaguauagaauccaaaaaccuucuccaauaggcaccaaacuugguuaucuacagaggaugagacugaggggaaccuuuuuccuugacauccaaauuuuguauauuuucaaacaauggacaucuuuuuguaacaacgacaacaacaacaaaaccaugaaaaaaggauguuugacacaguuacaauaaagcagcaaauuuccguagaugucauacuuauagaaauuaguccauaaagaguaccaacagaacccuucuaucuucauaucuucaaaguaaccucaccuucaucaaguucaggcucagaaucaccaaacacuucaucuucauaacgaaacauaucauugugaacauaaaauuuauuuggaacagaucccuauaggaaacaacauuuauuccauaaauauccagaaaucugguauuauauaaaagagcaaauuacauggcauacacaauuucucauuuuaauacuagagaucuugacucaauauaauuuuccaaugcugaacaugcuaugauguuuauauaaaauaaaaaggucacucaaaaaaacauaauagcaaaacucgcaauuacuuuugcaccaaccuaguagaacucaagaaacagcuauuuaauagaaaagaaaccaaaagaacucuucuauuuuguuuucaaauguaaccuuucaaauauaccaauauauuuuuuguauuaauguaaucuuaaucaucuauuuacaaacuuguaucaguauuugauuuuuaauuccaaauagucaaagcacauguacacacacgcacucacucaaacaacaggucaaacacaaauuccccaaaaauaacaauaugcaaaucuaaaccuauuagaagaaaccucuggacacuucaaccaacuagcaaccauauaaaugaaaacuaagugaauugagaaacuuacuucaggagccagaacaaagguuugcauaaacuuucuuucugguuguccacuguuagacagcaaacccaugaccuggacaacuacuccaucacucaagguugcaugagcauccacaugacgaauuuuaguaugacauucacugaaguucagagauaauacuuugugguguauauccuuuauuagggagggagggaaaaauauaaacucugugauacugcauuaccuacacaauaauauuaccuacccucauugauuuccuuacaacucugcaauauuaacuaaucuuccugaacugaauccaacgaccaugcugugcaucacugccagaaugauguuccuaaagaagaaaucacaauagcucuccaauauugugcaguaaucugggcuuuauacagcuuucucccacuuuucuguaguaaguauuuggucauucucacaaauuguguugacggcuccuugaacuuacacauaauuuuacuguguguuugcugaugcuauuuuuugucuacuuauaauuccuuauuugguaaggccaaaucuuguggucucacauccucuacacaaagucuuccuucccuguuaggccauaggaaacauacauuucugugcauuccuauagcauaggguuuagcucagauuuguauaaacuuaauacacugucucaacuaucucauguauaaaauacaucaaugauauaaaacauaccauuuucuccuuuguagccaucguaauauaacaccauguuucauacaaaaaugauguuuaagaacucaagcauguuugacaauuauugucaaacugaacaacuauugacaauuuaugcugacaauuacugucaaacauaaauuucaguuaccaauaacaaucauauuggggaaaaaaaaaaaaagccggccgggcgcgguggcucacggcuguaaucccagcacuuugggaggcugaggcgggcagaucaccugagguugggaguucgagaccagccucaacauagagaaaccccgucucuacuaaaaauacaaaauuagccgggugugguggugcaugccuguaaucucagcuacuugggaggcugaggcaggagaacugcuugaaccugggaggcggagguuguggugagcugagaucgcaccacugcacuccagccugggcaacaagagcaaaacuccgucucaaaaaaaaaagagaaagaaagaaagaaaaaaaaagccauggacacaagaaggcuauuuuuuaaaaucuccaucuuaacacaaaauuucuaaacuacauaugaaauugauacuuacauuuuggccauaaacagcuuccuggggcuuuccacuagcaucuacuccaccaugaacauaggaagaauuccugccauaaaaccugcaaaaccauaauuaaugauuaacacugaauugucaagagaagccuaagaagcagaauucuggugucauagacuagguuccggaucccgcucugucacuaauuaguugcgugaucuuggacagguaaguuacuuaaggucuucaaguucagcuuccuugguuauaaaacaggaacaggaacuacuccauaugguuguuguaaggauuaaaugacuaaugcacauagaaugcuuaguuuaucuggcacaguaaguagacaaucauuagauauucacaucuauuuuuuguuaaguggaaaaaucggauauuuuugaugauuuaguacauucuaaauacagaugcuauaguaauugacccuguuuuuuucuucagauacaaagacucagcuaccuagauuuguuugggaaucagaguuuaauacuguauccagaucuccaaaugauuacuaacucuaaaggcuuaaacuguuuagauuuaaaauaacugaaauaauucagagaccaagucuaaaauccaaaauuacgccagcaucuaauuucuuuuuaauauuuuuguacuguucuuaaguauguguaaauuagucuuuuauuggcauuauccaaagcaauuagaauuaacaucuuucuaaauuaagcucaaagaugugaagcuaauuuuuucacaaugaaaacacaacuccuauaguaauaaaacauguaagagcuuccuuuaugcuaagcaauguuuuuaguguauuauguguacugauucacuuaacuuucuuaacaaucucaugaagugcuauuaucuaaauaaacaagcugagguucagaagagguuaaauuaacuccccuaagguaauauaccuaucaaguggggcacccaagauaagaaccuagucagucuaacuugagaguccaugcuuuuaaccacuacucuuaucauuaaacuauuuucucucauguacuacuggcaauguuuucuacagaacaguuuggcuguguguguauacacaugaaaagccucagaaugaucaucucuuugaugcauuaauucuuccaggaaaguaucuuaagaaaauaacuaacuagcaacgugcacaaauaaugcauguuucaggauauucauuaguguugcuuaccacaaguggaaaauuauaacaaccugaauuuucauuaagaaagaaauuggucaaauaagcuaggucuaaaacagaagucaguuacuguuuaaacaugaugguguagggccuuauuguuuuaaaauuuguucuuggucacuaaagaaaacaaaaaacccuguaucaugaaaagaccaaauuucagauaucaaaaggcccuauuaauuauuuaucuucccccaaacucccucacauacauugucauaaaaaaaucuuuauuuuuacaauuagagaaugacaugcaguuauucauuuugcauuuauuugaggggaagauacauguuaguuacacuuuauauauauacuacauucuaauagaaugguuggggacacuacucaaaacugggccugaauacuggcuaugguuagcuuguuuacuuacugagugauccuagaugaauuacuaaccucaacugucuaauagguagagagcuaauaaaaguaacuucacuuuaagacugucauaaggaauacauaauauacauacguaaaguaauuacaaauagagccaagcaaacaguaaauauaaaaaugccucaaguaagacagauuacacguauguucaacagagcaagacaaauugcuacuaaaaugcuaauuaagaugaccuacagauaaaggaauuuaagucuuuuaaacagccuuucucacaguaaguggcaauauauuuauccuuaacccaucuggccaguguguucugcaauacuuacaaagucuaauucuuguaagaguuucaccuaucuucuacuugcuaagauacaccaagaagaacaaaaauuaaauacuacacauaauauaaaucaauuucacuucaaucucuggaaaaaacaagccuacagauguccacuucuuguuaaaacaguaaauaagguuauugcugcuguuuuacaaaggaauacuauuuuacagauuagaagaaauacaaauuuucacaguauaaucauuuaacugauucaucccccaacacuguuugggagaacuuuaaaaaaaagauuuaagcuguugauuucaaauugcauauuggaacccauuaguuggucaaacccaagauauggucuuuugagacgaagccucacucugucacccaggcuggagugcaguggcacgaugcucgcucacugcagccuccaccucccagauucaagcaauucuccugacucagccuccuaaguagauacaacuacaggcgccugccacacacccggcuaauuuuuguauuuuuagcagagacgaggcuucaccauguuggccaggcuggucucaaacuccugacccucaagugauccaccugccucagccucccaaagcguugggauuacaugagugagagagccacuguguccagccucauguaaaccuuauauaguucuccagcaccugcccccaaaguuuguuuuuuuuuuuuuuuaaugaaauaaaggucgggcuugguggcucaugccuguaaucccaguacuuugggaaugcaagcugcaagcugggagaucgcuugaggccaaaaguuugaggccacagugggcuaugaucauaucacugcacuccacccugagugacagaggagaccaugacucuaaaaauaaaauacuagaguacauauaagaauaagcgugugcauauauagauaugaauguguuauguaccagaauaugacauaaaauguuuuuauuacugugaguugcaguuaaaaacacuuuuugccaucaaaugaauaaaauauugaauacaguuuagacauguuuacaaagauacugucagauaaugaggagacaggaaaugcaaaauauauauagucauacccaagaaaaaaaguagauaaaaauaccaaauuauuuguuuaaaauuuaccuguguaaauauuccggagcuuuauucagcaaaguauaauauugccucacaaacucccgcccuacaagcagcggacugggcuucuccauaaccauuucuuugcugcacaaugucaaaugcugagggagcaaacacaagaauaacuauuaaaaagucaucuuugucaucaaccaccaugaaauaaauuuucuuuuuagccaaauuuagcaguggggaguuguauaccaauuuuagugacacuaauguuaauaaguucugauaacccacuaccaucagacuaaccugaaauaauuuuuuuuuuuuuuuuuugagacggaguuucacucuccuugcccaggcuggagugcaauggcgcaaucucagcucacugcaaccuccgccucccggguucaagcgauucuccugccucagccucccgaguagcugggauuacaggcauacgccaccacaccuggcuaauuauguauuuuuaguagagacgggguuucuccauguuggucaggcuggccucgaacuccugaccucagaugauccgcccgccucggccucccaaagugcugggauuacaggcgugagccaccgugcccggccuaaccugaaauaaauuuucuuagucauacaaaugggaacaaaauuaaugccacuauuaaaaagcaacuuacaacaaauagcaaaacaauacauuccuaacuacuacuauccauaagguaaccuccaacauuugugucucccuuucucucucuuucuugauuucccuacccuucgguaaagggaaauagcaucuuuguucaauuucuuauccccaggagguccaaugcugccucagacuacguacaaguccuucuauucacagugccuuuuuccuuuggggaccaaaaucuacuacauuccuggauuccagugguuuuauccuaggaagcaagacagagggcccaaguuaagacucagagauaacacucauggcaaagcaccaugacuuguguuuuuguauucucuuuccuucugggaauuaauuucaccauuuucaaaaugguaacaaugauuaaucaccagcuauaacuucaguacuuagagagaaucauuuuuuaccuuugauauuaugucucucuuucuuuccacuaauuaagcaucuaacuacaugagauacuguuuauaauaaaugaaauacucuagugaacaagauaagucucuagcccucaaggaguuuauagucugucaagaaauauaaacaagcaaacuggaaacuuaacagaauggguuaggugcuaugauaaugugccucaaaguuaaaaccaacaagaacaacuaacaugaaauaaauacaauuuccuauuuuugucuucugagacagggucucgcucugucaccuaggcuggaguuuaguggugcaaucauggcucacugcagccucaacugccaggcucaggcucaggcucaagcgauccuccccgcuaaaucuccugaguggcugggacuauaagcaugcaccuggcuaauuuuuuuaaauuuuuuaauuuuuauuuuuagcagagacgaggucuggcuacaaugcccugacuggucucgaacuccuggccucaagugauccucucacuucaggugugagccacaaacaaaacuuaucauuuacuguaggaauauaauccccagggccagguacgguggcucacaccuguaaucccagcacuuugggaggcaaggcggguggaucacaagggcaggaguucaagaccagccuggccaagauggugaaaccccaucucuacuaaaaauaaaaaaauuagccaggugugguggugggugccuguaaucccagccacuccggaggcugaggcagagaauugcuugaacccgggaggcggagguugcagugaaccaagaucgcgccagugcacuccagccugggcgacagagcgagacucgucucaaaaaaauaaaaaauaaaaauaugaaauauaaccuauuuuauuuuugagauggagucuugcucuguugcccaggcuggaguccagugguacgaucuuggcucacugcaaccucugccucccggcagagcaauucucuugccucagccucccgaguagcugggacuacaggcacgugucaccacaccuggcuaauuuuuguauuauuaguagagacgggguuucaccauguuagccagacuggucuugaacuccugaccucgugauccaccugccucagccucccaaagugcugggauuacaggcgugagccaccgugcccagccaccuguuuuauuuuaaaaagaccuauuaaacuuaaaaguacuaaaaaaaaaaaaucauaauuccuaagcauguaucuacuggguaaaucaggaugcaguugaaauuccugcuuagccaggugcgguggcugacgccuguaaucccagcacuucaggaggccaaggugggcagaucgccugaggucaggaguucgagaccagccuggccaaaaugguaaaaccccuucucuaguaaaauacaaaaauuugccaggcgugguggcuggcgccuguagucccagcuacuugggaagcugaggcaggagaaucgcuugaucccaggaggcagaguuuguagugggccaagaucaugccucugcacugcagccugggcaacaacagagugaggcuccaucucaauaaauaaauaaaguccugcuuaaacuucagguugagcugggaggaucauuugagaucaggaguucgagaccagccugaccaagauggugaaaccccaucucuacuaaaaauacaaauaauuagcagagcugauggcacacaccuguaaucucagcuacucaggagacugaggcacaaaaaaucacuuuaaccugggggacaaagguugcagugagccgcgaucacaccacugcacuccagccugggcaacugaguaagacucugucucaaaacaaacagacaaaaaaacacugcaggcuggcacaguggaucaugccuguaaucccagcacuuugggagguggagguggcaggaaagcuugaggccaggaguucaagaccagccuggccaacagagagaccccaucucuauacaaaaaauuaaaaauaaaaagucaauuuccauguguguuuacuuuaaauaacuaaaacaauuucagagacagcccugcauaggucauuaaaauugugaugcuguuuuuaauaaaaaucaaauaccaacuauaguagagcuuacagauagaguguagcuuuacauaauucuagugacucacaauucaacuucuacauuauguuuuuagguuccuuguuucuuccuuuccaacaaacuaucccuccucuaacuguccuucuuaaacucucaaacuugauuuacaaaaauccccaaaucuguuuaaaauuuuuuauaaugccucacuugcuuucaaaaauaguuaauucacaaagagcagauccaaauacugccauuucaggugucauugauuuuccagaaaacuuaaaacucccaauaaggguaacaacccuagugcaaaaaggacucacauaugcuacauuuaaaguaacaaagcacugggcuguggcucacgccuguaaucccagcacuuugggacgucgaagugggcagacugcuugagcuuaggagcugaagaccagccugggcaacaaggcaaaaccccaucuaaaauuagccagacaugguggugcacaccuguagucacaaacacacaaacacacacacacacacaaacacacaaacaaacacacacacacacacacacacacacacagcuaagcaacuaacauuuuuauuuugaauaaugaggguggguaaagaacaguagacuuaccugguaaaauuuaacaagauaacuaaaacauggaaauuauauguauuuuaacaccauaaaaacugaugguaaaauaauacuaacacaugggaaaauacuacauuacucucugaacaaaauaacuauacacaaaauaguuuucuuuaaauugauagugacagaaauacuauuaggaauuuccggguuugggaauuguuuucuucucucuggauuuccagauuuucuacaggaacacuguugucauuuaucccaaauuucccaucauauucauagaguacauacugaucuaucauuuuugucacuuacauauuuguuucucaaaccaaaauaaaaugguacauaauacauauauaauaucacaggucaaaaugcucuaaagauuuguuguaacaagguucaaaaaaagcuucaaauugcccacuaucuacauggucacugaaguauaauggccaacauaccaucaauuuagaacagagagacagggaagggcaguagaaguaauauuugauuaaucaauacucaauaaauuaauacuuagaacuauuggaaggcaguaacuugaaaaguuaacuucaaaugguaaauaaguaaggcaaugcuaaucugguaaaaucuaaacaggcauauaacagguuauauagaaagcugagcuuuuaaggugcagaggaggcucccaaaggaaugguaaaacaaaaucaagauuuacugagagaacaguguuucaacuaauuacaucaguuacuucuuuaaccauaacuccgauuugaagugacucagaauuuagagagccaaaauauaauugauagaaaucaaccagaaaaugacuacuagagaucaaccaucaaacaacgugguuuggguauugcaggaaauaagacuaugaaaauugaguaaguaauauaaaguucguauuuauaauucaugcaguguacguaagaagguugagaaaaaggaaaaaagccaaauuacacuuucagaauaaaagugauuacaagaagaaagaauugugccauuuuuauuauucauagcaaaucaucuuacagguaauccauuucuagaucugggaccuuccauuucuuaaaaaaaguuaacaaaacgaaacaaaauucugaauaugggaguaaaagguuucaacuaucuuauccauggccaugaaaaacucaugaccuuacuggaucucgauuuccuaguuuacaaauugagaagaaauccccggucaagccuacaagacuauacaguucuacaaagauagccaagaaggccuggugcaguggcucacaccuguaaucccaauauuuugggaggccaaagugggugaaucgcuugagcucagguguuugagaccagcccaggcaacauggcaaaaccccgucucuacuaaaaaauacaaaaaauuagcggggcgugguagugugcaagcguagcuccagcuacucgggaagcugaggugggaggaaugccugagcccgggaagucaaggcugcagcgagccaagauggcaccaccgcacucaaaccuggguaacaggagugagacacuguuuaaaaaaaaaaaaaaaaagauagccaagauuaaaggauacuuauacacaaaaagaaaucuuuagaaaguucuuagauuagcaccuucaaagauaacuaccaucuucaauaaggugguuguuagccucaccuaacaaccuuuuuagaaaaaguuaaauacaauauaucacacuccacuucuuccaaugacaccugaaaaugugaagaaucucacacaggaaugcacaguguaaaauuuuaucugauacauuagcucuauacacagucaaagcucucucaugaacaaauccgucuuuuacuugucaaaugaaaacauuauccaaggccaggcgcaguggcucaugccuacuucccagcacuuugggaggcaauggcaggaggaucacaaggucaggagaucgagaccauccuggcuaacacagugaaagcccgucucuacuaaaaauacaaaaaauuagccaggccuggugguacgcgccuauagucccagcuacucaggaggcuaaggcagcagaauugcuugaacucagaggcaaagguugcaguaagcugagaucacacccuugcacuucagccugggcaacaagagcgaaacucugucucaaaaaacaaaaaaccgaaaacauuauccaguauaguuuagaggcuuuuuacucuccaacucugccuaucgcaccuaaaaucccagugaaucuucaucagaauauuuuauucauuccuguuucuuaaaauguuuccucugcauuugccuaauuccugaagcacaugcacuucagcucucacggaaaauugcucuauauuugucaccauauuuucugaaucuauuaauuauacacauugagagagaguggaguauugguagauaauacacacugagagggaguggagcauugguagacauacaugcagauuagaaaagaaagucacauugagcuucauuauccuacaaugaacuuauauuuccucaguuucaaaauaacguaaaaaccaaaguuaucacucuccuuuccucaaacuuugacuaaaacgucaccuuuuagguaagaaacauuuagguuuuuuguuuaccauuuaaaguucagugaaucacuacuauaauggggcugccuccaaaacaaucaaucuuaggcuacauuaauuuagauguaauaucuaaaaugaguugauugcuaauugaauauagugaauggaaauuauaagaagguagauuugggugaaacauaacacaagaauaacgcgaguuguccaaauaucaaauagagcuacuuaacaaguagccagucacuacagguauuccagagacuaacugaaugguuuggcacaaacauaguagaguccauacauccaaaaaaguaagauuaggccauuccaacacuaagauccuaaaagucuguuaacaagaagcaggacuuuugacuucuccuccaauacucaucucacaccuuccuaucugcaaugauugaaacccuaugcauuuaucugggcccagcagaaauccuguccccuugaaaaucuuucuacuccuacugaauuccucaacagaauauaacucuucucuauuaacucuuaaagcacuuuuggccuuuaucauagcaguuuauugaucaugcucugcccuaaauuacuaacuguacaccugucuucaucuucuauuccccucucaaauauuauaacucagcucuccuuugaaugcaauucucuggaaacaucacaauucuucucaauaaucgaaugacuucucaauccuccacccaucugcauuaucaauguugacuaccuccuccuaacucuucuagaguucuauaaggcaaauuuuccuucucauccaaacgcagaauuucucaagguucugucuucuaaccuggcaauuucagcuucuggucucaugucuaccuaaacguguaucuagucuauaccauaaguucaaauuuuacauuugucaccacauacugaacaccuagacaugacccacauaugucccaauacacgcaugcaccaaagaaagcuauuuccuuauuucuguuaaaagugucauaaucuucucaacuugaaagcucagucgugacuuucuccccuuuagcuuugccacuuaaacugugaaauccuuacaauucagaagguggaauuugugcccuccuuuucacucccacuguucagaccuuuuauucuucaaaagucuuucaagccccuguaucacguguaguauauacuguacugaguaaaauccaaacaccugcauucaguuuggcaucuaaggcccuacacagaaauccagucugacauucaaugucauaaccaaccuuucaaauuuaucuccuacuauacuuucucaucccuguaucaaauucuauacaaauauuuuaaucaccuaauauuauucucugcaauuucacucucugcgccuuugucuuacuucauucauucccauccacaagcugagucaauggguuauacaaaauaaauucauuucaacauuuauuuuauggcuacuauguauguaccagaaacuacaaaaggaaaaagaggccgggugcaguggcucacgccuguaauucuagcacuucgggaggccgagauggguggaucaccugaggucaggaguucgagaccagccugaccaacauggcaaaacccaucucuacuaaaaacacaaaaaaguuagccgugugcaguggcgggcgccuguaaucccagcuacucaggaggcugaagcaggagaaucgcuugaacccgggggcggagguugcagugagcugaguuguaaguacuugguauuaguuauuauaaaaagaauaagaccucuaguaauaggaggcaguucucuuuaccagauacuguuaccaaagguuaugugggugcuaagacacagcuuaucuccacuauaggauacuuaccccuuuccccucuggagucccucacucauagcugggcucaaacuagucagguuuauuuauuuuaauugaaccauggacuauauccauuuccaacagcuaaaugcauauuaauacuggaacuuucugaaauuccagaugguuuuuguuugaaguaacuuaaacaaucuaaggaacacuauaccuuuuuaaagaaaugaccuucaaucuuuugugguacaccauugaaugaaagcuucacaaagaagaucuaagaaucauagugguacaaauaaauaauaaaaguaaguuauggauuaaaucucuuauucaggcuccaaaagguguuuuuguuuucuguccuucucagaaguugagggaggcuaguuuuaaaauucagaagcuauuaaaagugaccaagcaguaagaaauggaaaugcuugcuguccacaaaaauaaagcauguauuuauacuauguuuuaaaguuuaacaaguaaccuacuauuuucuuuugucuuuaaaauagauagggcauuaucuucauuuacagaaaaggauguuuagagagccuaaggaaagguguuugggguuccucaguuacaguaaaaagaaagaggauuugaaaucaggucuccugacuccugacucaacugauguuuucauuacacuuugguuaggaacaaccgcuuuggaagagcagccagcucuuccaacaauacaaaaaauuaauuuuaaacaagcaauuguuagcuuaugugaaacuguugagaagagugaaaagcaaaggaauacagcaggacagcaacagaaaauccaagaauaauuuucaauauaccuaugguuucaagauaggguaaaauacuuggaaauuagcagauaaaaguaagcagaaacacgacagucaagaaacuaauucuauugcuucugaagguaggccaggaccuuccugaagguggguggaccaauuuauucuaucggauauaaaacaagugucuaccaguggagaguaacuaggucauguuuguccauuaaauucuacugaauuuaaguucagacgcaacacuuuaguuugugccuuucaaaaucaacauugaaaaggagucauucacugucuccauauucacucaaaauauguggaaagucuuuuuaaagcaaucuagggggaaaauguucaauccuaauuaugcguaauaaacagcgauaauuuugcaggauaaggagggaaguuuucagaaucuaaagacacagugccaacacuuucuucaaaccaggaguugccugcugacaaaucaacugcucagcugcuaacugaacaguuaaguuaguuacucuacgaaauggucaaauaauguguuuucuucuuuaccuucuaauuuuuauccccauccaucccacaagcauucugguucacucuugauguuuuuucacuauuacuaauauuucgacccugaauaucaaucugaacuaugacagcucuuaguaagaaauucauucuagguccuuauuauuccuacaauuccuugacugcuuuucagaauuaguuuguaaagauuaaaucauaacauaaaggcccauaagaguaaucuuaaacauuuaagaaaaauguuacugccaaagaaaggauaauucaauccugagguucaaacucaucguaccguuuaucuccuaagaccaggaaucuuggauuaucaaaaagaccacuggaugcuaacagggccaaaaguuuacuuagaaacuugguucacaugccuaaggcuauauuaacugccaaauauggagcuagagaaaaauugccaucaucucccacucuaguacaccggggcucucuuaacgacaguuaauguuuccuagauccagguaccugcaacacuaacguuugaaagaccagaacaagguacagagccuugaaccuaaaaccacaguaucuuaauccaaguuaauaucccacaacaaucauacagggagaacaggacuuuacuauuccagcuaaaagugcaagugccuuuuuuuuguuguuguuaugaaggaaaaggcacucuccucccaccccccaaauccguuagaacauuaaguaugucuuggggaaaaaagcugaucuaugcaggaaauuauagacgaaaaucuauauucgccccaaagcggcaaagggccaucuuaagaaaucugcuuuuagagacgcaggaaaaauucuaucagauuccacuaacaaaaucaacacaaucuagggaagcuucuguuccuuucuguccccccaucccaacaaaagcgggaacccaucccccaaaagccauucccgagucaauaagggaucgucugcauaagagggggacgaagaaggcgcacguuacaguuccaguauccgaacacguucggauuaaacccgcgguggcagggagagggggguuggucaaacacgacggaacacuagguacuggguaagcgaagcggcggcugccuucaaacccggauucuguuuccgugcacagaaauggugcccggaggccgccacuuucgcaucugcgucgcuucugccuccgucgacacaaccucuuuuccccuccccccacgggcgggguggcgacggccucuccgcuccgaaggaacaagguacaagagccgaaaacgauucggaaacaggaacggugggcuacccacccuaaaacauccccuccagaaagccugcucccacacuuccuguauuaagcuuccaucagcgcgccuucgggagcugcugcgugccuccccccccacuucgccaccucauccccaauaaaccucaaccccaccugugcacucggagcccucugcccgcaagacgcucgcgggucaccucccuucccaggcggccucccaccccucaccuagaggaaagacuggucuucucucacgcacacacggcaccguagggagccggcaagaacaaugucucugccgcuacaccuccggcucccgggcucacacaccggacgauugccucgcgccgcggagcgcgaauggaaugucccuuuccgaccaccacaccgaccuccccucccggcgcccguacacaccuccagccaacggcggcggcggguacgucgcgcggaggucagaagagucgcugaggaccgggugcggcggguucuuauugcucgccgcccccuuccuccgacaacucggaagccucggaagccggagagccgcgaguucgucugccucacaaccaccucuucccgggcgccaggcgcugcgacgugcgacaaggaccacggacgucccgcccccuuugccaccg

SEQ ID NO: 21399 - RNA, 17827 nt, Homo sapiens
gcugaaggaggcuuggcccuugcgacgcuccgucgucgggcucguugccggugcaaacagggaggaaacagccggcguugcuguagcgcgucugggaauuacaccgggggacuggccggcccgcuucgugccugcgggaagucgggccgggggacucuucggaaacuccgagccucagagaaaugugagucggaggguuggacuaggccggauccggcguuagggcgggggcccgcaggcggcccgcgcgggcgggaaccggggcggcagucagcgggcgcgagcucagggcgccuccgggguccucacugcgcuccccacgcgcugugaccccauuuguugcacgugcauguucaggucgagagagggaugcgacguguucggggagcagcccaccuuguggguggccaauccgggacgggaaucuuaaacuuuuaacucuuggugcaaagacugauccacuggcggcuuuacgggagcgggaaaaaaguaugugaagcuugccacggucucgagaccgaggucacacguuagcagccugccggcuacauuuggaccauagacgcagaguguuugcccccaaaacuggaggaccuccagaaugagauucuuggcgugcaccaggccuuuucgcucauucagccggcguuccuacccaggcacugcaucgacccuacacuugaggacagcuuuugggucaggggaauuggugccuggagugagacugcucucugcuuucaaggcuccagcuguaucccuacauugcucaggcaauuccucucucuaggucucagcuucuucaucugcaagaugaaaggucuguccuccaugguagcccaacauacuuccgaguguuauuaucaguccccuccccggggacugccagagccagggcagguuggucccaacaggcagccccuugcagcagagagagccugggcucuggucucagacggacaugaauuaggaacccagcuuguuuaucuccuuuacuuccuggcucugugauccugagcaaaucacuuuguaaugcuuaacguuguuuuuacuaaccuuguuuuuuaaugccuuaccuuguuuuuacuaaccuugcuuuuagacucuuuuuuuccccuuaaucaccuagccuuguuuccacaugaauuagcucucccuuaguugagaaagccggaugaacuccaucugguucccucauuuacaagacaucaaggacuccuuacccaccccuuuccucaaggaguuaacuuguguaagcagaaucucaacauaucaaagaguccaauuaacugauaagguacugaaacaagcaauguacgaaguucccaggauuuugcucaaaagauaacaccauaaaaccuugaguuggugucgggcagagcacccauaucuaacauuuuaugaaagauuuagagccccugcaccuggaacuguuguuucucuguaaccauuugucuuuuaauuguuucucugugacucuuuguccuuuuaauuuuugcauguuuuuacuuauguagaauuguugcaucugagcuccccuccccuuccuaaaccaaaguauaaaggaaaaucaagccccuuccucgggccaagagaauuuauuagccgucucuugggcacuggcuaaauaaaggacucuuaauuucgucucaaacuguggcguuucucuaacucgcucggguacaacaacuuuaccucuucaacguaaguuuccuuaccugccaaauagcgaggugauuguaagaaugaaaaaaagucauauguauugagugcuuggcacauacauguguuccuuacauuauugucucuguuuaagcacagcauaaaugcccccgaugugccuagucuagcaaucuuaggacaaucccugugucugucuguuguguuccuggugauggcuggcccacagcugggugcacgcaguccagaauuuuuuauguuuuuguuuuuuugagacagagucucacugucacccaggcugagugcaguggcgcuaucauggcucgcuacagccgugaccuccugggcucaagcaauccuccugccucagccuccugaguagcugggacuacaggcgcaccaccacuccuggcuaauuuuugauuuuuuauagagaugagucucaugauguggcuggucuccaacucccggccucaagugauccuccugccucagccacccaaaguguugggauuacaggcaugagccacugugucuggcuaagguuuauuuguuuuguuuuguuguguuuugagauggagucuugcacugucgccuaggcuggagugcagugggacaaucuugguucacugcaaccuccaccuccuggguucaagugacucuccugccucagccucccaaggagcugggauuacagacgcccaccagcacgccuggcuaauuuuuuguauuuuuaguggagacagggguuucacuauguuggcgcagcuggucucgaacuccugaccucgugaucugcccaccuuggccucccaaagugcugggauuacaggcgugagccacggcaaauuuaaaaggaugauuugcagcacuaguggcagaucauuuuaaaaaaugcuggugccugggcccuacuaaguuuuuugauugaauuaguuuggaguggggcucagacacgguuuuguuuguuuguuuguuuuaaaguuccaccaguugauuucacugugcagccaagggguggugaccacucguuaaagggaugaggccaagcuggugaggguuccugggauuugcaguggcucacuuuccucccauuccuguucucagauggcgcucccgacgcugccguccuacuggugcagccagcagcgccugaaucagcagcuagcacgacagcgagagcaggaggcccggcuucggcagcagugggagcagaacagccguuacuucaggaugucugacaucugcagcuccaaacaggcagaauggagcucuaaaaccuccuaccagcggagguaauugugcgguaacugccgauuggauggaaguggggaccacuugcuggucaggggaugaggccuuaaggauuuagggagcguaggauuugccaggcaguaugaauuaccugcauggugauguuuuuccagcuggaaauggaaaaaaagaucaucagugcagccauacauuggcauugaaaaagauaaaaugaugcagaagcauaugauagaauuuggaagccugguuguaaccccauauccccagagacagccacaguuaacagucuggcacauauccuuccaugcuguuucccacugguauuugugcuuaaauauacacacacaaagcuacuuuuauagaaauacguguaaaaacauggaggccaaaagcauaggcuuugaagucagaccuagauggaaauccugaccgugucucuugcugaauguaugagcuuugguuuccucaucaaucaaguggggcuacagcagaccuaugcuguaggauuuaugugauggauaauauauacauuauuuauacauuuauacauuuucuuuuugcaaaaaacaagauuuucucuuacacauacuauucugugaccugcugucucugcuuuggcuggggacacauuccugugucgucaugacacaucuaccucagccucuuuuaccgacacagcagagcagagcacguucccuguggcuguagcaugauugauucaggcaggcccccucucacccagcaugcaugccuaucagcgggagaagaugaaggaggagaagaggaggagucuggaggcccgacgggaaaagcucaggcagcucaugcaggaggagcaggaccugcuggccagagaacuggaggagcugaggcugagcaugaacuugcaggaaagaagaauccgggagcagcacgggaagcugaaaucagccaaagaagagcagaggaaacugguaacuccccagagggcuucaggaggcuguggagcaggaguguucccagccugagugugucgcacauguagggucauuccugggugcucaggucugaugagaugccaguuaacuccagagccagcaggaaaagagcuuagguccuugugcagggacuggguuuuggaucaguuagcuguagucucuuuagccccuucaaucauuacaucugagugcuuuuccuuucuuccaguucuguggguccacagagaucugggacuagucuguuuuaccuuccaaaguaguuaugugaaacagugagcccuaaucugugcuuuucagccugcuguauuauuuugagacccccuagauaggaccucuguguagcaucagauuuuggcccccuuuugucaucauugcaagagucacuugguagugccaugugguucucagagcugugcaugugaagcaugaggguuugaacagugguugcagugacggugugaagggaggcacucauagccugagcugacuuccacugugugucauccaaaaugugaauggauuugaaaaaugacaucaggcuuuccauuuuguguuuucuugauagauugcugaacaacuuuuguacgaacacuggaaaaagaacaacccgaaacuucgagaggugaaaaucagagaucuccauugauuuaucuaaguagaugaaaucauguuuccagacacuuuuuuuuuugaacacguaucuuguaccggguugaaacagaggagggaaccuugagccaccugaaaagagcgccaggcagaagaucuggcacaggcugcgcugagcggcucauucgguuguugaacaaauguugauugaaccuccgcugccuggucugccaggugcgggcauggagauuagacaugguuucugcucauuagcuuguguccagcaugggagcucauuacagggcaggaugcagggugcugggccagccugagaggaugagcaugggccagcgcacucaacucuggagggguuggggaggcuucccagaggaguuccugggguggaagaguuugaagggauguauguguguagaggugaggaaaggauguucuagguugaugugacugugagaaccaggcuugagacucgagaacagagcgagcccugggagcugaaagugucugggugaggcuaggaugucagauagugagggagaaccccaagaaaugacgcuggcgaggcagagggugccagacaucggaagagcuugugugaccuuccuccaaaggggcugggggcagcauacaggaucccagcugcauuucagagagacuccucugguagcaaugugcccgccgacagggaggggugcugcgacagcccagccggggguuggugaaggccugaacugggcuggcaggggaggggguggccucuuggcuugguggccuuguucaguggagauuuggcugcagggagaucaucccucacuguuauucauuuauuuucaacuuacaguuuuuguauacauuuggugccuucguguuauucguaguuacauuuagaaaucgccaggcacuaaauaauggaacaucuggugcuuuugugcaguuugcacuaaucugugggaggacuccuuagcccuguuggcuucgguggaaucauccagagccguuaaaucagaaaaguuuauucagaacauucaaguuaauugccuauguucacagcuguaaguugggaaagauuauuuuaaaacuuuuuuauagagacagggucucccuguguugcucaggcuggucucaaaccugggcucaagugauccucccaccucagccucccgaguagcugagacuacaggugggcgccaccauauccagcuaauuuuauaaacaguuucccaaacaaaagauuuggauugaauguugugauccauuuucuaauccaggagauugucugcgcucaaaucucuuacuaacaaugcuaaacuuguugcaccuacuggugcaucacuugauacagggaguacguaguccaucugcuuugcagaggaaacuucggggagccaggcacaggguugagucuucucacucagcugucucccagggccuggcaugcaguacaucaacccaagguggccuuugaaauuguauuuccauuucagcguccagcccaacccuagggcuagugggagggaagucucuguuacuuuguaccagcucaaaagauugguguaggagugccugguccuuuggucuucugauugacaugcauucacacuauacauguugaagucaccccacgcucucuacuagacgccugugccacugaguccccaugaagcgaagucauggccacguucccgcagguggcacagagggcaggagcacacuguccccacagugcccaucugucuggugaggaaauucacaucgucccccuuccauccucagauggagcuggaccuucaccagaagcaugucguaaacucuugggaaaugcagaaagaagaaaaaaaacaggugugguauguggcucugggaauagccgcguauucugcugugcgagacuguucacgucuuugcauucguuuaccguuuucagcaucagugacuccaguuaaggaguguaguguacucuuuucuuaguuuacuugacacaugugaaaacugaauguuugcucuuacauauaccagaauccuaugugauaauucccagggcagaauaaggccaggugaccagggcugggagguggcacauacagcacgcgucuucuuuuuuucuuuuggaggcagggucuugcucugucacccaggcuggugugcaguggcgcgacucacagcucacugcagccucgacuggcugggcucaagcaguccuccuaacucagccucccgaguagcuaggaccacagguacgcaccacugcgcccagcuaauuuuuuaauuuuuguagagauggggucuugcucuguugcucaggcuggucuggccuccuggccuuaaacgauucucccaccucggccucccaaagugcugggauuacaggcgugggccacaggguccagcuaggacgugugucuuuaagggcauuuuugucucucuuuugaugaaaucugcaucguaaacucgcagcccuggcuuacuguaaccccuuugggguuaagcuuccacaccucugugcacuggucgcuuugcugccugguucauuuuagaaaguguuuuguugaguggggaggaaacccaacauuauugagucccucccugacuuggcgucugagggcguugucauuugggauucaggcaggaacugccugggcccuguggccugcagaacggcggcaggaagcuagguuuuuguuggcuuacgguacagauauugaccuguguucauuuggucccuuguagcaagaagccaccgcagagcaagagaacaaacgguaugaaaaugaauaugaaagggcccgaagggaggcgcuagaaaggaugaaagcugaagaggagaggaggcagcuggaggacaagcuccaggccgaggcacugcugcaacagauggaggagcugaagcugaaggagguggaggugggcacaagccccucucagccgugaccuccuccacagcugcucguuagcaugagaugggcacuugagaggcugcccuaagaagaggccauagcagggcugagauucugcaaagggcggcagcagccggguucucccucucacaugcauccccaucugccuugugcuuucccauccuccucguuugcgugccugaauuccagaacauuaacgacauggagccaguagcuguucucuuagaggugguuagcggccugcuguuggagaaccuucuuagaaucuggauuuuccagugcacugaguagacacaauuuaaucggguggucuagcacccagcucuccguggggagcagguuucgggucucgaggcauaacugaggguuuuugguccaggggcuguuuuuggagaacauggcacaguuuccuugaaagagaucuuucuauuuagaagagggaggcccaugcuccugugaccucacuuccccuugcccaggccgugauuuagcaacuacauucuuagugccuacugcuuauucuaggugcugagcacuggguugggaacuagagauagagccugaccaaggcccacaguccugaccuccuggugggggcugugucagguggaggacaguuguuaaguuacaguaagaguggaccaguacaggauccugugggaguuuagaguucagggcucagaaaggcccuugcaggaaauggcucagaggggauuggaugaguaagugaguggugggaggggaucgugaccaccugcauggccaggccucuguugguguagugucugcgaaaaauggagauggagaaugaaggaagaucugauucccacgaucucagaucucagucgagcuuacucucaucaucaccacaggcgaccaaacuaaagaaggagcaggagaaucuguugaagcagcggugggagcuagagaggcuggaggaagagcgaaagcagauggaagccuuccggcagaaggcagagcuggggugugugucagaagggccccccacucuucccaggcgggugggccucuugcuuuuucagacuugcauucguguugcugaaaccauaaaggagacagccuggucagcaguuaucuaacuucuauuuaauucuuucugagauacugaaggcagcccacauuugauucuccuucaggcguuucuugagacaucaguauaacgcucaacucagcagacgcacacagcagauccaagaggagcugguaagucugaagagacagccugacaucuuucuuagccucuuuuguaaaaaaggccuuccauugcuuaguauaugagugcauucucguaagaaugaagacagugagggguugggggaaaggggagauguuggucaaaggauacaucccucgguugggagaucugggaguaguguccaucauguugaucacagcugaugauaccauauuguauucuugaaauuugcuaagagagccaaucuuaaguguugucaccaugaaaaccaacugugaggugauggauauguuaauuagcuugaccguaaggauccuuucccagugucuguguguauacauagauggauagauacagguaucaaaacaucaaauuauuuuucaguaacuguguuacuuaaaaagcagcacaacacaaagugagaucacccccuugaccagcaccugcaaucucugucuauccccagaggugccuguuuaguucacaucuuucuagauguauuuacauacagagagguggagguuuuuguuuuuguauuuaaaucuaauugagguugcauuccucagcaucuucaauuaacacuaaaucucuuaauuuuuaaaaagaucggccaggugcgguggcucccgccuauaaucccagcacuuugagaggccaaggcaggcggaucaccugaggucaggaguuugaggccagccugaaugacauggugaaaccccaucucuacuaaaaauacaaaaacuagccggacauggccgggcguggcggcucacaccuguaaucccagcacuuugggaggcugaggcgggcggaucaccuguggucaggaguuugagaccagccuggccaaugugguauaacccugucucuacuaaaaaauacaaaaauuagccgggugugguggcaggcgccuuaaucccagcuacuugggaggcagagacagaagaaucauuugaaccugguagguggagguugcaauaagcugagaucaagccguugcacucaagccugggggacaagagcgagacuucucucaaaacaagaacaacaacaacaaaaacuagccaggcaugguggugcacaccuguaaucccagauacucggggggcugagacaggagaauugcuugaacccaggagguggagguugcagugagccgagauugcaccacugcacucaagccugggcaacagagugagacucugucucaaaaaaacaaaaaaaggucauuaugcuuagauugaaccuguucuuuucagauagcuccuuuguauuccuaaguacuuugaugagcucccuugaagugagggagacagaccuaagcugcccuucccaucccugcccacugcggucagggcaggacauggggcacaguggcaugguugguccuggugugcagcuguuuuuuauggggucuugcucuguuguccaggcuggauugcaauggcgcaaucacggcucacugcagccucaaccugccaggcucaagccauccucccaccucagccucucgaguagcugggaccauagguguacaucacaaugcuuuguagagauggggucuugcuacauugcccaggcuggucuugaacuccuaggcccaagugauccucccaccucagccucccaaagugcugggauugcaugcauuagccccagugcccagccuccugcauuauuuuaaugcuuccauuauguugauguacauaguagcuaauuccccaccaaggagcauuuugguuguuucugguuuuucccucuuaccuaaaagcugcaacgaguguuuugcacuuuugugucacuguggucuuuguucuuauaagugggauuuuugccaaguuguauuccaaaaaguugugcaaccagguguauccgagggcauguggugguggcugggucucccuuuagccagagagaagcuccuaggccugugcagugucugaaccaccccucgugauuauccccagucuguuccagaaauaauccaggaucuucccaucucugucuugagaacacuguguagaaucacgaaugucuauguagaaaggaaagggagggcaggccccucuguaggcucucauugcagaaggacucuguccagcccagccacgugccgcccucugcuuccucuaggaggcagacaggcggauccugcaggcccuccucgagaaggaggacgagagccagcgccuccaccuggccaggcgggagcaggucauggccgauguggccuggaugaagcaggccauugaggagcagcugcagcuggagcgggcgcgggaggcagagcugcagaugcugcugaggugaguggcagcugcugacugggcuggaugcuccuggccucaacucugauaccuugaaaugccccaugggucaccuguuacugaaauaucuauuggcugggcguggaggcucacaccuguaauccuagcacuuugagaggccgaggcagguggaucgcuugagccuaggaauuugagaucagccugggcaacauggcaaaacuccaggcucuaccaaaaauacacaaauuggccaggcgugguuguucauaccuguaguuccaacuacucgggaggcuaagugggaggaucacuugagcccaggagguuggggcuccgauuagccaugacuacaccacugcacuccagccugggugacagaacgagacucugucucaaaaaaaaaaaaaaaaaaaaaagaagaagaagagauagcuguguauguuguccaucauuccugaggagcacaucuucauaauggaccuggccucuggggguguuucccuuguauuaucugagguggaaaucauuaagguuuagaguaacgauguguucaucugaaaucuuagagguuuagaaggaaauuauuuuuuuuuuuuugagauagagucuugcucugucacccaggcuggagugcaguggcaugaucucggcugacugcaaucucugccuccuggguucaaguaauucucugccucagccucccgaguagcugggauuacaggcgcccgccaccacacccggcuacuuuuuguauuuuuaguagagaugggguuucaccaucuuggccaggcuggucuugaacuccugaccuugugauccgccagcguuggccucccaaagugcugggauuacaggcgugagccacuaugcccagccagaaggaaguuauuauagagauguugaaugcugcuuacaucuauaaaacugaguuuggguccuaaagacuaaacuaguagauugaaaucaucaaauaauaaguagcauacauugagcacuuacugcaugcuggacacugugccgggugcuuuacaggccucaucuuacugaguccugacauccagccaagugguggcuugugagacccggagacuugaagaggucacuccguccagggugagcuaucagugacacaggcaugcgguggcaggguucaggcacaggcagcgcccuccucuccauguucugaugguuucauucaucucuguguuaaacagccacgguguaagucaucccaauuccuuuuuauaaggagaugggguauuaaaaggguaacuuaaaauacuuccaacagggccaggcacgguggcucacgcuuguaaucccagcacuuugggaggccaaagcagguagaucacuugagaucaggaguucaagaccagccugaccaacauggugaaacccugucucuacuaaaaauacaguaauuggccagacaugguggcacaugccuguaaucccagcuacucaggagacugagguacuagaaucgauugaaccugggagguggagguugcagugagccgagaucgcaccacugcacucuagccugggcaacagagcgagacccaucucaaaaauaaaaaaaaugaaaaacuuccaacaguacuuuccguggaugcuguccuuaauuguaaucuuuucaaagugcauguggauguuuaucugcagugugguccugcagaagccaugugcccugcagcccugucuguuccguagcucgcuuccugccagggcggggaggagccugcugucaucccuuuuguguuugcccagggaggaggccaaggagaugugggaaaagagagaggcagagugggcccgagagcgcagcgcacgggacagacugaugagcgagguaaucccagcugcggcgauguggaccggcuguugggucuugggcaggugucuggaaguccauggucagucacccugccagaugcucugggaacagagucuucucuggucauuuuaagugggcuuuaaaaaucauugaaaaaguaauaugagcuuaguagaaaagaauucagaaguacaggaaguagaaauggaaaaaagucccccagagcccauccuguaugcagccguagcugcugcuucugucugcucuucuguuucuaugccugacauuuuuucuacauguauuucuuacugucuugugcuauuuggcuucaagcguugugacaugcuguuacaucuuuauaaacggcaugucaggggcuguaucacggacuguccucugucacccgcugccuuuccauucccucuuaugggugugcuguguuguucuaauuggaagccauucugagaaacgcugcagagagccucuuggugccugaggcucuucccacacguuuccccccucgggguagaugacagccgugaccuggaggacauaacugcuuuccuggucaguguguacacugugcguggaagauauaccccaaccgcagagaaaucugggaggagaagagagaguguuacccaugggcugaaagcuguuguaaagugguuucaaaugagaaacucuacguugugucugguaguaugcuguauuuuggaauccacaggaaauugggucgugauuggugauguuuugcucuuguaaauaccaagaauucuccagugccuuuugauuuuccucauuuaaauuucccuccugauggcggccacuuucuguuccccccagcccugcagccuaacuguugagagugucaggugguuuucugcuccugacuguggccugggcuggaguucagaugucacacggcucuggggccaggucucaaacacagcagguucaaaagguuagaggaccaccccagcuccaccucuggucaucuguguggcuuguggcucucuuguuuuuggaacccgcugauaggaaggagacucaccuuguugcuccaagguuucucuggccccggggagacagcuccauccccaucuccuuugauuucuuuggcacucagcugucucuccauaguacacagucuggauacauuuugugugucuuggguugcgagggaaacauuucuuguauacuggcaagcguggccgacaucgugagagcaaauccugucaucuggcucugccucugcguaccugggccugaggcccaaggaugaggcugggccuugcuguggcugcagccuguccaaggcuuguagaaccaggaucuguuagggucaaccucaaagcugcccuuuucuuucugcugagguuagguucugacagggagacaacagcaaauacaagagaagauugagcagaaccgacgggcacaagaggaaucccugaaacacagggagcaacuuauucgaaaucuugaggaggugagagaguuggcucgucgcgagaaagaggagagugaaaagcugaaaucggccaggaagcaggagcuggaagcccagguagggcugagcccaagggcgggaggcaccgggccugccagguucucugcaucaucaugggacaggguucagagccgcuggacugccuggcagggcuugcgcacguuugagagcacggugcucccguuuccaucccagcugcaguccucauccucuugacuguggcuucuuucccuccacauccuccaugucgugugggugaggccgguacugcugucuguucucuuuacucugucugcuucugcaagcaguuggcuuaccgggggccauagaucucucuucauuucagucccugauacauaagacagaacaguccuccaaacaccuggccacaggccgagcuuuucacgagguacacgccacgcauauguauagccucuccagcuuuccaugagguacacgccacgcauacagccucuccagcuuucuacgagguacaugccaugcauacagccucuccagcuuucuaccagguacacacaaugcauacagccucuccagcuuuccacgagguacacgccacgcauacagccucuccagcuuuccacgagguaagcgccacgcauacagccucuccagcuuucuaugagguacacaccaugcauacagccuuucaagucccgcaugcucccuuccguuccuuggcacgugcauugcuguugcucagcuggauucuccagucuggguagggccgcaggcuuaccuuccucaucagaggcagggcucugcccugugggccuugucuugggguggugacuuugcucuuggcacucagguugcagagcgccggcugcaggcaugggaagcagaccagcaggaggaggaggaagaggaggaggcccggcgggucgagcagcucucagaugcccugcugcagcaggaggcggagacuauggcugagcagggcuaccggccuaagguaggaagucugccaggauauaggccaacaccggcaagacagacucugcccggccccugcuccccugggccugcucaucgccccgcgccggggucugcucuccggccguccggguuauuccuuguuucucuucucuuguauuucucucuucccugaccagcagggagcccugacacaggggcuguuccaguccuugguugggccucaaaccuugaagugauuuugcucuggccuugccuacuaagcugcaugccuguccacccucuuuggucaaucuaagaagagcuguggccacagcugcugagaggggucagagcaguagaucuaggccucaacuguugagacagugaagcccgaugaacaagagaccaguccuccuccucaccuccccucccucccuccuguggguguccucuuccuccccucccucccguguguguaucuguuucucugccucucagugucuuuguucccggaccugucugcacagcaccauggggagcacagagaagcaaaugcugccuucccugcccugaggaagcugaugacugaagcaccuccacugcuggcuuguccccucugcccuccuuuaccuagggccacccuggccacccggugccuagagugcauuccccaggacacaugcugcagaaugagggcuggcucccuuguggucagaugacacugggaaacugagugaaacauaauuagagcaggugcugcguuugccauaggccacucgcccucaaacacugacugucacagucacagggaacagcauuuccuaaacccacuuggccguggaucagugagagugucagggucaggguuucacagaucauaugugaaaguguuucuuagggcuaguacucaaaaccaaaaagauaucaagugccucauuuauggcuuagggucagauuuuuucagcuggaaaugaaacagccauuuauauuguucuuuuagcuuguaguuaaaacaagguuaauuccucaugcugcagauacugcugaucugaucacucuuauguuuucuuucuuuucucagccuuacggacauccaaaaauugcuuggaacugacuucauggguaccauaaguacagagaacaagggaugcugaggcuucugaucccagccgccaggcaguuuuacagggcucuguuaacaguaagugcccggggcacugucagauggcucagcagugccugcucagguucaucauugaaacaucccaguguuuggccagacauuaaggugucgugagagucccuuucaugccuuucuuacccaagcaagggucuuugaugggcacguguuuacagcgcugcugcauagucuuguaauauauuaacagucacaucaacugaaggucaauacuaagagccacagguuguaccugugauggggcgugugguuuccuguugucucaccuuuaauugucaaccuccaguguugacucuagaaauaugaggaaagcuuuucaguuuuuaaaauugccauuuaaauuuagucuauuaaaaacaaaccuagaggucuuggugcaguugauuucagaguuuauuaauuuaguggucccaaaaguauuacaucuuuuauauucuggaagaaaagaacugugaacaaauuagaaccccggaacacucugacguccauggacgcauuccagaaaaguggcaagagaugagucuuuccuccuccaggaagcauuuugguagaauuuccauagagcauugucugugagugacugaucccaacauguauguuacuaagccccaaaacgaacuucaaacugggugugguggcacgugccuuuagucccagcuacccgggaggcugcggcaagaggauugcuugagcccaggaguucgaguccaaccugggcaaaagagugagaccccaucucuaaaaccaaaaagguaccuuagaaggucaccugguuggcuaaccuuuuaaaggcaggggcgugacacguaggacacauugggaaugucuuggcuacuacauguagccuucugggauauaugugcccagagggagaagcacugagccugaagaaacuagaugagucucagaaccacagaccggccagaaaucucucccaccauuauaucagcgugauacaggucuacauucauuucuacaaacaggaacaaguuccuugcagcaauaauauuauuuuaugacuuguauuuuuacuauacccuuccucugagguuuaguuuucaucacauuauguucaagauuccauaucuccguaaauuacagcuaauuacagggcauuguuccaugguuauuaaaaaucagaguuuauuaaaaauccugagucuuaagggcugucuuaccuuucacuuccacuguccuguagaaacagaucaagcugcaaaccacguccuucaucuguuguucauuuucuugcaacucuuugacucugauccccugagcagcacguucaucacgcaugcucucuguugcguuccccauuucagauguccaguaauggugaaauaaaauccugcuucgacagca

SEQ ID NO: 21400 - RNA, 20541 nt, Homo sapiens
cuuccugugcguccucaggucaccgcuugcucuaguucccaggcuuuggccuccaguggacgagaaucgcggagccugcggggcuggagguugagcgcccgggccagcaccuaggcgggcgcgggggugugcaggccaggguucgcgcgggccggguggaggcuugagcggggacccccgagcuugagccccggagccggcggcgcuggggccagaggggccggacgggagguggcggagguggcggcggaggcgaaggggcggcgggacgcgggccuggcccguguguguccuggcggccuggcccaggcugccgcuguacggugagcccgagggaggcggaucugggucccgggaaggacacccgccuggauuugccccuuaggcccggcccgggccccucgggagcagaacaaccuuagugagguggacaggaggggaccucgcgagcagacgcgcgccagcgacagcagccccgccccggccucucgggagccguggggcagaggcugcggagccccagaaggguaggucuuggguuuucgggcccggagcgagaagggccugagugaagucaccguguguuggggaccuuagaguguggggcagggggagggucucgaucgcuugcaggagagacguguguuuggguuugagggcaggguccggcugcaccgaacaggcgcugcaugggaaaucugggaggacgaggcuuaugggggccuggagggugucaccagccucagcugcggacgucgucuccacuccccgcuaaccccuaacagcccuuccuccuccuuuccgugcuccagauuucgaccuccucuaaacguccgucagcgccucuguucucucauuuaagugucugcugauuccccccuuagaucugcccuggagacugguaguaaugcaggaacagucugcagggauucucucuugcugccucaguugcuaggggaagagacugggccuuagcaggugggugacuugaccgggucacuggcuuuguggguagaguugcucauaguagaacucaggagucuuaucucccaggccaguguucuuucucccguauccuaguuuucuuaauagaagauuauuaggugcagcaauaaccaaguucaguuagauaauuuagaaacaaaaccauauuuuauacacauucauuucauuucugagagcucacauacucaauuccuauggcuucuuugauuuuaagcaguuuaaagagacaauaagaaaaugcgggccggaugcaguggcucacaccuguaaucccagcacuuugcgggggcuaaggcaagaguaucccuugagaccaggaguuagagaccagccuaggcaacauagggagacccugacucuacaaaaaauacaaaaguagccaggcaugcugggaugcaccuguggucccagcuacucaggaggcugaggugggaggaucaauggaggccaggaggucgaggcugcagugagcugugaaugcaccacugcacuccagccuggguggcagauugagacccugucucaacaaacagacaaaccacaaaaaacaugagcuguauaaugggaauuuuuuuuuucuuuuugcagguuguauuugaugauggcagacuauuuguaaaaggagucauguuacccaugagagucucacucaucugauuacuaccugauuaucuuagaguuacaaaguuacaagugcaugcuucgccuaucacucuuuuucacucucuuuuuuuuuuuuuuuuuuuuuuuuuugagacagugucucucacccagucuggagugcagcaguguggucucggcucacugcaaccuccaccucccagguucaaaggauucuugugccucagccuccugaguagcugggacuacaggcaugugacacuaugccuggcuaauuuuuuuguuauuuuuaaguagagaugggguuucgccauauuggccaaggaaggcggaucacuugaggccagaauucgagaccagccuggccaacauggcgaaacccuguaucacucuuuuaggcccuucugaguguuugcaggcugaguguucacaggguguuagccuauugagcuuucuuuugugguucuuacgcaggagauuccugccuuugcaggccagagcacucaugacuucagugaccugcuucucccccucuaggucuaccagccacagucucugcacguuuccaagagcagcagaaaaugaacacauugcaggugaguuuucaugcuuguguauauguuccucaacuuuauuuuaugaugcauuuuaagagguuuguaaggauucuuaccuuuuuuuuuuucuuuuuuuuugagauggagucuugcucuguugcccaggcuggagugcaguggcaugaucucgcuucacugcaaccuccaccuccuggguucaagcgauucuccugccucagccucccgaguagcugggauuacaggcgugcgccaccaugcccaacuaauuuuuuguauuuuuagaagagacaggguuucaccauguuggccaggcuggucucaaacuccugaccucaggugauccuccugccucagccucccaaagugcugggauuacaggcaugagccaccgcgcccagccaggauucauacuuuaaaaugggaauguggaaauagacauuguccuguaaaauauaguuaguguggcagaucagcaccaaaaaugauuugugaagcuuguauguguggauaguagauuuuaaggcuguugaaauugagccgcacccaggacugauauucuuggcagucaucacaaaaggaaaaugccaucuguauuaguccauucucacacugcuauagagaaauaaccaagacugggucauuuauaaagaaaagagguuuaauuggcucacgccugcaggcucuaucauaggaagcauggcuggggaggcuucaggaaacuuacagucaugguggaaggcaaagggaaagcggguacaucuuccaucaccagagcaggaggaagagggagggggaggcgcuacacacuuuuaaacaaccacgucuugugauaagucacugagugucaggagaacagcaccaaaagggaaauugcccccaugauccaaucaccucccaccaggccccaccuccaacauuggggauuacaauugaacaugagauuugguuggcgacacaaagcgaaaccauaucaccauccaugacaucauuugcauucauuauaaggagaaaccaacuuuguuacuuguggauuuaaaagauuuucuaggacuuggaaaaauuucuucauucaaguugauauaauugcggauagcuuuccuaauaacaaccauuaaguuaccauaacuuauggcuuauucuuggugcuuauguaagcagagggccugccugcugcccaaggagaacuuggugcauauaauuuuuccagggaaggaaacauugugaucccaguagacagaauucuguuuuuacuguugaguccuagaucauggggggaaugaaugacaugaucauccuucaaauauuuguucgucuuucaguuuggguugcacagcaaacaauacaguuacucucuugugaagauuuccucauuucuguuucucauuucaguucucaguguuuuaguuuuguccuuuucacguugcugagucagucuguaaagauuaccagugauuucauugcagucaaauccagaggggauuuccuagccccuaccucccaggacccuuugucugccuuugacaucuguuacuuccaaacugauacuuucuccauggagucucucuuuucuuggcuuuuaaaaagauucgucuguaaguauuucugcuugucuuuaaaugaugaagucuguuuuguuuuguuuuguucuguuucuuuuuuucuuuuuuugagauagggucuugcugugucacccaggcuggaguguagagacgugaucacaacucacugcaaccucagucuccugggcucacacgauccuccugccucagccuccugcauagcuacaggcgcaagcugccacacccgacuaauuuuuuuauauuuuaguagagacuggguuucaccaugucacccaggcuggucuugaacuccugagcucaggcagucugcccgccucggccucccaaaaugcuaggauuacaggcgugagccacugcucccagccuagagauguauucccacuguauugcucagacuggucucaaacuccugaccucaagcaauccuuucacuuuggccucccaaagugcuaggauuacagguguaagccaccacaccuggcuaauaaggaaucuuuuugaaaggggcuaggaauaacccauaauacucucuuaauacauguggcaauuggguuaaaucuuuuaauaguuccuauauuaugucucuugcgugcucauuguuuugaagaaacuggguugguuauccucaguuuggauuguguuacccuuguuucaccuuuagcacauuuaaaaaauauaucuuuuaugccuuguuaaauugguaguuugaucuggaagucuaaucagguuuauguucaauucuuuucacacagcuguaccguacguggcauuugucuacuucuggaggcauguguuaccuucuuuguuuuugugaacuuaagaacuauugacuguugauuauugcugugauuuacuaguucauuaggggaggcaaaauggugaugugcuaauucuaccauuucuucuuuauuuacuagccaaaauaccuuucuuuucuuuucuuuuuuuggaaacagagucucacucugucacccaggcugucguguuuacggcucacugcagccucaaacuccugugcucaagugauccucccacuucagccucccaaguagcugggaguauagucaugugccacaaugcccagcgaauuuuuuaauuuuuaguagagacagguuuugcuauguugcccaggcuggucuugaacuccugggcucaagugauccucuucuuugaccucccaguguuggcauuacaggcaugagucaccacagcuggccuagaauacuuuucuaaagauaaauuucuguucucuauuugguuauguaauucaugcaggaaagacaguuucuaaaauguugaguaggcuucuaagcaggaagguuuuuuuguuuuguuaccauuaugagcucguggguuuaaacagauaguaaauauuucaguacaucaaaguugugauucuuuuugaaaauuaaauggcuccaucuuuggccagacaaaaucccuuuaaguugguuucugaguccuuuugaaauauauuugauauauuugauagcaaaucuauacauacaauauauauuugauagcauuauuuucuguucagcauuuuauuuugaaaucauuucaaauuuucagaaaaauugcacggauuuuacaaagaaaucccagcuacuuccuuuuguucagauacuucauucuuaacauuuucccacauuaaucauuuauaugcauauauacauauauguguguacauauuuuuauauauuuuuuuucugaacuguuugagaguggguaugauuugucaugccucuuuaccuuauaaaguuuuagauuauaucucauaaaaucaagaacuuucuauuaaauacccauagcacaguaauugaauucaggaaauuuaucauugauuuaauacuuuuaucuaaacuguaguucauuuuccaguuuugccaauuucccaauaauuuccuuuauagcaauuuuuaauuuuugguagaagauucagucuaggacugucaauugccuuuaguuuucaugcuuuuuaaggcuguuuaauacggauuuguuccucagugccauuauaauauuugcagaauacaggccaaugauauuauagaagucuuuaaauuuagguuucccugaucuuucuucaugauuagauuuaguuggugaauuuuugucuggaacacuacaugggaccucuuaaauuuauggcucagaauaggaucugucuugggaaacuucugugcaugcuugagaagauggcuuguucugcucugguuggguggaguguuugauaaauguuaaugagaucaaguugguugguuguguuguucagguguauuauauccuuguugauugugugccuacuuguaucaauuguuggggagaggggauugaaaucugcugcauuugugguucucuuucucuuugcaauuuuaccacuuuuugcuuuauguauuauauuagauacauaaauguucaagguuauuacauccuguugauuaauuaaccacuuuguaaaauggccuuccuuaucccugcuaguauuccaggcugaaauguacuuuguuauuuauguagcauucuuuugaguaaugcaugcaugguauaucuuauuccauccuuuuacuuauaacguauuugcaucuuuauaucuaaaguauuauuucuuguaggcagcaagauuuggaucuugcuuguuuucaucagucuauuucugccucauaauuggggauguauagacuguuuacauguaauguaauuauugauaaaacuaguuagguuauaguccauugccuuugcuuucuuuuagucucaucuucuuuguuucuuuuuaaaaugucuuuguuugucuuccuuccucuugauuaauugauaauuuuuuaugauucuacuuuauaucuuuuguugaguuuuuagcuaucacacuguuuuguuauuuuagugaguuagaauuuauaguaugcaacuuuaauuaucauaguuuauucuuaagugauauaccauuuuucuuagaguaagagaagcuuacaauaggauacuuucauuucucuccucuuggucuuuacaccguuguucauuuuauuuuuacaggugguaucagugccacacagaaucuauuacguuguuguuaauuaaacaguuaucuuugauugauugauugauugauugauugauugauuuugaguuggagucucacucugucccccaggcuggagugcaggggugcgaucuuggcucacugcaaccucugccucccagguucaagugauucuccugccucagccucccggguagcugggauuacagacacccaccaccacacccggcuaauuuugguauuuuuaguagagaugagguuucaccauguuggccaggcuggucucaaacuccugaccucaggugaccugucugccucagccucccaaagugcugggauuacagguguaagccaccacacccagcccaguuaucuuuuaaaaagauuuaaguaaugagagaaaauacacaguuaccauuucugguacucuucauuccuuuguguaaaucuaaauuuuuauuugcugucauuuuacuucugccucaaggacuuucuuuaacauuucuucuaguugaugaauucuuguacgucugcaaaugucuucauugugucuuagcuuuuaaagguguuucugcuggauauuucuccacagugcuuuaaauauguuucucuauugucuuccugcuuacauuuuuuucuaagagaaaucugaucucauauucaucuuuguuccccuguauauaacaugucuuuuuuucuuuccccccuuauguuguaaacuuuuuaucacuaguuuuggguaauuugauugcaauaugucaugguaucauuuuuuucauguuucuguuuuggggaucacugaacuucuuggaucuuggguuuauggugucaucacuuugggaacauuuuuaucauuauuucuucacauacccaccaccuccccuccauugauucuuguugccuguauauuaggccacuugaaauuuucccacaacacacuguugcucuuuauuugcuuuuaauucuuuuuucucuguuucauuuuauguaacuucuguugcugucuuuauauucacuaaucucuuuuuuccacgaugcuguuaaucuuguccaguauaauuuucaucucagauauuguaguuucuaucuguagaagguuagcgugggucuuuuuuacaucuugccugucucaauuuuuuugaacauguggaauagaaugaugaacucucucagugcucuguguggguuguaaacucugucaauucugggccaguuuugauggacugauucuuuucuuccuuaugguuguaauuuccugcccauuuucccaucucgcaacucuuacaccucacaucugucucuguucuucuucccugcucuguggccuggaaacacucaaggcagaaguugauugguucaccuuguuuauuucccaucacucauagauaacucuacugccugauaaucagugccuugaaaaccauugcuucagcccgggcgugguggcucauaccuguaaucacagcacuuugggaggccaaggagggcagaucacaaggucaggaguuugagaccagccuggccaacauagugaaaccccuucuauacuaaaaauacaaaaauuagccaggcaugcugguacacgccuguaaucccagcuacuugggagacugaggcaggagaaucgcuggaacccgggagacggagguugcagugagccaagauugugccauugcacuccagccuagaagacaagagugagacuuugccucaaaaaaaaaaaaaaaaaccauugcuucauauauguucuccguuuuauuuuucuuucuguuuuugauuuuguuguugcugcuguucuuuguuaugugccauuucagguuggaggguauauccaguaccuguuaguuuaucacaacugagggcagaaguccucaugucucucucuauauauauuuuuucuaauauauauauuuuuuucuuuguagagacagggucuugcuauguugccaaggcuggucucaaacuccuggccucaagcaguccuucugccucaguuuccugagugcugggauuacaggcaugagccacugcaccuggccuggauccaguuuuguccauguccaaaugguguuuuucccugagcuguuuuugauuuucuuccaccucauaugaacuguagugucagcuuaucuaguuccaggaaaaagcuuuuugguauuuuuacugggguugcauauuuauaaaguaauuuaggguaacugacuuacccuagguaggguaaguugaccuuaauaauacaacuaauuuuuuuuguuuguuuguuuuuuaguagagauggggguuucaccauguugaccaggcuggucuugaacuccugaccucgggugaucugcccgccucggccucccaaaguguugagauuacaggcgugagccaccgugcccgagcacuuuuacuuuuucuuaguuauauuccucuaauuguuuuaucuucucuaauuguagauaaugagcauuuuauuaauaccuuguucuugaucuuaguaggaagguauguaguuuuucccuguuaaguaaaauccugacuuuuggaccgagaagacugaggcauaaaugugugugugugugugugugugugugugugugugcgugcguguauauacacacaaacuguauauauaugugcuuguguguaauugaaauacauaugucacauauauaucauacauacuauugcauauuagggugcaauauuuauauuuguguauauacauguuauugauguuaaugaaguauccaucaguuucuauuuucuuuaguuuguuuuuuuaaaucagcuuuuucugucaagcuuuuucagguaucuucacggauacaagauuuuucuucuuugcuguguuauaguggcuuaucauauuaauagauuuccaaauauuaaacuagucuauauuauuggaauaagucccauuuggcuauuguauauuauguuuuuaaucugguacuggauuuuguuugauuauguuucauuuuggguuuuuguauugauguaagugguauuggcauguaauuuuauguuauuuauugguugaucagucuucuaaccccuacuaccuccuugccuucuggacuaacuuaacccagaagguuauuacucucucucggugauuuuaucagcuccuguggccugacuguggauaagcuuggauguucugcuuuaguuucucagcccacagccuagcggcccugccucugcuaucucuugggaucuacaugguccuagcuguaucacuggauuugaaccccuuguugauauguucuuuauaaauaauaggauaaugcagccugcuuacugggcacuuccuuuuucuaaacuacaaguuugggcagggcgugcuggcucaagccuguaaucccaacacuuugggaggccaaggcagguggauugcuggagcccaggaguuuugcauuuuucuuuuuuuuuuuuuuuuuuuuugagacaaggucucacucuguugccuaggcuggagugcaguguugcauucacagcucacugcagccuugaccucccaggcucaagugauccuccugccuuagccucccaaguagcuagaacuacaggcgugugccaugaugcccagccaauuuuuuuuuuuuaauuuauuuuuagcagagaugaggucuuacuauguugcccaagcuggucucgaacuccugagcucaaacgaucuucccaucuuggccucccaaagugcuaggauuauaggcaugagccaccaugcccagccccaaccacuuaaaaauugaagcugcuucccguuugccauugguacuuuguacaccucaucauauucuucuuccccuucaucccauagaaugcacaauucaucuuuaaagacuucaaguuaacugagucugugaagccuaaucugauggcauaaaauuaaaauaauuugauccucuuuuguuaaaucauucugcaccuugucugcauuacucuaauaacagcuuugggcauucauucauuuaacgaauauuuauugcuccaagauugagauguuugagauaaaacucagccaugcagauagccagaggccacuggcuaugagaauaaaagagccaaaagaacaaggagcugaaacuaggugagagccccagagcagugaguuaggaggaagaggaccaggagcugaguggugggcacuccaacaugaagagguccagggcaaggggagggccuggcagcaaggaagacuaaaagaagugacaaggaguaaaaugcuuguguuuguuuacauguuuaucuccuuuuuagguuguucacuuugggagcaggcaugguguuucacucaucucauguccccaaagcucagcuaguucacuugcaaaauaggagcucaguuguguuuuggguuuuuauuuuuguggggcaauauauauauauuuuuuauauauauuauauauauuuauauauauuauauauuuuauauauuauguauuauaaccccaaaggauauguguuuccaauaugauuucccuuccauaaucuguaacauaaaauaagguauacaauguuuaugguuaacuuuaccggugggcuuuguaaaacguuaucccccuaucccuuuuccguaucucccaauucugaucauguugccauuacaggggccagugucauucaaagauguggcuguggauuucacccaggaggaguggcagcagcuggacccugaugagaagauaacuuacagggaugugauguuggagaacuauagccaucuaguuucugugggugagaauagcuugcuuucugaaugcucucaguugaaugggguuuuauccuugaguuugaagaaauaagugaugacaccauuuaauuccuugugggcacuagcuggaguguuuauauuauuauucauugaaagguucuaacuuugauaagguaaaaaauggagcacuucuguuaugcagcuuaugagguggcaacaucuuguacuucagagauucugaagccaagcagcuuccccaaguccuccuucuuuucccauuaacaggauaugauaccaccaagccaaacgucaucauuaaguuggagcagggagaggagccguggauaaugggaggugaauuuccaugucaacauaguccagguaaguuaguagcguaucaaagguuaaaaaaugcucaucccagaccuuugggagagacuaaagaguuguuuauauguauucaguacccucaguaacaccucccaacccccaaauaucacuuuccuucccgcacacauacaugaacucuuuuguugauuuuacauuugauuuacauugguagggauuuuuucauucuaaccgguacuggagacccauucacuuccucuuucuccagcauuauugguaacuuauuuacucccuugccauuacagaauuguuuuggguuuguuuguuuguuuguuuguuuguuuuggagacagaaucuuguucugucacccaagcuggugugcagugguaugaucucagcucacugcaaccaccaccucacagguucaagcgauucuccuuccucagccucccaaguagcugggauuacaggcacaugccaccacgccuggcuaauuuuuauauuuuuaguagacacaggguuucaccauguugaccacacuggucuugaacuccuggccucaagugaucugcccaccucagccucccaaagugcugagauuacaguccugaggcucccggccuuacagaauuguuuuguuuuggggcauucagaagucugacauaaaaaucaacuugagacuuuuauguucauuccuuuuaucuuccauuuucuuuccuuccuugcuuuaaaaauaccuuggacuuauuuucugcccucgauuuuauuuacuucuuuaggcauucagauaccaaaaccucauccuccaccuaugcuugugaacugagucacagcuuguggugucuguuauuucccaaaguccaugcucaguugaugugacgcuauagcacucccucagccuucgucucuuuccccacugcucaugacccgucuguguguucauuuccccuuccccauaacuggaaucaugcucuguccauaguagacauucaggaagugugaauuucauaagugaaugucgguuccuuuucuugccuuuucaggacugucccccuaggaccuguuuuccacuuuuuugguuuucuuuguaucccuuaaaagaguuuaucuaaucucaccuucuaagaccuuuuuuccuguguauuuuugcagcuugccuccaaauugauacgucugacacuuuuaaccuggagucuaguugaauauuuuacuugacaacauagcaguuaccagggagauaguucacuuccuucuuucucagaaugucugaugauaaacugugcacauuccaaaaucaugaauucugucuaccuuccucaccucccaguauuugauugugcuagucuugucuccaugguuuguguucuuugucuucugugaaaugccuggcagagcgucagcacauucuguuucuuucgacauucguguucaguauucucccauaccuggauuucaguggauccaucuuccauucaaaugaucauuguccuuuuccuucaucugcauuuuacuugcccacauaauacauauuuucccucccuuucuuccucuccucccucucucccuuccuucauuccuuccuuccauuuugagacagagucucacucuugucgcccaggcuggagugcaauggcaugaucucggcucacugcagccucccccucccagguucaagcgauuccccugccucagccucccaaaguagcugggauuacaggcgcacgccaccaugccuggcuaauuuuuauauuuuuauuaaaaaaaaaaccacacauaacauacaauuuaccaucauaaccauuuuuaaguauacaguaauguuaacuguauuugcauuguugagcaauaaacuuuagaacuuuaugcuuuacauuugaacugaaaagguuagcuccuugaaguuuccuucaugguucauugaccacuccagucuuuccuucucuuaauaucuauuccagucagcgauuguuaccucaaaaaguuagauaugauuuuacaguccgauaggauuauaugcucuaagaucauauucucugauaggaguguaugcucuaugaauauaagcucuaagauugugugcucugugauuauaugcucugauaggauuauauauucuaagauuauaugcucugauaggaguguaugcucuaugaguauaaacucugaugggauuauauauucaaagauuauauguucugauaggauuauaugcugugauaggaguguaugcucuaugaguauaugcucuguuaggauuauaugcucugaguauaagcucugauaggaguauaugcucugugauucuaugcuuugauaggaauauauacucuaaaugauuauaugcucugagagguaggugcauauauuuguugcuugagcuucuucuaccgaauuauaguccuccaaagaggaaagaccuuuuuacucuucuugcuuuuauaaugcaacauacaguaggcauucaguagguuuuuauugacuuaccaaggagcuagguaaaagaaagaucuuuaucauuaauccaucaagagaucauuuauucugaaccacagauucugauaaaacagauagggguuagauuagaaccuguaagcacccaucagauuaggaacuacuuuaauuucuauucagagagauucaaagaaaauaugaauauuuuccaagggcauagguuuugguuaggaaauaagauaaaagcugcaugaauuacuuuaaaauucagcuuucacauggauaauuuauacuccaaugcacauugugcaacuuuaagaagcuauuuuaaaauguaagggaaagagauucaaugaacugggaagagauuugauaaaugucuucaaguuucccccaaaguauagauagauuuugaguauagccaacaccaggagucaaauugaaugaggaagaucacgaguacagacuuguggcugagaauaagcaaggcauagccuaggcuuccaggagcagaagauguugacagauuaguggaaugcuagcuuggauauauauugugaguccaaguagugaaaaaucccguuaauaaccuuucuguuucuucuguugguguuuggggugcuggagcucagagauguuguagauuucugagcagaguaccaucaggguugcauugaaugugggugauagcagcuaaaaauaguuugugcauccaaaaauuuguaagauacauaaaaauaaaaguacaucauaggggcagcuuuaggaaucugagauauaagauuuuacaccaaaugaaacccaggaguuugggaacucuuguuuguauucagaauuaaguaaaagaauuauacagagacaugacugguuuuaggaaauuuaagucagcaaauugaaagaaaauuaauggcucaacuuaaugagcauuuguuuuauguuauaaacuguucuaagcaguuuacauguacuaauucaguccuuugacaacccuaugauuuaggcacucauauucacauuucagaugagugaaacugcaucacaguuacacagcuugaccaaaugcccuaguuaguaaauuguuggggguuugaacugaggugaccugcucugguggucaugcucuuaaccacugugcuauauugugcaagcagggaaagcagaauuuaauggcuaggaagguuagcuaguauuaaauaugacuuucaaaacacuucaaagaucugaucuuggguuuuuuguuuuguuuuucuuuuucuuuuuuuuuuuuuuuuauaguagagacaggguuuugcauguugcccaggcuggucuuaaacuccugagcucaggcgauccauccaccuuggccucccaaagugcuaggauuacaggcaugagccaccaugcccggcaugaucuuguuuuuaagauauucccuggccggccacgguggcucguguuuguaaucccagcacuuugggaggcugagguggguggaucaccugaggucaagaguucaagaccagucugggcaacauggugaagcccuaucucuacuaaaaauacaaaaauuagcugggugcgguggcgugugccuguaaucccagcuacuugggaggcugaggcaggagauucgcuugagccugagaaguggagguugcagugagccaaaauggugccauuguauuccagccugggugauagagcgagacuccaucuacaaaaaaaaaaacagauaccuugucuucuggucuaucuuauguuucuuuuggacauucacaugccuggaucucuccuccagaugaaugugaauccucucuguaaacgugaggaaaucaaagcauucagaaugcuuauuugcauuuauaugcagacuaguaaggcauggauuuuggaagggaugccaccaucguagucuugauaugaagugauaucuugcaguuuaauauaaauuguaauagaugucucccacauguaauccauaauggagucuuuccuuugcacggacaccuagcaccuguuuuuguuccuccugaucccauuuguaucggggaaccugccccgauagucacguagguucuuuucuauuuucccuaagcaucggcugguuugagaaauaaaggaacagaguacagaagagagaaauuuuaaagcugggcguccgggggagacaucacaugucgguagguucugugaugcuccacaagcugcaaaaccagcaaguuuuuauuagggacuuucaaaaggggagggaguguacaaacaggugugggucacagagaucacauacuucacaagguaauagaauaucacaaggcaaauggaggcagggcaagaucacaggaccacaggaccggggcaaaauuaaaauugcuaaugaaguuucaggcaccauugucauugauaacaucuuaucaggagacaggguuucgagagcaaccggucugaccaaaauuuauuaggcaguaauuuccucuuccuaauaagccugggagcacuaugggagacugggauuuauuucauccuuacagucucgaccauagacgacggccacaccuaagggggccaucuauaggcccaccccuaggcgcauauucucuuucccagggauguucuuugcugagaaaaagaauucagcaauauaucucccauuugcuuuugaaagaagagaaauauggcucuguuccacccggcucaccggcagucagaguuuaagguuaucucucuuguucccuaaacauugcuguuuuccuguucuuuuuucaaggugcccagauuucauauuguucaaacacacgugcucuacaauuugugcaguuaacgcaauuaucacaggguccugaggcgacauacauccuccucagcugauuaagagauuaaaguaaagacaggcauaggaaaucacaaggguauugauuggggaagugauaaguguccgugaaaucuucacaauuuauguucagagauugcaguaaagacaggcauaagaaauuaugaaaguauuaauuuggggaacuaauaaauguccaugaaaucuuaacaauccauguucuucugccauggcuucagccagucccuccguuuggggucccugacuucccacaacacauuugaucuaaguccucccaucuuugccuggaucugacguacuuucaaccacuucucugcucaucauuugguuuuauuucaccuuuucuaccaaaguuugaaacauaauauuuguaaagcaacaaaguuaccuguauucaauaugaauuuacucuucuauuuucuaccacugucucaccuuaauucuuucacuguguguguguguguguguguguguguguguguguguuucuguuuuguauuccaaaccaaaggaaaaagagaacuaugcauuuguaauuauuuuuauuuauggagauuggcucuaaagccagagucaaccccacaaugggggcucuugaauaccaguaccuuuccauagcuaguguguucagauuuacaaaguuuguuuacuauuuuuccuuuuuagaagccuggagaguugaugaccugauagagagaauccaagaaaacgaagacaaacauucaaggcaagcugcuuguaucaauagcaaaacccugacugaagagaaagagaauacauuuagucaaauuuacauggaaacaagccuuguuccuucaagcauaauagcucauaauugugucucauguggaaagaauuuagaaucuauuucgcaauuaauuaguagugauggaagcuaugcuaggacaaaaccugaugaguguaaugaaugugggaaaacauaucauggagagaaaaugugugaauuuaaucaaaauggggauaccuauucucacaaugaagaaaauauucuucagaaaauuaguauuuuggagaaacccuuugaauauaaugaaugcauggaagccuuagacaaugaggcuguuuuuauugcucauaagagagcuuacauaggggagaagcccuaugaguggaaugauucuggaccagacuucauacagaugucaaauuuuaaugcauaucagagaucacaaauggaaaugaagcccuuugaaugcagugaauguggaaaauccuucuguaaaaagucaaaauucaucauccaccagagggcucacacaggagagaaaccuuaugaauguaauguaugugggaaauccuucagccaaaagggaacccucacuguacaucggagaucacacuuagaggagaagcccuauaaauguaaugaaugugggaaaaccuuuugucagaaguuacaccucacucaacaccuaagaacucauucaggagagaaacccuacgaauguagcgaaugugggaaaaccuucugccaaaagacacaucucacccugcaccagaggaaucauucaggagagaggcccuauccauguaacgaaugugggaaauccuucucccgcaagucugcucucagugaccaucagagaacucacacgggagagaagcuuuauaaauguaaugaaugugggaaauccuacuaccgaaagucuacucugauuacacaucagagaacacacacgggagagaagcccuaucaguguagcgagugugggaaauucuuuucucgggugucauaccucacuauacauuauagaagucauuuagaagagaaacccuaugaauguaaugaauguggcaaaaccuucaauuuaaauucagccuucauuagacaucggaaaguacacacagaagagaaaucccaugaauguagugaauguggaaaguucucucaguuguaucucaccgaccaucauacagcucauuuagaagagaaacccuaugaauguaaugaaugugggaaaaccuuccuuguaaauucagccuucgaugggcaccagccacuuccaaaaggggagaaauccuaugaauguaauguauguggaaaguuauucaaugaguugucauacuauacugaacauuauagaagucauucagaagagaaaccuuauggauguagcgaaugugggaaaaccuuuucccauaauucaucccucuucagacaucaaagaguacacacaggcgagaaacccuaugaauguuacgaauguggaaaauucuucucucagaaaucauaucucacuauacaucaucgaauucauucaggagagaaacccuaugaauguaguaaauguggaaaagucuucucucggaugucaaaccucacuguccacuacagaagccauucaggagagaaacccuaugaauguaaugaaugugggaaagucuuuucucagaagucauaccucacuguacacuauagaacucauucaggagagaaacccuaugaauguaacgagugugggaaaaaauuccaccacagaucagccuucaauagccaucagagaauucauagaagaggaaauaugaacguacuugauguggaaaaucucugaagucagaucucaauuuuuagaaaacucucugaauauaaugaauauggggaauccaauaggaagucaaagcguuuaucugagaguucguguuccugaacggugagaagcauuuaggcauuagagucauuuuaauccaaauuuucacagagaagaaucccgaagaauguaacaagaagcaaagccuucagcaagaucauacgacucaucggacacuaauuuauauaggagugaaguuuuauaaauauuuaauauuuauuuuggauucaaauuguauuuacauaucagggaaucauacaaaggcaaaaucugucaauauggugaauguggaaaauauauugucuuggaaauuuguuguaaaagccauauuucuaauggaaaaucagguguuuacaggaaagaucucagaggcuaugagcucugaauaaaucuucauuguauaaaaugaaguuuuuaaauugucaggaguugaucaugaggacaguagcauuaaauaaguauauggccguuuuuuaucaugucuuaaaaaugcaaucuaaugguaauucuaugcaaguuuggaauuggaugacuugugaagaggcaguuuucuuauuugaguauuaggauggcaaaauguauuaagacaggacauauuguuggugagauaauauuuaauagguauaaaaugguaaaauaccuaguuuucuauuuagaggaauuuacaaauggguuuuuaacaaaugccucauuaguacaggaggcagucguuuuguaaaguuuucaacugcaucugaguaagauaagauuuucuaaaagacuauuuugauaaa

SEQ ID NO: 21401 - RNA, 3013 nt, Homo sapiens
aggaggagcugggacggccgccgcgcucccgggcgcaccaagcccuuuaaaagccgcgggccuugacaguucugcaggcagccgccgcggucccggaccucuagucccgcacucccagcuggcgagccggcuccgggugcggcgaggcccagcccucucggauugcgcgccggaccccgggacgcgcuccaugcggccgcucagcauguccgggcacuuucugcucgcacccauccccgaguccuccucggacuaccuacugcccaaggacaucaaacuggcggugcugggcgccggccgcgugggcaagagcggugagugcggcggggacccccgggcggcuucgcuccccggcuccggccgcgaccacugggggcgcugcggagagagggcgccucggccgaagcagagggcgcgggugcagguagaaucgggcugcuuucgcgcugggugggucccgguccgucccggccugcuucccuggcguuuccuggugcaucuacuccugggaucucggcgggauuggcgccuguucggggauggggugcgggagaggugucccgccagucguacucgcggccaagcccgcggcaccacggcuuugcggagccucuggaagcgagcagugcccacgguucugcacccuucacuccccccaguuuguccgaggugccuggguuugacaggcuuguucuacuccuucgguugauuuuccuauuuccuuuucagcaaugaucgugcgcuuccugaccaagagauucauuggagacuaugaaccgaauacaggugagaauacuuucacgcucccugcuuuuaugcuugcguguuucuuuuuacggaugggaguuugagaauuaaaaagcaaacucuacuucauucuccaggcaagcuguauucacggcuggucuaugucgagggggaccagcucucccugcagauccaggauacucccgggggcguccagguaagaaccgccaggggcaaacagcucacccccacccgugagaccaccccagugggcacagcacguagggcgcccaugcugggcgcaggggucugagcaaggcaucuaaaccgaccugugcguuuagagggaggaaugggcuguccacagguggggccagugguugggguguuagaaacucucuaagggggaggcaugguuagaagcagccuccucuuguuaagcaccugacuuaacuucacuuugcaacccuggugggccaucacuacuuaagcaggucucaccauuucuuccggagguagccauggaaccauuaacaaagaaaaaaacguuuaaaacaaaacaaaacaaaacaaaaaaagagguaggauucugaugggagagacucuucuccccuggcaagcucugcuuuuuuugagacggaguuucacucuugcccaggcuggagugcaguggcuggaucucagcucacugcaacuuccgccuccuagguuccagcgauucuccucgauucuccugcuucagucucccgaguagcugggacuacaggcacccgccggaacucccagcuauuuaucuauuuauuuauuuauuaguagagaugggguuucacuauguuggccaggcuggucucgaacuccugaccucaagugauccgcccaccucggccucccaaaguggugggauuauaggcaugagccacagcgcccggcccaagcacugcugaacugcugcuguuaauggcuguucccucaagucaguaauugcaaucagauaaccccuuggcagagggucuagaauguaacuuguuuauuaaccaguuacuaauugcuacuccguucuccagaggaaaggucuuguggaagaacccuaagaaaggaauuucuuucuguaacauucuuaagaagugcauguuaaaaauguuuuuaugaguuugggaauagauauuuaucuuggcuuauuuucaaaguuuuguuuauuaugaguuaguguuuccuaaaacuugagccauucugguuugaggucauucuucagucagccaugguucaccagagacugccugacaagcaagggguuuaaaaauaaugcagggauaacagcuaauaaaguaacucaggcagggaguuugccugggaaucuguucuuuccauaucaaaagccugcuucugcagaagcuggguggaaacugaaaacuguauuuagagauuucuuuuucaaguguuucuucaaggguugccuugauguuguuuugaguuuaucucccacugaggguuuccuugacuggaucucauuuugauguuuucucagauccaagacagccucccccaggucgucgauucccuguccaaaugcgugcagugggccgaggguuuucugcuggucuauuccaucacagacuaugacagcuacuuguccauccgaccccuuuaucagcacauccggaagguccacccugacucuaaagccccugucaucaucgugggcaacaagggggaccuuuugcaugcccggcaggugcagacacaggacgguauucagcuagccaaugagcugggcagccuguuccuugaaauuuccacuagcgaaaacuacgaagaugucugugauguguuucagcaucucugcaaagaagugagcaagaugcacggccucaguggggaaagaagaagagccuccaucaucccucggccccgcucucccaacaugcaggaccugaagagacgcuucaagcaggcucugucucccaaagucaaagcccccucugcacuggggugaacuaucucagacagaugccucuccuuuuuaauacgcauuugugcagcuaaaagacugggcuucucgcuuuuuaaucacacauucagaguuuauuuuuauaaaaaaauugauuuucaaguacauguguauuucugaaaauucaaacagugauugccuagaagcuggauaaaauuuuguuuuguuuuauuaaaagaacuuuuuuuuuuuuuuuuuuuuuuuuuuuuuuacuguaacugcuggccacuuuuccauuaaaggcaaaauggcaacauu

SEQ ID NO: 21402 - RNA, 26465 nt, Homo sapiens
uuuuuuuuuuuuucuuuuuuuuuuuuugccggagucgagcgggugcugcuagcggaggcgccauauuggaggggacaaaacuccggcgacagcgagugacacaaauaaaccccuggacccccuuguucccucagcucuaagggccgcgauguuguaccuagaagacuaucuggaaagugagugcgcggcgcuggcggcggccgccagugggacgugcgggcgggcaagagcgcgaguggacgggcagcgagauggcgggagggagggggcggcgggggauguuucuuucucacgguaacuggcagccucguugugggcugccggcccccucgaccccccugacgcacgcgcgcagugacguaagcgcguauuucgccguuggccccgccccucugacggacucucccuuugacagugauugagcagcuuccuauggaucugcgggaccgcuucacggaaaugcgcgagauggaccugcaggugcagaguaagucggcgcgucuacuacuccuguucgcugcgcgcguucagugccagacuugcuugucaucacugcuagcgccuagugcucuuucacuguccucuggcucacuccgcuagugcauaaggaguugucaaaaagaacuggcagcccugaaucucgccuuccccuucccucccaugcuacuuuuuucuggcuuuugcaagagcaggaggcauugggacacguguauuccuuucuagaaugugggauugugcaaaaaauauuucucuaccgucauugacauaguuaucuauguuucaauggacgucagcauaauaaauguugagaugucgucuugagccuuuucguaucgaacuuagauuucagcauuuauacuuauuuuaaaguucauccuauucacaguuuuucaagaguggaaagcacagaagcagagguuauauauagcucuuuagagaccauggcaaaugucaaauuuugaaaacuuaguuacacauuagauacauuuuaaauuguaacagaaucgucauuuucuugguuaaaaugagugacagaaauuagauuucacuguaaaguuucuuaugugcuguacuaaaaauuuuagcaguuaaugaacauuucuuuuucuuucagugauagcuugguagucucuaggacuuuuuccccaaauuaacuuugcucuuucauagagcaacgacuauaaauagguggcucagggaccaccugcugcagcuaagaaccuguccuuuucacugcuccuggcuucucugcccaugaccacacacccacuucuauacccuuugcuuaugaguauauuuuuccgguaaguuucagguggcacauaauaaaaagugguggcauggaagccacuuucuguucaguggauugugauaugaaguaugaauugugugugugguucuccagcuaucucacaaauucauuuuaauuuuaguguaguugaaaugcugaagauuugcugaaguaguguucucugcaggacugagcacagacauugaugucagaucugaguuuguuuuagggcuuuacuaauuuacucauugacucugacuguauuaucacuugugaggggcuuacauugucuauaaaaagagaaucauccaaggauuuaaaauguuacacauggauuagaauuucuaguaucugauacaaaguaggcauuaaauaaaggguaacuuacuuuaaauuauuuuuauauuuuauuguuuaaaauuuuaaauucucuuguaauuugggcuuacauuauacauauuacaggcuuuuuaaacgugcauuucuuuacaguaacuagaauuuucuaaaguuaauagguauuauggauuaacagaacugugugccaaauaaauucagaaaugcuuauuuaaacaaaggaacauacuucuaaaaaauuaaccauaggacuucauagagucuuuaaaaggcuauuguggacuggaaaucuccaaaagaaguauauuaugaaaagauuuuucucaacuuacauaacaacagaaucuuuuuuauuaauuuuuccuuuuuuuuuuuagcagacauccaaugagaugauuagucuuggcauauaauuuggggaaaacuuaccuagaauuaauguuuaaaugauuguaccuacuacuuucaguugggauaugacaugaugagauguuuaaugccauauaccaaauauuuuuaucacuuuuucuuguuaaaagaaaugugaggauuaucuaaugguguuuuaauuguguuucgguacauuugucugauuuaauaccauuagcuuuugaccuaaaggcuuuauugcucaaaaauuauaguauagagccuaucuacuuuggcuguuggaaaaaauuuugaaguaacaaaaacaaaaauaaucugucaauaaggaaaauuguaacuuuuuaaaggaagauaauugaggcauuauauauuuacacaaucaaagcauaacauauuuaaguuacuggcaaggugaaagaguguguauugucagauuuuuucccucccuaaaucaaaccauguauauuuaguauaugaauuuggucauuuaauaugaauuuuuuuuauuaugucauagaugcaauggaucaacuagaacaaagagucagugaauucuuuaugaaugcaaagaaaaauaaaccugaguggagggaagagcaaauggcauccaucaaaaaaguaugugcaacacuuuggauaauuuaucaagaaauauugggacccucugaaaaagauauuucaaaauuaaauaguggucuggauaucaaaaugagagaauauuaucaaugacuccuuagaauauaaauaauuuauugugguuuagagcuucagauagggauuuuuagucauuaaagcguuuugguaauuaaaaauauuguuucaauaauuacugaguauuagaaagugacagaccauuuaaaaguuacuuuuuuuucuauuaguuuguuuuauucuaguugagauagaguacuguauuccaguuuuggccacaaacuagguaaauaaacaugagcagaccuugaagaauauuuuauauauugcuagguacuuaaauuaguggacccacagaagaacgaaaucuuaaaaguuagaaggaauuuaagaaagccuucuaguuuaaacucuaaauuugcacacgaauuggucuggaaacauagaauucuuugagguuuuguuaguuuuauaguggcuauagcugucuuccagaauugaaugaguauacacguacaucucaaaguuugcuuugaaaguaugauugaguucauuuagggauggauacauuggaaaaacaacuuaaaagacuugaguuuggucaugauucugcuauuuagcugugugacauuaaaucuuaauauuucugaauaauaaugccuuccuaaacccaauguucauagaauuguucaaggaucaacuaagaggccuggcgugguggcucacacccauaauccuagcacuuugagaggcugaggcggguggaucaccugaggucaggaguucgagaccagccuggccaaccuggugaaaccucgucucuacuaaaaauacaaaaauuagcugggcgugguggugggcgccugugaucccagcuacucgagagacugagacaggagaaucacuugaacccaggagguggagguugcagugagccuagaucgcgccacugcacuacagccugggcaacagagugacagagugagacuccgucucaaaaaaaaaaaaggguccacuaaggaagaaauuuggaaacuacaaauugaguaguucuguuaugauauguuauuuauucuaccacauggagggaagauuguuucucuuaggaaaaaaaaaaaucauaaucuauaacagaagugguccuagcuuggaagauaccuggagggacauguguuugugaguaaagacauguuauauccacaucccagagucacuaaucauuucuuuaaccuguggagugcaccuuaaguauacccugaaaagucuaguacuccauggaaauucauaguaucaucuucuuucccccucuuuuuuaaaaaaaaauuuaauaaguugaggcaaaaucuaaaauacagauugaguuguaugaauauauaccuaauuuaaagugggaguuauagaacaacuggaaaauggggaaaugcagaucagaauccuuucaauagcugaacuuuaacaaaaauuuuuuaauggaaugcaaauguacuuuacaaguuagaucaauuuuaguuaacuuuuuauuuuaaauacuguucauuaacucauauagcuuuuucuagacuuacaauggcauuuacuuuuaauuauauccuuucuagaaauucugaacaucucccuuuuacucuuggccauugugcauaguuucuaauccuauaccauccccacccuauuucuaacagguuuuuguuuuguuuuguuuuuuguuuuuuugagacagagucucgcucuguuguccaagcuggagugcaguggcccaaucucggcucacugcaaccucuggcucccgguucaagcacuucuugugccucaaccuccugaguagcugggauuacaggcgcccacuaccaugcccggcuaauuuuuguauuuuuaguagagaugagguuuugucauguuggccaggcuggucccaaacuccugaccucaagucauccguccuccuuggccuccaaaagggauuacaggcgugagccacugccccuggccucuaacagguuuuuuauuacuaagguaggaugacugugauaacaagauaugauaaugaaaaugcaguuguauguccugcauaugaauauuuuaaaaugauuaauuuauuuuugaaaugaaaauguuuucauucaggacuacuauaaagcuuuggaagaugcagaugagaagguucaguuggcaaaccagauauaugacuugguaaguaaaaguaaugugcauacugugccauaaguacuugaauaacagauuauaucuuaaauuguauuggcuuaaauguaguaggaagaagcaacuaaaacugaaguauugcucucuugaucacaucuaauuugacauuucaguguccauuuuaugguuucuuuguggaaaagucagagugguuaguuaauguggugagaacuguacauuuuagcaagucuauacggcgguaaggugguuucugauguuagauauuuuuuaaacaagaauuaauguuuaacuuuauuuuacuaauccuugucuucuuaagguaguguguuuacuugccuuauacaucauuuugagauuguuucugugguaaaauacaccuaagaagacugcuuugacaagaguucuugguagucugauuaaaaugaagaagaaucauuugaaucaguguuuaugugagugauguuaaaagaucguauguaacagcugugucaguuguuuaagcaauacaagaugacaaacuuuaaacaagauucuuuuuuugcagcagcacuucuaaaagauugaaaacaccaagaagauagauagaauauucacuauuucucauauugaugcaauuguggugcucuuuuucauuugaaacaucuucuccuaaaauauacacuuuaagaaauagucauuucuguuuuugcauuaaaguaaauuaaagcagaaaacacaugcucacuuuuggcuaacuucaguguauagauuucauacuuauguugucuuuccuggguacagauuuauuacugaacaaguacguguaaguaaaaugucauuggugagcaggacacaagauaaaaggugaacaccacauauggugugaauuguaaaugcuuauaccacaaacuugaaaaugugucauguagagccauggaaaaugucuaguuguuuuuauguaguacacacauuuuaauggugcuaacaaccugggcucuuuuguucauagaguuauucugaaaaaaauuucauaaaagacacugccuaaagauagguagaauaggcuguagcuugauuuacuguggaauaaaaaccaaaaaaaaaaaggucuuaauuguuucagucuuuaauuaugucuauaaacuuagaaaaaggcauuuacauuugaaucuagacuaauuuguuuaguaacauucuuccucauauucaaugacuguauguaucaguccuuauuuagagacugccugcuuuuuaauucauauagcucuuugguucuauucuuuguuuuguuuauuauuuuguuguuuuauugcuuguuagaccuuuacuaaagauauuuuguguauuuagaaaaaauauaacauaaauauaugcuuuuuaaauauguguguguguguauucaucucuuauuuaaaaaccacacuguucauccacucugugccugaaaaaagggagcuguaccugggucuaauggaggaauaaaaaguaaauacuaggccgggcgcaguggcucacgccuguaaucccagcacuuugggaggccgaggagaguagaucacgagaucaggagaucgcgaccauccuggcuaacauggugaaaccccaucucuacuaaaaauacaaaaauauuagccgggccugguggcgggugccuguaguuccagcuacucgggaggccgagacaggagaauggcgggaacccgggaggcggagcuugcagugagcagagaucgcgccacugcacuccagccugggcgacagagagcgacucugucuuaaaaaaaaaaaaaaaaguaauacuagaaauggcucuuguccucaaggugucuguaaacuacuguuguggggcagacauaccugcaaacuaaaguggagaauccauacagaaacauguaauaaacauuaaccaguugaauauuaaggggugucuacugaaaaacauugaaguaagucaugcagaguuacuuacugauuucuuagaggguauaggaagaguuuugaacagaguuuguuuagaaagucaagguccugaauuagguauuguauugaggggaaagcauuucacucagagauaauggcauaaacagaaggaaaguacaaauucagaaauuaauugagaagggauagauuccaaggcuaaagagugaaguaauaaaggcgagguaguaaauuuaauaaagcauaagaaauacaacagaaagcaaguguccauaauggauccaugcagaugugaguucaaacccuagcucagccauuucacugacaccaugacuuuggaaaaguuauuuaaucuugaaccacaguuuccugcuguaaaaaagcaauauuaauuuauaccuuacugaaggguuugcauuagaauacauacaaugcuauuaguuuggcagauaguaggauuugcuccuucuuuaagaacucaguccaucucauuuccugaacuggaauuuucuauuuuccugaagccacugcuucccuuucaacucugccaaguggaagcugcugucucucacucuccuaguaucucugaggcuucuuuuugucuuuucuucuuuuucuucccccacccuuucuuuucugcccccaccuuugcucuacccucuuccuuuuuauuauuuuuuuucuuuuucccuuucuccuucccugccuuucuuuuuaaauacuuuaauccuauuucaggugaacauuauauccuuaauauaaaaaaucccuucucuuucagacuuagugauaaucaucucaguuacccucugccucuuaucacuauaauuuaauggcuucuaggugaggcucagauugaaaaacugguacccgguucacaguucucuguugcaaucaucuuauacuaccuagucaucuacuucuuuggcuuuuguaaaugcuaauccacuucagucgccacagacugaaccugaucaucacuuggaauugcccugccucugauacuucuugcgucuacacuuccuccuauuuuaucagcccuuuccuauucaaucaagagacugguugagcucuugaccacuuuucuuacagguaccuuccacauuguugcugccuuagggcauguuuuuacuugcugcaucuuugcuucaucacuuaugccuucucuuuuucaucuuuagccucuuuucuuucuauuggcuucuauaccacagcauuuaaacaugcucaggucuuccucauauuuaaaaagaacucaggcaaucuaauauaaaucgugucgugaccgugacucugcuuuagcuaguguagucuuccuuaauuucucauucagacucuuugacacucccuuaccuucaauuuauuccuaaauuuauggcaauugggguucuauuuacuaauccucuauaacuucauuuaaugaauucuuuauugcuaaauucaucagacagcuucaauucuuuuuaacugacccuauugguaaauuuaaugcuuauugccauucguuuugucuugccauucuugaccuuguauuaccaugugacugccugcucuagaugcucccaccuuugugaccuuucuuagucuccuucuuggguacagcucauaaugaugguguuccucaggguucuguccuugaccuacaugguuucuuacucuucaagugguucucacaugaaggugauugucuuccccucuucuaccugccaagagggccaggaagaacaaauuccacagcguaaagaccuguucuuucaaaugcaaguuuuauccccaaccuuugcacaccacccaaguugagagacacuccucuauugcaauuccauguguucucuuaguguuaacaauuauacguuaauuauuccugaagcccaagcuguuucuuugagucuuuuaaucuuagcugacuauucccaggcccuagaacucaguguuuugaaauuuaaaacucaaagcaucuccuuuuucuucucuaacuacccuccccugccccaucaccaacuuuuuguuucuaaaucucacaugaaccacacugaccuuguagucauucagauuagggcacugaaagucacccuauacuccuugucacuuccucacauuuuuuuuuuuuuuuuuuuuuuuuuuuuuuuuugagacggagucucacucuuucgcccaagcuggacugcaguggcgcuaucccggcucacugcaagcuccgccucuuggguucaugccauucuccugccucagccucccgaguagcugggauuacaggcgcccaccaccacgcccggcuaauuuuuuguauuuuuaguagagacgggguuucaccguguuagccaggauggucucgaacuccugaccucgugauccgcccgccucggccucccaaagugcugggauuacaggcgugagccaccacaccuggccuggcaaacuauuaaauaaagacuauuuuagauuucgauaaguacacaggaggaaauaaacauuguagaaagagaggaagggggagaaagggagagacaauugaauaacuggcgaaggcuguuaagaauguagucuaaggagaugacguuugaggugguacuuggaaaauaagaaagaaccaccuguuggaaaagcuaaggaaagaauguuucaggcacgugguauaccaagggcaaaguuuggaguggaaaagacuuggcaaguugaaccaagagagaggccggggugguuggucuguggucuguaaugggaaaggagcagcaugaaaggaagcaggcaggagcuaaugcaugggggccuugcgagccagucuaggaggagagugauucuuagucuaaagcggugggaagccagugaaggacuuuaaacagaggcguggaauauagaccuuaaaagagauuuuguguagguaugccuuugcuuaaacauuauauuauaggaauuuuaaauaagcauguauuacuuuuacagaauuuaugguacaucaccauaguaugcaauuauguuugauuuuaucccucaguguuuuauauggcguugcauuuuguuguauuuuuucauugaaauauuuuauuuacuuuuaaaccaguaguaaacauuuuuuuuccugugaccaucacugcacuggucaccucauuuauuaaggaauaaaccaaacuacauauuaucaacauauuaucaaugaagaaauuuguuuuaggguuccgguagaagaaacugacaguuuauuuuaguagccguuuuagugaaauuugacuaacacacacaaaaaucuauccuguuaaaauaguuuuguucuagaagcaugauacucauaaauaguuguuaaauacuuauuuguguuucucagccagaugucacugucauaaggauguauuggauugcaauaccuaauaaaguugauuuauacauacccugauaaaauuugagcuuuuaguuaaugcuugaaugauuuuagcagucucuugcagugcucaauacccuugaacuugcuucuuuuuuuauauccuggccuguuccugagaugguuauauuucagaugcacauuuuaccuauaaauuugagaguuuucaucugauacucuaauuaaggaaauaugugaguuugaccuuuugauuucuguccuguccuuauugucuuucaggaagaugauuagacagaguuauaugcuaaggccucucaaguauuuguuucagcauaacaauaggucacauuuucaucuaguuuaaaucuaauuuagagauauaaagaaucauuuucaugaccuguuaucugagaaauacuuugcuaucaugguuucuucuucuuccccaauuuacccucuuuacucgcuauuacuagaccuuuucaugguuagaaauuuaacuuacugcugucuauuucaacuuagaauguaacagacuugauugccucuuccgauagggcaagcuagacaucuaaauuuuauaaauugauuguauuggaagcaguagaucauguagagacuuuaaaaaagcuguauuuaguuuuguuuggguccauuagugauacacuuuaaaugugaauauuagaaaaccagagagucaaaaaagaaagagucaaagauuacaacucuaugcaaauauuauaggaugaaggauuuuuuguuuguuuugugcagaggggccaaguaugacuuaaauuugcuaugaucaugaguguguuaacaaguaauguugguagaauauccuuugucuuuaaagaggcuagaaaaauuauaggaguuuaaacuuaaagcuguuaugauuugggguuguagaauaugauuugggauuauagggcaaggaaacuuuguuuauagcacuuguugacauuaacugggaaaaaaagaaauaauuagacucugugguuagcccuguuuuaggaaucuguggcuaauggaaaaucucucaauuggaucaguacccucuuuacuauuguaaaucagucuuaugaaagcagauguuuguggaagggugagguaacuuacauccuugcuuugcuugaugccuguggggacaacauggugaucagcuagaagaggugcuguaaccguucagaaucauguagguugagggaaugcacaugauggauuucaggcaaguucacagcucuuauuauggcuguuuaauauuguuuaaauauccuagugcuuuauagcuuaaguuaauucuuguggucaaugggacuuuccaacuucuaauuugauuuaguacagcaguaguaaauagaagaaaaauaaugcucauugccuaauaauugcuuauaauauuaaucaggucauaaucucuuuuacauaugaggaaguaagaaugauuggaagccgucuuauaaagaugccuaccacaagugguuaaggcuuuucugucuuuguuuauuuuaacuaugaauuugguuuuuagaguuauuaacccuuuagguucuagugccuuuucugagcuaucuaguauugaaagucuugucauuauuuuuaacauuuucauauguagugaacuuuaucaauaauauauuuaauaaaaugaaacaauccuuaaaugcagaggugaagugaguuagggcaagguguaugguaugaaaaagaaaggucuuuaucucacccuaacacuacccccucaaccuaacauucuugcucacugugcuuuauauacauauuacacgcuacaucauacuuuguuuuucucuaagcauacuguuugucuuucugucucuacauuuuuuauugugauuccuuuuuuccuucuauuugaauacaauccaucuucaccgucuuaauucguaccuccuucgugucuaccaguguuacuuuuuuauguacaacuucugacucuuuuugaacuguugcuuauuugugacaucuagacuauauuuuuaucccuuauuauauuaaaaaucauauauaaaucuugauuugucagcuaaauucuaauuccuaugaaggcaaugauucucuuccauucuucauauauccuccauuuaauccagcaccaagcacguaauagcucaauauuuauuauuaguauaauuguagguacaaaaagcaauggaguguuuucguugcauuaguggucuuggaacuuaaauaugaauauuuuuucugauuucccuugagauuaaauuuugacaaugaaagagguaugcucaaauaacagacgucuguguucacacuauuauuggaaaggaaguuccauuaaaggaugcucaauuaccugcagauucuuugaauaggagcaaguauccauaauaugugauguuauagguuuuuaaauauucuagaacucugaaaaguaauguguguguaaagguagaaggaaaacuggcuuucaguuuuugaaaaaaucacaaaccaacacccuaaugauuguuguuaauauauaaaauacaaauaauaggacaauauuacuaguuuuuauacuugaguuauauuauucugaagaauguuuuucaaaaaaaaaacaguuguuuucugcaugcagaaaguucagaggucaaugucagguaaauggcaaagcagaauuuguuacaaauaaaguuaaauuugguuucuguaaugcauuagcuauaugaccuugggcauauuacuuaaguaacccuuccgagccuuaauuucuucaccuauaaaguagagacaguaauaacuucaaaagaucagaucgagggcuagaaaagauaggucaucugaugcgucaagcacauuaccuccucuucauaggcaucuaacccaugcacauuguguuuugcuaccuuucuccccuucuuccucauguuaguuacacauuauuuaauucuaaaccuuacuuaaaauguugcccugguagaguaucauagcacauguugauaucuguaagaaaguuauuucuaauucuagcaguaauccagugggaaacuagacuuagaaaaggauguuaucaauaaugugacaugaauauuuuucaaagaauuuguguauuuuuugguuucacuucaaaguaaugaguuugaaaaaauauuaaaauauuuaauauuaaguuuaaaaaauacauuaagacauuuuuuguuaguuugaagugucauauaauuuucugaaauuagucaaaagaucucucagugacaaaauaaaauuuugccaaguuaacuagggaaauaguauuauaaauaaaauaauuuuaaccagauccuuugaggaauggaguuuucuggcuaacaaucccuuuuguuucaccucuucacauaaauguuuacaagcauuaugauucacucucaugccuuagaguaauagauguauagaauauaggaacuucuuuguagacugaggaucuuucaucauucuaaauaauagcuuuuaucguaugacaguguggaugauggccuuauaagcaggaggagauuaggcucuaaguaaucacagggcauauuaugaaaagugaccagccuccaccauccccuccucccauucucuaaucccuaaucaguuuugcuuuaauuuucauguccugacuucugaaaauggaguauagaacauuuccuaacaaguugagagucugggucuuagaacuuaaaauuuauugaaggagacuugggagauuauuuagccuaacacccucauuuuauagauuaaaaaccucugaggcauagauuaauugacuugcucaaggauacuaagcagauucacuaaaagaaacaaaaauuuagguuuccucauuaagcugacacuuuaacagugucccaaauuuuggugguuaucuuugaucuucuuugaaacagguagaucgacacuugagaaagcuggaucaggaacuggcuaaguuuaaaauggagcuggaagcugauaaugcuggaauuacagaaauauuagagaggcguaaguaaaauuuacaguuuuccaucaauauuggacaguacaugugcaaaucgcugagaagaccuugucccacagaggcuuuugaaauccugcccuucaauggaugguggcauccaggccagauagcuuggacccuaacaguuggaaauguuugggucaugcauacugagagagauaauauaggauaucauccacucacucuuuaugaaacaacauauuaaaucauuuuauauccacauauacuaguaaguugagugguaagaacaaauuuaaagaaauguaaccaucgggagacaaauuaaccaucuugcauuaaguguguugacuuuacucugccucuuuauacacuuaagcuuugaggaaaguuguuaguuucucuucuuaagaauuacuuuauggcuuuuccuuaacugcauauacugaaaaagacucacauugguuucauaacacuaccucuuuuucuuaaagaaguguuuucuucuuucccuuagcagcaagaaaccauuuugauauuucuuugcaaggcucuauuugaucuccugcuauaacuuaccccugucacuucuuuggugugacuucccaaaaauggaagcaugagcacuguuuccuuaacuaauuuagcauuucuucaaccuaaauagguaauguacauaaaagcaguuagugugguacuagguguagaguaggcacucacuagauguuaauugaaccaaauuaauauuauggcuaauuucuacuagaauuuaauuaaaacuuacaaaccuucuuuuucuuggugcauuucaacaguaagaauauguaccuguuucuacacacagaugaaagauuucuuuacagugccaaucuauguaucucucuacucacuagaagucagcuagggaagccaaucacagaucugucuugguauccauaguugcauuuuuguguucaaaaguagauccaucacuuuagauaaucauccuauuuauuugugauacuuuucuucuggaggaacccuauauaaagauaauaaguauuuugagacaaaauuaaaaauucuguaucugcuuugauuuuuuaaaaaugcugaugauagcugugaguaaugauaauucaugccuauucaguacugcaggaagguuaauaaagcauccucucuaaggacacagacauaugaaacaaaauuggaucaaguuauaaaaacugcuccacccugugcccugccauaauuucaucucaagggaucaaaaauaaacccagaaaaauguauuuagagguauuuuaaagcuugguguuagagauucuauuccucacuuuuugcgaacaaaaucccuaacuucuuuuaggaagucuuuauuaucauaaugucauuuuaaugaucaaauaauuuuuuucauauaguaaugucccccaucacguagaacuucagaaucucccauuaaaaggucuucaacucaguaaaacuagguugacucuuaccaguaaugagauuacaauguccauucauccauuuauauggcacccacuauggugaauucccuaauuagacacgaguaugccuugagccauuuuguacuuaagauuaauauugggaaaaggauaacuuauuguuuagagagaggauaacucagugugggauggacaguggugauccucuaacaugucuggcuaaaauaaauacaggcauaugcaucagaacuugcuaguccucugcuggguaagggaacucauugccuguaguugagugacaugugaaguucugcggugacauuuaauggugguguaucucugugccucucuucuuuuaggaucuuuggaauuagacacuccuucacagccagugaacaaucaccaugcucauucacauacuccaguggaaaguaaguuugguguagugcagcuaaguuuuaaaaacaaugaaaaccuuauuauaucaccuauauguucucuuuuuuuaacucuacacaaccaauugagaaauaaaucccuucuuuuuuuuucauugcaaguacuggcagacuugucuuuuuccuuggggggagcauaugugauucggaaaugaguauucuguuuucucuuaaaugcguagaaggagaauguauaguacuaauagcauauauucccuucauacacauaccugauucuccuuagggagcuuuucaacugagcauucuccuuagggagcuuuucaacugagccaaacaauaagcuauuuuguaauaggcccuuugucuuuuucauccuugcuucuccagugcuuaaccuaauguuuggcauauaauuaagucugaaugguugguaagucagugaguggaugaauuguuaguuagaugacuggcuggcugguugguaacagucaaaaaaugacuauaucaguacaucuuuugacacaucaauuuggugggaaacuauuuuaagugguagauuguguuuugaaaacaaaauuucccucacauuguaugugagcccaugguguaucuuggguuaucuuuaguacuuugcuagaaguuuuuuaaaugguggagaagucuacucuuaauaaacaugugacacagaguucugcuuguccugccuucugaggaaacaucauguucuguauuuuaugaggaacccagaucauacuguuucacauuuuaacuggauauaaguauuaugccuuguccauaguucucuaaaguuuaaaaacacaugaauuuuuuauuuauauuuagaaaggaaauauaauccaacuucucaccauacgacaacagaucauauuccugaaaagaaauuuaaaucugaagcucuucuauccacccuuacgucagaugccucuaaggaaaauacacuagguaaguuaauuuucuuaaauaugauugcuuuguuuguuuguguuagaguaaggggaaauaaaguguuucaggauuaaugaaucauacaguuucuuuaccugguuaaaguauacauauggagaaagaagaaaaaggaaaaccaaauacauuauucaguugacuuaauguacaagugacauuaaaaauuuuaaugauuauaugucugugcugggaaauaauguaauuuagacucacuaacauuauguucucugcaaccauuuuuauuucuuuuuuacaucuacacagguugucgaaauaauaauuccacagccucuucuaacaaugccuacaaugugaauuccucccaaccucugggauccuauaacauuggcucguuaucuucaggaacuggugcaggggcaauuaccauggcagcugcucaagcaguucaggcuacagcucagguaaaaaguaaaggguuuagagacaaaauguuacauuuugucggaaucauuggaaaccuaauagaaauaacgggaugugaacaaauaguuuucuaacguuguauauuuucauuuuuaagucaugauuucacgauaugugauauuuuauuuaaugaaauaauacauaggaauugccugauugauaaugaaaacuaaaaaauagguuuaucaugcggauuacaugcagacccuucucacaauaacugcucauguugcccauguucuugacugcaguccacagcacaugcuagcauaguucuucguucuuucugccaguuccaaggcuuccccuguagccuuggacuuaggucaucuugaguuuguucacuucuguauaguuugccuauauuccaaauuaagaagcugcccaucccauaguuuauauucuaacuguguaaaaucuuauuuuaaaucuuuaaaugaaaaagguuaggccaggcauggugacucacaccuguaaucccagcucuuugauaggccgaggcagguggaucacuugaggucaggaguucaaaaccagccuggucaacauggugaaacuccauuucuacuaaaaauacaaaaaaauuagcugggugccuggugggugccuguaaucccagcuacucgguaggcuauggcaggagaauugcuugaaccugagagguggagguugcagcgagccaaaaucgugccacuagacuccagcccaagcgacagauugaaacuccaccucaaaaaaaaaaaaaaaaaaaagcuuaaauuccagugaugaaaauaauaguuuaaacaauauaaauuaacauuugauaaaccaaaauaaaacuauaauuuguaaaacuugaaaaagaaaaucuacauauuuacauauauugaugcuaucaaugaaugucuauuuaagaugaaggagggacgaagaacaucaaguuuaaaagccaguuaugaagcauuuaagaauaaugacuuucaguugggaaaagaauuuucaauggccagggaaacaguuggcuauucaucaucuucggcacuuaugacaacauuaacacagaaugccaguucaucagcagccgacucacggaguggucgaaagagcaaguaaguuuuauuguuacaguagcccuauaccuuuacugaacacuuggucuacuugacacuucagccaggccucucuauguuaaaggcaggauauaacggauuaaaauuaaccuugcagagguagggagacaugcgguuuucauuuuauagugccauacuuugaaggugucaagucuuuaaaaaguguuagaguuguuuuuaauuuuucuagagucauaaauugaguuuguuaauacaugacuucuuuuuaucuucuuuuauucauuaagauaaaucauuuuauggaacugcuuuucauuuauuacccuuuauuuugccauguguuucaagguaaauuaaugcaaugcaaauuauauccuggugauuuuuuuuuuuuaaacaagauuuuucauuuugauuaacagcaagcaaggcgucuucauucuuagucuugggucccaaaaacugaugguguaaaaauaucccuagauuuuguauaugagacuugggaugacuguauaagcuuuaaauaugaaaaccuaauagcauuuaucacugucuaucccagguaacugaauaugcuggguguuuauacauaaugaaaguucaaaugcuaggccaaaauaauuaguuaccuaguaguuauauuuucuguauuuuaaaauauguuauauuuuuugugaauuaaucccuuaaagaacgaucaauaugaaauaaccacaacagaagugucaaacaucuuaaaaauuaauucaucuuaaugguacaaguuuaauguaauuucuuaugauaaaguucuauacuuuuagaauuuaaauagcauagggcuuagcaguaaauuacuugugaauuuuuacagucuugguucccugccauacucaugguagguauucacacaucaguugaugguuauaaccacuuucaucaaauguuuuugugugugugugcuuuagguuuugaugaagaguauucaguuuacuuaaaaauacgaauaaugaguggcugggcgggguggcucaugccuauaaucccagcacuuugggaggccgaggugggcagaucacgaggucaggagaucgagaccauccuggcuaacacgaugaaaccccaucucuacuaaaaauacaaaaaauuagccaggcaugguggcgggcgccuguagucccagcuacucgggaggcugaggcaggagaauggcgugaaccugggagguggagcuugcggugugcagagaucgcgccacugcacuccagucugggcaacagagcgagacuccaucucaaaaaaaaaaaaaaaauacaaauaaugucuguaaaguagccagaacuuauguuaauucuucaaaguacuaccuacaauuuaagucauugguaaauccggauuacuuuagcuuacacuuuaauuuauacauuugaugucauuucauuuuauacuauuuauuuaggaguuauucucaguuaacuucuggauggugagcaaauaaaacuuauacuauuuuuuucagaaacaacaacaagucuucaagccagcagucaucaucuuccuccuccucuucuuccuuaucaucguguucuucaucaucaacuguuguacaagaaaucucucaacaaacaacuguagugccagaaucugauucaaauagucagguugauuggacuuacgacccaaaugaaccucgauacugcauuuguaaucagguaaaagucuguuauaucuauaaaaguauaaucugaauaaacuagaaggaagagaacuauuucauuuuuaagcacuuuuuuaaacucacuuaaaauaccuuugcuuuauuuguauacuuuucucccccuucuuacaaaagugacauuugcuguaaauacugaguauaaagaaaaauguuacccauaauccuagcccucagauacaaccuguaacuaaacauuuuugguauaccacuaccauauaccucaugugcacauuggcugccuuaauaaaauacaacagacuggguagcuuaaacaacagaaaauaauuuucucacagguaugaaggcugggaaguccaagaucaagguguccacugacucaguucuggaggagggcucccuuccuagauggagacugcugccuucucaccggguccucacaugauagagggagaaagagugugcucuggugucuuuucuuauaagggcaccagccuugucagaguaggaccccacucuaugaccucauuuaaccuuuaccaccuccucacaggcccuguuuccaauuauagucacguuggggguuagggcuucaacauaugauuuugagacauaagcuugcauuucauaacacgugucuaugcagauuugcacaugcauguguguauaaguuugucaguaggaaccacaguguauacuuucuuguuacuggcuuuuuucucuaaaucagguauaccgaacaugauuuuucuuuaagaucauauuuuuaauuuucacauaguuaucucuuaugccauccaguguaguuuucuuaaccaauaccuagcuauagauuauauuagugguuuuaauuuguuugaaauuagggauaauauuacgauaggcauuuuuuaaauguaauccauuuuauacaucuaauuucuuggauaaucuuuuagaaauaaaauuaggcuguaaauauuugacagacaccaaaauauauuuucuagaaauuuauuaccaaaaauuaauaaacauaccgguuuacuaaacccuguccaacacuggauauuauuuucuuuuaaaaacuaaguaccaauuugguaguuuuauauuaugauuguuuuaaauacacuaguauuauugaaguuggacauuuuuugaccauuuuuguuuuuuacauuaugaaucgacuccuaauggugucggcugauuuuucuauuguuuuuguuauguacucuaaauauuugcuugauuuaguuuuuuaaaaauaauucuaaaauuuuaauuuuauguaguuaugacuguuaauuuuuuuuuaugaagcaagccauggauuauauacuuagaagggcuuucucuuuggcucuucuuucuacaaaaaauugucuuguauaauauuuucuccuaguuuuuauaugguuuugucuaguucuuugcaugcuucaguuucuucacauuuaagacuuagucuaucagcagauuauugugucuaacaguaugaguugccagucugauuuuuaaaaauuuuaacaauuuguuagcuguuccacuaucacccgauaaacauuuuucaguacaaaugauagaaaagcauauccuguauccugacaacaaaaguagauuacuugcaaaagaacaaaaucagacugaaccuagaguuuuccucuguaacacuaaaaaacuagaaggugauggaauaugucuguagagcuuucagggaaaaauuaagagcccccaaaaacuugauauucagagaaguuauuucucugcauaggaccauguaaauauauuuucacucaugcagagaaucagaagauaugccaucuaguuaauccugucugaaaaauuauucaauccacugagaacuucagugaacucaagaauuagcaaguuaugcccuaaagugcuggugaugaagagcaaaagaaaaaugagaaaggacauaaaauagauaaguuuagaaguuucaaggaaggagacuauuaauugcaaaaauauaaaugaccuaaugugacccaagaaguaaaaacuuucaguaaguaaauaaucaagaaaggaacuuaaaauuuuuacaauaagaacuacccagaaagaugacuccuucauccgggugauuuauaugucaaguucuuccagacuucugaagggcagauaauuccugugcauuucuucccacccuugccccacccugcccaaaagaguauuucaggaaaaaauuauuauaccuugauucucaauguaauuguauauucaguguauuucccuuuauuuuccagcaguaucauacauaaacaguuaauugguaucuagguguuuguuacauagucauaauaaagacauuuaauuuuuuuuaacuagguaucuuauggugagauggugggaugugauaaccaagauguaaguauuacauuuuucuauuuaggaaugaaaaaaaucacagguuguuauuacuugaauauuugucuuauuugcuguaugguuuggucuaagaaaacagguuugcagguauauuaguuauauuaugcuaaugcuagaauauuccucuucaaaauaggguagugucccuuaauguguucccuauuuuaauuuuuaaagcuaauuuuaugguuuuaugugcagauugucucagaaguguuauguuguaugaaaauuauaaauacccuccuuucccuuuacuaaaaaauacuguguuuacuagaauccaguucauuuaucacauugaagaaauggaauuuuaaaacaauucauucuuucaggcugcaccgugcuaaagugaagggugggauaauugaggaucuaaugugagauuaucuuccucucaugaguauaauauuuuuuccuguacucugcaggugucagcugauaagagccaccccugaucuaaaaaguaaaggaaauuugaaaggaaggaauucuugguuuuuaggagacuuaauuuuaguuagagauacguuuuuuauucaauacugagaauauuguugucuaguaauuuugacucccuccuuauuuaguagugacaggauccuaagauuaacaagaguuuuaaauuuguaaaacaaucugaagauugagggagcuggcuaggugcauuaaaauguguacuuuuccuagaccugauaggguuacagcaacaugcucacguagauugggacagagccuccuucuguuucccugucuagaaucccuuguaggcuguuugugguuguugcaaaaacaauauugcccaaccauuucaagaacaucacuguaaacucuucuggggcaguuagugaaaaugaugaaugagauuucuaugaguaccagcaucaugcuucucugauucuucuuauucccaguugugcucuucugagugcuaagacuuucaugaaagaguuuucugcuuaauauguuucaaagaggaauaauuuuucucuacauuucaaggaauagaaacacccacguaggaaaugcagggcauaagacauaaauuaaugucuuuaauuacaaucagcuuauucuacuuuaugagacagcaaauaaggcugacuauuaaauaaaaucuuaaguuauauuuaccuucuacauagaagauucaucccacuucuuuuugcccuugaaagcugaaaacuagugaauuuucauucauuaggaugaggggacuagauuacauggaccucaggauucuugaagaugcauaauuuuucugugccuucauuuccucauuccugaagcuuaucauuuagucuaaaugaugucuaaauaaucuagaucuaaaaauucugaugucacacaucuaauuauuguuaaauuaaauggauuauucagucuccugagcauauuuuaauauacucucuugucuucagaaguacugaaaacuuguuuuuugcaauuuugcuuucuagugcccuauagaaugguuccauuauggcugcguuggauugacagaggcaccaaaaggcaaaugguacuguccacagugcacugcugcaaugaagagaagaggcagcagacacaaauaaaggugguccuuuuguuugaugaagaaauaaacuucagcugaagauuuuauauaggacuuuaaaaagaagagaagagaaagaagaaacaaugcauuuccaggcaaccacuuaaaggauuuacauagacaauccuauaagaucuugaacuugaauuuuauggguuguauuuuaauaauguaaguaaauuauuuaugcacuccuggugugcuaugaauauuauuccaguuagccuuggauuauuucaguggccaacauaugcagacauuuguacuccucaaccauuuucucaaaguaaugggcauucuaugauuuagacuucaaggaauuccaaugaugaagauuuuaaggaaaguauuuuauauucaacagguauauucugcugcauguacuguacuccagagcuguuauguaacacuguauauaaaugguugcaaaaaaaaaaaaaagucagugcuucuaaaaagaauuuaagauaaugguuuuuaaaaugccuuuauaauaagcuuuguuucuuugugaaacuaauucagcaggcugaaggaaaugguucaugugauaaugugggcugguauccucuagaguaccuggguacauaaacagaaacuccuguagguaaaaaguaauuugugccauuagucuuucuauguuucugcauccagauagagugcaguucaugagggagggggcgggggacugaaggggaaagggcguuaaagugauacauuuuuauaccaaauguguuuauuuuuuugugcaaguaauccuuaaaauugcaauuguauuagguguuaaaauaaaguuuuuaaaaaauuacuuguauuuauacuuuacauacuuaauaaugaaaauuucugaauuccaauuaacuuucaacuuucauaaucuaaaaagaaucagagacccaggacacagaauacuguguaaucugugaugucuuuaaugauguuuagaguuugugauauaagaauacaggaaagacauuuuuaauguaaauuugaaaugccaauguauuuuuuuaagaacaucaucuggcuuuuccuucagucuaaaagacaugaaagaaguguaaguauagcaguuaaaacgaaaauaaugguuauggguguuuugacuggaggcaauguagccaaauagaguaaagagaccccccuggucgggagcuccaaauugagcuauuuuugauucuaccacuuacugauaugacaguuaauucaaauuuuguaucacucugggccuuacuacaccagggugaugcugacugcagaauagaucuuauucuaaggugcuauuuaaauuauaaauuugcauaguggagguuuuauuuaaaguauaauauugagucuggucgauagaaaaauccuuaacuuuuaagauacuuaauauaucauauauauuuuauauugaaacuuacuggguccaucagauuucugcuuuaauuaaaccacuuaugagcuucuuagaacuuauucagauaacaguguaaaaucuaugcagugcuacccaaagggugugagguagauaggggauuucaaagaucucuuccaccuuugagaucccaugauucugagcugccacagucugauuauacaacucuaccagcucccuaaacaaguuagguucauuugugaguacucaucauuucauaauaucaugauuaucacgauuucaugauacucaauauuuugagauuuuauaacccuuuaagaagugauaaauaauguaguauucaauucguuuaucaaaguauauugccuggaaaugcucacauguaucauuuacauccucuauauauuaugacuauuccaaacucauucauuuuauagaaauggucaaaggaaaaagccuuauguacagccuuauuugaagagaaaguucuuugucugagucaggaacauccuguuauccagcugcuacauccccuuucagugugaauuccacuccuuaccaaaucacuuagaaaacacuuugacaaguuuuaaacucaaacacugaauauuuuaugaagcauguguaaagaaagaaaccaaaauuuggugcagguauuuaguaauggguagaaccuguuaauaucugagucauauauaauggggccaaacauggaacuaccucaucaaccccccaaaaauguggccaacuauuaauauucuuugugacauuuacaccaaggggcauaguaaguauuuuugguauuauaaaauacacauucaaaaucucuguuguacaaaacucauguaacaguugggacaaaauauccaaauguggguucacaguucacagguggugaaaauugaggccuuacugcuauggaguguauaucaaaauguucauggugacacauuugaagcaauaaauggcuuaauuaaaugcca

SEQ ID NO: 21403 - RNA, 220478 nt, Homo sapiens
  misc_feature (122043)..(147042): n is a, c, g, or u
cuggguuuuuuguuauugacuuuuuuuuuuuccuuuuucuuuuuuaaaauaaaaaccauagauuucccacccucuuuaaucccuuccuuuuaaaaauguucucuucucugcucuacguccucccacuucccgguucaaguuucacuggugucccgacccgucccccugcccucugcccccccccccccccccgccccugccccguuugcauuguuugugugcggcaucuucaguauaaaaggccagcgcccacggucccaggagcgccucccuccuucucucccuccucccucgggccauucucucccucccucccucccucccuccccuccaguguuuauauguaaggguacugguugaccuuggcggggcucaguggguauccaguguagacgguggaggcuggcgaggcgcugauguaggucuggugggcaaauugggcuggauacugacucggguggauggugggcgagggcaggacccgggggcccaugcucacggggaccugguggacgaugcuggcuggguaggcagugugcugcacgguguggcgcgcagagccuugcgaggccaccaggugggccacggugccgguggagcccagggccgccggcgcaguguagguguagagguggggcuggguggggaggugggcagcggcagcggcugcagccagaugcgggugcacagugccguggcuggggcuguugugcgggaaggaguacggagccugggccauggugggagugauguaggccugcugccuucgguggcucccagugcgguccguggugaugugcugcugagccuggggaggagaggcaccaagagagacgucaggggccgacacauggggaggaaggaaugggaggaggggcaggagggcagggaggaggaagagaagggaaagacuccagaaguaauagaaggggcuucccucuguguguugagaaaguaaaaauuuacuugggaccuggcgcaguggcucacgccuguaaucucagcacuuugggaggcagaggugggcggaucaccugaggucuagaguucgagaccagccuggccaauauggugaaaccccgucucuacuaaaauacaaaaaaauuagccgggcaugguggcacgugccuugucuguagucccagcuauucggugggcugaggcacaagaaucacuugaaccugggagguagagguugcagugagcugagaucacgcgagugcacuccagccugggugacagagugaaacucugucucaaaaaaaaaaaaaaaauuuacuuggacugagaaaaucccgacuuggccugccacucacugggcugggaugauacacggauaaagccagcugcaaaguuauaggagaacauauuucucccaaggacguacagaagcugugaaguaucaggaugccccaggcuggagugcaguggcaugaaccuagcucacuguagccuugaacuccuggccuagaaugauccccccgccuugggcucccgagaagcugggacuacaggcgugagccaccgcacccggccaggacacucucuuugagcagcaguugcuuucuuacucacuguaaaaucuuguucucaaaauuauuggcucucacaacaucucuacaaaaaauuuugaaaauuagcugggugugguggcucaugccuguagucucagcuacucgggaggcuaagguggaggauuacuugaguccaggaggcagaggcugcagugagagccaugacagugccacugcacuugagccugggugacagaacaagacccugucuuaaaaaaaaaaaguuggcucucagaagcguugcuguuugaaguucugucaguccaaauaaaauagcccucuucuaccuggugaaccuaagucacgugacagagacacgggcuccacugaugaccuggggcagcacuucagaugaggggcucugaacacaaacaccccauuuaucucacuuuguuucuagagaaacagggcccugaguccaccacgugagucaggccugaugccgagcccuugacacagacagcccugcacccacagaaacucaggucacucacauuucaccucaacccaccccccuuccuccagguccugggacaaaucuuacccuugacuugggggcuguggugugcgggcccucccugcaaugagucggaugcaggucugucccugaugucccaggccgacagggccgggacacagugcucuacccuuugcuggguugaaacagcaguaugugggccauccuauuuuuaagcucuggcaccaugucacuaagggcuuuguaacauuagacaagucgcuuugcuuugggccagcacucugugcacuggugauaucaacuuccccaagggugaccugugguagaaaaagccaccagaggucaccaagggcaugugcugccacccguggccaggacugcagcccugugaggugggugaggggccgccacagcaauccucucugaagcggaaggaugaggggaugggggcccugccuggccuggggcgccagcuguggggcuuaccuggcugagauugaguggcugcugcugcuggaagugggggcccggccgcugcugccgguaggugauggcuccagaugagcucccugaagagugaccgcugguggaggucacguugcuggaggacuuggacuuguaggaggacgaguggugacugguguugacuguggcgggaggagaaagaggucagaucaguggcagggucccagcugcccagaagaugcuaccccaccagagaacaguggucuuccaggaagaaacaugugccugaggccgggcaguaacaaaucagccucaucucccccggacccacuaggacuuugccuugacucuggaugcaguggggcucuggcucacucccucggcugggaggguggucggggcugcaugagggaaugaagcaagggaaagcggaaaagaaucaggagaggcaaggugggcugguggccuaaggccaggcccagugccguuccucugggagguguuacuuucagcaucuggaaaauggguaggagagaucugcuauaauuugaauguguuccccaaaguucuuguguuagaaacuuaguccccagugcaaguguuuaggguggggccaguaagggauguuagguccugagggcagagcccucaugaguguaugaguucaucagugcauuaauauuaucucgggaguggguuagcuauugagagauuggcuuuuuugaugaaaacaagucuggcccccucacccucaugcucuuuuguccuucugccuccugugcuaggaagaugcagcacaaagguccuugccagaugcuggcauccuguucuuggacuuccagucuucagaaucgugagccaaauaaacuucuauugauuauaaauuacccagucucagguacucuguuacagcaacacaaaauagacuaagacaggaucccugcuugguccccaccaugggugacuaugaguaucagaggagacagugucuguggugggaccuaauaaacuacuagaagcuaaaauaacccucagagucaccugguccaguuaccugccucuaggcaggaugagacuaaaucauccggggaauggcccugugagccaaacauggccaagcacaaaacugccuccauguuauugccaagggggcugaagaguggaaaaaacacugcaacccuccagaggugaccucauggucagcagguggcuccaucaacaguucucaaauguaauuccugcaucuuguucagugcagacucuggccagcagcucuggggggcccgagcaccugcauuucugacaagcucccagggggugccagugcugcugcuugggggaccacgcucugaguagccaggggcucugagagagguggguuaaacccugagcuggauggcuuccauguuacccagccagagagccaggggagccaggagccucuucagagcccagugguuuuaacucauccaaguauuuucugagcuccugcccugugcuaaggacggugacuguguaccaccagggacggggguggcagggagaaggcugagagcgugaauaaggaggaggcaucacagaucacgcagaugagguggcgaggccagaggauaaaccagaugaagacgcugacagucagggacagcccaaguccaagaaggcugauggaacaggacagggcaggacagggcaugaguguccagcccagcaggggcaagagccccagagggcgggagcucugcugccgagugggggccaucuccccaccccagcuuggggaguucugcagacaggaccaucaccccuugauaaaagcagaagagaugcuuuacuagccccccaugucccugugccucagcucuccuccaggagagggcugccuaacacacagugcaguauuaauacacaccuaaaugaaauuuccaaucaaaugcacccagaugcaccagucauagccauucauuaaaugcaagcacuuuuguaauggcaaaagcaacaaacagacccagacuagugagaagauacugggcuuccuuuuuuuuuuuuuuuuuuuuuuuuugagauggaguuucacucuuguugcccaggcuggagugcaauggugcgaucucggcucacugcaaccucugccucucagguucaagugauucuccugccucagccucccaaguagcugggauuacaggcacccggcaccacgccuggcuaacuuuuuuguauuuuuaguagagacaggguuucaccauguuggccaggcuggucucaaacuccugaccucaggugauccaccugcccuuggccucccaaagugcugggauuacaggcgugagccaccgcgcugggccaacacugggcuucuuuaggagcaaacugcauaauggccuaggaaagugugggaggcagaaaauuccagauaccuuucucuaacuucaaugacaacggaagcagaaaaagagggguuuaguaagugaaggcuacgacaaagcagccugaagacugugugguuuguguuguauaguuagaaaccauaguuacaacaagcauugcuucuguuccuuaaacgcuaaagaacaguagaguuaauggagaagaaaacaucuuccagguggaaagacaggcagauggucccccaccaagaagggcagggcagaccagggaaugaacaagagccuggcgcuggggcugggggcuguccugccuccuugggcaaccaguccugcuggggugagaugugcacagaaacaauacugauuuuuuuuuuugagauggagucuugcucugucucccaggcuggagcgcaguggugugaucuuggcucacugcaaccucugccucccagguuuaagugauucucgugccucaaccucccaaguagcugggauuacaggcaugcaccaccacgcccagcuaauuuuuuuuuugagacagagucucgcucugucgcccaggcuggaguacgguggcgugaucucagcucacugcagccuccgccucccggguucaagugauucuccugccucagccucccgaguagcugggacuacaggcgcccacugccacacccagcuaauuuuuguauuuuuaguagagacgggguuucaccauauuggccaggcuggucucgaauuccugaccuugugauccaccugccuuggccucccaaacugcugggauuauaggcaugagccaccgcgcccagcugcuaauuuuuguauuuuugguagagacagaguuugaccauguuagccaggcuggucgugaacuccugaccucaagugauuugccugccucagccucccaaaguguugggauuacaggcgugagccacugugcccagccaugguacugauucuuagucuaagaaccagacugaggaagacuuugcccaggaaaaagggagcgcauuuuaagagagaaagguaaugaguaaccuccuuuccgccauccuuuguugauuugagcacuucauguguuguaucuuguacucaguuauuuuucuucauuaaguuucuggaaugugcuugaaauauuuuuaucaccuugacuuucuauggaggacagcuaaauuccuuuuuuuauuuugagguggagucuugcucugucgcucagguuggagugcaguggugcaaucucgacucacugcaaccucugccucccagguucaagugauccuccagccucagccuuccgaguagcugggauuacaggugugugccaccaaaccuggcuauuuuuuguauuuuuuaguagagaugggguuuugccauguuggccaggcuggucucgaacuccugaucucaggugaucugccccacccuuggccucccaaagugcugggauuauaggcgugagccaccgugccggacagcuauauuucugugauuuauauuuuuuggaaaccuugcuggacuuuaggauuacugccuggugacacugaaaagcguaaggaagcccuaggagaggaaagaugaaauaacugaguaugggaaagagcuuuggccagggaauccagucauucgccaaaaugcggugcuauuguuccacagagccccaacucuaaagcaguccacauuugaggaaggugcccaaaguagggguguucaaaggacgaaucagguaaaauguuucauaugaagggagaggcagcaagaacauauugcaagauguccaaagacagaucuacaccucacguucagaagcaagaauucggagcauucauuuuggggccugagcaucuuaggugaacuggaaggcucauacugucucaaugaaguauccuaugggugguuaguguaaaaggagagaaucuggucauucuuggggcagaggugcuaaauauuaaugagccaugcauggaaacgaccaggcccuugauugaauucgguuggaucaauucuauuacaaaucccagggcgaugaaaucaaagucaaagaggagacgccugaggcuggagccagcaagaaagaaugcugauuaauuguugaugaagagagaaaugugccucuagaggucucagccucucaagaaggucaaaggaaaaccggaaaccuggggacagaaguuucuggugcucacuacagguggaagggggccuuccugaccccaaaacucagagcccccugcccuaagugaagggugagcugccgcaguggggaugggggcagugggugcuauucagaggccgcaaauccaaccgugcauuugcgccuggggccccucccaccccauccacugaaucggaaucccucgaguagguacgggagauccggaaucaguauucuuagcaagcuucccaggacaccagagccuccuggcccuggcugaacagaccugcauuugggaaucagggccuugcgacccaacacugugcccaagccaaacccauuagacucaaaggucccccaaaaccugagggauggagggauuuuuguggacucaauguagaaaagaaaaauagaaagcugcaaacauuggcucugcagagccugcuucuugccuucugcagccacaauguggcuguguugggggaagccuccuucuugcucugcggcgggucacagacugugcugggccccgcugugcaugucaccuacuucuucuauuccaacuuccugggcauuuugugguaaugauauuugagggagaaacacugagcucgagggaucagugaagggguuagggaauguuagaugaaaugggcguaaugcagcccugaugcuaccaucaucauggggacaggagauggggguugagucagagcuugccaagcucucagaggacgagagccccgaguaagggaggacguccugaaggggaccaagagauuaaaguauaacaguaacuccuccuguggcgauggacaaagcgacaaugggcuaaugcuggucaaccuccuaauguauacuuuggaacagugaggaaacauucuagaguuuuccagucaugccuuguccagcuacucuccgugaucuccuguccugagaacagccacaguggcccugucuacacuaggugaguuggcaggggugcuuacagcacagauaagcuccagggccagaccucugggaggcccagccacauggcucugggaaggcuggucaaccccucugugccuccauuuuuaaccugggaaacugggaagaucauggcagcuccauguagggcugugaugaggauuaaaugaguuaacaaguguagaaugcuuaguaucuggcaucuaagggcuuaaguauugaguaucuggcauuuacguacuuaguguuagcuauuguuggugucauuauugaacucugucuccugguuaaagcugaggcucaaaaaaaggugucuuggccgggcaugguggcuuaugccuguaaucccagcacuuugggaggcugaggcggguggauugccugaacucaggaguucgagaccagccuggcuaacgcggugaaaccccaucucuaccgaaauacaaaaaguuagccgggcgugguggugcaugccgguagucccagcuauuugggaggcugagacagcagaauugcuugaacccgggaaguagagguugcaguaagccgagaucgcgccacugcacuccagccugggugacacagcgagacuccucuccggaaaaaaaagcaacgacaagugucucuccaagcugggacaaucaauucuggucuccuggaaaugggacaccaggagccugggagcugcugucggugagucgggugaaggcagcuucagagagcaggcaucuggcccccagggcucagguccccgggguucuggcuccugcccugccugggacuuaguuguugaacuuucccuuagcccugcauccuuccaauaaguuguuugucuuaagccaguguagaguucauucuguugcuuccaaaagaaacuucacuaaccccaaccugagaaggacugaaagacugagagccacaggagggggugaguauggcggggaaacagcagugcauauccuggccuaagagggcugggggagcgcugaacucucccaugcucugggugcuguagcugggggagcuguuaacuggcuguaccuuggccuguaugcaucacugggcuccagggagcugaggaaggcugcuuucccgacuuuuccaagccuagguggguucuacagcuaaagguguguaucgguauugaacgccacuggcuggggaagggcaggcaccagacgaggaaugccccugcucgugagggcacaggcagcacucccgcauaugguaugaguucagucugcagcuucgagguuugcacaaacauauauuuaaggaacuuaaauaaugauacaagacaaauucuauccuuugcaaauauuuaaacuuaaaaaugugugcugcauauacccuuaaacaauauuuaaaggauagcugagcugaaaaguaugcagcucucuuuaaggaauccuggcucccgggaaugacuucgggugccucccagggcccuuugguuacugcuagagaauguugcuuccuggcaggguuuccaccaaaacauuugcccggguggaaaaagaugguuuuuggagagagauguccuuguagccuuguggaagggacagcuucauuuucuuuuccucacagagaugccuaauuuugggagggcuccagccugcuucucuggccccaggucaccagacccuagcagcaaguacagccuggccccugucaaccagaaugcucgcccuggcauguggcacugcuguggcucuauuuuuccugaagguaaggucuccuucuuccgagagagcacagcgcgagcugcgugcugcuugugugucuuucucgcuguaggcaccacgacccccugcccccaggcccacaggagcgcuggcucugaugucaaagcugcuuggaggcugcaucgucaugacgguacuguuggggacagaccaggacuugcaaaaggagacguuuuagcagggugcugagaagcugcauuucacaagcauuucuucagaggaaagguagcugggguaacuccaaagucagggaaaaagagcuucgccgcaaaugucggaaagggugaugcugccuuggguuaggaaguagguggcggggagcgcaagccuguggcugucaccaucuccccuuuaggcagagccucucagcaaaaggggccccaucccaggcaaugccaugagcucuugggagagcgugccagggcucugacccucaccgugcaggcuggccugaggcacugggcuggaaaagcccuaaugaccccauccugccucuacgcuucauccucaguggcagccccugaauggggccugcgcccacugggucucacauguggucaccacccaggaagaguccccaguuuccuguagcgaccucaggugacagacaugagguccuccugagaaguaacagcuucucacaucuagacaaaagcuuccuggcguucccuuuccuucccuuuucaguuaugccgccacgcaggugcaggcuggcuugggugugguuuguggcggaauagcgggacgcgcagacuucuucugguuuaguccccacauucuuccacugugagcaugagcaagggaaacgcuaaauagaugcuacaaaaucuacagugagccacugaguuuauucagaagguuacguucucagccuuuauuccagggcccaauuuucaagacaagccuucgcgggacaggaggaguccucugaagauagcagugcaugagcagagaaacacacauggcuuggucucgccgcccagcagcugauuccgaggaggggcugagaggggccaauuucacccuucccuagcaagacucggaggagguucuuccuacacaagaagcccaucugaccaccagggcuuccuggcagagaguggugcuagaugucagccaggaacuccccagaccagguauucuuccaggcucaggcauaaagaaccaggaggcuuuuauuuucuauuaaucaaccuaguuggaagcagagccauuguaaaggcagagagguauugauuacaggauuaaagaaggaaaacgcugcuuauacaaugugcuguucagcagaagccuccccuggauacuugaauaaaauccucgguaagggucgccugcagucacugggcacuuucuauuguacuagcucccauacagcaacauuucuagcagcagaaaagcaggaaaaccacucuccagggagagguuccugcccuguccuggccccaaauuaccuggcaccaggcuaucacacuccaccaauacuucgcuggccuggguuuucagggguggcacgaugaugguucggggguuccccgugcagugauucuccaggcuccccuuggugucaaaggcauuggcauuguugugcccagcacgcugcugcacggaguaggggcugguguugcuggaggagucggaguagggggagucguggacugugacacagcugaugacguuuuuucuuugcuuggagacagugcugaaaaugcaaagggagaagucagaggugggagaaggccgugaggugagacacccaacuagcacuucaugcccuggggcaggggagggaggcagaggggagagggcaggaacagggcuuuugcccucccuaacccccauagggagacugggcaugcaaaaguccccuguguagccggcagcagggggacaugugaagacauggagaaggggcuggugcuggacccacaggggcuucuggaaacuagggagugagaugcuuccgggcuggccugggcucuuccugugcagcagagcucagcagagcugcaggggaggcaccugcagcccagagcuggguacaacccccgugggccugccagaaugggacaucugagcaaggagagaaccagcaagaacccagcaaccuggggaccuggguuaggaguaaaccucgcugggagaagaaugucauaagcuuagguuuggugccugcggccuggcaaagcuuaugcaggagggagcagaauguccaaugggaugcagcgugaggcucugagggggcugcaugcacacagcacagugcagacaugcugcagagaacgcagagcuagaguugacacccucugccucuccuuacuuugagugugcucugugggcugugugcaggccacuacgaccucugcaguccccuuuucaggagccaggcucaccugcagcuuuuccacugccugggccaagggaucgggggagaugguauugcaccggggccuggugggaaggccccugccagguugaugcugugugaaagccacucugaagcccuggccuucaucuuauauguggaacuucauacaauagggaggcacuggcuuuggauagcucuuggccggcauguuuguucagagauauuuaaguuagugugguuacuuugggaacuacuucuguuugucuucaaacucagugagaggcugcuggcaugauggaugugaaauuuauuguuuauugugugcuuauuuaagacuuuaaaaugaaugugcaucuauuuuuauauauugaucauuuauuuuuaagaaauaaaaauugccuaggcaacuggucaguuuccagcuaauuggaugagagaagcagcugguauuuacggagccucauagagucacagccaccucccggguaucuuguuugaggccacacagccaggccaggcucuucccaugauggaucuccaccacccuagaggcagcagggaagugggcaaauuccagagcccacagcagccaggcaggagggacagaagcagagccugucugcugagcuacagaaggcugggggaucuggggggugcaguccccaggaggcgcuggcccugcuccccaacgcccagcgcuccugacaucuaggcuggauaauucuuccaguggcuggacacuguccucucugguucagggugccuaaccguguucgugggugagaacacgaaccuuggagucagcugucuaacuucggcaugugcuggugacagggcggugggcagcuauuuaaccucucagugauucaguggccucaucaguaaaagguagguaauaauuguaccuauaucauaggcuuguuuugagaacuaagugagaaaauacaagugcuuucaaugauacacaacacaugguaaguauuccauaauagcugcuauucuucuucuucuuacaaguuguguuaccuuaguuaacaugugaaaacagguuugcaaaaaacuuauuuaggcaaagagaauucuaucaggguaaggacuugcuggaaaaguuuccuuuuuucuaguuuaugaauaaaccagaagauugaaaucaaagaaaauuaaaacucaugauaucucggagaucuacgcgggguacuacagggaauaccuauacaaagaaauaugugucucugcccucgaggagauuaaaaucucaguggaggacuguauaacaacaugacaaguuaaauaguaaaagcuuuaaaauaaccaguuagagagaauaauggaugucacaaagccuccgugauuaacugucagaugaaucguacagaugauaauuguuaagaacucagaagaaggugaggaaugaauugguugcauauauuuauggcucuucauguuaacuuaaaguagauaaauuuuaauuaauaaagacccacaccucccaguuaugacaguuuaaaugugaaauguccauaugcuuguuccucaaaaagcuaaacacagaguuacccuauagcaauuccauuccuaaguacauucucaaaggauuggaaacagguacucagauacauguaagccaauguucacugcagcacuauucaaaauaccaagagguagaaacgacccgaguguccaucagcuggugaaugaauagaaaauaugguguauccauacaguggaauacuauucagucaugaaaaugaaugaaugcugggagggguggcucaugccuguaaucucggugcuuugggaggcugaggugggaggauugcuugaggcuggggguucaagaccagccugggcaacacaguaagagccaaucucuacaaacaauuaaaaaaauaagcaaaguaugguggugcaugccuguagucccagcuguuugggaggcugaggugggagcccaggaguuugaggcugcagugagcuaugaucacaccacugcacuccagccugggugucagagugaaacccugucuccaaaaaaaaaaaguucugauacaugcuacaauauggaugaaccucgaaaauauuaaaugaaauaaaccagacacaaaaggacaaauaguuuguuugagucuacauauaugaaauaucuagaacaggcaaauucauacagacagaaaauacauuagagguuaccagagguugggggcuaggggagaggagagugggaaguuacugauuaaugguauaguuuuugguugggguaguggaaaaguucugaaaauagauaacggugauggcuauacagcauuaugaauauaauuaaugucacugaauuuacacuuaaaaaugguugaaauggcaaauuuuauauuuuaccacaauuaaaaauuaacagacuaaaaccacugaauuguacacauucaacgggugaacuauacaguacaguacaugaauucuaucuccaucaaaaacaaaguccaggcugggugagguggcucauaccuguaaucccagcacuuugggaggccgagguggguggaucaccugaggucacaaguuugagaucagccugaccaacauggugaaaauccgucucuacuaaaaauaccaaaaauuagccgggaguggugguggggccugcaaucccagcuacucagagccugaggcaguagaaucgcuugaacccaggagguggaguuugcagugagccaagauugcaccauuguacuccagccugggcgacagagcaagacugugucucaaaaaaaaaaaaaaaaaaaaaaaaagcaaaagagauucagagucuugggcacuucgccgcuguacaucagggcucaguagagacacccagagggugggagggcacugagauccaguacaagaauuacaaaguggaagcuaggugcgguagcucaccccuguaaucccagcgcuugaggccagaaguuugagagcagccugggcaacacagugagaucccaccucuacaaaaauaaaaacauuagcuaggcaugguggugugcaccuauaguccuagcugcucgggagacugaggcaggaagauggcuugagcccaggaguuugaggcugcagugagcuguggucgugucacugcacuccagugugggugacaaagagaccuacacucuaaagaaaauaaauaaauaaauaaaaauaguuagguacgguggcugacaccuguaauuagcacuuggggaggucaaggcaggcagaucauuugaggcuaggaguuuaagaccagccuggccaacaugaugaaaccuugucucuacuaaaaauaagaaaucugcugggugcaguggcucacaccuguaaucccagaacuuugggaggccgaggugggcggaucacuugaggucaggaguucgacaccagccuggccaacauugcaaaaccccgucucuacuaaaaauacaaaaauuagccaggcgugguggugugcaccuguaaucccagcuacuagggaggcugaggcaggagaaucacuugaacccgggagguggagguuacagugagcagagaucacaccaccacacucuagccugggugacagagugagacucugcccccacaccgcgcuggcccccugcugaaaaaaaaaaacaaaaaaacaaaaaacaauccugggugugguggcacaugacuguaauccuagcuucuugggaggcugaggugggagaauugcuugaacccaggaggugagguuguagugagcugagaucacaccacuacaauccagucggggugacacagccagacugucuuaaaaaaaaaaaaaaaagauugcugucuaccaauaacaacaaaaaagaauaucucgaaauauuuuauaaauauaaauuaagcaaaaaaaggaagugggacucuaggaggucucugagcuaggagguagggaggagggaucugaaagcagggagaugcuggaggcugaggacgaggagggagcaggagggaaggagagcugccuuaagaagacaagggcagagaaaccugcagcugucuucugggaugaaugcgggggaguaaagggaaacaacuggucugcugcagucucuuguguaauaagggaacuccucccaccucacacuguuucgaaguacucugagggccaggggaagagcugggagccaugacugggagcagcugcuggcucccgaggggaggugaggagauggcgcugcccugcccuucacucucagcuucgggcacagcuacuccugaaugaugaacaugccucuggucaucucaugaaacgcagacauguucuguugcaggugcccauucuguggguggaggaccccaggugaggauggaggcugacucccaaauguguccugggagcuggcacugcaguccuagcucugcuguuccuuuacugguguggcucuggacaguggccuggauaaccuguaacauccauccagcuccaaucugcucugaaauucauugagagagauuacucauggcauuaaaggagccauuaugaggaucucugaaagauuccuagagacauucuaaaauaggaauggucuagcccuaaucuggagaggaaagagauccuuuuagcagauguaccuuaccuauagacccagaucuggccaguucuugcugaucauaucuuccuuaggaucugaguaguuuagaaaaugagcauuuaaaaaaaaaaaaaacaacaaaaagacaaaaacacacacuaauuuuggcaaaacuguaaucugcccucgaguaaaauucaaauugggcauauuuggagcucuucacucaaauguggaaauuguggagaagcuucagcuuaauaugaauaagaauuuucuaacaacuagaacuaucucaagacacaacagccacuucaugagucacugagcuucuugucacugaagaauggcuuucuggcaugagucuugugagagcugacagcuuggcgugggugaccugugagaacugagggccaucuccuugauggaaacccaacagguagugagccucccacugaagagacugaagaaucugcaugucagugucuaauuaucuacaaggagugugggauaaaaccuuuauaaacucuucccaggucccaucccuuuguuguagcuggggagccccuggcuuaaugagcaaauauguacggcacagcuugaugcugauuugccuaccuuuuuggauuuacaagugacacauuuauuugcagaaggugaauucauuugcuagcuguuuuucaucucuuccauuguuagaaagcucugcgcucuaccugaacacacuaugcagauuagagaacuaaugggaagcuguuaaaugagucacuuuagaaaugagcacacauuucagaugacuacggcagauucuuuaggcucguaucuaucgauacuacugggauucauuccaugauugcgucuaguuauuauugacagcuuaucaaucccauuaugaguugguuaaugcaagugagagagauagcgauaggggcagagugagaaauauuugcugaaauggccuuggaagaacaucacuucugaauaaagaacaaagcugucagaguucacaauugcauuauguugucauggcaauagauaauuuucaucauuucaaaaugaugaaaauaaauaaggagcuaaaaaguaaagaaaucccuaaaggagaaagcacuggcagaagaucagauauaaccugugaccccuucccuguagggucuuaucuggaaugugucucugauuucuauuugcuaaucugagucaauuucauccuucaagaccagggucaaaacucaucuccuccaauaacuucuuuuacccuucugauuucauagucaaugcuauguguucuauuacuaugaugcugauuauuaaguacagguaacauuuauuggaugcauacuaacuacagcuuaaagugcuuuauauguuuaucuccuuuaaucaucauggcaagaugaugugguaaagaauaugacuacuuuuggcugggcacaguggcucacgcugguaauuccagugugccuccagaccaguaugcuccuuccugauagcugcugacuuagagucauuagagagaaaaaaaaaaucuucauuuuaauauggcacauacauuccauucaaauuauuauuauuauuuuuagagacagggucucacucugucauccagacugcaguaucguguuaugagcauagcucauugcagccucgaacuccugggcggaagcaauccucccaucucagcuucccaaguagcugggacuacaggcacguaccacugugccuggggaauuuaaaaaaauuuuuuguagagacagggucuugcuauauugcccagguuggucucaaacucuuggccucaagugauccuggcaccuuggccuccccaagugcugggauuccaggugugagccaccaugccuggcuccuccuuucaaauuguauuaucugcauauuuaugucuaugucuaugucuacacguguguguauauaaauacacauauaucacccuuaagaucauuuuuacaugacuacuuucuagagaaaucagaaacagggucgcagaaguagccaugaguagucaccucguccuugucccaucagaugcagcggaaggaaguguuugcucuccuuccaucuucuucugaaguccagucucucucuucccaacuggccugggaguuuugacucaucuuuccucaucaccuucagucuauccacugagcaccgcucugcccuaugguauccaacccucugccaccccucuuccuccuucuucccuguggaaagcaaggagcaaaccaggaagcuguggcauaucagugacagcuuuguaaugugacagcagcuggggacaguagggugaagugucucuucuucaaaauacaccccugagccacucuacucagcccacuggagugucuuaaauggagcccuguaaagaggguguggcgaagucagcuggacaaaagauccuaccaucaccucuugagaugagucacaugacugaaauauuuuucaacuggggauguauuguacucaaaauggagagacaccaaaguuccuucaaauggcacugugugucuggguuccuuuguuccuucacucaagccugauucccacgucuccaugagcauggcaggaggcuggcuguagcagcuucucaaccaauggcaggauggagcaagcuacaugguuauagguagcaauggaggcuaaucccacuuugggcuuuuugcccaugcaauaauaaaugagugugugugguuuuugcucccucuguuaaguggauguuaauuuuucaggccaaaguaauuugagcugcaguuuaucaguuuucuaaccuugcuuuaucuauaaugauuucucuagacuuucaacuuaguauaaacaaggaaaacauuucgggucaaauuuuuuuuauauauaaacauguuaagagugagcuaaguaacuguuuuuauaucuaaaauacugaaugauauuuaugaaucaauuuucuuaaaguuuucauuuuugguaacgucggcugaaacaguggcugcuuacacaggcacagugaagugcagccugcaggagacacuugaugaccuaagcagaacaacccaccuaccagaaauauccagguaacugaaugagugaaugcgugaaugaauaauggagcuggacaaaaucauuucuauaugaucaguugaugugaaccacuuugguuuacacacuuaaaaaauuacucucggccaggcauggaggcucacaccuguaaucccagcacuuugggaggccaaggcaggagaacugcuugagccugggaguucaagaccagccugggcaacauagugagacacugucucuaguucuuacaaaaauaaaaaaagaaauuacccucaugacuaaagguuguaugcuacagccuuuacaagaccauuucaacacaagguaaagauagcaggggggucuggaucaggagacguggaucaagagaguccaggagagaaaagauggcuuguucaguauguguagacaauuaaaugcuuuucuaaucgaaauugucuauaaauauuuaaaagaagaccaguucuacuacuuaauccugggggacccagaacaauaucuguuugucuuaucuuuuggccaauucucuagccaugaccagaguccccuaguccaacaguaauucacugaaaaggaguucccuggcucuucccugcccuucuuacuuuaaaaagagcugacuccgcccuucucagugccauggcuccagcacucugacaaacgcccagcaccaagagggggcucaguggacaauacucuagacucccuauggcccuggcauggugaccugcacacaguggcauagugguagucacaggagggagcaggauagaaucuguauucauugaaugaaugacugaaaucaguuauuuuugccaguuauuaaguuugacauuucuucaagagcauggcaccugagucccaauucugcuauuuagaaccuguaucaauuugggugagucaccuaccuuuccugagccucaguuucuucaucuaucaaaugggaauagaaauaucagccuugcaugccccaucaaaugauggaggagcuagugcggguggaacacccagugcauguuugcuaugauucuccugucuuuagcucagugucucccagcaucugccuccaacaugcccuggaguucuuacgaguggagcugcuggccagccaucugcugugcaaccaacagugccacauacguggggucaggaauaaugauuuugcauuggcuuucuuuuaaaaauucuaggcuauaucaucuaguccuagagguuuagugacacccucaaucaggucuaaaagccccuuuggugguggaggcacugccaucccucugaaggucaucggcugccugacucuggcugccaagcugaggcugagccauguuaggggaauuaaccagcauuuuaggcaaaguuacaggacuggcacugggguaaguagcaaauagaaaacgaggcugggaacacagaaggugggaaucaacaugcccacagcauggagaaaucaggcucgagaacaaggaugaucaauguguaggagggaaggucuccaucgcuccagcugggacacagaagggcuggggaagcucuucagcuggagagggaccaggugaccccuccauguggcugcacuugggggugcauccuuguuuucccaggacugaugcuuccccuugagccccucaguaucuccugacaaagcugaccacccccauguaaggggagaucccuccccaacccccuuuccauccugaagccccuuuuggauaagcuccugcacaggggucuugauccuguucgcuugccuuggaggcucugccccaucaaucaccucacuugaauuugcaaccgcaccuccucuacuguguggaccuguccagaccuuuggccuucaaagccccccuccccugcuauucccuuaagcuauuuucccuuugaguucccaugguacuuugcucauuuuuaugggacugacacuguguuuuguguuauaaugauuuguauguguuucgucuuguuuauuacccugcaaaccucaugaggacacaaacugucuaccuuauuuauguaacaccugcaguucccagcauaauaucuuacacuaguggggccaauaaauacugacuguguuaaauuuuaugauaauucugacuucuaagaacaaguaaucauauuuccccacauuuuuuuuuucugaucccaaaauguagucacaauaaugugaucacaguuacacagugguuucucuauaaauaaaacagcuacugguuucuguuuuauccuacucagacucaaauacacuuuccuaccuucuugagugcaaagacauuuucuaaggcacuugccauuagaucucucuagaaaacauuauucugggagcucccagucacaacuguggacagcugaagccuuuuggaugacucccuagccucagucugcagcuucccuauucagccucauguguccggcacauuuucacgacccuggcaggcuggcaguccccgccacucuucacugcaggaugcugugggacucaguagccacugcuacugucugucuguggcugccccucaccugugcaccuggcucucucucccagguuucuuugaguuguucccaugaagguccucaucugcugcccagccucucgguucuaucauuucuuucugggggccuuaggggcugccgcagaggcacggacaugcucuggcuuugcguuccacucucagcccugucagcucucugacugguggagagacggcucucucauccuccuucucagacacgcuauucaauucucuccugggcacagauguugagagucugugucaacucagaucucauacguuaggaaugagauuccaaucuagcugauugucagauuuuaaauugcuuuugcuuuuuuccauuuguggcaaagggccgggcaaggcugcuggacccuucugaugaccaaggcuacccacguguggguggcugcucaaggccaggcuucagucuggggcugggcagggccguccccuuugugaagagacugcugagcccacgugaggacugaaccgacaguauuccugggugguggugugggggcacugcggagaauggaccauucacucaacuugaggcugucaucaaaaagggaccugaggccauuucuggacuaggcagauggggaguaaaaggcaguccugggcugccaaaguauucagugcuaugccuggaccuuugaccuggguccccucugacaccuggcacaaugcuacggccacaagugcuccacuacauucuucucugaaauacaaugacaauuaggcuguaccuaauuggugggaagaggacacuugaaugagacauguacuaaccccacccagaaacaaacuaaaaccacuggacuucauuauaaagagggaagggaacguccuaugcaggaauaguuauaaugagaauguuuucaucagucuaucuauacauuuuguaaugauuucaaaugugagaauuuauuaucuaaucaaaggauuugugauuacuaauuaguuacauugcauccaaucaggaauuaauaauucgagccuaauugugaauuaggcuucauauccagcugcaggaugcgugcugacuggcagcgcugggccugggaggggcaggccucccuucccuggcucucgguuccagugcaaaggagccagcaggguggggccaugagauuuugggcucuacaaggccacacucuagggaugcagaaggccaggaggccaacuguucuagagggguugcucagaaccugagcugaguggcccaaacaaaaaccacauuuugcugaagucuggcugggcaguacagaaaaagaggcucuggcgccaggguuaguaguuuuguaaauauaauaaagauuucuucccucuccccaggaagcacacaaagacuaaaaugaauuauuauuacuuugggauaaacaguaaugcucucugggugaagagccaacuggcaguuuugaaagauuagguuaaucagacacagggaaauuucugauuaauuggacaauuacuucguauucugagugagccaaggcaauguuagagaaauauccugaccaacugggaauaaauucacuagcuugaggcagagacuuuuaaacuuacagaggaugaaauacacuggcauugugugcccgauuuuuauggucucaaguuccccaaauguauagggccuauaauuaucuuuuaagaccaacaugauucgacauuauuuugguuuuaaacaauuauggaaaaccuguuugacauucccuugaaauaacuuuaggaccacaguagauggcaaaaccaaacuguaagggucagaagagagggauccuuauguuugaugauggaagauggucagaucugcacacaaugcaaacccucccggcuccuuccuggaaggcuaagguggcacugccucaccuggugggggcguguuucuguuccuccuccucguccgugucacugcugauggugaugacgcugaccguggggcugggagugucgggaaugacaauugucugccgcugccguucccggguggugcuggaggccacgucgccccacccacaggugaccgaggugcugcaggccgggcuacugugcaccauggcacagcggggagguguguucuccuugacacgcuuggaucgcuguggggagcugauggccugagaggaggacaccucacagguggagacauuucuguaaugagaaaaccacacucucacacagaggaaggucaggccccacaacuccuucgaaggagcccaauugccuagaaacaccugcuuugccaaaucucuguaaaacacgucaguggcugcccaaugagccuccaucugugacugggaaagggaucauucagugagcggcuacacaggccuucucugggcucugguuuggaucuacaugccugcucccagcaggacaaagggagcagccagggcuuucggagcagggagggggcucuugugccccaggcucuacaggucuuguaggagcagaugucaugccaggauuccagcuguguuugccccaacacacccccucgccuucagggucaaggcccuacuucugagcucugucuugugucaucccuucaaagguacuuaagucuuguuuugggggugguggaagaauugguguuugccacaucaagcuuugguuuccuugcuaaugguuauucuacugaaacauucauuccuuaagaguuucaggaucuaaaggaccuaaccuuggugaccagugguucaguuuuccuucuuuccuccucuggaaaaagaacaugaccaucaaaguauuugugugcauauaauugcuaaaaaccuuaaaaaugauuuuucuggauuuugccucguggagccucaugggaggcgcauuagucuaaauuguaauagaaaauuuggaaaagugcaagaguuuugaaaaagcacucuuaaaaagagaacuuuuaaucuuaauuuugaucaacuugaaauuccuuacuaaauuaaccagugugauuuuugguaacuuuaggggaaaaauacuuucuccccucccuauuagauccucacugacucuggcacagggugaacaucuuuuaccugaaaugcuugguccagaaguguuucggauuuuuguuuucagauuuuggaauauuugcauauacauaaugagauauauuggggaugaaacccaagucuaaacacaaaauucuuuuguuucauauacaccuuauacacauagccugaggucauuuuauacauuauuuuauaauaauuuucuggaugaaacaaaguuuugacugagaccacaugucagguguggaauuuuccacuuacggcaucaugucaauccucaaaaaguuccgaauuugggacaauuuuggaguucuggauuagggaugcucaaccuguaguaucuaugcagugagagacuaacagcaauguauaaugaaacucagacuuuuauaugucuuuagagauucuagcaccuucuagcuaaagggauggcaguaaaaugaaaauaauucaauaaagguggauuuauuuuccuaucuagcuagugccagauacauugcuugcuccuucuagggacugguaauauguuucacugauaugauuguaccauuguuuguacuuacuauaaaccuauguauuugucguugcuaauacauuacaauuuuaagauuauguuuuucacuaccaaugguuuuaguaucuccacuuggcauuguuaaggaaaaguaugccuggccacaucaccaacaagggagagacuucuggucuuucagacuguuuugcuaaggcauuggucuuaaaaauaagcaaauacauaccuuucacuauaauuauaucgaucuugaaauguacuggcaaugaggcuucaugaagucagcuggguggugaguaaacaaaaaggagggacuugcuaaacagguugggaggcuaaggguucuuacugccccuacucagccaaggugaaccacaaagaugcuaagcucaguccugggacagaguagugcuccaugugaccuugcugggcaugacagcccaugaggauugagacaguggacuuuguugccacccagucuaauaaugacaugggugagcugucacaaggcugccaaacaaaagcguucuggaaagcugccaaugaucugagauaaauuucccugaguugucagaaauacccaaauaaggaaucuuggaggaugacaacuucagcccuuggaugaauuuuugaauaagaaugaaaagaaaaaggccuaguuucugguaucugcuuauaugaggaagcagaaaaccaaaaucacuagacauuuuguauaccagauuucucuugauugacuuaucgcaaauaagcaauuaagcaccucaaagcugugccauuaggaagagaugcaggagcaauccuguagucacacgaucucucucucucucucuggcuuggaaaucuccauuuuuuaaaaagucagguuuauuaagguauaacugacauauagcaacauuucucccuuugaaguguuugaugaguuuugacaaaugcacagucauaacccccccuacaauccagacuuagagcuuuuccccucaggauucuucgcagucaaucuccuccucuccuacuggucucuggcaagcccuaaucggaucucugucucuauguuuugccuuuuccgaaaugccauauagauggaaucauacagcaugcagccuuuuguugaccuugauuuuuucaaaguguucauugagaugagaauggauuuaaagggaaugggaaagauuuguguucugcugguuagugucugggauuaaacaagcuauugcuucuauuuaagcaaggugcuaaaucaguuaaacuucugaucuuagauacaaagaaagcacauuucuuuaguauuuuuuaaaacauuuuuaaacaacuucaacauuuuaaaauauuuuaaaacaauuauuaugguaaauuguuuccaaaaugaaacuucaggugaagcugaguguucuccagacaaguagaaagugacaaaagauaauuugcuucaccaaacuuuagucaggcuugugaaccuucuccuaggucuaacugugcacucugcuguacaaucuacuuuuggcaaaaaaccuugcuaagucaguuuagcaagaacccaccaucccugauaucugaucacccucgauaucugaugagguuccucauccuccaggugugauaucugaucacccgggccugucauuagcaagaauccuguuaggucaguuuaggcagaaucucccuuaccccugaugcuuccucuuaguaacuucccauccaccgacaccccccaacccugccuuggcuauaaauuuucacucgcccacgcuguauggaguugagcccaaucucucuugcccacugcaagauuccauugcauccaucccuacacuauuaccacggucuuaaaccaagugcuuccugcaaacccuaggccaaaccaggugguacaggauguuuugcuagucacugcaggaagaggagugcccccaucccaugcaacugucccauguucagagugggugcugauacucccuaaacuacauuucuuuagcacucacauccccugggauuucucuucccuaggguggcucucaccaccuaccucacagaugacuggugcugcuuacucuuccgggaggagguggugcugguuggcugcugccgcaucacgugggccacacccacauuuaagggcugugcugcuggaagggucacaugaccggucaauagugcaggcugcugcaugaugggauuauaauggcuuccgugagcaugcguauuucugaaaggcaaccgggacaacaaggugccuuagagguguucuaaaaguagagcuccucuauaagaucaagcuuccuccccaauuaaacgcugacugcaguugguuaucucacuagcugugcagcugcugaagggaugagccuggccaugugugcucaacggguggguuucuucuacucauaaggaguaggugaaacauaacuggcugugagugagaaagaggacuuucaagugggaagaaugccaaguacaccggcuccaaguuuuuaaguucuagggacuggagauaaauauucccuccaacuuuuaaagucccugagcaccuagguguuuauccugaacaauauucuauuuuagaauuuacaggccagguaugguggcucacaccuguaaucccagcacucugggagaccgaggagggcagacggcuugagcucaagaguuugagaccagccugggcaacauggcaaaacccccuuucuaccagaaauacaaaaaauuagcugggcaugguggggugcaccuaugggcccagcuacucgggaggcugagguggcaggaucacuuaagccugggaggcagagguugcaugagccgagauugugccacugcacuccagccugggugacagagcgagacacugucucaaaaaaaaaaaaaaaguuucaccuuaauuuuauaaaaaaaauuuuuaaaugaagaaaaagcggaauuuacacagugucuucaauggguuauuuuauuccacucugugacguaggcaggauaucuuagcaauaccauuuuauuaaagaagaaauuauacuuuacgugaaaaacaaacuuugaagccugggagccauaugcuucugguguuaggaaguguuaauguucuuuugaauucccucaguggcuggaacaaugcucaggcauauagcagcugaucaauuaauuacacgcuugcugaaugaauaauuagauuaacugaagguugacuagacaaguauaaaguugguauuaaaucaaaauuaauaacagucaugauagaaauacuggcagcccucauccuaaaaacggguuauguuucacaauucuuauaauuuggguuguaugaagcuuaaagccuuguuuucccacagaaauguuaaagguggugacugacucagagauuggcccauaagagcucauuuaacacauaauaaaauucaaagcuaaaggauaauucauuugaauuuuagaaaauuauaagaaccuauuguugcaacauggggaaaaggaugaacaggaaaaaagaaguagaugaacacuuuuguagggauuuugauagcgccuuuugggcauuuacauggacuuuagaaacucauauuauggcuucuuuuuuuuuuuuuuuuuuuuugagauggagucucagucuguugcccaggcuggagugcaguggugcgaucucggcucacugcaaccucugccuccuggguucaagcgauucuccugccucagccucccgaguagcugggauuacaggcgugcacugccacgcccagcuaauuuuuguauuuuuaguagaggcgggguuucgccaugcugaccaggcuggucucaaacuccugaccucaggugaucugccugccuuggcuucccaaagugcugggauuacagacgugagccacugcauccgaccaagaaacugauauuauggcuucuuuauuuuguuguagcucuuucuccuguagacagguggcacucuuucucuuuugagucaggccuagcacugguacuucuguuuguuagccacaauaauagauguucuuuggcucacacaugaaauggagagagaccaggaagagaguaugcuggcuuuagaugucuccuguggucacuagguaagagaugucaaaacgaaaggaaggagggaggaggaauaagaaaauauguaggaauuaguaaguguauguguauuucugaaauuagaugagcuauaaaugcugaaagacaaaagggaaaaaaaggaauaugucauguguguggucuuuuaggagaaaaaggggcgagggaaaaaaaaaaacccaguuggucagacagcuuuccacucggcugcuccuaaggagcuggaggaggaaaggcaaucuugcugagcaugggccgaugugauaguggggagggaagaugacagguuuauuuaaugccugucauguaccgggcacugcgauggugcauguuaaauauaggccaagugcuuuguauuuuaucuuacuuuaaaccucccaacaauccugugaagcaggcauuacuauccccacuuuauugaagaagaaacugaggugcauaaagguuaacuugccccaggucaugcagagccaggauugaacucagcucuacaugguuugagauggagucucacucuguugcccaggcuggagugguggcaugagggcguugccagaagggaagugagugggacuguggggaagggcccagguacucuguacugggcagaaaaugaacuggaggaauggaggaagcugcaguaggggucugacugggggcuuauaucaccaccuuucuucuuuucucggagagaucuuaauucacaauagccuuguaggucagaauaagaacugugggagguucccugugugauauggaggcugucaggggguugaggggagugaccuguccugauauucgugcagaaugagagauagcccaauagggccaugaggaguuggggacaacuuggaggguugccaucuggcucugcacuggugaaggggccauuguggugguguucgggggaagguacaaggguaucuagccauaaaaauaacagaggagcgcaucugugaggaaaucaugaguugggcaggguagaguucuggaaacagaugcaggggguaugcugugcuggcaggcagucagguggacgccucuggggugugugggaaguagacucugaucuguaagauaugacuauuaacugaagaggcacacucagcaaacaugccagcauuuacccuuccaaauaaaccccauucugucaagccaucccgugggaggucagauagacuccagaguacccccgucucaaacaucuucagaacacuuucuagaauugcuuagggcuuuggggacccucuucugcauucuuucacuggugacagaccuuuguuuucugaacguagaauuuaauucugagaaacuaccaaacaucauccagaaccaagucuggugaauuacacugaugaguaaaugacauaacugaauucuggguggaaaugacaaccaagcauaaauuaaugaaacugauuuucuuguauccugguauauuauuuaaaaauugcuucuuguuacccugcacucauaguccacacaauauuuuuagaagcuuuaaaaagcucucuacaaaccggggaauugaaguacaggccagccuggcagcccuguguuggcaguggacgugccucccaucccagacacacccacucacccuagagggguuuccugcuuaccuccaguccgccagcugcugggugccugccauggucucgggaaucacgguggcaugcugcacugauguguggguggccacuccagucaguugcugccaugcugggggaagcaggaucugcugggucccacuuggccaagccugcuguagaacacaggacaugugcaaugaccauguuugcuaaucacauaauugauuugcaugaacccacacuuauucugugccugggguugugcuagacauucucaugggugugagagugagggccuggucucuggccucaaaaacuaaaguaaggggagauaaacaaugaacauacaggccgggugcaguggcucacgccuguaauccuagcacuuugggaggcugaggagagcggaucacgaggucaggagauccagaccauccuggcuaacacagugaaaccccaucucuacuaaaaauacaaaaaauuagcugggcgugguagcgggcaccuguagucccagcuacuugggaggcuaaggcaggagaauggcaugaaccugggagguggagcuugaagaagugagccgagauggcgccacugcacuccagccugggcgacagagcgagacuccgucucaaaaaaaaaaaaaaaaaaaaaaaaaagaacauauaugaacuaaguagaagauaauuaaguacagggacacagcuguauggaagggauucauucauguugaagaaugauuucuuuauaaauuugcucuaaugagcaaugcuugaaguuucugaaaguuuauuuauuuacuuguucugucccacaacuauguacaggggauuaggguaguugaguugagcuagaugagggugaccgcuggcccucaagaagcuuucugccuaguauccuuuauuuaacauuuuaccuuugauuuaucaauuagaaucuagguuccagcuuguguuaucuucugaaucuaaguuuacacaauucuaagaucaccaaauaucuggaaccuacaucugagagcaagcaaguaugaaguaaaauucuuagcugugacuauagcuuaauugagaauuacuuugauuucucaaagcaaaaaugagagagaggcggaagucacugcuugaaccuaauuuuucuaagaaaucuaaaaugaacguuugugauucuuccuugauagauucacugguguguguguguguguguguguguguguauguuguguuuuaagcucuuuuaauccaugaucacuauucugcuugucuuuggucauuagaugauucagacugaauaccacugccuaaaguuggacacuuaaagcauagucacuaagguaaaauaccuuuuggacagaucaaauauuuaaagguuugauaucuuagccaucucucuuucuaucagaguggaugugacuaacauuggguaauuuaucgaaugcagugcuucacaaacugugcaugugcucaguguggguguuuuauagguacaaauacgcaauucuggaaauggauuacagauuugagucagggccuaaaaaacauugacgcuuauaaaaaugagagaaucacauuugagagcugaguggaccaguucaccuguuccguuauuuucauguugcaccugaggcccagugcaaucucuuagauguuuuugauacuguuuguuugcuuuugauauaggcagaagcucagggaccaugcgcauaccaugagugcuuaauaucuguugauaaaaugaaagaagcaacucuaccaacgcuauuaacuacaguuaauuguauuucagguuuacuuaacucacagaaagcggaaacauaauuuaauugauuaaaacaguugcaaauuccaaauauuaaauaaauaacaauuucguuugcaguaagguuucuacugacuuagccaauuggaacucauuucagagcucaugaaaagcauuaguuuuaacuaaugucauuuaaaaaauaaaucuugauaucaagcuaagguuaucauuuuucuucuauuucccugaaauggauauuaacauuuuaccucaaagagauaggguagaaagacuauuuuugacuuauuucacugauugauaugcuuggcucauuugugacaacgcuucaucagacauuuuuauaauuuauuacuacuaacaagaaugaagugaacauuucuuaauggauauugugugccaaacacagaguuaagucauaaaugaguuucugacuacuucuuuuuucugacuucuuaauaccaguucugugagguagggacuguuauuuucuuccauuucuaagauuaauaaauugagacacagagagguuaauaauauuaauaacuugcccugaaauaugguaaauuaaacauauacauuuauugccuucuuuacacucaacuaaaaugauaguaaaggaauaaaaaauacagauucauaagggcaaagagaguaggagagaggcaaucaccaugaauaaaauuuuagaagcugaaaaacugauggacaauuacuaagugaauuaacagacugaaggaaucuaagaucaggucuucauuuccccuuaguucccagauccuugguguacaugcuuauaccacccuccacuccccgccccaaagcaggaggcuagacaauucucucuaggggaaaugacuaguccaagagaaaauaacuacagauaugacauuuaaggaucaggggaucugucagugaaaaugcuggacuugccucuuuucagucuauagagaagcccacauucaauagucucuccccuacccuccagguuuccaauuaguuuuuuagugcuuuagucuuaaauaggaaugaauagcuaaugaucaccagacaguaaaggaagccucuaaccugaaagagaauaaaauaagcaaacaaaagaaagaggaaacaaaaacagugugggaaucagaagaaaauuuucuaaaaucuauaauuaaugccuuuacagaguuaaaaaauauauccaugaaacaagaucauauaaagaaucaauaucuauauucagagaacaugcucuuuuuugguauggagggagcagagaacaaacucuuggaaaugagaacuacaacaacagaaauuaaccauucaaaaggagguuucaaaaaaguuuaagaaaucucuuagaaaguagugcagacagaggauauauaggaaauagaggggaaaaaaagauaagaaaaucggaagaucaauuuagaaguaccaacacucaauuaauaagaauucugcaaaggagaaacagagaaaauggaggggaagaaauuaucaaaggaaaaaaaaaauccagauuaaaagggcaaauaggguguucaggacaauguaagaaaaaagacccaaaagaaggcauguagucaugaaaugugaguccacuguggaugaggagaaagucgcuuucagagaaagaaaaaacaacauacugagaucagugugcucaaacacaucaacacaucaaacauacaaaccuuuuauagcucuggaaggguuuggggcuguauaaugagauauacagaaaacuaacccaaugggaaaaaugaggcaaucauuaacuccaggaaaaacaaaaagauguguuagaaagaaaacauaaucacaguauauuauaaggcucaacuaagaauaauauuauauaauauugauaauuauguaaauauuacaaaguaguugaaucaaaauuaugugggaggaauaggagaaaagagugagugaaaggaggaacaggagagaaauuguguguguuauggggauggcaguggguuagaaagcuaaaucuucaucuuccauaauaggaagucaauggauaauaccuaaaauggaaaaaaaaauccauaaaaagcagucuaagcauauuauuuagaaacacagaguuaaagaacagauuaaacaguuaaguuaaaaauuaucguuauggccagggcacaguggcucacaccuguaaucccagcacuuugggaggccaaggcggguggaucacuugaugccaggaguuugagaccagccuggccaacacauugaaaccuagucucuacuaaaaauacaaaaaaaaauuagccggggcgugguggcacaugccuguaaucccagcuacucgggaggcugaggcacgagaauugcuugaacccaggaggcggagguuacagugagcugagauugcaccacugcacuccagccugguggcagagcaaggcuaugucucaaaaaaauacguguguguguguguguguguguguguguguguguauaaauaaaaacuuuuagggauaauauauauuauauauauaaaauauauauauaacagggauaauauauauguguauauauauacauauauacauauauaauguaacuauauauauuguuauggggaggagacauuaaggaugggauagagcagaggacuauaauuuuccuauaaguuuaugguauuaauuaacuuuuaaaaauuauguacauguauuacuuugaaaaggaauuaaauuuaaauuucaaaaauaacuuccccaaagccauauagccaguaaguggugaggcagccaucugaaugugggcaaccuaauuccagugcccaugcuuucagccaauauacaccucuccuuguguugauaauacacaaaaauaauggccccuauucaggaucaggcauuggugguaacugcauaaagguggcaugaacaagucuuccuuauucucuaagaauaucaggugccagucaagagacaggcagacagcaggacaaugguuggaaagacugguugcugaaaauguuaucagaggaacuuuugagugagaaacauuaaaauuuuguauuucgaacaguuuaaaggguucaagccaacaguuuguuuucagggaaacauuuaaaggcucaguuggucaaauaugagcccaagaaauaaaguaaauaaguaaaaaauaaagagguucaggugauaugauuugauuggcuagaagaacacaaaacacuucauggaaggguggagucuacagugauuucucuaacccugcuagucaaaggagauuuuagauccugacauuugacaagucagauaaauucaauacugucucaaucaagaacugugcuucccaucucuccacuauuaccuacucauucacaauuucuguugguggccaagaugcuagcuguggcauggggcuugggaggauggaguugacagcuccuuuuaggcaguaccaaaaaagcuuuuguugcaaggugauccacaaagaucacucccauaucacuaacauaagcagaaugauuaccauuuccaccugccaugcacacauccucugggugccccacagaggccuguuucccugaaaguuuuaugugaugcugcugggagguggggaggaaaagggcaaagaaaaugaaauuaacaugaggaguggauucaaagacuccaucucuaaguguucauaaguaaaauccuuuaaaagauuuucaguauuuagagaaaaagaacaaugucaacuuuuugaauacauuuaugucaaauaauaggauuuggaaugccucugccuggugccuagaaauuuaacuguagaaaaacgaagccuucaguuuaaaugcuuaauugugcuuuuuuauagccaccauaagaguuuuauaaauuaacuuauuuuuguccuuugaagggaauguuuaaaaauaucuaggagagagcccaucucaacaggcuaacauauuggcauggauuaagugacaagcagagagaaaaauaaaaagcaacugacaaaaagacacaacacgauacuggauagggcaggauuuuuuucacuuaauauaucuuagaaaucucugcaugucaagacacaaaggucuaccauguucuuuuaauggcuacaugguguuccauuuuacgugugcaucaacuuauuuaaccaaucccuuacugacgaacauucaaguuucuuccaacaaucucaguuauaaacacaguagcaauuaaaauccuuacacacguauuuuuuguucacuuuccuaauuacagcuuuagguuaaaucuacuuggagauuuacaacacucuagggacucucuuucaaggaagcaaaagguaaaguucuccccugcuacgauuaaaggacugaaacaaauucugacugcugagucuacugguuccaccaaacugaacaacgaagaaucccuauuuuggcuaauaagaaaugcuaauuauuauuucuuucagagauggcuccuggcuuacuaggguuaagugugcaaacauaaaaaagaucuguaauuauccuuuaaaagcacacgugaguucuguagauuugggcucacaaaggcggagcacugggagacugguguggauuuuugccacucagauaaaguaugaagaagcuuuuuugccccuggacugagcuguaguucuuucucugaucuaucuuggccuuuucugaacuccccgcuacugaacuaugcaaauaaaaggaagcuacaaggacccauuggagagagaggaacgaagagaaggccuguuuuaaauacaaaaaguucucuguuuacaaacuuucaauaagacaaaacuuugugugcuaccagucacugguguuaguggucaacugcacagugucauucuggaccuaagcacagagaugaagaauacuucauaucgaucuuaaacaaacuguuccggaaaacagaauagauaauaauguaaccacagcagucugguucaacuuuuauguaacaaaguugugaguuguuuuucauuugccauggauccacagguuaaaggucacauaaccugagcaugcccagaugaaccagguauguaacaacaggcagaaccuaagugccuggauugaggcgagugaauggaauuuagaaauggauaccacauggcaggauccaggauccaaucagaucgagcuguggcaucacugcauggcaggauccagucagaucaugccucugauaucaauucguugcaagauccaaucagaucaugccucauuacccuaugcuuauaaaaccugacccagcccuuugcucagagacacugcuuugggaacuaucuccaguguucuccuuacuuguuacaaguaauacaauccccuugcuaaauccuugucuguggucauuggguugguaccugucaagugaccaaacccacucguguggguaacaacaagaagaagauauuuuaugagccugguguaaccuuguacucaaaucagauaaggauuuuauaaaaagggaaauuauaugccauuuuucaccuaugaacauagauauaaaaauacuaacuauaguacuuacaaacugaauccaauauuaaaaagcauaucauaucaagcacaugagcaaauggaguuuauaucauaaauaaaaggguaguuuaauauuacaaaauauauuaauauaacuugucccauuaguagauuaaggaacaaaaagcauaugagugucuuaauagauacagaaagaacauuugauauaauucaauauucauuacaaaacuuaaacaugauaaaguguuucuauuaauuuuuuuuuuucuuuacagacagggucguacccuguugcccacccuggagugcaaugaugugaucauagcucacugcagcuucaaacuccugggcucaagugauccuuuugccucagccuccuguguaucugggacugcaggcaugugccaccaugcccagcuaauuuuuaauuuuuuuuuguagagauggggucucacuauguugcccaggcuggccuugaacuccugggcucaagugauccucucaucucagccuccugaguagcugagacuacaggccugggacuacaggugugcaccaccacacccauuacagaguguuauaccauguucauggauaaaaaugacuuacacguuuaaagaugucaguuguuccugaaguaaauauaaauucaauguauauccaguaaauauaaagcagauuuuugguuucuguaacuaaaauucuuaugaaagagugauguuaaaauucacuuaaaaacaugaagggacaagaacagacaaggaaaauuugaagaacucucugggaacagggcuucccuacuagauaccaagacagacuaaaguuacaaugguuaagacaacaggauauuagagaagccaauggaauagaagagcacagaacaaaccuacgcaauuugauuacauaaaaauuaaauuuuuaauuuuuuaaauuaaaaauuaaacaacaacaaaaacaacuuccauuuaacaagacaggacaaauagugucuuugggaaaagccuuugugaaccuaccuuauuuaaaaauaaagcugcuucuaaacuaauaacauuuaggucaagcuacucaauaguagaaaugauuauacagaaguaguauagcuuggugguugaaauacagaugcuggcaucagacuuacuggguguguguccugguucuguuaccuaauuguugugugacucugaugagcaaguuauucugcuucaguuucccuauuugucaaauggagacaaauacuguggcauuguggggauuaaaucaauuaacaacuguaaagugcccugguauaaugaugauguauuuguuaucaggguucgagugucauuaaggauuguuacuguuaucauugcaucacuacuguuaccuuacguuuacauaacacuuuacaaauuuucaaccauuuuucaucucugccaucucauucuaccaucagagcaccuacauggauacagagauagaagguuccagcuuacaguaaccaugagccugguuuuucaacuauaaaaugagaggauaaucaccaaggcuccuuuuggcucuaaaaacucauuucuauuuuacaagaaagaaauuugaggcaaagagauauuaacugacuugccuuaggucauagacaaguuacuagcaguuaggauuaaaaccuagguaucccagauuaauuugcauuucaaagauauaauaauaauaauuuccccagacucucccuguaucuaaauuucuucuuggaauuguaagcagauacuuaggaagguaauucacuuggggaccauuuagaauauuacagauacauuccaaugacuagaagcaccuaacucauuacuagggagagagggaguggagauauauaucuuuugugaacaacauuaacacagguaaugguaauaccaguaauaauaaaggagaaagaauuaccugggcaagcagaccugguuggaucugaagaggcugagcuccuggggcuugagugacgaugggaacugcauuuuccauucgcaccgaguagccagcgugcuuagagggagaggccugcaagccuguuccagacagugugagggagagaaggguuagcugagacgcugugaacagcuggaugaaaagaaccuuccugggcaguuaugucaacuuucugcuucccuuugcacuggucacugacaacaaccagguauugccugguccuuggaagucuccccuuuggcuucuaacaaauuaaaaaacaaaacuccuccugaaaucuugaaugucuucaaaggcuagaaggucagauuaaggaggcuguaaggccaaaaguaggacagauaugcucgcagauuacaacaggaaaacaagggcuucugaccaucaagauguaccuguguaugucaaaaugagggguguuggggagauguaugaacccauuuggaauugcauugacuguaaccacacaguuuacaccaugaggcuugcaaaaauaaauucuuaagcuuucuggguaaauuguaacaaaguacacagucuagcuucuuagagucuacaggagaggagugcuggggucauggccaaagaauuguuuugaggaggggucccagggaaguacuuuucagacugauggauauucuucaugggagcugggacuaugucggcugucagagauuggcaguuuucuacagauaacccacacagaggauauuucaugcgaggaaaagcaagagcugacaucagcauaacaaugaaagcacaaacuauguacuuauuuacagacagcuggccagggacacagucccuggcaggugugagagucacaaaggauugacuuggugcugaggcauaagcccuauuguuucuagguuggccacaguaggagaggagcccucuaguucagugauaccagcgcucucacuggaagaaaugaggagggccuuucuccaugaaaaugagcgugacagaaaacugcaggugccggagccccagaggccguucuguaagaagcaggugagaggcuguggcugcucaaucuuaccuuggaagccggggggacacacgaugagagcuugcuggaacgggucaggccgggcacaaaucugggcuguuccugucugcaggggcaugcuccgcugggccacugcagccauggaugccgcugagggcugguagaguguagauggguaguuuaguauggagacuucgggauuggcuaaggaaauaguggcacugguagaggagggagccuaaaggagugauggggauuaaacaaaaauaaacaaaaauaaaaaaugagggagguggcauguugggagacacgaaucuaaaucaaauaaaugaacucaaagaagaacaaacaaacaaaaacuaagagcagaaaggcaaaagcagagaggaguggaaacacgauugaaagucgcagggaaaagcaggucccugaaaacaugggagacagucaccuugguguucacauucagacuugcuccuggcauuugugaggcccagacaagaggacacacggaugccugcuaccaugucuaaaugcugaaaaggcuaaaaauuaggcuagaaaacuguuuaauaaaauguucugccuuuucauuuugacaaauacaccuucccaauaaccgggaagaccaggcgugaguugaggacuaugggauuccuuggguucugugcugacacauggugacagggagagagcuggaccuugcccuccuucucucugcccaagccccauuccaucccacaacaugaugagcucugggugccuggaccugccagccugcacguccaagcucugcucacacuccccucgggccuggugggugcaguccacaugugggaggacaaauccagggggaggcucuugcaggcccuaaaggacuauggucucaguacccagagcuuggcacaggagcacaugcaacaggcggagagcagggccgaggaggggcucaggacuaugggcaguacuguuuacagauguccuuagauggcugcaaagcuuagagaaguacaggagauguaugcagagagggagagggacauguugagccuggggcuuugugucugcaucccaugcauucauguugguaugcagugacaaagccuggcagauagaaaagaugcugguguguccagauaacugaaauggagguggcuuugacaaacacaagccauugacauuauguccucuugccuuucuuuuucagaaaaagacaucacuugagacugaacuugcaugaaaaaugaggcuguauaaggaaaauaaauuccaacuuuggaauucuccaguuuccccuaucuuagccuucauacugauccuuuagcaagauaggugguuaccagugguuucacauucagcacugucuacaagagguuuugccucuagaaguuacaaggaccagggaauacauaggaagaaaccacgaagauaucuuggacacaaauagaauuucaaguaggguguguauggaugucacauuugauaaaaaggacaaagucuuauuuuacauauguuuucuauacuuagauuuugugcuaaauuucauugcaaagcaaauugauuuguuugaaaauaaucacgaaauugaguggcacagaugucugauuuuaagccacauauuuuaaagugggugugcuuuugcagcgucgcauagucugcuugggacacguguguacauaugugggcaucagugucuguguuuugucagaugacaugacuuguauuuccuguuuucuccauaucgcgaucucuuccggaggcuucuucccccucaacccuccacauuccccauggucugcucauaucuagacuccccccagcccuuagccccugugggugucccugcuggggguccuggcaccuguauccucuagguucccaaacuucugcucggugguuccacuuucuugccagccacugcuccugcugcugcuuccuuccugaugucccuggaauccacugacucuuuucaguugugacuuccuggugccugggaccuauaaggcccugacuagaaauguucuggucucuacuucccuuccagccuucuugagcacagaggguagaucauucuuuccacaagacaccuuugugcaugucagcaccccugcuccaaaaucccaauuacagcuugaugaacaugguaugcgccuggucuagugcccuguuuucccugguuuggccaaccuuaccuucuagacuuaucucccucugcucuccacucuucugacaccaagauuaguuuacucauuguuuuccaagcauacugugagcacaggccuuucccuucauacaagcucucugacccauagcauucucuccaagccuuugggcuuuaaggccuagccugggucccacaugccccauugugaaacccuuucagacaccauuaauggaaaugaauugcuccuuccuuugcuaucacacaguacaauauagccuucuagcccagcuccuguuacaaucugccuuacaguacaguuggucuuuccagccuaaagucuccugggagggaggggcugugucuuagugguguuuuccuccagccugcaguggucucuccuuccucucgauucuguaacacauaaucuguuugucuaccuggccccuaguacaugcuauucugcauuuugauuaaacuauuuuugcuuacagccugucucaccauggagaccaugagcuccuugagaggcugaaucuuccagcucuguagacucaaggacaaauggcacuuguguccugauauggacccagucuccagugugaccaucagacaugcauaagguuuuccccuaguuucgaacccugcuuaaggaccaguugaagaagcccaugugagggcaacaaaaaguuuucuacuucuguauauccuccuuuagcucucagaaagguagcuagccuaucacuugccagagaggagcacacagagaacugggaagagcucuugcagcugacagauaguaauaacaagaaaaaacaaguuaaaaaaaaucagagacuggggucuugcuauguugcccaggcuggacuugaacuccugacucaagugguccucccacuucagccuuccaaauagcuaggauuacaggugugcaccacugugccuagugaaaaagcaaguuuauugaugacacagguuuuccaaaaauggaagaagugauuccuggaagcaguuguaguagacguucaaaugguuccagaaggaagggguuugagcuuggucuauaaacucaaauucaaauucuugguagaaggcuagguccaaauaauagaauuccacggaaauguuagagaaguugcugauccacaugauaaacaaggaauagcugagagaagacuuauuauucaacauguuaccaacuggguaaccugaaaguuuuagaaaguagaggaagucagcugccuugagacuuaacggguuaugaauuauugacccagcuuccuugagaccuaaaagauuguagauucaugaucauuugggaaaugguucuuugguuagucuacuggauauauguuaaagguagcaagagauucuuuaaguaguuuaauguccuucaacuucuaacauaaaacuaugcauauauuguauugcuucuaaauaucuaaaugggcaaacagcuccaaggagcucauguagaaagcuagcuacuagaaccagcaaugaacagaagaagucuuguuggauuuaaagagcagacaucaccuaggaaaggcauuuggggaccuccauaagacuuacuuaagacuuacuuaugcugcuguguauguauauuuuaagaguccagacucugaagccagauugcuggcugcaaagccuaagcccaccucucaugaacgagcaagggccuuggguaagagaauuaaucacucggugccucaguuuccuccucuaaaauggaaaugauaauaauaaaaccuaucucacaacguugcugggaggauuaagaguuaugguacgcuuaguaaagccuggcacauaauaaguguuagcuauuaguaaugauguuauuuaauaacaacaguaucaguggagggaaagcaugccuuagugcuuaaggcuagguguguccugaguaauuuuuuuuuccugauguauucaaaaguagggaguaguagaauccaaugcaagagaacagaaauccuguucuuggacccuuugcuuuugugggaugucauuuucccuuacccacgacucuggcccaagcaucacacuaaguuaccagcuacuccuacuucaccccagucccaagccagaucuggauggucucagugccguggagaagacggguguucuuauuugacaacugccuuuugaugagcaacccuuuuaguuuugcagagucuuugcgacacccuuuggaguggauaugcuggcugucauaucaccagcaagauggcgguggccccccaccccgcgucuggucagggaccacaguucuccagccuggcagaaagacauccaugggaaggacagccugcuggggagacuccacuugacaugacgccugcauuggaggggugcuccuuccuccuguuucacagaugccuuugauaccugauggggcagauguuagauggggacagguaguuugggguuagggaguuaagaccaggugccucaugagggcuggugggagaaacaaaugucuucaaggagguaaugaacaaaaccaugcugauuuuugucaagaagcucacaggucuggcuauggaugcuuuagccuuagggcugggcaagguuaguuuucggacucccaacagcucuuucacccuaaggagagcuucaagaaugcaaacggcccccagagggcagcagauaccagguggugucuccuagaauuugggcaaagggagauggcaggcugggaagaaaagcuaggccugagcaggccaaugugccacaaggauggccuaggggaaaagggugggaaggggagcggcugaaaagcagggggcagugacucuucagugacaggagggaccuuucaaaaagaauggacauaagguauucacauuucagguacacacacauccacacagaagucuuuucauuccagauugauauuaagaacaaaaaucugggggcccuucuuuaggggaacuaggaggauugaaagaugggaguaggaguuacaguuucuuagacacuagaggcagucucagcucagacuuggagauuauucauucaauaaauauugccugggugucauccaaguuucaagcaguauguuagcugcuccuucugccaauuuccuggaaaucugugggaagaaaaccuuagcuuccugaucccauuuaguuccagcugcugggauucuggugacaggcugaugaacugauuuucuccaugacucggagaaaggacaggguuuaucugucccaaaaggagaucagguagauccagccauguggggacgaggggaagggccugaacugggugauucccugaguccuucccaguucuagaaucuuuauuuuuuuuagauuaaauccauguuuccaugaucuuuuucuuuguuuuuugagacggggucucacucuguccccuaggcuggagugcaaugacauaaucauaguucacuguagcccugaaguccugggcucaagcacuucucucaccucugccuccugaguagcugagacuauaggcaugcaccaccauacccagcuaauuuuuuguauuuucuguagagauggcgucucacuguguugcccaggcuacucuugaacuuccuggcuuuaagugauccucccacccugaacucccaaagugcugggguuauaggcaugagccacugugccuggccaguucuagaauucuuuaccaggcacauaucaggcauaaaaggaucauagcacccccuucccccuauucccacaucaggacagaggaaagcaguaaggggaaccaucucagaaagaauggcccucaccaguccuuucugggaccugucaauggggccagaagucaacacaaaaugugccugggucccucaaaggaaauaaccuuggaugcaaauacuuuguuuaguuguugaacaugacagcaggaauuuugccuccugacuagguaugauggaaaauacaaguccugaggcucacacugugcagccccgccucuccuucccuucuguuucccacuuaccugguuguggacaguggucagcugguuguuaaaggucauggucagguugguggacgugcugggggccacgugcgugaugaaagggguuuugcucugguucaccgugucauacauauucacccgacgcuugcagaucuccauguucuggaaacaugauuugacgcuguucaugcaaaaggcagaggcauauugagacauaaggggaggggaagaggguaacgugggaugaaggggagaaaacaaaggaaaggagagaaggguuaauucaguaaacaggacaagcagggaaacuaaacuuuaggucuaaguuucuuggauugcuugugcaaagccugugcauuugcaacaggcacgguuauucagaugaauuuucuccagugcccuacuacccuuucuccauauagguucuauauaucacaacaaaacugacugcucacacugcauucucacaucagguccaccugcagcaucacugcucauucucaacucucagccugguuucuggcccacaaaccaauguauaagcucucugaaugggaacauuaacuagucacuuauaacccgccuccaccuuucccaaagacaacccuuguagucaccugcuucagcuacccugggucaccagcaccaccuaggggacggccaaggaacucuccaacccaguauggugacccuauugccacacuuucucccacagggguugugcagguagguaauggaaacaguaauaauacuaauaauuaauaauagugguuaacauuuauuaguguccuaauaauaauacucugcaaccucucacucgguccggcaacauccauaagacggagacaugauucucgucccuacuucacgaguaaggcugaagcuuagggagguagggaguuugccaaggauagguaaucacuggcuaccuucguguauacacauacguccucuuucaccaacuucagccuucauuuucuugucuaagucuuguccagcuacaugaaauagaaauuuucuccuuuucuucccccauugcaucuguguaucaaaacaaaaccccaacuacaaaaguaaaguauaaaaguggugcugaaaccagcaucagggaaaaggaaagccacaaguggcuucagccacccaaauucuugaaaaucgaccaaaaaguguccuucagaauuuauacagcgcuucucauucauuucuuguaguuaaacuuacuuuuccucaaaugcuaauauucaagauaauaaaaucccuuuuagucugggugggguggcucacgccuuaaucccagcacuuugggaggucaagguggguggaguccaagagcucaagaccagcuuggacaacauagggagauccuauucucuacaaaaaaaauauaaaaauuagcuggcugugguggcacgugcgcauggucccagcuacuuaggaggcugaggucggagaaucacuugagccugugaggucgaggcuacagugagucaugauuaggccucuauauuccagucugggugacagggugagacccugucucaggaaaaaaaaaaaaaaaaaaauuaaaagaaaaagaaaaaaaacucauuuaauuuucaacucaaaaugucuauuuuaauuauaaaaaauguaauaacugaaugaguaaaauaaaaguuuucuacuauuuuaggauuacaaacguguacuacuucaguacucuguggguaugcuaucuuuggggcuaagcaggugucugugggcuauucccaaacauccugugaaaaaugcauuccaaguuucaaaugacugacugagacgcgacuuagagaguccuacuucuuucuaagauucugaccacuuacacuggcugcgucaugcacacgacauaaccauuuacggacugaugaugcugaagagaaaagaaaacauauucugcgguauccaguagguaaaaauacuccuaauaaugcuguuaaugccaguguguuuucagcuccuacuaaguaccaaggucuugugcguggaggcugcagcauaaaaccaaugcauuuuauauucuuuuuggaaugggcuuaaagcauuugguuucgugacaauucaacacaaaauuuccauaccccuucagaauuuuccaacugaaauauuucaaguuuuggguuuuaggaaagggcaaguccuuucacuuuagguuuauaagaagauugguuuuuuaaaaauugugcacuggaauccugguauggagaaaggaguggggucuguuucaccuaguaauccaguagcuguggcucagcucccagggcaggggcgcuacagcugcaugggccuggagauuuauccuugcccuggaguucuucaagguuuucccagcaaguucuagagaacuuuagggaucaggccuacuuucaggcaagccuagguguguucagagacccaccuuuccuucuuaggcuaauuucugaguucugacuugucagugccccucuugggucccagaugaaguucugaauugguugcugaugcucacggucuccaugugaccaagccgugaaacacucuacugauucuuccuuacagaacccagagguggaaggacucugaggucauuaaagccccaggcuuuaugggggugacuaucugacuguuuuggugcagacggcuaagaggaccucuguagagggcaccccuauccucagucuccuauccguagcuguuucucagucaucccauuuuacccgugauaucaaaagacugaaaucaugggagcccuauccaguaaauugccaagucugcuuuucuucuucuugugguacagauggacagcucuguggcugaccccuauggcacucagaaacaggacaaauccaggccaggcacgguggcucacgccuguaaucccagcacuuugggaggccgaggcgggcagaucaccugaggucaggagcucgagaccagccuggccaacauggggaaacccugucucuauuaaaaauacaaaaauuagucggguguggugcgugugccugcaguuccagcuacucgggaggcugaggcaggagaaucgcuugaaccugggagguggaagcugcagugacgcagugagcaaagaucguacugcugcacuccaaccugugcaacagagugagacucuacuucaaaaaaaaaaaaaaaaaaaaagaaaaaaaggacaaaucccauaacaagaguaggggagggauggguccagauuccuuuguaccggaguucaguuguuucaagcaugguuuuacauuaaagaggcacuaucuguuuguugcaaugccauuugacuugcuucacugauaguaaggcacagaaaugaaauggaggccccacuauccaugguggugccacccacucacuuccuguaggccagaaaggggcggguccagccuugagacccagcccccucugacucuggagacagcagggcccgccaugauacgcacaauucucacaucuccaggcucuucucacaggauucccuuccccuccugauccuuauagaaucugcugcucucuugagcacaccccuuuucccugcagacguaggaugugauuauuuauucuuuuacaucccaaguaccucaggguugagaggcugaagugagacccuccauuaccuucccauccaccaacggcuuccuauuuuuuuuuuuuuuugacggagucucgcucugucgcccaggcuggagugcaguggcacuaucucagcucacugcaaccuccgccuccuggguucaagcgauucuugugcuucagccucccaaguagcugggauuacagaagugcggccaccacgcuuggcuaauuuuuguauuuuuaguagagaugggguuuuaccaugcuggccaggcuggucugagcuccugaccucagcugauccgcccuccuuggcuucccaaagugcugggauuacaggugugagccacugcaaccggccaugacuucguuuccucuccccuucguucacugaggccuuugccacuggcuggaccuuccucuccaagccauucccugccucgcuaggaaggcuucagaagucacaggucccuuuuuaaauacccuggcuucccgcuuacuucucauguccagugacucuuguucucaacccaguacagccacucauucccuggaccgucaaaccugaaauugcuccaccuccagaaacuacaaguuuaagcauccuguuuucccagccacauucuuccuccaucuggcucauuccacuaugacuaugauaacccuucucugcauugaccagaacaccacguuuacuuggauccccucccaucuucacuuccuuucccuuugggcaaagucuccaauagacaucauucuggauuacaguuacucucuggcuagccucaucagcuuccuugucaaucugucuucuucucuuaccagccuggcaaaaauuccaccuggacaaaccuagaucagaagacucaucugucuucucuaugccuucaccuggggagaugaguuacacuauaaacgauucaugucgaaccucagggcucaacaauuccaccguauuucucuggucaguuugcucugccaccuucugcuccagcuaccuaaacuuucuacccuucuuaaaccacccuccaccucguucucaacagauaaccucauugccuacuucugagaagcagaagcugucugacaggacucccucaacuuuucuccaugagaccagcacauacgcugacauccacaugccccucguccaucuauccuuccaaugacacuggcccaucccugugcucugaacccugucuuaaaaacaauccccuugaccccuccccagucaccccucuauuucuucucuugcauagccucacuucaugaaagguugcuauuucuucaccucucacuuggucuuucaaccugguaaacugguuucugcuuuuaccacuccacugaauggcugccacugcguuacugacaacuugugaguuguuaaaccgaauggacauuuuuuuccagacucauuugacuuguguggcagcagacagaucuuugcucaacacagaucuaaccagcuauucccuugcugaagaaucauuuaaugaguucccauugcuuuuuggaucaagauuaaaaaccuuaacauguacggccugcccuggcugacuggaugccucacugucucaccuacugccuucugggaugggugcaugguccugcccaugggggaguguccuguccauacaggcaaugcccugccugcucaugcccauccucuuccucauccuucacaggccacuuccugggagucuuccugguuugccccaaaaugaggcuccccuguggguaugcucucaucacaccugauacuuguccucauagcagccuggugauuugggcaucacuuguuuuauaccauucucucucuuacggacugcaagcuccagugggcagggccgucugcucugcucaccacuguaccccggcacacagcacgcugaagaaaugaaugaacaaauccaaacccaaacuagacuggguccacucugggaagguucugggagcaaucuuuggcccugagacuaguuuugcgcuacagagacuaccguuucgggcaccucucuuccugcacagauacccagagucagguucauccagcucugugcucuccucuucccuccuuuucagugugaagccaacugcaggccagggacccaguccagccacugcccacuuucuuucuuuuuuucuuuccuuuuuuuuuuuuugagauggagucucgcucugucgcccaggcuggagugcaauggcgcgaucucggcucacugcaaccucugcuucccagguucaagcaauucuccugcuucagccucccaaauagcugggauuacaggugcgccccaccacacccagcugauuuuuguauuuuuaguagagacaggguuucaccauauuggccaggcuggucucgaacuccugaccucaggugauccaccugccugggccucccaaagugcuaggauuacaggcaugagacaccacgcccagcccugcccacuuucauaaauguuucauuagaaugcagccucacucaucuguuuauguauugcaucuguggcugcuuucagcuacagugacagcugaguaguuguuaccaagaccuuauggccgcaaaaccuaaaauauuuagugucugggccuuuaaaguuugccgaucccugguacgaagcaucaggcaggacaccuacugugugcuguggggaaaaucgaguaagugugucauggugacaaagggaugguucaggguuucgauuggagugauucucuugucagcaucaauggucagcaucuucuucaacaggucaaugaacucccgccggucagccuuuucuaccaacaugucgcucccuuccaaaucugucgucauguucaccuggacgcaaguaaggacagguuaccaaggaagaccccagcgugccuccccucuccuggcuccccuuauuuuuugcccuguaacuuccuccugaucucucaagcccccuuucucaguucccaggaacucugccccuaugggaggcaccacccacauguugucauugcccacaggauguggcuuuucucucugcaggaaaggcagagaggggcugugccccaggaaggggagagggcugcugcugggaccugcaaauauaucugaaugacaggauguaaacugcuccugcuuucaucaguuaaguugaaaugcagcuuucaucacuccucauuaaaaauaaccacaagaugaaaagaguucuggagacugguugcauaacaaugggaguguuaauacuauugaacuguacccuuaacaaaggcuaagaugauaaauuuuaugcuauguguguguuugccacaauuuuuaaaaaagagucacggccaagcaguacaaauaagauacaaaaaagucuauguauguauguauguauguauguauguauguauguaugcauguauuuaaccuuuagagggaaguggaagggccugagugugcccguccuccaccuacagcauaucauccuucucauggguuccccaguuagggccagaauuauuuuagucccuguguucaauggagucaccucuggccaagacaggcaggauaucugaacacaggauuuuucuuccaagggugagucuauacuaggaucgacuuuaaaaggcuuguuuuguggugauuucuguauuuuccaggacauggucuggaaaccaauuucaguuuucucagacaaucuaagcugcuaaucaacugacaagcacacuuuacucagaaucaugauuuuugguuauagucaucuacaguaagaggggugcuaaguguuuacugguguauagcuuuguuucucauugcuuuaaagagaaaacucacuuuggguugcccugguuucagacuaauuuucacacuaaaaauagcugaaguucuagaauuuucucuggggcacaaaggugagagccugcggucccugccagugagcugagacuguguagcagauugaauuguaucccucuaaaagauauauuaaagucccaguccccaguuggugugaaugugaccuuauuuggaaauagggucuuugcagauguaaucaaauugaguuaagaugaggucauacucgauuagggugggcccagugacaaggcaagggagauguggacacagaggcacagaggagacacaggacaaaagccaugugaagaaggaagcagagauuagagggaugcagcuacaagucaaagaacgcugaggauugccagagcugccagaagcugggagacagacacggaugcucuuccccuauggccuuuacagugaacaugggccugcugaagcccaacuuccaauuucuggccuccagaacugugggggaaugaaagucuguuguccuaagccauccaguucauggcaccuucuaacggcugccccaggaaacauacacacuaaauuaugggcauuaaacccauggguacuaaugggcuggaauucuucucaugauaacaucaggcagauaggccaguacuauauuacaacugggaaccaauacacuggaaugauuguuuuuuuguuuuuuuugagauggaguuuugaucuuguuguccaggcuggagugcaguggugugaucucggcucacugccuccuggguucaagugauucuccugccucagccucccgaguagcugagauuacaggugcucaccaucaugcccagcuaauuuuuguauuuuuaguagagacgggguuucgccauguuggccaggcuggucuugaacuccugaccuaaggucauccacucgccuuggccucccaaagugcuaggauuacaggcaugagccaccaugccuggccaacuggaacgauuuuaaaggagcugguaugaaguuuuaaaaauguuucacacaccaaaugguauucuuacuaagacuggcuguaacuauuuaaggucaaggucaaccacugcaguugaauaauguggauuucaacccauuaucuucuauuacuauugcagaagucuugcugcccuugguuuuaaagggcuuacguugcauacucacccaugaagcuuaccugggccauaucaucuaaacaguugaaaauguacuuucuugcuucuuuugacuuaaucccugucucugcuucauggucaucuggugucugucaagagaggcaaaagccaauugguagcgugacuuagcuccucaucacugggacucaagccuuggaacuccugugucucacagagggucucuuucccacauuucggaagagauuuugauucuucaaugaccugcacaccugcaauucccuucucucuucauccacaccaacccaucccuccuccuuccuaugcacacgugucaggggcuggcuccgggucagguauggagcagucuugcuccauaccacaggcugaucaagguaugccacauccucgaucagcuuacagccuucucugagucuaaggaauaaggcaagauuccauuguggaaaagcaaagggcuuucccaugcauuuuccaauuuuauuuaauaaacccuuaugcacauagcucuugcuacgugccagacauuguucuaaagcacauuuauucauuuaauaguuuugacaaccacauuagguagcacaguuacuauccccauuuuccagauggggaaacaggaagagaaagcuccaggcacuugccauggucacauggccaauagguggcagcuggccccagaguuuguggcugggcugccccucuauugguggcugagacacagaccuacauuccccaaauggcuggagauacugcuguuuccaauuacuauggauuucuguacucauccaugagguaauccagagguaauucgucuucaaaaucucacucaaggacagcacaccuggagcggcuuaaguccugggaacagcuggacaugugggacugaggcucuucaauaaaacacaacagcaaacuccagccucacccuccuccaccggaggacucuuuuuacuggaccugaccuugacacucacccucacaguugccaaaugccaggccucccaucaauagccugagugcuugcucaguucccaaaucucuuuucucagucuuuugugacuacuggauauauauuaucuuuaaaccauauuaggauuuggcugcagauuccauuaaaaaaacaaauccaaaacaacaacaaaacaaacacccacccacccugcugcaaaaaaagaaauaccuaaaaugaaacauauuuaagacuuuauuauuuucuuuuuaccaggaaaauacuuugauuuuaauugcuaggcacagaucaaagugaaagcaaacuauguuucuguuaaagugaagccccugcccccggaguuucagguuuaugguuacuugugugaaccagacaccucccugggccuuaggauauucccaugggcucaccaggcagccuccuuugccuggaaccccucucccuaacccccaucaccccagccgccaccccacacuucuauacugggcaaacccgcuucauucuuccuuuucuuuuuuugagacacagucucacucugucgcccaggcuggagugcaguggcacaaucucagcucacugcaaccuccgccucccaggugcaagugauucacgugccucagcuuccugaguaggugggauuacaggagcaugccaccacgcccagcuaauuuuuauacuuuuaguagagacgggguuucaccauguuggccaggcuggucucgaauucaugaccucaagugauccacccgccucagccucccgaagugcugggauuacaggcgugagccaccacgcucccucuucauucuuuagggcccaguucaaaugcuccuccuugccccucugcugcaggcagaauuaaaugcuccuuccucuuggcacccacacccauucuugaccaggaacagggcccuuacuacagugggcgggagcuuguggcacaugguccugucucccucuggacugccagcucucaagggcagagugggguucguuucucucccuagcacaaaucagacagucaucaaggcuuaucggauuaaauccugggaguucagcaaucauaagguuggacucucacaggcggcgauaggccaagggaaagaggggcuucugagcauucagauucagccauaccauguauuaacaacagcacccccagugcccucauuuugcugacugaaucaaaagcuccccacuaaugggucuacggcccucuucccuaagcgcugggccacugugaggaguggaggagacgcucuuccuaccuucagucuccacaaaggauauggugaguccgugucacgguugaaaaaccuaguugucuuugucccggcgcuuaauaaauauucagcaggcaaacccuguguuugugaaauauaccgaaucugcaagaaaagauaagaaugaggucagggcuuuuccugucacuauacauaugguauacuaauggcucugcuggcuuugagaaaaaugaaaaugacaauuuuuguagggaaagaaguuaacaaaaaagagaaaaaagaaaaagggaaaagagaaaggaauaaagaaaaaauagcaagguuaagggaagcaagguuugggagacaacgugacauuccacagucccgcccauuugucauguaaucaaugaaaugcuaauccaggcuauuuuccagaugaagaaugaggucuugugaauaucugugucaucuggacccaccugaucauacuccgaagcuccuggauauaacggccaacccaggaacaauucugcaauaacacagcccagggaccacaugucaauugccucacaaaaugguaaaccaaggaugaucucaggggcccugaaaaggaagaauggaagaaaccauuagcaaguuggaaaugcaggaagcuguuucuauaugaauacuaucuuucaaaccuggggugccauuacugacuccuccucugaagggccuguggcucucaggagaggcgcugugcuacaacaauccuuccauucuuuggcuugguccccuccauuaguggagggcccacuuggaagguuggcugagaugaaggauaagucuguguguuuagaacacaccuacagagaaccacgucuacugacuucauuaccuucacacgccaaucagaugagcuaacaaccauuuuagagauauucugaaguuaucuuuuguagcugaaagucugggaaacuaaucuucagagaaugccugguuuuuacaaaggaguucugaaacgcaggucuucuauuuucuucugucuaucuagagaugggaacucacuauguugccuaggcuggagugcaguggcuauucacaggcaugaucauagcucgcuauagucuugaacuucugaacucaaacaauccuucugccucagccuccugaguagcugggucuauaggaaugcacaaccacaccuaacucgagguauucuaucuucaggaagauguaaaacaagcuguccccuucccaaaauaacgggauuaaguccaauaucuguuuaugccaauuauccuuucuuaagaauuuacaucacacuuucuuaaggaaacauugcuauuuuuuauuagcuucuaaaaagcuaaucuucuuagaaguuaccuaauauuacaauuauagaaccccauucaugaauacagagucugguaucaaccaggauuccagcguaaacuccaugaacaaccuguuccugaaugcaggaguucugucccuucaaggaaaucaccuaaaccccaagagaacauuucacagggaguugguaaucaacacuaaagagaccacccagguacaucuucuuuucuaagaaucugucaugauuagguagggguauguuuuggacaaaaccaggcucaaaguuugagauaugaacacagcuuauguuuuuuuaaaaaaauaugucucaaggccaggcacgguggcucaugccuguuaucccagcacuuugggaagcugaggcagguggacugcuugaacccaggaguucaagagcagccugggcaacauggcaaaacccugucucuaccaaaaacaaacaaacaaacaaacaaacccaaauuagcagggugcgguggugugugccuauagucccagcuaccugggaggcugaggcgggaggauugcuuggacccgggagguggagguugcagugagcugagauugcaccacucuacuccagccuggacgacagaaauagacccugucucaaaaaaaaaaaaaaaaaaaaaaaagaaagaaaguagcucaaggcauucugcugauaaugaaaugcauuagccugauuuuuguuuucucuauaaauuuuccacuucacuaagagaugguagaagaggcuacuuuccuacccuuucugcagccuggagugggagugaagggagcuggggagaccuuucucuugguuaccuuucacacaccuagcaugagaguggggaggaagagggcgaucagaaacacccccacuggucuuggaucuucuagcugaauuuuucucuacugaaaaaguaccuccucuucccccuuuaaauuuguucucauugcuaaucuuuuuucuuuauauaauaguauugaaaagaagaaaacaaacaaaacccaaaaaugucuuauuaccaaguucugauuuuucacaaguaaaauggaguuuggccaggugugguggcucaugccuggaaucccagcacuuugggagggugagaugggaggaucacuugagcccaggaguuucagaccagccugggcaacagagugagacccuguuucuuaaaaaaaaaaaaagggguuaggcgcagugguucaggccuguaaucccagcacuuugggaagccaaggugggaggaucacuugaggucaggaguccaagaccagccuggucaacauggugaaacccugucucuacuaaaaauacaaaaauuagccaggcgugguggcgcaggucuguaaucccagcuauucaggaggcugaggcaugagaaucgcuugaacccaggaggcagaggcugcagugagccgggaucgugccauuguacuccagccugggugacagaguaagaguccgucgcaaaaagaaaaaaaaaaaaagccaggcauggaggugcgcaccuguggucccagcuacucaggaggcugaagugggaggacugcuugagcccaggaguuugagggugccaugagccaugauuugcaccauugcacuccagccugguaacagagcaagacccugucucaaaaaaaaaaaaaaauuuuaguuuauuccuuuccucacaacuagagacuggguacuggcuacuacgugcuucuagaguaccagucacacuugccggucugggcagcagaaggagugaccgcugggggcuggagugaguugccuuguugcuauuuaaugaaccuuccguuguccccaucgccugcugcugggcgucuucagcugccaguguucugcuuggcacuucacccccuuuggccuuugucuccuuugguccccacauuggacugcgcauguauugucaggggccacucuuacucacuggcacugaugagcuggggaugccugugguggcuccaagacaugucccugcugcacccuugucuuccaugugaccacgagcccaccaccugccuaggccaccugugucaguguuggccacauaccagggcccccagguucacucaucauuguguguaacugauaagauuacugccagguugccucuagcagugccuuuagagaucguuucaguuuauuuaaaacaucacaucccuuagaaaaaagaagggacuaucuguuucagguuuuuuuuuuuuuuuuuuuuugagacagagucuugcucuguugcccagccuggagugcaguggcaugaucuuggcucacugcaaccuccaccuccuggguucaagcgauucucgugccucagccuuccagguagcugggauuacaggcaccuaccaccaggucuggcuaauuuuuguauuuuuagcagaggcggguuuucaccauguuggccaggcuggucucaagcuccugaucucaagugauccaccugccucagccucccaaagugcugggauuacaggcaggagccaccauaccuggccagaaaagaagggaauaucugaaaagaacacuaccaaaaaaaguauuauggugucagaaccugcuuuucucucugcccucccuguucuagagucagggguggccuccugccuccucucacguggaucuaggccucuucaugggaggagaguuuuggccuggacugcuggcucaaggaucaagcacauucucaccucugucccccgauucuugucaccuggccucuuggcuggccccugcccucuugcagccugacguuuggaagucugacgcuccagucuguagguuuggauguuugacacucaaguaagucuuaggaaggccggucuggccccaggggacuucucugaacuugacuaugggccugcccuuccuaucagguuaguuacgugguucucauggcccggaaggcuguuccuaacccacggaaaccucguuuuccaguuuccauuccccagugaugaacaaggcagacugcaacaacuaaaauggccacacaaaggcacuuuagugauguucuuuagcaggaaacaccagacauagauuuugacgacugacgugacaugaacggggccugggaaaauugcuuguaguccaccaagaaaaugaaauggcagccauucacgguaccaugauacgugccgcagaauguuccugcugcgaccguaaagaacaaaugcccaggcaucuggcuagguggcugggagacaguacugucugcgaaggccucugaugcugcgaaagccacaucaaagcacacaggacaacucgagucgaauacaaaacgugugucacagaaagacacagacauaaaaaucgagccgacacagcacaccacaugcucuagcggcucccacguuagaaaacaaagcagaacacaagaacaaaacagaacacaaaaaacaaaacaaaagccccaaacacaaaccuuuccuaaucccuucgucucccagcagcugcugcccuaguucucagcuccccuucaaggcccacucucuggagagagucaucucccccugugguucccaccucuucaccucacagcauuugcucagcuuccucuaauuggaguuggacacucugcgucacugacgcgcugcacuuguugagaucagcagugaucuccacgcugucacaucuguugaucaacuucuuagcucugugaccugggagccacauuuuuuucacgcgggugaucauuccuuccugcccugaaacacuuauucuugguuuucaugacaucgcuugcuccccauaucugucccgccucucugcuuguggcuugcccauuuccuuuguaggcucgcccucuucuauccaacugcuguguguuggccaaguccuaagcccaccgucuucucuccuuccacccagcccuagauaauuguuauggguugaauugugucccccuaaaaguuauguugaacuccuaauuccuggcaccuuggcaugugacuuuauuuaggaauggaguugcugcagauauaauuagcuaagaugaggucacacuggaguaggugggcccuaauccaaugugacuugcauccauaucagagggaaaucuggacauagauacugacacagcagcaagauggucaugugaaaagggaggaagagauuggagugaugcugccacaagccaaggaacaccuggagccacccgaggcaggaagagacaaggaaggcucuaccccuggagccuucagagggagcauggcccuguugacaccuugauuuuggaugucuuuuguuuuaagccagauauuuugugguaccuauuucagcagcccuaggaaacugacagucaucuuacucgcuccauagguuuaaauuccauuuguauucccagguuugucuccaucuuggaauucuccuucuggcucuagauuugcauucuggaagccugguauugccucuggaaugucucauagucaucuccaauuccacacgucuagaagggaacuauucucugaucccccucucuaaacauauuccuuccacuguccuccucauuuuaugaaagggaaccaccacccuccagcugcuuaggcagaaauccaggaaagauguuugauuucuucauccccaccaucuauccacuaacauggccagcuccaaagucucaagucagccccugauucuccauccccccugccgcagcaguggcgcuggucaccccugcgucaccuggagcuuccacugcagccuuuccacuugucucucccuuccuugugcccacuuccuccauggcagccacagggaacagauggcaccccacccccuugccguaagccuucaggggcuccccacuggacuuggaaugaaaucuagaccccuccauggccauggggccuccacgauugggacccugcccaccucuccaccaucacugccaaccacucuccuagcuuaauacguugcaggcccguugguuuccuuuccauuugcaagaguaccuggagcuccuuuggagccagagucuucgugggaugcuguugcuucugccuuaaaugcucucccugcuggcugucacauggcugccuccuucucaucccucaaaucuuagcucagcugucacgcuacagacaggccucccuugacaccaguuagucuucauauagggugccauaaaugccacuucacagcacuuucuuaaccugcucacugucugucuucccugaccaagucuaugagggcagcgcaggcauucgguagccacucauuaagcauuuguugaucaaauaaaccuuuauuaaauauaagaaaguguuaaaauauggauuaagacaaagcucuaaggcagugcagauaaaagagaguagaagggcugaaucauuaugcagcaaucaagguuugggcaugagggggcaggauuuagcccaaggaggagcagaagcugaggcucagagaggggcacgagcaacccggcucacacucaccacagcagggcagacagcaggagugccaaggacaccuacuugcagguggccaacaaaagaauuacagcaaaaaugacagggaggaggaacaggagggcuagaaguggcaccuggcucaugcaggguuaggacuugggaccucagggauuuagcccaaaccucuuauuuuauggccauugucauuacgcccucuagagccuccaccuuagcucuuauguugaagacuuuauccugcgcagucccacugcagcaugcgaaaucacaugcucuuccaucugggccucacuacagccaccugcugcucucuugccuuugguuuuaaccuuuuccaauccacucuggaucccucucccaccccuaagggugcagccuuuucucugcacucaugagacauguuucagauacagccugcuccccucccugcccgcuuccauucuuccuuauucaaacagacacugcccacugucucugugcuggcucuaccaggugacaagcauacaaagaucaaugacauacucagaccagauugguccaauaaauacuaacugagcacccacuggccccacagaaccaucuuaaagaauuuccucaucgcuauuuugggacaucagaaauacuuuaaacauauauaugaagugucagacaaaaucugcaccuaagaaagaggacucauuccuuuccaacauucccaaagcaagccacuaaacauucuuguucuggagaaagagaguaaauaauugucuuuuuuuuuuuuuuuuuuugagacagagucucacucuguugcccaggcuggagugcaguggcgcgaucuuggcucacugccagcuccaccucccggguucacgccauucuccugccucagccuccugaguaguugggacuacaggcgcccaccaccaugcccggcuaauuuuucguauuuuuaguaaagacgcgguuucaccauguuagcuaggauggucucgaucuccugaccucgugauccgcccgccucggccucccaaagugcuggauuacaggcgugagccaccacgcccagccaauaauugucauuuuugacacacaaauacguuugcauaucugccucuacuauaccuccuggagggcagggucugcaucucacuuguccuugauccucagccuggcacacagaagcugcuucguaaacagcugcucaacacccagcccauaaacccucagguaagggagguaguuccccauuuggcccccaggaaucuuuggggacuucagaccauuuugcugggaucugaucuugcagaggccuugucccccugcucugcuagucuauaaggcucugagguccuagaaguucaaagucaagucuaaaauguuucuuuucauccagcccaccugaagcauguuggaugguugcuaaagcaugcuuaaucuucagggaagcucauucugacagucauucugagccagaauuuguuucaagcuguccucacucacuuauuagaauauucaaccaccauuuacuaaguguuuccucugugccagguacugugcugggugcuaaagaucaaaaaguaaaccagacccugcagcucuuccaggaguucaccgucuagccaagguagcagcauagcgacaucugacauacaaugugugaaguguguacauaguacacaaagaugggggaaauuggaggaggagagagaaagcaggaugggcuucccaggaggagucugagcugagccuuaguaaguggccaggcagggguggcuaccacacacagagcagcgcaagucccccaacccccaugucacugcuguaucuccagcgccuagcacgcagccugggcauguaggugcuccauacacauuuguagaaggaaugagucuaugucaagugcacacccucagcaguugccaguuuucccuggagcuggcaaugccaccuugucaguaccuccuaugugagaggcagacagcuuggccuuucuguuucagaguuuacaugguuuuuuggguugaucaucacaugucgguugcuuccacaggggcuguuccuguucucgguucgguuucaggcagguagggcugcugguuccugaauacugugagugagcauuuccagguucugucauaacugaucucucauuugcucuuccucaccuucacugcuacagcuccaccccauggaaccaucuuaaagaaucgccucauuacuauuuugggacaucaaaaauacuuuaaacacacaugaagugucagacaaaaucugcaccuaagaaagagggggauaauuucuuuccaacauucucauaggaagacacugaaaauucuaucuuucuaaagaaagaggaaaaacaacugucauuuuggacaccaucaauauggaagcuuugaugauuuagcuccacucgcucucuugacugcacacacugagaagcauucccagaucauguccagaucauaugacccugcaggggaauggccuccaguggagguguagaggcugcagaagucaagagggcguggcccgcacuugggaucccaguguucaccggguugaaucccagcccugucagguacugguuguguaccuacuucuggguacagguaugaagacuagguuaaacagagcaucauaggggggcaccuugcagaggccuggcauagaguagucagcugaacaauacuaaaccacuuaucuauaacacgucuaaguccaugugaaagcaaugaaauaaacagaucaucccucuuccuuauuuuuuuuuucuuuuugagacagggucucgcucuguuguccaggcuggagugcaguggcacaaucuugguugaccgcaccuuccaccuccugggcucaagcaacccucccuccucagccuccugaguagcugggaccacaggcacauagaaacaggguuucaccauguugcccaggcucuucuugagcucuugagcucaagcaauccuuccgcuucagccucccaaaguguugggauuauggguaugagccacugcacccagcuuccucauuuuuuaaagccacuuucuuucugauauggaacacucuguugaaauacauuaaagcauauacacuaaacaacuguuucauuuauuuacacaaaaagcugaaaagauuaauauaaccaacagugaaguaccuaccaccuagcuuuagaaauaaaaacucccuggccgggugcaguggcucacgccuguaaucccaguacuuugggaggccgagguagguggaucaccugaggucaggaguucgagaccagccuggucaacauggcaaaaccccgucucuacuaaaaauacaaaaauuagccggacaugguggcacgcaccuguaaucccagcuacuugggaggcugaggcaggagaaucacuugaaccuggaagguggagguugcagugagcugagauugcgccacuacacuccagccugggugacagagcaagcaagacucagucucaaaaaaaaaaaaaaaaaggaauaaaacucccuauccacaauccucuugcuucuuccuuguguggagaaauacuaccguaaccuaguguuccuuuuauuucaucucacaugaaugcuggguacaugcaguacacuaggcaaugaagacugaaaagacagccaugcgcuugggcugcuuggaguccuaacagugugccaggcuagaggucagagugaugcccagggagcacagcccggggaacagguuugggaggguggucccgugggucugaggaccccggugggcagagucaaccuguauuacugugucugcuuauggcaucggcggcaacaagggcugggacgcaggguucaggguauagucccuugcucaccccaaacacuuuggucaagucugagaccagagucaaugucuugcucauuuacauaguucacugacaaaacaagggcaggguucacugccacuccgaacuuggguaauaaaucugcagcgcuaaucggagcgcacaggcggagcugugcauuucuggaaaaauguuacucaauuucucugaguuuuuauuucaccaucuauaaaaugugauuauuaaucucacuuuuucucuugucucuacggcagcuuaugaagauaaauuaugguuggcagaauuauaaaacaguuuaaacuccuuggaagcaagacacucuauuaguccaugguauuuuauaaucacugguauuauaagguguacucgaacugcagagaaaaaguccguucccacaaauauauguagauugaaaguaaccucaguauggcuggggcagaagcaaucaaaauguaaaacuguauuucagauggguuguuaaaucuuauguuuccacugcaaaaauaaggagacuugcauugcugucuugagcucugagccgcuguuugagcuggugaccgggagugggaggcgagggauuacagugaagcagcacaggacccaagaaacaguggcagaaaucugaagagcagggaggaggaggaggcuauuucagaggaauuggagccagagguaagagagagcugcacagaagacagccagaaaggcaagggcuggaaagcaccucggggcagcugcauggagagacaacacgcccugugaccacaggcaagccugcugggaaaacaggggcagccuccccacaggaugaauccacaccaugccuagggggauccagaagguccaaguggagauguagauggccauugaggugagcuaaucccaggucaaccugugauuggauucuuaaaaagacacacagcuuccuaggcaaacaggagaucaaagagaaauaguuuugucuuugauuagggugauaggcagacaagcaaaaggaaaaagggacccagagaugaagcucuaggagcaaaacaugggggagguugacaaggggcccacccauugcgcuggcuuccacggagccauccuuggaauggccaagccaaacaccguggaccccaagaucucugugcacucugcagcaggguacuuuugccugguuauaagcugaagaaauuaagguggagagcugcugcaagggaacaggguuccaacuccaaaaggagagcuggggggacagacacgacacccaaacuucugggugguugcagcuugauguaauacacguagaaccacuguugcagagauuuucuaccuaaggggccgcuacugauguccauaaaacugugugcuaaggaggaucauuucagacccucacugaugauucugucauaacugaguaucuucagcuaucaccaauacaagugcugaagacuucagaaugaaccaucauauccauauggagguugauauaauugcaguugggucuagauguugacaucauucucauggcacacuuggacagucucuuaaaggaugcaggcuuccuugauucaacuggccauucccuguauaauguuagaaucagauuggcgguuuuuucuauucauauuggcagugaacaucuuggcucugaauauguacuaaauacacacacacacacacacacacacacacauuuucacacugauccuucguucuuaguccugcuccaacucugcuaagcguagcaccaaaaucuaacucacuuguuuacaugccagaggagaagguugcaucugcaacugaaaugaauauaaucuccaaaggcuucuggugauguuggugcaaacuggaaaccaguucucagauguccagagcauacuggccucuaaauuugugguuaugugcuugugcauguagaauaaagugaagaaaguacagccagggacauggauccaccuaaacgauauugacuugacuuggugaaauaagaaaagcaagaagggaaggaaagaagaaaaaaagaaaacuaugaauuguaaugucaaugaggaagguuccuagaagaaccaguuuggacuccaugauaaguauuucaaagauacucacgcugcccuguaauuccugagauccuuauacuccugacacgugcugugccugcuuuacccaucccuggccuggguggcccaauaucccccaaucuggucucuggugcuauaccaugaagcucugcguugcuggagaaagccuguucugaccucccagcacucuaccagacuacagugucaccaggccacgcuuuaugcuuggugacuuuugucaaagaaugugcucaacaaauguuugcagaagcaccuaucagccagagaaauggaaccaugugucucugcaggugccuaucuauguaaucuuuucauauguauacugcuccaggcucuuuuuaaauguuuuuaucuuuuuuuuuaauuaugaaagagaauauauauacaaagaaguauacaacaaaaacguauaccuuaacaacuuauuggaaaacaaagaccagugucacuaccagccaggugaagaaacagagcacugucaacaucacaaaagcccugugguauuuccucccauccgcugucccuccuccucaaaggggcucugaagucaccaugugugggaggugacaugcagccugcacacucaagccuggguaugggugcacaucgguguggcagcccccaugccucgcugugcucugccacugugcucagaugaggcuccugcccaggugagcgcaaaggccagaggcugggaaucccaacacaguggcugagaaaggagccaggccucagccauucuuuuaugaugguccucaucauggauccuuuuguugacuguuuuucuuccgauucauuguuagucuguugacugaagccgaggguugaaacugggcauuuagagcuguguugggaagccugcugauucugggaaggccuaacccaagucccacugucaccugcugucacuuuucagcuuucugggaccacucuucuuuucucugcacuggcaagggauuuggaauuucaauuccuguggaucaacugcagauguggcgucuucacuuuauucagccuggugauguuacccacuuauagugaucaugagaugugaggcuggggaaaaggcuggucucuuccacacuaacacauuaauucaagguucacccucuacucuagauggaugcauacuaagaaaguaacaucacuuaugugcaacuuuacugauuuaaaugcaaaacuucucauugcuucaacauuuagcuucgacugguucauggugaggccucaauaaguguuugcuggaugaaugaaugaaccaacaacaggcagaagaaacacgaugcuuuccuuuccaagguucccagugccuccacuggagaagccccgaauccccaacucucagaugagugacugugccauagacaaggcucaucuuugggguauuuucuuuccuuacagcaccaucugaucauguggcuuguggagcuaagucacagucagucuuuauggcugacagucugggauaaaagacagaaacuugcuccuucuuugaaagggagauacauucagugucaccagccggagacauaccaauuaagagaacagaagccagaaacuugagcuaugaaaaggaacccacucaguaaaaaugucaaacacaaguuagagagugaauuuccauugcagccuaagggauauuccaauaaaacagguaucgucugaggaggucucccccacugcacuguguguuagguggaaaacuacugagaaagcagggccgaaacccacuaauacccuaccuaagcaacuuuccaaauaaagccacuacuccuggccgauggaguaggcucugauccuguaaguacaggaugcggccugacucuaagcaggcaggugugagugcggugaggggagccagguggaugaggcuggccuugcucucuggagacgugcacgccaucaaaccagcaaaacaggacucacugaggguauguuuuuuacccaauuuuagagcagggagcauccacagaguaaauguggccauggcccgucugcucacagcacuccugguuaggaccugcugugguccggacaagagcgagcucucacggugacugguugguuauuccagcaggaguuaggaacaagaagaucuugccaaacaaaaugggcauaaacuccaggucuccagccaagggcagcuuacucaggggaaaccuuccaacacucaacuuuucuuaaaggagcugaaaaagaacaaaccaaaccaaaccaaaccaaaguuugccuucuuguguuugggucacagaggaaauacuaagcuggcucuuuacaccucccacuagggggcgcugaagugcaacagacacaggcucggaaagccaccugaaccuucaacuuccauggagacagagggacgcgacccacuggguaagggaacaaacgguucccuuaaggcuggugcgguggcucacccaugcacugccagcacuuugggaagccaaggcgggaggaucacuugaggccaggaguucaagaguagccugggcaacauaguaagacuccgucccuacaaaaaauuuuuuaaaaaauuagccaggagugguuguacacaccuguagucccagcuacucaggaggcugagguaagaggauggcauaagccugggaagucgaggcugcagugagcugugaucacgccacugcacuccagccugggugacagaguaagaccuugucuuaaaaaaaaaaaaaaaaaaaaggaaagaaagaaaagaaaguuuucagaugaggauaccacugcuccaucuucucauuaaccaguuuucuuauccuaacaauggggccucuuuguaguccaagaacagggacucuccuacagugccuuuggaacggagcaacauucagcaaaagagaugagaaugcucauuuuguucucgugagccccaaacacuacuccagccaacugagcuaaccagcuuauggaaucagggagcugucacacaucagcuggggcuuuggguggagaagggaagaaaggaaggcaggaggaagggagggagggacucuugagggaagucagagaagaaagagugaggggcggugaggcagcaccugagacucuugguggucccagacucucccugagcacacccaggcuuccccuccgcaccucugucaguggcccuguggaaagcaugucuggccuggcucucauggaaagccuuugaagcuuucuacucaaaccuuaccugcucuagcacucccugcugacugaggcucccuccugugcucuauuccuacaacgcuaacuaugucucuacugccaauucagcucuuucacucauccuugcacugauaguuuuuuuuuuuuuuuuuaaauaagaaucaucuauaaucagcuccuagacuggaagcaucccgaggccauggccugugcaugacugaucucuguacaccucacagcacccagcguacagccuugucuacuggggugagagggucggugucugcagacauugggugucauuguucacacucaugagcuggaagaagcugugguuucauuaucuucuuuccuaccgccaagcacugugcuaagaacaguaaauacccaauacacagauguuugcugaacugaguagcugauugugugaagaagaagugaaaacugggauuucuuacuguuuauuuacuuuuaaggaaauaaguggcucuuuuaguucuucucugauaauaaggauuucaauggugaaaugugaauagaaaccuauaaagcuccacuuuuuaauaggagaagcuugacauagggaguuuguaucuaucuaucaucuaucuauaucuaucuaucuagauaucuauauauaugcugaggaauagugggugaaaagcaggugauaaaggagauacuauuuaccuaccugaagaagaagagagaauaaguggagauagggaggaggcagcuagggagauuuugaaaauucaauuaaaaaaaacccauaagcaauuaaacccauaaaaaaaccugugagauguuugaaagaaugacagugaucauugguaugaacagcuuaguuucuuuuuugccaaggaagaaaaguuuuguggcaucacuggaaaucagcgagggccugccuggcaggccugucucuguagugucagcuguguaaguaggucuuuguaugguuguauuuaggcuuguccuggauucccccaagagaucaaaaguuccuugaggagacagaaccuauauuugcuucccagggaagugcucagcugccacacagcucaggguggugaugcacacagcaggaguucaaucaacauuaacccgcuaaauggagcuaaccaaauuccacccccagucugaaaggcucugacacagaacugucuaguuccuuuucauuuggccucaaaagggguacauuuuucaaaaaacaaaacaaccccacauaccccaaaguuucaaccugagauucaauuuugaauugaaggcuaagugaacaauucugccuaacucuuuaguaagucuugcuugugugaaaaucaaacagaaaucuucccucuucccucuucuggguuucccugacuauauagagguugauagacuucagaugaucacagaacccaaaguuacaggccaucacuagggagucacaguucagaccaggaaaucacuagcggcagagagaagcguggagggaaacgacguugcggcuuucggguuacacaguggaaaggcugaugaagggaauacggcacacaguccccagccuuguuacuuuauccccccgggauagcaucaauagcuuacaugggagugagcaucauuccugcuugcaccuucacguccgguuaaaacgauucuauucugcaagccagagcuuagguuccaucacuuccuaccgagcaacgccccccacccuucucaucagccccgucugcaucauuacggaggacggaggacggcucuugggauugucuugcuuggcaguggagggcggagcagaaggagggagagggugcugcggguuuuuuuuuuccuuuccccguauguauuguguucaguguggacaaauauuuguguagucuguauuuaccauuaauacuaggauaaagucauuagugauucgauuuuucuauggaaagaagcaaggcauugggcggguggagggggaagcaaaaccccaaacggaagaacagaaacucuaaaagcuggcgucugaagguauuauucaaaaacaauaugggaaaaggcagcaccauauuuccucuguucuucuaaggggaaguucagaaaaaggucagaaagagaacaaugcaggccaucuaucauagcagccucuaaccuagaggugacuugcccgcugcagccucauuucucaguucuguaauuaccaccccucccacagacuggacaccacagcggccuaugaauuaugcauuucauuuccaccuccccacacccugacucggugaccacugcugcggcggguggcugcggggggcgggccgaugcagcaccccuucccccagguacacgcgcaaauguuacagggccccagagccccggugcacacccgcagaugcugcuugugcugaccuucaguucccagccuaagauuuuguuuauugagcaaauaagacuaguuaccaguagggauuuuccuaggggaaaacacacuggggcaccuuuucuuccccuucacguuuuuauucaggcaaaaucugguuaaaaugaauauuaaggguggucuugaaggaggcagaggugauguagagccugaggguaugugugugugugugucuccugcuguuagaauucgggggggugguuuggaaagugggucccagaaauggauacugcugcaggaacaggagcaacccugcuccucccugucugugccucugauuaacuggugccccucuccuaccaauucagagggucccagaaaacuucuggggccaccugucuucacaggugcuacugguauaccaaagcagggacuacucuuuguucagagugauuuuccuuucaaaucuuuacaaaacguuagguuuaguagagaaguugguuagguuuaguugcucgagcaacugagagaccuaggaauaccccuggaagcagacagggguaagcagcaagcgaaaggguucccuugaaaagcaaggguucuucuguuugguacaccucagucuaucgcuugaagaggugguauggguaggauuuuaaaaaauauuuuuaaaaagugacuuuagauacauucagggaagacaguucuaagaugggauauaaaaauaggauauuuaggccaggcaugguggcucacgccuguaauccuagcacuuugggaugccaaggcaggcagaucaccugaggucaggagaucaagaccagccuggccaacauggugaaacuccaucucuacuaaaaauacaaaaauuagcugggugugguagcaugaaccuguaaucucagcuacuuaggaagcugaggcaagagaaucgcuugaacccaggaggcagagguugcagugagccaagauugugccacugcacuccagccugggcgacagagcaagacuccaucucaaaaaaaaaaaaaaaaaaaaggauauuuaauuucugaggcugaucuggggaacacaauaguaagugggcugaauauuaggugcaaaucacuaugacauauauuuuauucccuucggguuuuuuuuuuuuuuaaacuauucucaggguuggaccauuuguucauaagggaccgacugaggguugugaucacagcugugacagccagcccuuaagauggccccugaggacccaguucuccuggaagucaacacccugguguggucuccucucacacugagcagggcaaaccuguguaaccaauaagacagcgcagaaaugacaauguguggcuucugagacuaggcuguaaaaggcauguggcuucugcuuuugcucugccuugaaucacuuacucuggaagaggacccucaauggcccuguggagagauccacguggauggaacccaggccucuggccaacagccagcucuggcuugccagccacaagggugacccaccugggaagaacacccuccagccccagucacgcccuugggugacugcagccugggcuaagagcucaccgccaccucaugacagaacuggagugggaaucguccugucauguugcucccaaauuccuggagcacagcaacggugagauaauguuuauugugucagccacggaauuuugagguacuucguuaugcagugacagauacugauugggcgucucuaagaggggagggagcacgcagagaagcucuggauuuguguuuccaacaagccuuaggucagcacccccugauacccaacacaucacuagguccuccauccagccccugcccugcccugaugggaaccaaugaagcacuuucuaaaaagguaggaggcacaaggaaaacacagccugaggaggacuuccaagcacccaaaugcaggcaagacugaacggauggcaugaaguuugcaagcugcuauuccacaggaugaacccggcacagagacagacacucuuuggccugcauagauauuaaauuuuuucaacuagcuauuaacauuuagaacucaggugauauuccuaaaaguuuggauuuccugcugaaaaucaaaagcucuggcaacucugggccacuugucaguucguggucacaaugaccuggggcuggauaaggcugcccucugcacgugugugucaccagaugcagaccuuagucauuaccagcucacugaccaccuaccuggcccuggaggcacuugaguucgugacuccuaggagagaggcgagcuggagggggacaaaugaaacacuuacaugaaaucacugcuuuuagcucuauagcgggggcacuguggagagguacacaauuuguuuucuuuuauuaaacaaacaaacaaacaaaaaagguuuagcaaacagcugccccagaagggacuucuuagaacuuacaaggaauguaaaaugauuauuccacuuuacauuacacagugugaacuuuaagaggagagauccgauguuauguuucugcaauguuuguuuauggaggucuucguuauauaagaccuccguggagaggaacugcaaugcuggagucucacuuugcugaucuggcuuucuacucuaacaauuauuuacaauaacauuagagaggaaggcucuggcgccauaacucagugaauaucugccggauucuucccuccuacaagauacaauaauauacccuuuauuggccuucucccaauucuccauuugaaacaggauuauaaucaguuuucagaguggcuuacucaggaauuaacuagccaagcacuggaucacugcuucuugaacaauucuguaguccuuugcacauuuuuggaaaaggaaugugaugucaacagccucauguucuugagaauauccuuccuaggugggcaagugcugggcugggggagaauggggccuuguguuugcauaagacgcugcucacgaguggcuuuguauaagacagcaggaggaaggcauucugucugccucccccuuccccugagcucggggacaugauuggauuauugagugauuauguaguaaguucaaucacugauauuuauugagcucccagcauguucaagacucugcuagagggugauaccaagucaugguugcuguucucaagaagcuuaucaucucguguacacguauggaaaaaggaauacagacagaaaucaugaaugucagaugccagcuacguuuagagggagcaaucucucucauucaauaaacauguauugagcauccauuaugugcugggcacuaauuagagagugaacaaaaaaagacagucucuguucucauggaacuugaacucuaguagaccucagcggacuccacuccaggcugggaagaacaggagagaauucaaggaggcagaauuuaaauagaaucguuagguaccaccgacuucagaguugagagaagggagagggcacugcagguaagaaaacaucauuaacgaagguacagaggcaggaaaacacaaagaagacuguucagggccggcacgguggcucacgccuguaaucccagcacuuugggaggccgggguggguggaucauuugaggucaggaguuugagaccuggccaacaugguaaaaccccaccucuacuaaaaauacaaaaauuagaugggugugguggugggggccuguaaucccagcuacucaggaggcugaggcacaagaauggcuugcaccugggaggcugagguugcagugagccgagaucacgccacugcuacuccagccugggugacagagcaagacucugucucaaaaaaaaaaaaaaaaaaaaaaacuguucaggagaacaaggaagugacacaagggcuagggcaguaggagcaaggggcaagugauaccagagcagaaacagcgucacugucauccucgaugcuaacucuggaccuccuaugccauggugcugaggcaggacaacagcugcucuuugauuucuucagagagcaacuacagacaaagagacauuugucuguaaacaugaguaacuggaaaaugcagugcugaggacuaucaacuguuacagaauggguggugggauuuagagaucuuaugggacaaaucacaccucccacaccgccaucucguaugguaaaacucugacccauggaccucgggaaggaggccucugccuccuguuacagacaugccauugagaggcacaggugauaagugagcaaaggaaaucagcuuccacugccucaagaagcacagccugggauuaccugaccuggugugaugaaaaucgccaaguuuuauguugcauuagugaagauuuuccacuuguacaauguuuuuuucuuuccaaagguggggggaacaaaacaugcuccucuggccuccucgagacuguuguuguuuuuuuuuugagauggagucucgcucugucgcccaggcuggagugcaguggcaugaucucggcucacugcaaccuccaccucccagguucaagcgauucuccugccucagccuccugaguagcugggguuaaaggugccugccaccacgcccggcuaauuuuuguauuuuuaguagagacgagguuucaccaucuuugccaggcuggucucaaacuccugaccucaagugaucugccugccucggccucccaaagugcuaggauuauaggcgugagccacugugcccagccaaaacuguuucuuuacuacagagacagguuuguguaugugcagcccagcuuauugaaugauaaagcagcaaaacagagccucaaugacacaggggcugccaggccccuguuccuauagguuuaacagcaugagauacacauaaaagcugcugcuauacaagugaggcucuuaaacaucauuaaaaacacauauuugagguuaggcacaguggcucaugccuguaaucccagcauuuugggaagcugaggcaaaaggaucgcuugggcccaggaauuugagaccagccugggcaacacagcgagacuuugucuacaaaaaaaaaucaaaacauuagccaggugugguggugcacaccuauagucgcagcuacucuggagggugaggcaggaguacugcuugagucugagagguucaagccaaagugagucaugaucacgccacugcacuccacccuggacgacagagcaaggcccuaucucaaaaacaaacaaacaaaaaacccccaaaaaaccccaaagcaaaaaacacaucuuuggaacuguuuaaugcauuuagggagcauggaguccuuaugguggucuguuaugggcuugaggcuucaccaagccccugugaaaacucugagugcugucuccauggcgggguugcagucaguagcaagauaacaaaacucagaugggaaggacaaagcgcaacauggacgcucacgaguccagccaaauucugagugcuuaagaagaggccuguucauuacgauauuccugguaauaucaacucucaaacuacuccuuggaucaccuacccaauauuuauuuuugggaacaguuuaaaucaagagaaaagcuauuaauaaguuaaauaaaagcuguugaagggauuccugcgagugggagguugaauagggugauuucuaaagcccuugccaacacacaaucuaggauucuaucacugccuuccucccgaucccaugcaauuacauauucacaggcgacaaagagcaauagaaaauagcuaauucacaugaagggcugcucugacuguggggggaauucgcuuggauaagaaagugucccuaggaauuaggguccccagccuggagcugaguauugaugagccaguuacugaauucucagugcccauaaggugcagaguugaugacaaggaucacagucaguuaagggaccacagucaugacaaauacaaaccagaaaauaguucagaaaaggguugagcaggcacacaaauaaauucagagcaagcgaagcuaguuaugauaaacaaacaaaugucagucuucccuuugggacaaagacguaaguugcaguggagccaguagagagugaauggggaggcccugugcaagaggcucccgccgggcaaggaggcugcugccugcaguucugcagguggcuguagacagaaggcgugugggaaccugcacagcaacucugucuuccucuggagucuuuccgcuuauccgacguggcagggucuucuuggcucuugcuucugaacaugcucacuuccucuuucuuuucuccuuggcccuuucucuccuucuuccuuuaagguggcaaugcuugucccugcucccugcccugcacugauggacgcacaaguggaggggucuacacaccccucuuucauuuccuaagcaacccacaaguccaggugaagauguaugauuacauuuguauuuuggaaacauaaugauugauugugguuaugauuuuaaaggaagggcacacucuuguaaugggcaacuggagaaugaauuagggucaagaaggcucaggguggggaggcaagucaggaggccuauaugauaauuggaugaucauuuaaccauggaugaggagacucgugccagggaagcuggaaaggcugcacucacacaucaccaccaagcugcuuuugggacucaggggccuucccuugguucucauccucagccuugccucucuuugauaacugacccuguugaccucaacucgcuuuccaaguccccuuaggguugcuaauguguuuugcuggucucugcucauuucucccaucauucuucucucuccucuuccuucucccacucccucacucuguacccugguccaccuccauggugaacucauucacugccaggcaucuaccaccaggcagaugcauucccagccccaaucucucccuggguucuaguaccauauucucauugacuuaaguaucucuaauuggaugccucaaagugaagucaucaugucccuccacccccacaaaacggggcuccucuccagcucaccccacuuauuccagcagaaccaugauuuuuucaucuccaaaauuaggaugcucaagagucaucuuugcuuaucacguuuaccuuuauuucuugaguuucugccuucuuuuugggauuuaccucacagucacuuuuucuucuuuauucucaaugccacuacucccuuggccugggcccgauaacugaaacagucucuuggcuaguuucucugccucuaaucuuucccuccguccaauccaauuuacagccugcugccugacucacuuucaucaucccacagcuuuccucaagaaccaacuugccuaucacacggaauccaaauucuaauugcucccaaggccccacagcugcccucccuuaccccaucauguuuuucuguguucaguucauaacauccucuucuuuuaggucugacccuucccugucauuugugcacaccgcaauacucuccuuacucgacacuucugugcauguugcuuucuucaucugcgaugcucucuccuucucuuauucaaauccuaaacauccucagaguucaguucuaccuccauuuuuuuuuuuuccugagauggagucuugcucugucacccaggcuggagugcaauggcacaaucucggcucacugcaaccuccaccucccggauucaagugauucuccugccucagccucucgaguagcugggguuacaggcuugcaccaucacgccuggcuaacuuuuguauuuuuaauagagacgggguuucaccacauuggccaggcuggucucgaacuccugaccucaaaugauccuccagccuuggccucccaaaaugcugggauuacaggcaugagcccccaugccuggcuugccaguucuacguccacuucuauuagcagucccccgacagcucacccaggcuucugcuguagucaagagccuuggacugcacuguguccaccuugcacgcugacccuccgugggagguacuacgucagucagagucgucuguuagacagcauucaucuaccauccuagguagugauuaugcuguuaggguggcuuguguugacccaaauguuccuucagaccucguccauucgauuuuucacuguauuggucccaaauccccaggccuuaucuacgcugagcuuaucagacuucaccuucagcugcacaucucuagacagagacaggacuggcacauucugccuccacccaaaugauucuuggccaucauccccugccuggguagaccuuuacucucauuggccucuggauuuacccagugcuaucucugcacaauguucaguuucaguucuuccugaggaacuuuuugaugccuuccagaaggcucuucuuucccuucacacaccuuccauuaaacuguaagagucaugccaggcacuuguuucuagguguagcaguuuaaucucuccaauuaagcuauaagcuucuugauuaaaacaaaaacaaaaacagaaacauggcaccuuccuuucuuggacagcuaucacugaacacaguguuacacaauaagugcucacgaaaacacaacugauugacuuauuuugugucacaccaugugacuggccaccauccuuccagaugcccuuuaagaggucugcacagggaucaggagaccuggguucuccacaugaccuugucacuaucuacuuuguguuccugguugagucacuuaaauguuaugagccuaaguucccucagccauaagaugguagcagccauuccuacuugaucaccuuaagaaucaauaggggaucaccugaggucaggaguucuagaccagccugagcaacauggugaaaccccgucucuacuaaaaauagaaaaauuagcugaguggaguggugugugccuguaaucccagcuacucaggaggcugaggcaggagaaucacuugaacccaggaggcggagguugcagugagcagagaucgugccauugcacuccagccuaggugacaacagugaaacuuggucucaaaaaaaaaaaaaaaaugaacggggaaaaggcaaacagaguguugacauauuugacaaacuucauuguauguuuaauuaacucauucacucacucaaaucauucaauguauguaugcuacacaaauggccauguuaugaaaugaagaugagccaagaguuuucaauuccacugaauuauuuucagggaaagugacuucaugagaaguaggaaagcgaaagcaaaauuuucuccauagaaacuaauuuaaugcccacacuaguuuaaccuauuuuauaaaccaaauaccagaaauuuggacagagaagagucuuugacaauauacaaccuagguaggaagaggagacagucagaguucugguagguacggcagaguugggaggugcugugaagguggggauaagaucuuguuuuguacauccuaauucugagugcccuuuuauuacaacugcuuucugccaucuccuucaggcaaaaccccagguugcugaagugccugcuaauuuuauauuggaaggccaguucugggucacugcacuacuagucuuucucaaccaggguuuucuaucugaacuacagagcacagaaaaugaucugugugacuguaaccuuccuauauaccacucucaguggccaggagaggagucgauucacuacaauggaugucuuaaagcaggagggcuuauuucucccugggaacccuaguuggggaaggcuaaacacugacugauggacauauuucucgcugaggccgacggcaugugguauuggcauuggcugaccaaaaacaauagggcccugucucugcugcaagggggccgggagggauuuuuucacugaggagcacuaccuuaaugaacucacuugcuuuucuaugccgcuuguguccacauuucccucacugcccuacuucuuuccugggacugucucucgucuuaacccuuucccugccacgcaucacaauuaggccauucaaaccaaauuuucuacucuaaaagcauucacagauaugccauuucaugcagcugaagauucaacaggcauaauuuaauaacauccgauucuuucugcacccuucaaguaggagcagccuuuuuugaguccaucuuuuugguagguucccuggcccugagccgcggggucagaucuccagccagaagacccagcacagacccccggcugcagcugcagcuugugcacggauagagagagauuccugcuugggcuauuagugucccaggucuggacucugguuaauauggucgucacugucaccucugcuguugcuauccuauagucucugcaguaggcauucaguuuucucuuuauucccuguccuuggccuaugccuuggccuaugccuaugcccuuuaaaggaagacagacccuuccuuuaaagggugugucuccagcccacgaacuucuggcuggcuagagcugcauucucucucuuuucugcucuuuucuuccugacacccuauuagaaaauuaggguuauuucuugauuuccuuuauucaguucucccugaucccucuacauaugccaccaucauacaggcauauagcuaaucuuuacuuggguuuagucucuucaaaaacagaccuauuuauagcuucccaauauauaacugcauguuaaaugcaacaccuauacuucagcucucuuauuuauaauuugaauuuugaaauucggaauuguuccaugguucaaaaaucaccuuugggcggguuguuuugccaagaaaaccuuuuaucaaaaacaaacaguucacuggcuggcaauacacacuuuacuggaauggccucccauaguuugagaagcucauaucugguuguagcccaacuggucaaggguguuauugucugucucuugggaaaccacuaaaggaaagaguaggaaguaggcacccuuggggaaaauggcaaagccuauaggguuucaaauagaacacaguaggcaacuaagaaaaguaaaaacaaccaauuuuuuguuguuguuguuguuguuuuuaauuagagccucaaccaaacucaaauacaauuugcaugaccacagcugaauucgccuaucauguauaccacaggacauuugcuuuuccugguuacagcaugacucagacuuuauuuaaauccuuuuuacaaagaaauaagggagauaaaagugacagaaauaaagucauuguuugcucucugcccaggcagcauggggacagaggcugaucugaggucaacccaaaggccccaucgguugggcuguuauugccauauggccugcggggcuuuguuauauuuguggguuggaccuuacuccuacaaucacuuguucucaacagcccagguguuuccaaauccuauuucacugguugaauucaucugauauucacaguccuugaggcuagugcugagaaugaggugggaggcaccucucacagagggcuagccagucuagauacguaacaaggaaagaauuauuccaagcaacagaagauaucugcguuuuccuggcagauccagagacagagaaacucacaggccccagaucuuggcaggagauaggaagugguaugagcacaaaaggggagcuacgcaccauuaacaaggaaacagaaucugaaaacuccaaagaacacgcacguggauguucccacacccgucugcucuuccacauuccagagacucccggccucuaaaagacaccuuuuuauuauggauaauacuggugguaugcuggcaugcugacacuggguaggggugggguggggugggguugaucuauugccaauuuccuugguauaaauacugcuuccauggcccauuucaagcaaacaacauuuuaacuacuagcccuuaaaaauccucauuauuuaacaaccagcuccugcaagcugguaugaacuggcuccagcacaccacuggauaauacuuaacacacuagaaacccuggagaacaauccgacacccaauauaagcgucucuucuacagaaucccugacagcuguacaccaaaccuguuuugcucuccacuggugagcugcucaugaagucuaacaucugccuagcuuagaaugcccuaaguaugcccacuggagaagugcaggauaagucuacccaucuguggugucuucaacauggcaaccuuuuacauacuugaagacaguggucaugaaccuuggggucuucuccuuucuucuccaugcugaaacauauccccagauccuucuacuacccuucacaucaaaaguauaacagcccacccacaauacaaugaacauaaaaaugucccaaauguaacauaacacaauggggccauuaucucccuugugcuaaucagaguaagaauugucuugcaucacacauaaaauacacuaacacuaaugauagcugauuaguuaaaaaaaaaucacacacacaaaaaaaucucauauguuuuaaggaaguuuaggaauuuguguugagccacauucaaagcuguccugggcugcaugcagccugcaggcuggacaagcuugcucuaaauacuaugcuuuucuuacucuccuaagauugcauuaacccuuuugacagccaccugauacuaaccauucauccuuacauaacuaucucccccaaagccuuucccuccucccagagucuuuuaauauuauuucagguuuuucacauuaauugauuauuaaaauacacuugcuaagacuacauuauucucaccaacuguuauauguuuagcuuggcuucugaccucuacugagaucuucuuuauucuuccaaaggguguuacccacaaacgugcuaaaaagccuuuuaugucuucauucaauucacucacauagauuuuugcagcaucuacaagggaccucgcccucuuuaauccaugcucuuugaguauaguccuuagcuaacauccagccagcggcaccacucuccaaucuauguuucuccaucuugcucacagaauuucacacacuugucaagugccuaguugaaauuuagaauguacuuuuagcaggaaagcacuguauaaagguaaggauuugucuguuauuucccugccagaacucucugagaauguuaugaagaaaauaaaugggauucauuuggcaugccuuuuuccucagugaggucacauggguacccuguggucuuucuaucguugcuuauaaaccacuugccaaagaaauccuguaagaaauuuccuugggaaucaaucacauucagguugaguuuaccacucgggccauauaccagggguguacaagccugucccuagcugucucuccuguguacgacugccaggcgaaguuuccuaaaacaccacuuuuuuuuuuuuuuuuuuuugagacggagucucgcucugucacccaggcuggagcacaguggcgugaucucggcucacugcaaccuccaccuccuggguucaagcguuacuccuaccucagccuucaaaguagcugggauuacaggugcacgccaccacacccagcuaaucuuuguauuuuuaguaaagaugggguuucacaugcuggccaggcuggucucgaacuccugaccucaagugauuugccugccucggccucccaaagugcugggauuacaggcaugagccaucgugccuggccuaaaaugccacuuucuucauguugcccugcuguucagacauuccugacacuauccaaguccugucucugacuaucagggcucuccaucaucagaccccaccuucccacuggccaccauggccucugacuggguuucaggccagcuccuuucuguccaugaccuucgacacuaauuccugcucacacuucccucagcccaggaacucucccugcauccugcccuucucaugcccacuggccuuucagagugcacuucaaguccccuccaccaugaagcuucuccucccaguucuggucuccacugaccuucaccuucuuuauacgacauucauucaaaugcuuacagccauggauucacagaagccuuacuuggaaggcuggacuggagaucaccuaauucagcuuucuuccuaacuaggaagcggguuuacagcucaggggcagcagugcaaugcagcuggagagucacaggggcccugaaugcuggcucugccacugaugagcuggaggccucgugggcuuccuccacuguccugacguucggauaugacacuauacugaaaauccuucagaaacaaaaaagagcaccucagcugugucuacugguauuuuacugguauucuaugccaaaccauauguaaccauaaagguaacuggugggaaggaggggcuccaggcagggcagaccugaaacaaagcuauucaucuacguuagggaucccaacccaacggcaacuguaaauagcuuuggguaaaacaggcuuuugagacauuagaaacaaacaaacaaaauguaaaaguuaaauucaauuagacucugggguaaaauuuaaccuugagacuuuagcacucuccacagugcugaccuuugaagcuggagacagacugagcaaggagaaggaacuagccaggaacuuccucaauucuaucuccugcuuucccgaagcccacccauaaugccggcccacgagucuuccuucaccagcucucagaaauauucuuguccucgacuucugccaagccaguguccacauacagggugaccagggaucaaaccccagaggccugggccaaggggccauucuucaaggaggacucugcccccacgcuugguaccgagucccugacgacccuccucucacacuuggucaucucgcuucagcguccuccccucaugcccaaucugauccagguuucuccugaagucaaacaaacaagcaagcaaaccaaccaaccaaccaaccaaauaucucauguuaaucucacuuugcauucaucuacuuauuuuuccugucauccgcacccuucuuucucaacuacaauaaguagcuugagggguuggguauaguggcucaagccuguaaucccagcaacuuugggaggccaaggcagguggaucaccugaggucaggaguucgagaccagccugaccaacacggcaaaaccccaucucuacuaaaaauauaaaauuagccgggcaugguggugggugccuguaaucccagcuacuagggaggcugaggcaggagaaucgcuugaaccugggaggcagaguuuacagugagccgagaucaagccauugcacuccagccggggcaacacagugagacugucucaaaaaaaaaaaguagcuugaggauuuuucuccugcaaacccuugauuuuuauuccucccacauggcuuccacccuuccugcuauggcgcaacaucccuuucaggggacaacgagggccaccuccgcuggucucuucuuuugguagugaguggcucugagcuguacuguagcccuaaauuucucugcugucucuuuucucacucuccaccauuaacuuaggugccccuuugacuuucaacuaguuuuuccuucuguauauuaauucagccaaagcagaaaugaucaaaaaaccuaaucucugcuacuaacugcucccuauuuuuuuaccuuaaucauuugcauagacauccuacagauaucagcuauuuacaacauaccaacaagcgcucagacuccuuccucugaccuuaauacagagugucucuaacaccaccauaacaacaguuuccaaaggcuuaaaauuccuuccagcucuuuccuugguuacccuucuucuuucucucucuuuuuuuuuuuuuuuuuagacagggucuugcucugucacccaggcuggaaugcagugguacaaucauggcucccugcagccuagaccuccugcgcuuaggugguccucccaccucagccuccugaguagcggggacugcaguugcaugccacuaugccagguugauuuuugaauuuuuuacagagauggaggucuuacuauguugcccaggcugguauugaacuccugggcucaagcaauccuccugccuuggucucccaaagugcugggauuacaggugugacccgcugugcccagaagggcggaccugaaacaaagcuauucaucuacauuagggaucccaacccuucuucuuuuuuaucucacauucaacacuuuuaaaauaaaacccaacaaacuccuuuuauguaaaguaucaggaauuugcugugucuuccccauuuucuuagcuuaugcccuagcuaugcaugcgcugaccuggcucuccuggauagagcacugccuucagccuccuggccacauccauccauccauccauccauccauccauccauccauccauccauccacccauggugcuuagucacaauuuuuauucuacuacucacuaaccagaaaucuacaagcauucuuuauccucauuauauuaccaaacuccuccccucuaaaugagugccugggccuucacuuuuucuuccaugcaugcucacuccauuugggcacccagugccaucugccuagcuaaucugacccagaugcucauuuguucaagguccuucagcauucaguucaguucaaaugucuguaaugugacuuguucauguugagcuuugagaacauucuucagucauuucaugucuucuguuuacaagcagacuguaagcucuuucaagucaauaaggaggucugccuuuuuuuuuuuuuuuuuuaaacacugagcugcccagauggugcuuucaagauagcaauuaugugauagguccugccgauagacagugacuauugggggccagaagccaauuucuguaaggacuggcaaugacacccaaucaaagacacacaagagaaaagcguagggaugacaugguagccuguuucgggagacugccauugucaaaauaauucacuaguguacugaagagcaauguuuucccuguuuuguuccuccuucaaagaaaaggucaagaagaguguuuaaaaaaaaaaucacaguuuaaaaugagggaggaaugucaagcuauuauuuccagcuaccauggguucaggccuucugagacuugaggagcaggggcugccgugguguguccucugaaagaggccuucgccacgaaagcacagaagacccagggcucacuggaaccaucaaggguccucugguucuucuuaaagucaaagauuaggugccaaaaugucaguuuauguacuggcaaauaucaucuucuuccuuggggcuuuaaguacucagauaagaugcaacagaaugaacugucccacagaguaaauaacuuucugggaguagguaaaagacucucagaaaagcagucacucuuuuagaaggccacaaaugaauacaaucauuuguuaagaggcaccacaguacaacaagacaccauauuuuggggauauggacugaugccuucuaguccuccauaaagugcugauauaacaaaaagauguuagaaauguauuagacaacuucguaacaacaugaagaaaacaaaauuuaaaaaauccacauucuggcuggguacaguggcucacaccuauaauccuagcaguuugggaggccgaggcagguagacggccugaggucaggaguucuagaccagccuggccaaaauggcgaaacccgucucugcugcuauacaaaaauuagcuggguguaguggcaggauccuguaaucccagcuacucaggaggcugaggcagaagaaucgcuugaaccuuguuggggggcagagguugcagugagccgagauugcgccacugcacuccagccugggcaacagagcgagacuccuucuuaaaaaaaaaaaacaaaacaaaaaaacuccacacucuaacucuaacacaauaaauuuucauuuaacuccuuaaauacauaguuguaaucauaguaucauauaauuuugcauucuuuuugucacuugauagccuauaguuacccuugcauaguuuuggucuuucuacuuauaaucaaguccaccaauuauuaauauuccaucuuauaaacuuugucacugcucauuugcugauuuugguuguuuuuaauauuuaaucuuuagaaacaguuggauaaucacauauacacauauagcuuuuaaaaaauuaauuacuuauaauuuuaaggaaugagaucaucagguaaaaggauauaaaaauauucauggcuggggauaugauuugaaaaacugaccuuuagaagaacuguacacauacauaguuuuuaauuaauuuuauacuuuuugaucuacccuuugugacaacuaguaacacugcagagugucacuaaucuggugcugaaucacugcugcaggauccuaauguagugacugccauuucagaagugguacugacucacuagcuuuuauaaucagaaaacaacaacaaagaaugagcugcuuuuuagaaacauugccagauucucgggaaaauauuuguacauuuguauaauauauaaaacauauugguuaauuuccuuuauacauuagaacaaucuaguuucauagguguuaaguaguaaauauauucuauuuuacuuuggcuuaucuuuuagguaagaacaaagaaagcaauuacuuguggcugggagcgguggcucgcaccuguaaucccagcagcacuuugggaggccgagauggguggaucaccugaggucaggaguucgagaccagccugaccaauaugaugaaacccugucucuacuaaaaauacaaaaauuagccgggugugauggcaugcacugucaucucagcuacucggaaggcugagacaggcgaucgcuugaacccaggagguggagguugcagcaagccgagaucaaaccauugcacuccagccugggugacaagcgcaaaacuccaucucaaaaaaaaaaaaaaaaagcaagcaagcaagcaguuaccugcauaugauaugcaacuaaaaucaacgguaucuuaugcaauaauagauaaccucaguguuaacuaaguaaguauaauuaaugugaaaugcuauuuuaaaaagguaugauuuacuggccgagugcaguggcucacaccuguaaucccagcacuuugggaggccgagguggguggaucacgaggucaggagaucaagaccauccuggcuaacauggugaaaccccaucucuacuaaaaauacaaaaaaauuagcugggcaugguggugugugccuguaguuccagcuacucgggaggcugaggcaggagaauggcgugaacccgggaggcagagcuugcagugagcaagcuccagugagaucgcgccacugcacuccagccugggugacagagcaaggcucugucucaaaaaaaaaaaaaaagguaugauuuacuuuucauuuaacugggugucuggugagacauuucucaccugaggcauggauaaauaucugaaguuugauuagaaaaaauuaacaaauggaaucuauucuguuagaguuuaaugccauuaauuuugugauuaaaaguuacaaaugcuauucaaaauuucugggucugacugguuacaguugcacauuaaauuggauauuagcuguucuauuuaguugagauaaaauccagcuuugaauccaaaugguuaaaaauggugaaguaaaagaagacugaugacuguuuuagaaaugcaauuauuuacaugauuggcuuuugucuguaugccuuucaaaugucaagauauucugaaaauaaucaaauaaccaugaaagaauucacguggaaggaucacuuuaaccugugccuuauauaauguacucaauuuacagaaaagccaauuccacguucuuauccaaaacaauaaaaucaaugaugcagccuuaaaaucucuuucucuggauuaaucccuuuaccuaacaacuacauucuaaaaacugaggacuuaucauucuggauagggagugaccuuuugggaagaaucacagaguccucuccccagcccgagaccacuaucaauccccuuggcuagggggucaacuguguacucagcuuccuuuuaagucauuucaaaggaugaacaauaaacagaagccgugcucucccaauuugaggcauuggugaucuggcaggggagauaacacccaaauagggagauaauuguauugugacuguacauaauuaaaggcagcggugacaguaauaagcccguuuuuucuuuuguagacugagagagaaagaucuuaaaaaguugucuucuugaauucagccuuucaagacucauuggugaaugacaaaaugagacaucugguucuccaaaauguaucuguugagcaugguucuuacacggaugguaucuggcaaauagagaugagcaugagaccacauaaaugccacaggaaauucccaggucucacugaacuguuucauucgcaaaaacacugucacagccagugggcgggugggggggacacauuaagugaugaaauaaaacguacuaaagcacagaaugucagauacuucacacacacacaaaaacuacaauuacgcuaggcuacaucaauuaucauggaauaaaaagauuacaaacauuacaaaugugugagugugguuuuuuuaggaaauuaauuaaauauaaagagcuauugaugguggucauauggcaaugaggucaacacgaaagccaggcacuagaguacccauggaugaauuuucaacuggaauaaucaagcuuuauuuacuuuuuguggccaugauuuuaaccuuuuacuuauugagaugccaagacaaaucaaaacggcacacaauuaaccuguuaaauuuauuuuucacaaggccugcuaaaagaugugguugaaauuacucucaaauugcuuucggagguuuggcaagugagacaauacaagaaaaacuaaacauuuucaagucauauuguuuugagaggcgggccugagaagguucaaguccuaaaaggcuguuguccuacaaggcuguuuguuuuuccgggcggguugggguugccagacucaaagagucccccugaucugcauucugaauugagauucuggacauugccacccagcucuucauaugucuaaggaaacuguggcuggggaugguggcucacaccugugaccccagcauugugguaggcugaagagggaggaucauuugaggccaagaguucaagaccagccagggcaucauaacgagagccuaucucuacaaaaaaucaguuaaaaaaaaaaauuagcugggcaugauggcacacaccuguagucccagcuacuccaggaggauugcuugagccuaggagacugagguugcagugagccaugauugcaccacugcacuccagccugggugauagagcaagacccugucuugaaaaaaaaaaagaacaaaaaaagugaaggaaaaauaaaaaaaaaugguguaauuauuugauuccugcugacugcagcuauuaaaaagggagguguguagcuaccaccuuugcauucccaaucauucaaaauagguuuuauuucuuuuucuuuucuuucuuucuuucuuucuuucuuucuuuuuuuuuuuuuuuuuuuuuugaggcagagucuugcucugcuguccaggcuggagugcaauggcacaaucucagcucacugcccucuccgccuuccagauucaagcaauucugccucagccacccuaguggcggggauuacaggccugcgccaccaugccuggcuaauuuuuguauuuuugguagagacaggguuuugccacguuguccaggcuggucuccaacuccuggccucaagugauuugcccgccucagccuccccaagugcugggauuacagguguaagccaccgcacccggcccaaaauagguuuuuaaagccaauuuuaaauaccuucuaguucucauuacaacuugaaaaauaacacuuuaaaacuccacaacuggaaacaaugaaccaaaagagugaucugcuacagaaagaacauuaagauauuuuuauaauacuugaaaacaaaguauuacaacuggaauucagggaauugaaauuggcaugucaaacaauaauagaagauucuaaagguaaaaaguagaauaauuaaaagaaauaguaauuauaccaaagacagguuuauagaaaacaacacuggugaacuuuguauuuacugacuuacuuaaaaagaacuucuagcgugacauuuuuucuaacauuguaauugcccugcaccuaucuuuacaugagucuccauaaacacugcugaauguagaucagaaaauugaagaugauuaagaacuguuuaucugaucuguguaccaaaauggauuagacucauugguaguacuuucaguugagaauaaaguuuuuuuuuuugacagagucucucgcugugccacccaggcuagagugcaauggcaugaucucggcucacugcaaccuccgucuccugguucaagcaauucuccugccucauccuuccaaguagcugggauuacaggcgcacgccaccaccccagcuaauuuuuuugcauuuuuaguagagacaggguuucaccauguuggccaggcuggucucgaacgaccucaggugaucugccugccucggccucccaaagugcugggauuauaggugugcgccacugcacccggcugagaaucaaguuuuaaugaagugacuuuaaugcauuuaugagaaauggucaucacuaaaaucuaagccuugaaugugauaguucagauucaaggcaaagaauuuuuuaauuccucccauuuguuugcuacuuauaccucugguuuaaaaagauacaucugaaguuuaacauuauaugauucuagauuuuuauaaaagauuuuuaugaguuucuuauaguuuaugucuauagcuuacucauucauuguucaauauuuaucuagugaccacaguguaugcugaacacugauuuagaugcuaaagauaaugcagggaauaaaacagaugauucgccuacagaugacucccugcccucacggaauuuacaucuaccucauaacacuugaagauaaguagaauugauuagcuagugauuuaguuaccugaaaaucaaaugcuacauuuauguaaguuggcaugaaauuauaaaauaucuuucauagcgaggaccagucaagaugauaaaaacuacuggguaaguucuaaauaugucauaccaaguaaccauuaacuauuuguaaaaaaaauggucaguuuaagucuugacuuagaacaugaagacuucaaaaaaaauaauuacaaguaacuuuuuuuuuugagauggaguuucgcucuuguagcuccagcuggagugcaauggcgcgaucucggcucacugcaaccucugccuccuggguucaggugauucuccugccucagccuccugaguagcuacaggcgcugccaccacgcccgccuaauuuuuuguauuuucaguagugaugggguuucgccauguuggccaggcuggucucgaacuccugaccucaggugauccacccgcuucagccucccaaagugcugggauuacaggcaugagccaccgcgccuggccacaaguaacauuuuuauucacuucuggugauuaauuagaaucacugaaccagaaucauaguuuauuuaaucaucgcagguugucuucuacaugacuaccucaucuuuaacuucuguauuaauaaagaauuugcacuuucacuauucucagucaugguaugacucaauguuuuagaacuuaguauccuccuugcaaaaaguaaugcgagcuggaacaaagcccauaagguaacauuuaccaccuggaacaaucaaaacaaauauuuuaacagcaauagauuuguggaggacagaaaguccuaguggcuagaacaguggugauuagaaaagcagugguuagaacuuuuuuuuuuuuuuuaaugaaaaagaugggagggaagauggccacuaaauuguauuugaaaccaaaagaagugacccaucugcucuggggcccguggagagagaagagagugcagauuacgaacugggaaugcagaagacagaaagaugaucagcuggaaacaaacugaaggaguguguuggcuagcaacacauaaugagaguaggggcaggcuucugaccuugaugguggcggagccgcauucucucgcauaaucugucaguucucucucucucuuacaggagaccagccugucugggaaaaagucacuuagcuaccaaugccucugagcauacggccaaauucccccaaccuccucucugaucagcuucugccucuuuuuguaacacuaaguggguuggggaagccccuggaggcugagggcugucauaggccaucugugugaggacucccaggggcugagggagcugugaggagggacguagagacugggcugacaccaggugcuuaccauuaucauguaaguucucuaacuguuucauguggggucuucccuauccuucuaccuacagugaugguagguaaccugaagaagucugacuuuuuaaaauuggcacagagcaaagcccauuccuaaggaauguuaaaaaauuugcugacuuuggacagggcgugguggcucacaucuguaaucccagcacuuugggagggugagccagguggaucacuugaggucaggaguucaagaccagccuggccaccauggugaaacccuaucuguacuaaaaaaaaaaaaaaaaaaaaaaaaaaaaaaaaaauuagcuaggcagacugcagacuacgccuguagucccagcaacucgggaggcugaggcagaacaaucguuugagcugaggaggcagagguugcagugagaugagccuacugcacuucagcccggaugacagagugagacugucucaaaaaaaaaaaaaagaaaaauuugcugacuuuuggcuggagauuuuaauuacaaauauaguagagaaguuaagauuaauauauaaaaaagacggugccaauaacuaaauguugugcggcacuuuuuaguuuauaaggaaucuucccuacaucaucucauuuggugcucagagcugugguggggaaggccucucaucagcucagauuugacacaccuaauguggagugagguggguguuugguuuuucaaucuuuuaauucuuuuccauuauuccacacauaaagcaauaagaaaaauuaaaugcuaagccguaugguauugauuagguaaaacggugacuuaaaggagagcucgguagugucagaagagcgcaaauccauccuggggaugagaugcgugcugagccugaaagagcaagguuuuaaacggaaggccuuccaccuguggagagggcaggaagaaaggcaugaggaugggaagcagacaggcuacgugggaaaggcgagaacagauuccaggcagcauggugcuagcccaaagcagcaaaccuggcauggaccaaauucuggcuccuuuccacgaaaggaagaaaaaugaacacaguaaucuauuaaucaauuagucuucuguuuucgacuucaauucccagagcuaauuaaucacuucauuaaguaggagauucucucuugguuuaggucauuaaugaauauuacuaaguaaagccugguuuauauuucuaaaacuuuugcauuucaaacuccugguagcgcuuacgaugaagauguaaaagaggugccacauauggacuggagguuccaucccagcugccgcuuccugccauccacccuggcucuucucuggaacagccaucuccggaccuguccuggaaguucgcacacuucugcauuugccuuugucaucguaaggcuaaugcugggaaacgugcucacgucuugauuguauuuaugcugugucuaauuuuaguucuauuguaccaaaaugacugacauggguuuaauugcuugauccaauagaugcuggugcaucagaccaacagaagcuugcucuuaccguuauuaaccugauauauucugacuaauucacagaaugagggagaguauguuuucuucuuacagcacauccugcucagugacugugucaucaccaaacauuuaaaaagaguccguuauguuaaaaauauuaugcuaaccaccgagaacacaaagagguguggacacagucacugaccuucaggguacugacagguugugcaacaggucacuuuacaaacaagaccagaggacagcauaugaaaaacagugagcaaggccacagguacuaggcgcuuggagucuggggccccagacuugcuuccauauuuaaaugucggcacucacuuugcugccagugacucucaucuuauuucucacaugcggacucgacacagcaugaggggcaggcagguggggagguggcagcaaaacaagaaugcaugguucugaccucaagaagccugagaguuacuguggagaaaagaaaaaauaaucugaaaacaguuacaaaguugaugucagcaagaaccagacaccaugcugugaguuauauguuugugcaaagaucaccagagaggaaguuagcaugugaccgauugggugggguugaccugagguuucuggagcugugagguggacccccaaucuagugacaugaacugggacugggagaaggacaaggcuuucuggccuaggagguaauacuugccaaccccaacgcuuagauaagacucaaaaugaugcucuuucuucaaugaugccugaacagauggcuguaauauacuccuaauugguuuucucauacuuggucccuuucccaaaagcuccaguccacugaaucauucucaugucaacuuuccuaaaccuuacauaucuccaaucaggucagucgucuccugaucaaaagagaaccaaguaugcaucgucacuuugcaauggggcccccuaagguaacugcgcucauuuuuguucugugccucuauggcagaguucagcaaacacuuuccauaaagaaacaaauacuaagucuuuucggcuuaccaggcuaucuauacaccgcaacuccucucugcugcaucuacucaucucugcugacguggcacaagaguugccagagaccacagguacaugaauggaugugguuggccuguggacccuaguuugcuaacccuggcaagggaaucccugggcucacccaugcugaacuucugguugcccuccugcgggugucugagccuacacaauagucuccuuaccagaaguauccucacauccaucacugacagucaagagcccuacacuuuccucugcccgccucacagauuuccaucacaucuuugugcucacccaaugugauccauuuaacagauauuuguugguuacccaccaugugccaagcaccucccagauacuggguauacaaagugaaugacagcccuuuuucugugagcacuaagaucuaguagggaagaacaaacagaucuguuuauuugguucaacagaccaaagcuagauaugagucccccuucuuccaacaugccauagcacuucuuuucugcaaugaaacacucaguaggcaucucuggagagcaggugaagugcucagaagguaccccacacaguuccuuguacacaguagguacucgaaaaacauguacuaaacugaauuaaacugaaauuaauagugccauacaucuaauugacaaaugaacacaaguauuagaaccauaguauuucuuuuuuucuuuuucuuuuuuuuuuuuuugagauaguuuugcucuuguugcccaggcuggagugcaauggcaugaucucggcucacugcaaccuccgccuccuggguucaagugauucuacugcuucagccucccgaguagcugggauuacaggcaugcaccaccacaccuggcuaauuuugcauuuuuaguggagaugggguuucaccauguuggccaggcuggucucgaacuccugaccucaggugauccacccaccucggccuuccaaagugcugggauuacaggcgugagccaccacgcccggccaaaccauaguauuucuaaugugggauguguguguauguguguguguguguauguagagagagaggggcugauauuauauauauuauauauauauauggagacacacacacacacacacacauauauacacauuuuuuaaacaacaauaaugauccugugaccauccuucuagcuggguaaagugacuucauuuagugagaaaaugucuuaguucguuugugcuacuauaaaacaacacccaacauuggguaauuuauaaaguuuauuucucacaguucugguggcugggaaguucaagaucaaggugccggcauuuggugucuggggagggccuucuugcugagcccucacacagcggaaggcagaaggucaagagagcaagcuaagcuaacagcuacaugaagccacuuuucuauuauuuuuuuuaaauuauacuuuaaguucugggauacaugugcagaacgugcagguuugguacauagguauacaugugcuaugaugguuugcugcacccaucaaccaguuaucuacauuagguauuuccccuaaugcuaucccuccccuagcccgccacaguaauggaauugcugggucaaaugguauuccugguucuagauccuugaggaaucaccacacugucuuccacaaugguugaacuaauuuacacucccaacaacagugugaaaguguuccuauuucuccacauccucuccagcaucuguuguuuccugacuuuuuaaugaucgccauucuaacuggugugagaugguaucucauugugguuuugauuugcauuucucugaugaccagugaugaugagcuuuuuuucauauguuuguuggcugcauagaugucuucuuucgagaagugucuguucauauccuucggccacuuuuugaugggguuguuuguuuuuuucuuguaaauuuguuuaaguucuuuguagauucuggauauuagcccuuugucagauggauagauugcaaaauuuuucucccauucuguagguugccugcucacugugaugauaguuucuuuugcugugcagaagcucuuuaguuuaauuagaucccauuugucaauuuuggcuuuuguugccauugcuuuugguguuuuagucaugaagucuuugccaugccuauguccugaaugguauugccuagguuuucuucuaggguuuuuauauuuuuguauaagguauaaggaagggguccaguuucaguuuucugcauauggcuagccaguuuucccaacaucauuuauuaaauagggaauccuuccccacugcuaguuuuugacaggucugucggagaucagaugguugcagauguguggcauuauuucugaggccucuguuuuguuccauuggucuauauaacuguuuugguaccaguaccaugcuguuuugguuacuguagccuuguaguauaguuugaagucagguagcaugaugccgcuagcuuuguucuuuuugcuuaggauugucuuggcuauacaggcucuuuuuugguuccauaugaaauuuaauucugugaagaaagucagugguagcuugauggggauagcacugaaucuauaaauuacuuugggcaguauggccauuuuuacaauauuuauucuuccuauccaugagcauggaauguucuuccauuuguuuguauccucuucuauuucauugagcagugguuuguaguucuccuugaagagguccuucacaucccuuguaaguuggauuccuagguauuuuauucucuuuauagcaauugugacugggaguucacucaugauuuggcucucuguuugucuauuauugguguauaagaaugcuugugauuucugcacauugauuuuguauccugagacuuugcugaaguugcuuaucagcuuaaggagauuuugggcugagacgaugggguuuuuuaaacacacaaucaugucaucugcaaagagagacgauuugauuuccucucuuccuacuugaauacguuuuauuucuuucucuugccggauugcccuggccagaacuuccaauacuauguugaauaggcguggugagagagggcauccuugucuugugccaguuuucaaagggaaugaugaagccucuuuucuaaagggccuuaaacccauucaccagggagaagccuucacggccuaaucaccucuuaaaggcccuaucuuuuaauacucucacauuggcaacaccugaauuuugaaggggacccauuaaaaccauagcaacaaacaauuauaaagauuaugcuaagaagauguggguacuucggguagacagagaaguguaaaugggguuaggaauugcauuaggaacacuauaugcucagaaauaccaaucuuuaaauuaaacaaccuaucgaacugccuuuacauggugcacugcugguuauaaaugugcaauaccugauggggggaaaauuccaggagagcuuauaaaagcaugcuagaagcauuaaaauuuuccagccauuucauuauuugucauucagcaaauguuaauauuucucuuuguauuccuacugaagcuugaaauuaacauggcuuuuuguuuauuucuucauuucugccuccuugucagcucaucucaggaaugcaguugguuagcuagcugcugcagagccaaauaaaaaagccuaaagaaacucaaacauugacuggcaaaaggcucugcaugaaaaggcauuuguuuuuuaaccucucagaaguagaacauuuagcuuaaaauaaauauuuaacaucuaggaugcuuuuaucaagaaucauuuugacauggacauuagucuuuaucccaaaagccagauacccuggggagcaaaguucgcugcaaauguaugcaaaggaauagcgugugcaggauacaaggaggccggaaggccggaaagcagggggaguacaggauuuccuaagguaaaccgaucucuuaagaaugccuguuccccucccgcaaauaaucauuaaacagaauucagcauaaguucagcauuuucaagucacucagggacacagguacccgggaauguucccucugccccuggacuguuuguguuggauuccagccuggcuccuccugucccccgacugcaggacuguuucccacauggaaucacgauucagucacgauuaacacccuccccacagcguggcuggugcccaagcagccccaguagggcuugggccuuguggaggagagcccuccccugggugaacaacccagacaagccaagucaacucugguuuugggaucgaacauuaaauucacgucacuggcuuuaauucuuuccuuaccaggugccuuggguuuugaggggaugcuguuuuaugagggcuuuugugagggccagggauguuuucaaaacuacagggcuuggcagacauggguacugaauguccccaggaacaaaguaaccagggauuguguccaaaacuggcuugaagaaaugccucaaauguagcaaaucauuuuuuaaaauucauguuaagaucggccaacagccuucagaagacagaaccuuuuucaugucuguggcauguguguguucacgugugcuuccugaauuucccaaccaggacaugaagagcacagcccacugggauuuuuuugcugguggcuucccauuugggaacaggcucugagagacaaucugagcgggcuuccuguguugucugaggccagcuuccacagggcugccaucagucagcccauuacucagccaugggcccagugaggcagccacagggccacugugcuacaagcacccuccccgccccugguuuucgugccauggguuuccuguggagaacaucgucacgcuauauucaucuuuccucuuagcuggcgcugagucacuccaugauaaagccacucuucaagcucuauuuuggguacacuuuacacucugagggagccgguaacacaucucuccugauauaaauguacaggagagcccgucaaccacagcucucugauggagccuacaaguugcaauugggucaauguuuucacugccacagcacuuaaucacuugaaaacuuuaucuaaacuugugaaguuuucccugcuuuuagcuuuucauucuuuuuggccuguuuugauaacagaagcaugcugccguccaucccaggucagagcugguggcaggagagaggugggugggagaggagggaggacacagcccacuucucagguccuucuaaauggucuuuauuagcggauuucaaaauuuugcagugaaauuaucagaacaccuggcaccuccacauuuaaauggaagcacaaacccaauuccaaagccaaaggcuucuuccggaaccccugcuguuuucuauaaucagcgccagugcugcacuccccucgccuccucccgcucagugugggugucaagaggugaccacaaaagaggcugcucaacaucaccugagaacaaagccuccuuuccugcaauuccaaauugacuuuugcuguacaagaaaauuaaggaugcuguggcuaccaccagagagcacauuuaaaacuccucacaugaaaggcccuugcacuccugggaaaaauauucucacuuuaaggagagucacagcgugcggagccuggacuuuccaugcaccaagcccuggguccaugcagccaccacugcuccagggagcagaaggucugauguucucugagcuggaaucuuccuacauuucuuuguccacugacugggggcccugguucuaggacagcaucuccccuggugcuggaggugcucaaaccaccauggccuggccugagugggcucuaucuuuuccagggcaggcaucacaguggagcccucggaucuggcugacacuccuguuacucgugcacggcuuaugucaugcugguacagacccugggccauguagaggacucauggugagaugccaauguggcuacugccccagcuucugcccucacuuggcacauaccauagaccacguugcuuccacuccucagaaggaaaacccccucuauugccaagcuguucaauauucacgacaggcaagguccuuaugauucaguccuguuaccucuccagccucaucauccaccacaugcccucacucacucacucaucaaacauccacugagagcccauagugagucaagaccugggcuuggcaccaggaacacuggguaaaacccaucucuagccucaagaaacucauccaugagcagggguagccagaccuguaacuauacaugugcaaugagggguuggaaugaagggcucuguugaggcaccuaggacagagaugucaguuccaccuucuucaggugcaguguggacaccaccucuuacgggaagcuuucccucaucccucccgcugcgugccugugcccuccucugggucccugugguggguggggccguaaugacugugcuugacugcuccucaagagcaggaacacuguuuuacucaucuccuccccacagcacccugcaccauguccugccacacaguaagugcuccaugcauguuuauuguuucaaaugcgccuaaugguaaaucucagacucugagucaauggcaaucucccaaaagcacuguguuaaggacccgcguuccccuuucuucuaacagaggggacagaaggcgcuggaagacuccagucaggacaugugacugcuggagcaagccuagcugcucaugagcugugugcauuccagagaugcuucuggccccucuugccccuuguccccuccucuguaggacaguggagggcccccuggcaucacagggccacagacaggaagugggguggagcaagagaggcugguccuuucugggaaaugacagagcagcaagaaccagacuuucuggugggagagaaaggagaauguguguucucucuuaaauauaaggcauuuuuaccaccaacacgccacucaguaaggucacuccuggguugaugaacaaaaccuugcuguuuguacaauauuuagcauuaccuggaagggccuggcucucaccucggagccuggacgugaccugcuucaugcuuaacuauauaacacgcgugccacacacgaggauaaaaaugcgaacagagacugcauuagcugccuguuaauguguaacaagguaccgcaaaacuuagugccuuaaaauaaccauuacuucaugguugcucuaggccagugcuucagcagcggccuagccgggucuggugcagggucccucaugaggcugcgaucaagauguuuccaagcuccccaaggcagcugcggucugugagccucagcuccucccuacgggggccuccacaggacugcucacaacacgggagccaaagcgagaaauaccagagagagagacacacgcauaccaagacagaagcugcagaaccucucagaaucuaaucuuggaagugaaacaccgucauuucugccagauucucugggucacacagaccaauccuggugaauaccaggaggugagggucauuaggggccuuccuggagguuggcugccacugucauacccuggcaauggcauucauaccauuggcaggcaauggcaugucauacagcuucaugaggguuggcuauguccuuuccagaguaaaauagauagauucauuauucuguauuacaccaacaguuaggucuuacucacucuccugugguuuugaagggcuacaaauacuuuagaaaauaguuuuaaacacugaaugggcuuggaauuuggggaggggcauauauauagagagacauaccucauuauauugccccuagcuugacugagcuuugcagauaccaugauuuuuuuuuuuuacacaaauugaagguuuguggcaaccgugcaucgagccggucuaucaguaccauuuuuccaaaagcaugugcucacuucaugucucugugccacauuuugguaauucucacaauauuucaaacuuuuucaucauugugauaucuguuauggugaccugugauuaaugaucuuugauguuacuauuguaaugguacuugugugccaugaauugcacccauauaagauggcaaacuuaaucaaacaugugguguguauuccaucuaugagcuguucccccaucucucuccuucuucucgggccucucucuucucugagauacaauaauauggaaauuaggccaauuaauaauccuacaaugacuucuaaguguucaagcgaaagaaagaguugcaugucucucauuuuaaaucaaaagcuaguaaugauugagcuuagugaggaagguaugucaaaagcugacacagggcugguugugguggcucaugccuguaaucccagcacuuugggaggcuaaggcgggaggacugcuugaggccaggaguuugagaccagccuggaugacacagugagacccuaucucuacaaacaaaauauuuuaaaaaauuagcuggacauagugauguguaccuauaguccuagguacucuggaugcaggagaaucacuugaauccaggaguuugagguugcaguagccuaugauugcaccaaugcacuccagccuggacaacagagagagacugucuuaauaacauaaaaaaagcugagacaggcugaaugcuaggucucuugugccaaacagccaaguugugaaugcaaagaaaacauucuugaaagaaauuaaaagugcuacuccagugaacacaggaaugauaagaaaguaaaauggccuuacugcugauauggagaagguuuuuuaguggucuggauagaagauccaaccagccacaacacucccuucagccaaagccuaauccagaacaaaucccuaacucuucaauucuguggaagcuaagagaggugaggaaauuguagaaaaaaaguuugcagcuaucagagguugguucauaagguuuaaggaaauaagccaucuccauaacauaaaaaugcaaagggaagcagcaagugcccauacagaagcugcagcaaguuauccagaagaucuggcuaagaucauugaugaagguggcuacaugaaacaacagauuuucuuuuuuguuugagacagggucucacucugucgcucaggcuggagggcaguggcacgaucucagcucacaacagccucaaccuccugggcucaggugauccucccaccucagccucucaaguagcugggauuacaggcaugcaacaccacagccagcuaauuuuuuguacagacaagguuucgccauguugcccaggcuggucucaaacuccugggcucaagcaauccuccuuccucagcuucccaaagugcugggauuacagguaugagccaccacacccggccaacagguuuucaauguagaugaaacagccgucuauuggaagaagaugccaucuaggacuuucguagcuagaggggagaagucaaugccuggcuucaaagauucaaaggacaggcuugcucucuuguuaagggcugaugcagcuggugacuuuaagucgaagccagugcucauuuaccauucugaaaauccuaagguccuuaagaauugugcuaaaucuacuuugccugugcuuuauaaauggaacugcaaagccuagaugacaggacaucuguuuaaagccugguuuacugaauauuuuaagcccauuguugagaccuacuucucagaacaaaaagauuucuuucaagauaugacugcucauugacaauguaccuagucacccaggaucucugauggagauguacaagauuaaugugauuucaugccugcuaacacaacauccauucuguagcccauagaucaagggguaauuuugucuuucaugucuuauuauuuaagaaacacaucuuguaagccuauagcugccauagacagugaguccucugauggaucuggccaaaguaaauugaaagucuucuggaaagcauuccccauucuaaaugccauuaagaacagucaugauucauggaaagacgucaacaugucaacauuaauaggaguuuggaagagguugauuccaaccuacauggaugacuuugaaggguucaagacuucagugguguaagucacuguaaaugagguagaaauaggaagagaaccagaaagagaaguggagcugaagaugugacugaauugcugcacucucaugaucaaacuuaaauggaugaggaguugcuucuuaugaacgagcaaaaaaaguaguuucuugagauggaaucuauuucuggugaagaugcugugaauauuguugaaaugauaacaaaggauuuagaauauuugauaugguuuggcuguguccccacccaaaucucaucuugaauuguaguucccaucauccccaaguguugugagagggaccuggugggagguaauugaaucaugggggcaguugcauucaugcuguucucaugacagugaguucucaugagaucugaugguuuuauaaggggcuuuccucccacuuugcucuguacuucuccuugcugcugccaugugaagaaggauguguuugcuucaccuucugccaugauuguaaguuuucuaagggcuccccagcccugugaaacugugagucaauuaaaccucuuuccuuuuuaaauuacccagucucggguauuucuucauagcagcgugagaacagacuaauacaauauuccauaagccucguugauaaagcaguggcagggucugaaaggacugacuccaaauuugaaaguucuacuguggcucaaauguuaucaaacagcaucacaugcuacagagaacucuuucgugaagggaagagucaagugaugcagcaaacuucacugcugucauuuugacaaaauugccacagccaccccaaccuuuagcauccaccauccugaucagucagcaacgauugacaucgagguaagacccuccaaccagcaaaaagauuaugacucacugaaggcccagaagaucacuagcauuuuuagcaaugaaguauuuuauucauucauucauucauuuauuuauuuaaaaaugaugucuugcuauguuggccagacuggucucaacucaucacuacaagcaauucuucugcuucagccucccaaguagcugggauuaaaggugcaagccuagcucuagcauuuuaaaauuagcucuaguauuuuaaaauuaaguaugugcaauuuuuuagacaugauauagcauacaaaugagguaaguacaaaugauugcacacaaagacuacacuacaguuuuuuauaugcacuaagaaccacaauaaugcaugugauucacuguauugcaauauucacuuuauugagguggucugaaaccaagccugcaauaucucugagguauuuauaauaugccaggcauuauuaggugguugggauauagaauacauuggugaagaaaacagacuaacauaguaaauacaggauauuuaauguugcuuaagaauuuugguuuuaauuuuaacacaggguaugggugauaagcugcccccaauucuugucucagucuaucccaucccaucucauccuaucccaugucuaaagucccucagcaggcaccccucacuaggauugguaugccaagaaccugggagaaaauacuagucuccuggauuccuaaacuugcacaccucaggcaguacagggcagaggaaccagcucuuccugucccaggcuaaacacaauucuggcugaaacagcuuagauuugugcuuaauaauauucuggggcaguuugggggcugguggauguaugggugauugggagaaggauccagagaugagaggagaugaaauuucccagagagaaggcaaagauccuugggaagaaccagauucuaggaucuuccuuagccaagaucugcaaagcugugcuugagcacauccagggauaagcucacccuuguucucaagcagcauggauucuugucaccccaacucacacaggcagcccauugggccugcagggacaauccacugggccaacacacacacacacgcagcccauugggccugcagggacaauccacugggcacacacacaccccaucccucuucuugcccucugaagccuggccagaccaggccugugugagcuccuccucuuucgugaccacgugaaucuggagcugaugacucauucaucgagaucaagaggcacucccuccucucauucucuuggucuggcagucuccuccacuuuuccacuuuuuccuuuucaaacuccucuccuuaccgcucccccuaacugggagugauugucaaguaaaugauaacuugaccucugaauaucagaagcaguugaagacagcuagagacuggaagacacaggaagguguggaagaacgggcuucucacucccucaacucuagagucugggccaaugucaagggccaaaaggcaggagcugauggcugcugccgguucucuuccaagggcuaugguuggggguaugaucccaguuaaagggagauguuuaagagggcugguaggcuacuuauuuucaucugcagccuacaaucuuagcaucaaguccuccccugaauaauguggcacaggauaauauuuguuaucaaucauaugccucaauugacuauuuuuaacaccagagaugaguucccauguaaaaucacuuucccucuucccaccucccaccucaccaaaauccagacagcaaaacuuaaaaauacuaauguucauuauaagacggauucugccugcaugugaauuuaaugccaccaguauagaacaugaugaaaaaaaagucaaagugaccaacaacuuguauaagacuucuggguacauucaggggcuuauguacaguaaaauaccacaauuuuauuuccagucuuacuaagaguuuauaccuuaugguaccacuacaagucaaaccugaauauuaacaaggcaaaugaagagaaacucucaaaaugaaaacuuuccuaacugccaagugguggaccaagagccaaagcuaaaguugaaucuucgugcagccuggagacgcccgaugagugccacguuuggcugggguguaaaugcagccacggaccccacagagugcuccccaagagcuggggaaaugaacugcugguagggaaaacugcuaucgggaaaacuuagaagucaggaaaugcaaucagagaaaagcggucauauuuuguuggcguuaacagggcugccuaauucaaucaucacaaugaagcccacauaccaaauggaaccuugaaguucucaggauuaagauuuaggcaguccaagugugucauuuugaaguuauguauguuauaugcugucuuauaagaaagaauuggcuugcuauccaauuuggaaugaaaauaaauauuucuugugaaacagcccagaauuacuuucacacaacaucauuuauauguauuagcuaaauugcaaguuccucacagguaacaucuuccugucucaguuaccuuaugucuguugauggugaagaauacugggucugcuaugggggaggugugcagaaauguuucucaccugaugagcccagccuggaacuuuccuauuacaaaccugcccaucucugccacacacagcuucccauugguccaagggucauaucuggcccuacauguaaucguguggcucagaaaucccaagcuauggcuugcgcuuugcuugaagaggagccaggacuaacuggggucuggagacuucuaacuccaaaaugagaaaaagaggacugggaaggagucagguggugagucaaucaacaggagagcggcagagcuucccugacaggacagggacaaaggccucaggcagccugugagggggaaagacgcuggguggauguccuugcucaccauccacagugagagcucacgcagggugccgggcaccucggugugcacagggggcugggggagccucaagguggggcccaaucuaugcagguccaugagaagcggugggggcgggggugggggagugcggggagggacagcugacacagcagguuuaaagggaugccaggggaaagcgcuugggaaaugagcugcacccagaaagcccucagacccauuccugaacacuugcuugcccaacuacgucaguguaaagggguggugaaugcaucaacacaagggccauuugcuagagcaucggucccuauuuagugguaugagcagugcacacagagucaggggagggcagagggccaagaagaguagggacauacagcaggcuguggacagaugcuggcuucccuaugcuacaguuuugauguuugucccccuccaaucuuauguugaaaugugaucuccaguguuggaggugggaacuaaugggagguauuugggucauggggacagaucccucaugaacggcuuaguguuguccucgcaguaauaaaugaguucuugcucuauuuguucccacgagagcuaguuguaaaaaagagccagccccagcacuuugggguggggggccaaggugggaggaucguuugugcccaggaguucgagaccagccugggcaacauagugagacacugucucuacaaaaaauagaaauaaauuuuaaaaauaaaauaaaauaaauacaaauuuaaagagccuggcacuccccugcccccgccuugcuuccuccagugccauguaauccgcacacgccagcuccccuucaccuucagccaugagugggggcagccuguggcccuuaccagaugcagaugaccaaucuugaacuuuugcagacaucagaaucaugagcgaaauaaacuucuuuucuuuauaaauuacccagucucagguauuccuugauagcaacacuaaagggacucagacauccuacgaaccggguguuugauccuggacaaucucggccugggaagccugcaaaugcucaccuuuagcaucuggccgagagccuuaagccuccaauguauuugacauaaaaaacaggaaucuguaaugaaggaggugagauuagauaauugccaagaucacuuucagggacacaguguugagauucugugggaaaccucuuuucuuuggacaaaaggaaaacgccccccuacccuuacuaucacagugugguauuggcucuauauguggcuagcugcagagcugguuuauaugucucuauaguuccauaguuucgauugugcaaacaucuggcacccuugcugauaaaaccgaacaucaaauaacacugcaguugcugguaauuuagcacucugacgagcccguccccauuaugacuaagaaaguucaguguucauaucugcggagagagugacaacaaacuuaggcccucuuuucauguaauaagacaauaauagcagauagccaaugucauuaagucuugcucuuuugcaacccugcucccugccuacccaagaguaauauguggcuuggaaucacuuacacucugaccuggcacugcugcauggagcacaauuucuaugugaaacacuggaccaaaaugaaagccugacccuucaccucaugagcccucauaaaccaugugggaaaagucuggcacagugagcugccccacagcagcaaaaccagcugggauaaggaggugagccugguguggagagagcuggcuggggaccagcuggcuugacuccuuccuggcucugcguccagggacagggcagauucucaguuuccaccugugcaaguggggaugaaacggagcugcucugaugauuaaaugaaacuguauacaucauggugcucugucaaguacaaaauuguauuaauaccucaaaaauaaauaauacauuaaaaaccguggccuaugaaaaaaauccagaguuuuuggggaauagaaauauacgugguauacuuauuucuccuuucagggaagguauuaaauccaccaaaaccaggauauuuauaaaaagaugauuucuacgcauucauauauuaaaaaauaaaacuuaagguaacagguuuuugauauaacauuacaggcauaucaguagacaguagauggacagcuuuuugguuuucuaaaaauuuuaaauaggccagugcucaaagaaaugaccaaccuggugcaguuucuaauucugaaguaucugaaacaguauuuucuuuuuuaaagaaauacauacauuuaauaacauuugaagcucauuuucauuuggcaccaacaacuaccuagaacauaacccagaaccuggaagugaacucaaaaaggccuuugagcaccaaaaauagauguaaaaucugugcauuaagcucaugcacacuggcuacagagagggugucaggcccuccccgagagccugcuuaaugccaaggucaaagguauagagcuagcucuguauacccugcacuauguucccacauccuagacuuucacagcaauccuacuaagggagcaggacagguucuuuuccuguguacagagaggggugaccguggcucccugacaugaaguagguuucuauugucaucuguagaauuuggggugggggaaugguuagaucccacaugauaguaauugcauuguuacuaucucccaauugagaaaauacaaaauaccaaaaagucacaguaggcaagucacauuuuccaauuuauuaaucacaauagcaucuauaugcaucagaaaaaaaaacaguuaugugcuuacgucccaaacauaauuucgucaguacccauuauguggguggagcauaugcagauucucacacauucgugauaaaugcccauccuaggcagggaagaaguacggcucuaaauuucaggagccaagggcuugcuuaaggccacaugcccagcuuggggcuagaagccaggucguuugguuccuaugccaauauuuuuuccauuaccuccaacagguuuggugacuugauucugcugucaugaagagaugggaacacgacauuagaacaggagagagccacugcaggaaggggcuggcauaaugacaacaguuccuaaccccaagaggaacagagaccaaccacugugagaagaugcaaagcuuuuggaggcagaaagacuccaaaggcucuaucacuuagugauuauaggauuuggggcaaguuacuuaaccuccuugagcuuguuuccucaucuacagaauggaaaaaaugccuugugaagaacagagaaaaugcauguaaaauuccuugcauauaacaggcacuuaauaaauggcagcuagaguuagaauuuuaacucaaugaacacagauacaaggagccuuuuaacuggagcaaagagaauuaaacucuaaguagagcaccuaagugcaugucuguguuugaacacauuucaucacauuuauaauaacccugagggauuaggaagggguucaguuggagagagagcagcacuugguagaagaaacgugugucugggggucagacacaccugguucaaaucccagcagcacuacuucuagccuugugccacuuggcaguugguuuccucagacucaauuuucucauccacuaaauggggaguugucccaaagauuaaauguaggccucuggccuuuagcagaugcuuauuaaaaugccagugccauucauuccccuucguccucuacucuauaucagaagguaugggaugcuaugaugucuuccuguuaaauuuuuguccagaaaaaaaaaaaaaacauuuuaaguaugguguugaaauggguaaguuuuagucacuugggaaauguauacacacaugauaucuuuauucuccaauaaugugugacucagguaaacauuucuaaaaacaugugcacuuaucagauacuaaaaugcaguaucccgcaggcagcaggcacucaauaaaugcuugcugcaaacugaacacaugaaaggagugauaauccaacucuaaaaacaagccacuuccacaugcauaaagagugcagucuuuccuugaagugacugauucuaaaccgagaagaaacuuggaacugcaaaagcagaaauauacuuuuuuuccuauucaauaaaucaucaagaaagguuaagucugaagggucugcauuacucaguacagaagguuucucagauuucucuuuugaccuggcuguaauagaugcacuucgaauuagcaaaaauucaucugcucuuucugacucaugaaauaaacggaugaacuuuaauccauccuccuguaacucucacagucugccaugcuccacucugccagagacacguguguccuuacacgcuccacaagacaccagauauguaucaacagagcaagguucugucaccuagcccagugauagauacccauuaccaacacaaagauaccucagaucgaugaucaugacguaucccagcaacacacggcucagagcuccgacaggugucuccucccaaggcaggaccaaaggcacggggcacugucaugcugaggggucauuccugccccagcccagauccaccucuggucucuggaaccacguggggagucuguuguggucugccugggucucaaagcguucucgccaccugccaagguucacugauugagacaagcccaccauucccugguggccugaucnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccauacacaugccuaccauacauaaacacacccaacacacaccccauacacacagacgugcucugucuucaggggagucuuaaacaggcucuuuggcaucacuccagccuuggcuuuuugacccuagugaugucaguggugauacacguggcugcaggagguaccagcaggugucaaaggcaguuuaacccccaaggccuccagcgccccgucccaccacucuccucggaggccccugcacuccaccgucggacuacaggacucuagcguugcuccugggccagaagcagcagccuggaggugcagcucucaagucaggaaguauacccccaccuuccuccccaagcaaccaagaucuguccuccucccucuggacucaggaagaggugucuccucucuccccaaaugcugggcccugucccuuccuggugccagaggaaaccaacuaaccacacucccaacauccaggcccuuguuccuuugggaccuagugagucugauauacgaugcugggccuccaggcgccuguaagaugaaaaagaaaugauugggaauacuggggaugcccagcuuacaaaucaugaaugaugacaccaggccaaggaaaaugcaugcugucacagaagcauggaucuggguggggaggcuggggaaagcauggugcuuauucgugacagagcugcugugugccaggcauggcagagggcgaguuacacgcaugcggcuaucucauucagucccuaccaaccucaucuucucuuaaaagggaaaacuacuaccaacugcuaguaguuucccccuuuuuuuuuuuugagacggagucucgcuaugucgcccaggcuggagugcaguggcgcaaucucggcucacugcaagcuccgccuccuggguucaugccauucuccugccucagccuccugaguagcugggacuacaggcacccaccaacacgcccagcugauuuuuugguauuuuuaguagagacgguguuucaccauguuagccaggauggucuggaucuccugaccucgugauccgcccgccucggccucccaaagugcugggauuacaggugugaggaaguuuucucuuuuaagaaaaaagaacaauaagccucagaaagguuugggaaccugccuggagucacacagcuguaaaguagcagaucuggaauucaaauccagcucugucugccagaugauaguaaugauaauacaaauaauaacaaggaugaaaagauuaguaaaaaaaaaaaaaaaaaagagcagcuaacauuuccugagugcucacuaugugccaggcacggguugagcagcugacgauuggccuuacucucuccaggaaggcuuuguucaugcagcucuuacguacgaagacaaaguuacaaggaacgugagcagcauguccacagagccucaaaaacagaaaagcagguuggagguuacgaggccccggggaugaugcugucuuucuauccucaaggugacucagccaggucuugcugcauuuggccccuucuuuaugcuggggaagucgcuucucauuuucugcgaagguauaaugggacaagacagauguuggcugauuucagggaacugaucuguucgaagcugaaucagcugucugcaggccuuaaauauaaacuucacacagguggaaagacgagaugggaauaaguguuuuuggugagauguguacguuccccaagaggcggaagcgggcggccccugugauucaggguucagagaugcuagaugcuguggcccaggacuuaggcagcagugaaaguuccugcaugaaagaugacaagaaacugggcaugcgaggguuuccggugggugacgagaugagcugagcuacaaggcaugggaugccgcucauaucauucauuaaugcaugcaggcauucggucauucacucauuccacugaugagccuuaggaaauggugucugcaacauuuaauaagcauuaagggagaaaacaugggacagaguaacugagcucaaccugcuucuacuguuucuggagcuuguauuucagcuuucagccccuccccugcucuggaauucuaucucagagcccagccuggcucccgccugcucacacgggagguagagauccccaacuccucgcaaacguuuagagcucaacugugaauucuuagcuugcauucucagauuugucuauaaaggcauuuuccuuuuauucucuuuccauuuacaaaugccacacaugugauuggugggaaggacaaagagugacgucccagcacacugugggucacacuuucucugauucggccacacuguggccucagucaggugcaccuugcaucgcuuugcuuuucugcuucagagccaccucugacccugcucaagcccacucaguccuggcacaagcucugcccaagcaaagccacaggggaguuaacacccuggggagcccucaaccccugcgaccagagccccgccuuuggcccuucccaggcacacuccuggaggccucgggcaggcuccucagaggugggacggagcccugaguguacagcagcccagaaucauggggcuuacuccucucagcaucacucucccgauucccuuaggccugugaucaucuccuaaacaggcgaucugcacccaagcccuugcucuuggggaaauucgagacaguugcuucuguaacagcaccaucucaaucugucccggaacaagggccacaagcccaauacccgcaaagcccugaggcuccauccggcacuggccguggguuugcuggcuucaaucacccuccguaagaccccgcaggggagauuggugagcgagagaaggguggcccugucugcacugcugcgacgcagcgaccugcucucacagggcggcaucgaggacucagaacaugcuaguggcccuaaaagccaggggaacuggcaaaaugauucaaggugacaaacucugccuuuucaguuuaaugagagauguucaagcugggagaccagggugggccaggacagugggggcuggcugucuacucggggacagccucuuccaucgcagacuggggacagauacugcagagccgagggcacuccuacucacguccugaaaccucagcacaacacaguguauggcacaucuucggaauucaaaaaauuaccuguuggaugcauacaugagaguuacagcuccaaacccagcuguggcuacagggagaguucagcagcuccuuggcagugagugcgcuauccaucguaagucaugcaggaaggaaggcacguucaugucuccucugcuguucaccuuucuauucccacccaguccaggcguuccccuccuaaccacccacugcuugccaguucaccaacccacaugaccccuccuaugguaccccccaauuauucuggaucucuucuguugccaccccuggggcauaaagggucugaccacaaggaaucugacaaacgggcccugcagaagggcucucaaccacuugggagacagacggacagcucaaugccaggcugucaugccggccgcacccucucaccuccacagggucuacacuacacccuggugggcugacacucuggagcccaugccaucuaagcaacaauucucaaaggauaauaauaaaauaaauaaagagggcaggaggaaacuuucggaggugauggauaugccuauggcauaggcuguggugguuucauggguauauacucagccccgaacccaucaagucauggauauuaaguauguacagcuuucuguaaguaaaucauaccucaauaaacuguguguguguuuuuaagaauuagcugcagagcuuguccaaaugcaugucaccuggccccccacccccagagggccugcucauuagguuuguuucggcaaguacccugggugaugauggggcaggaggguccuuagaucccacuuggaaaaugacuggucucuaccuugagcccaagaguaguucuggcccuacuguucucagguuagagacauguauuuggcagcucuguggcaaggcagaaaacugggccaaguuuccagggcgugaacacugcgucugcaccugggcccucugucucuggggacacugggguauuuucaugucuuuaagugugugcgugugcccuugcauguccaagcaugcuugcugcgugugccuugugucuuucaccacauggugggcgugugugcauuaucaguagcucuguauggagggcugagugucagcuucuuggucaccaugguucucauaagcacaccugugccugcaugucacacaugggcuuaaacugugucgccugagucugugugugugcaugugugugugugcaccugugugugugugaagaggggacugcaguaccagggcaguauacacagagcauuccaguucaguuauuucauacuuauaauuaaauaauaauacuuauuaagagaaauuuuaauugcaaaguauuuuaccauacagcugaaggucccagagaugaauaagggaaacuugaagauaaccuaacagccuacauaacuuauugauuacuucucuucaaaagagaagcugcaacccgaaacgcauacauguacguauuuauaacagucucccugggcaaaugaaguugucgguggguugaacaguucacuucauaucuucaagugcaaacuagaaccuucuccuguuguuucuauuaguaaaagacaaauuaauuuuaaaaguucaugccugcgaugcacuugcuuucagagacccucuuuucaaucaaaccuaacuucuagucacucacuuucuauaugcuguaaucugcacaagcuaugcaauuuuugaaaugacuuauauuuauggcuuuauaaagcuaugccccuuuuugaaaugauugauauuuccagcccagagcauggcauuuuagaauaugcucuguucucuguugaucaggggaucauggaggguucccaguuucagcuaaugaggccaaggucaacccacaggagagaaaacugcucccuggccacagacugaaccaccaauucuggccaaccgccucauaaacacaggcccaggucauaaugggauccagauggaggaguguggacagucacagcugacauucuacugaccgugacucaauggaacacagcuuggggcagggcuaggacuggugcuaaggucucugguuucuccuuucagagccuauuucuuuauagcaguggugggauuugaaacuaggcucugaaagacuggagcuucagaacugagccuuagagacagcaaggucauuaaacaaaagaaagcaaaauaaacaaaaagcuauucccucuaagucaauucugcaaucaaagcaucggaaaaguuaaaugcacuaacaauguccacauucauacuaucgggggguagaaccccccauuauaaucuagggccucaucccuucauuccugaguaacaacaguugucuccuagccucuggcucucaaaacauccccacaacuuuuuuuuuucuuugccauuccaauugauuuauaccaucauuaauuuucauuaaacuucuccuuuguuccagaauuuacaauggcucccagcucuggcacuuuggcucaacccaagccccucaagccuguauucaaaacucucuauugucaggcuucacucaccggauuauuauuuuccaguacaggccuucgacucccgccaggugucacugucuaaggagucaccaucauuucucccaucuucccuuauuuauuccagucuccaugaccccuagacuuccccaucccuaucucauguuaacuucccuguuaacccaucuggcaaaaucuuucacugacuuuuaauuucuugaacuggcuuugcucaucauuguuucccuagagucuggcagaagguagguucacaauaaaucucuguugaaugaccaaacauuuaaaauauugaagcaucagaaugacagucuuggcaguugguuuguguuuuccaucuccucaaagagacugugaacucugcaagauuagggaucaugccuuacccucugcacucuggagcacauaucuacuacgggacacucaguaaugaauguuugaugaauugaacugaaaauuaaucuccacccugauaugguuuggaucugugucccuacccaaaucucauguugaauugugaucuccaacguuggaggaggggccuggugaaagaugacugagucaugggggcacacuucccccuugcuguucuugugauugugaguucucacgagauuugguuguuuaaaagcauguagcaccuaccccaccucucucuuucuccuucuccagccauauaagaugugccugcuuccccuucaccuuccuccaugauuguaaguuuccugaggccucccagccaugcuuccuauacaccccgcagaacugugagucaauuaaaccuuuuuuuuuuuaauaaauuacccagucauagguagcucuuuauggcaaugcaagaauggaauaauacacacccccaccuaaaaccaccaugaaaucaacuugaagacagucuuugcaccccaaagaaucagacaaaaaaaaaaggcugggcgugguggcucacgccuguaaucccagcacuuugggaggccaaggcaggcggaucacaaggucaggagauugagaucauccuggcuaauacagugaaaccccaucucuacuaaaaauacaaaaaaauuagccaggcguggucaugggcgccuguagucccagcuacucaggaggcugaagcagaagaauggggugaaccugggaggcggaguuugcagugagucgagaucgcaccacugcacuccagucugggagacagagcaagacuccgucucaaaaaaaaaagguuagauuauucugaaaaaguggauuauuugcuauuuuucauguccuaauuuuuuauguucaauuuuuggguccugguaacaguccuacguguuucaaaaaacucuagacaagaauauuuugaauaauccagaguagaaaccaaaaaaaaucuauauauuuuaaucacugauuacccuuugccugaauggcaugucuuuuuguuuguguuuuuuucugagaguggaguuuaacauuuggucuuauuuguaguuuacugguucugcugauaauggaaauaccccaguaccaauuuauugcuugcucaaaaaaaaaacaaaaaaacuaaaaacaaacaaaaugaacuggcaucaauguagaauuaaauaacaaaagggcaggggcgcccaaggugaaguaauacaagcaaggauuaccugcaacucuguucuuuugggugucaacaccugaaaggugacaccauuaagaaaaucccucuguccuucagaauaguguuucucaaagacugguccuaagacccccugccuggcucaccuccaguucucugaggcaagucucuguggugguggguguggacuuucucccaggguacucccagggagacucuguucccagcaaccucuccaggagauuccugugcacaguaaagccugagaaccugggcagcugacaguuaaugacauaacugaccuucgaauuggaagggaauaccccugcuucagacucgagaaaaaaacuuaaaaagcagccuuuguuuccugaaaaacacaccagugggcuugccucacagaauaccaacagccacuguggccaggcacaugccugagagcuggggaaaacaguuggcuccggggacaccaccuccuuuuccaaguccccaaggcgaggauaacauauccuugucucacaccguuucugugucacuagguggggacaauggugggaugagacacuuagcccagucccaugcaaaaugacagagggacacauaaguacucuaccuuuugaaagucagauguccugggacgauaaugugcccagcucagauacagggggccgaggggagaaaguccccacccaccaccugcaggacaaaggccaaccugcugggaggcuggaugcacagcaugcaaugacuccuccagcccaggcggcucaaacacacagccauucccucacgaugcagaugcagcugaaagcaucugaaagcgucuucuuucugggacaugggccuuaacgauggacaauuaaagagcuuuucuugcccccuuucuuuccuauaagaggcaaagccaccaggaaaaucaacuugauaaacauggccuagagcuggcugucccacacagcugggacgaaaagagacagagcacuagagacuguccucgaaaaaucggaucgaucuauaugguggcaaaccacugcagggcucagacaaggccugagggagaaacagaacauugcaccaacuuagaaaugaagccucauuucaggcagaagagccgcugucuuuccugcugaccguauuuuuggaaccagggcugggcacagggaggcugacaugagggccugaaggugaccacagaaaggagaaagaggccuucuugcucagaauuuuaggcaauggugauuucaggggugaaaagaggguacuaucacaacuaaacggaggguccuucagagggauguggggacacaggggccagaugugacugugccugucacgaaguggggaaaagagggcuccugagggcccaggaaccgccagcaaaccagccuaccacacccaccagaggcguccaaaaggccugaucucacccacagaggggggcaggagaggaucgcugugaguccaggugaaggagucagcccuccccaacccucacaggcaaacuuuuacugcugccgcaggcuuccugagcuaggauccccgauuuugcgaccugucuccucagcacuaggggcaccagcaccaggcaggaaagcaaagaaaaacucgcagaguccaaggggaugggcagggagggcuccaggaagcgucacaugggcaccagaaggcaagaugacaagggggucuuaagaauccccaauucagcuuacucgauucaccaaguuucgcucuaaggaugugcugccuuuuaaacagaguuugucgaagucuuuuuacaagucgccaugcuagcuuucagugaauguuaauaacacugguacguguucaugaugcagcaauucagaugaacuacauaaaagcccuagcagccaagucaggggcuguucacccugaauucaggccaagaacuagaaagagccagccuuuggcaugcugaauuuaccaaccuaaauacgaaguggcacagcagccucccagagccagcacagcaccagcuagcccccaauggggcugguacccgggacggccaccagagcuggcuuucagaggcccaggcacucucuacagagaauaugugcugucgguaccgggcacccaacccuccagauucacucaaccauugcccauccuucuccucuggagacaaggagaggcuucuugucuuccuuggaggcuccugcccugggcuuacuucucccugccauuggcucuggggccagcggggcacagaguggauggccuggucaggacgagggaguggagagcaaguggaggggcagcaguagacccgucuguccgcacggggccugguggugaaagcacaggccuguggagaccuuucugcgcauaggaaaugagcgggaaaggaauccucagggcagggcagagaagaggcucgcagagagcuguucuaacucaggaaaugccuccuaaagggaagagggaagagacagaaacagcaugggugaagaggccucgaaaccuccugugugagucaggauuaggaugaaaggagacgggguggaaggugggagggcaucuggggauccgaacggaggggcuguugcucucccagggaaggagggccuggugcccagcaggcugagggaggggcugggaggagacuugcaacagcucugccugcagccaggaugggggcccggacagggagcaagaaggggaagcuggcccaggucagccccaggaaugggugacaggucagcugugucgacaaggcccuggggcauguuccagccuucucucuguggccuugaaaggcgcauggagaaagcacacgggcaagcgagcgugcuugcuugcaagcaggauggccuccggggaccccggucuuccugccuacguggcacgcucuuaaaugugcauccgucccaucuucucaugggaguuucaguuuuguuucuugugaccucuaucuccacugcacuguucggcaccaccccaaacacacccccaggcugguuccacagagcagggucuugcuuuccaucccugccgccuccccgcugugcacccgccauggccagccacggagugacacaccuaagccauguuacagccauguuaccucccagcugcccacgaggcuggugagaggauuucucccacuucauggguuaggaaaugaaggcauggagaaaucaggccauuaggagaggagggaccagguucacucuggccuuuccugacuccaaagccagcacuccgaucucagcuccaugucggcagcgguuccaauccugacugcauacaggggucccugaaaagcuuccagauaccccaggauggcaagggcccugucuauaucccuauaccuagcacugcggcuggcacauauuaaaagugaaaucaaagcuuguugaaugacugcaugugugaguccaugacugaacacacuucccugccacggacacuaucauuccucccucauccugacccaaagccugaagucaccuuaccacaggagccacccagcuggccccagacuagucucucccuuccuccagcccuucugcacguggauagacaaggaaccuucucggaacaucccuuucaacccguuaccuuauguuguucaagguuuccagggcuugcucuggguuugaggauacaguugcaauuccuugaucugauauuuaagacccccagugaccugguuccaaccaggcuuucacucacaucucccaccacucacaaacuguucuggccaggcggguguccuucuugucuccuguaaauucccacuagugugacugcggacuguggauggcacaucccucucucuccaccaccugucuggauccuacccauccgggaggacggaacucuucugcucugcaccccaggucccagggagcccuuccaacgcugaacaccugugccacggaucuuaccuggcuccguucuaaugugacuucuaauugacaucgcaaugugcacauguccuaauuucguaaguacauuaagaucacuugaaggcaggaacuguagacauauaauuuuaucuccccacagugacuaagguggcacauucucugugagugccacugggcauucagcagcuccugucuccuuguggacggucuuaccuguaauaucuggacugcaaguagguggagcacacagccuuggagacguggcuggcugaaccaaagucgaugaccuugacucuguaugguugucuagauggauccaccagcaugauguuuucugguuugaggucagcguggauaagaccuaggcuuuugaguuucaucagggcuguggcuaccugcuggagaacugggcgaauguauuugaggggcaaggggcuaaacuuguuuugcuucagaaagucauagagguucugcuccaacaucucgaagaccaagcacgugugguucuugugcuggaagcauucguaggcccggacgaaguuauagucaucggcacucuccgugcucaaccgggccaggaugcucacuucaaucugaccuugucgggcauaggaugggugguucuucaggaucuugauggcuacgaucucauuggugccccguuuccagcacuugaccacuugcccaaacgucccucggcccaagaacucuaagaccucguagguguuggucauggagcacagcaccucaugcugcaccagcugauagucgcccucgcuguuggagccgcuguuuuuggagguggcaguagacgugguggcaguggcgacaguggccccgcuugcauuauucugaaucauggguggaugcuccucgaugaucugcacgcugcuuguguucucgaucuccucgcucuuacgcuugaguccacauuuuugguagguaucaaggaggcucacagugcuucgacgcauuagguugugugguccgccgaggacuugcccggugacagaagugcugcuugcugaggugaccacgaugugcccggugcuuccugggaagacgauggucugcucguaagguaggcuuggguuugggaccggcaaggaggugcugacgguugugguggcuggcugcgacagggggauguucuugcucuggcuauacacuuugcugugggagccguacccagucaugucccaguuggaacucggcucuauuuucaguuucuucacacuacagaaggcacuugauugaagggugugaggggagaaaacuugcacaugugaggccauaccuacaaggaaaggaaaacgaaaaguaaguaucggagucaccuugguacaaguaaacucaacagauccccuucaguucucaucuguggcuugggccauacagaauauauuccucccacuugaaaacaagguugaaaaagugaaucucuuccacccagaagcacauucuggucacugaguuuguggaaccaagugguuccagggugccacuugccaccauuaggugccagcaacacagcugagacucagaaacagaauuccaauaucaggacauaggucaccauuuuuuuuuguaaacauuacuugugacagaaauggauucuuccucaguucucccuggguugcuuucuacugaaacucaggaggcucugcugucacguacuucguugcccacaucaucagcucagccuuguccacagacccugucaaguuuacugguuugagaaaacaucuucccacacaggccccaucaccaggccacucaggaucuucuggauccuggaugaacccuaauuaccagcuggcaucuuugucaucgauucuguaggguuuaguggaucagcaguuggucugacguuuuucauuucaacagcauaaaacauuuuaucagccuuacugguggggacuggguagcacaauucauggcuccauucacucacgcuuccugcuaaauucauauaucaauacauuucucuagaaaguacuauuucuuuuuguuuuuuuuuguuuguuuguuuguuuuuguuuugagaccgagucucgcucuugucacccaggcuggagugcaauggcaugaucucggcucacugccaccucugccucccagguuucaagccauucuccugccucagccuccaaaggcugggauuauagguuccugccaccacgcccgacuaauuuuugaauuuuuaguagggaugggguuucaccauguuggccagccuggucucaaacuccugaccucaggugauccacccgccucagccucccaaagugcugggauuacagacgugagccaccgugucuggccagaaguacuauuauuucauaccaacaucucauccacaauuuagauaaacuuagaaaccuaugagaccguuauucuggaacacuuguacaaauuacggugauacugaaacaaaaauucauagaaaauauauuaagcaaaaauaauaaggugaugaaggauaacuccuuaaagguuaaaagaguaacaaacauugcccaucuucuaagccacuaucaacaaacauuucucacagaagcacaaggaagugcagcuucugcaagcccuguuggggguuggcuaaccuaguguuccugucucucugagccccuggcauuaccuagagugguaauccuuuccacuccaucaaccaucacccuaguccaccuucucucucaguagaugacccaacuuccacuuuguccagaagccugaggucagccuuacuuuccuccuuuauuuccuucuucauuucagaacauuccugaaucuacaucauccuccauccuucauuccuucucuccagucugagagaaagagguguugcucuuuuccaauacuaaaaaaguucccgauucucaugauccauauuugucccauuuucucuugaaccugcuuccaccacuguucuuucucuuguagcuuuccauuucucccuguacuuaauuggauccaaguauuuaguaggaacuuaauauggcuguccaaaugaaucggucaccucaucuuuuucuucugccuucaugugcgugcacacacaaacucccaacauggaaggcaaaaggaguaacagccgcauuccccccucuuaauucuuucccuccucucaccugugaucaaugguuuaugcucccuuuucuucaaugcccacaucuuaauccaucucccccaacucguuaaugcacuauaggcuccuguucuugaagguaaaugacuuccuaauugccuaauccaauggccuuguuucagcccguucuucuuaaccucugcaacaucugauacugcugaccacgacuuccuucuugaugcucuucucuggacuucagugaaucuguaaucuccccaucccgugucugauugcacacugugugcucgggugguuccucuuccuccuuuauuuuauuauuauuauuuuuugagacagagucuugcucugucgcccagacuggagugcaguggugcuaucucggcucacugcaaccuccgccuccugaguagcugggacuacaggugugcgccaccacgcccagcuaauuuucauauuuuuaguagagacgggguuucauguuggccaggcuggccucaaacuccugaucucaagugauccacuccccucagccucccaaagugcugguauuacaggugugagccaccgcacccagcccucuuccuccuuucaaauguuggcauuuccaccguuuugacucuguucucucuggcagcuaucauccauucaagcaguuuaagccgucaccucuguguaggugacccccacauguuuaucacaggcugggcucucccucagagguuacagugauauauugcagccuccugcuacaaugucaaagaugcgcuuccaaagcugaaccccuuauuuuuuccuaaaaaucuagccaucucacccucuauccuaacaucuccaugacuguucuagucacuuggcuccaaaacuaugaacuaugaugguucuucuuuacauucauagacaagaaggugcuaagccuuauuaauuucuccuuccuucaaaacaucucuugcauccaauucuuuauuucugcuguugcugccacuuccacagugaauguauuuaucacuuucuagaaggacuaaagcaaaucuagacaucucaucuaccugagcacucugucucccuuuaauuugccuauauuuggcuaccagauuaaucuuccuaaaacaucucugagcaugccacuccccucuccaaacuuccacuggcuccuuacugucaaggagauaaagcugagaacucgauacauuuacauguugauuccaacuaccuuguuagcuccagcucuacuaaccuuccuggguccuuaacuugaaugaagcuggucuauucgcuguuucuagaaugucucuuauacuuccuaucuucacacucuuacacuauuccuuuaccuggcaugccuuugcugcuuuucucaacuuauccaaagaccagccagcuuagauuccuucucuuuccagaccacucuaacccagugaucauucccaacucacuguuccuacagcacuuaccauauguaccaucugacuucagcucugacuuccuaggggcaguucugcuaacauccagcaccugauuggagccccaccuccacccugggcccauggaucugcuggaggguguucccuucuugcuucaauccugagcuccgaccuccaucuacgcacugugacugcacgucuguaggaauccucgugccugacaagacuauucuggcuugcuuauucagaauccguacuucacccguuucuucccacuguucuuuuuguucaagucaacaucccccuuauucuaagucaacaucccccuuauucuagaacaacacagaauauggcuauucccuauuuaucaguaucaagugaauauccauauuguucuagauguuguauacaauauagaaaugaccaauuacuuggcuuucaguaacuuagccacugaagagucaaagcaaaacagccauuuccuucauccuuucgugucaagccugcugcuuauuuuucagucuuuaaguacccggaagggggcggucagagagagcgacagcagaaauacgcuguucauacauaaagaaggugaggugcuagucucuguuuucacuguuucaaaaagaucuugguggaaaggccguccacggugcagaaguggaauuuuacagaggggaagaggguggcuuaugacuuauuuguuauugggaugacagccaagggucauaaaauuguggaaaucaucacuggcugccucugaugacagaugcccaggaucagacaggaggccuacauggcuggaaacacccugcaccacagccggcugccucagacuccggccuggccugguguggccccugcugccccuuuaugaagucaacagccgcuauuccaaugacuggacccaacgcucagugcagacguguuaccuuuguucuguagcagaggccacuuugcuucaggcagcaaaaugcuccaacaagauauaguuaaagucuuuaacaguaauacuuuuuuaaaucccugaaauaccuucauaaggaauaagacacugcuggugguuuuguagcuuaaucuuaaaauaaucuuauggcaacacacuuauuuccaaacauuucuccuugagaguauuucucuggaacaaaccuucccuauuaguuuagcuuucagagaguugagcccacaacguauuacuucucuauuuauucagauccuaaagugagggacaauaaagugggggugcagagggggacucaauguuuuuuuccacuugaaaguaaaagcuaaaugucuccucucauuucuuucuguauugaccucuggacuagucaaggcuacuucccgccucauuugucaauauccuuuucaggaaaaacagaggcuuaaugcacauugucaguuugauccaauggcaaaaucucaacugcuuuuuaaguuaucucugcacuuccuaguuggcucuugaaagagaaggcggauuuuacuccuucuaggugagagaccagggggacuacuggacuugggagggcaaguuucgagcccauggggagcaguaagaggaacccaggaggucacgguaggauaaaucugccauaaccacaccugcuccuacaggaaugaccugacccagacuuuuccacaaaagccuuaguggccucccaagauaaaaccugucaaaauggccacauuuucauucacuaaaggacagggagucaccauaaccuagaacuaaagcuuuuaacaaguagcaugccuauuaccauaccacucugucucauaaacaggcugaagucauaaacacugaaucucagauaugcaugggguucuuacaugcuuguuaauuacacagacacgaguucaugugguugcuacagaagugauaaguaaaaagcacugaagaacaaauuuauuaaaauuuaaaacaacuucuauuacacaacuauauauaauaaacucuucauugcauaugacaaaugaaaaauagcaccuauaaaacugacauuaaaauauaugcuauaguuagaagaauuaaaguccacuauuuguaagacauuauuccuuauuaccauaaagcugacaaagucucucaugccgaaacaaauccagguuacccagacuuagggugcacuuugauaugcuaaaggcaaugaggguucugacccuucuuuuaguuacuuuauugaaauucucauuuugcauuuauaaaaagcauguaugcaagucugcauuucaaaauacuauuuuuaaaacaucugccuucuagccuuaauuauagaugccauuuaugucuauaaaaugcuagacuugacuucaucugcuauuccucaggauucuuaaaacacuuaugagucuccagguuuuaaaaucuugaguacuaaguacacagcaggcuccaggacagauguuuuauggacaggguaagcauacguccuacugccgguuggacguaugcuuacccuguuaggccaauucaauuauucagagcacccucccuacuuucauucucacaaagguccuacuuugaaaacugggaagucaugugauggguuuaagcuucugugauaagugaaaaaaaucagacccugaccccagaaguucaaaccuagaucuaaauucuuuuuuuuuuuugggacaggaucucacucucuguugcccagguuggagugcaguggugcaaucauagcucauugcagccucgaacuccugggcucacaugauucuccugccucagcuucccaaguagcuaggacuauaggagcauaacaccaugcccggcuucaaaccuauguaauucuaugcaccuuuugguuucucuuugucuuaaugguuuaaugagaaauucauuggucuggggcuacaaauaauguaauaauaagaauaucuaaaaaucuucaugauuucuugaagucuuaacucacacaguuacgguuuuuuucuuucuucuuuuuuuuuuuuuuuugagacagaguuucacucuugucacccaggcuggagugcaaugcugcaaucuuggcucaccacaaccucugccucucgaguucaagcgaaucuccugccucagccucccaaguagcugggauuauagacgugcgccaccacgcccagcuaauauuuguauuuuuaguagagaugggguuucagcauguuggccaggcuggucucgaacucuugaccucaggugauccaccugccucggcuucccaaagugcugggauuacaggcgugagccacugcacccagccaacucacacaguuuuuuaaaaaaugacauuuguuaagggacuggcucauuuagcauauuuuccccccacuauuuacuuaguuucuucauaacuuuauauuucacaauuagaugaacugaaaaguugcuucauaucugaguaacauuuccuuuccauuucaccaccccuaaauaaauuaucuacuggaagaucagacuacaaggaugagugaggguucaacuacaauaaaaaaaaauaaauugaauucaauuucacugaauucuagcaaagcucaagcccugauucccagggaggugaucucuaaaauaguggcaccaauuuuaucgguauguaauauuuaauuuggguuuggcagauguaaaacagauuaccgcucagaauccaguuauauuauucaagagaauggaaucaugaacaccugauuuuaagagguacuaacuuccuuacuuccuaaaaucuucuggacacaagcucuggcugaauaaugaguacuuaauagaugcuacagaucuuuuuuuuuuuuuuucauaauaaagaacucaaaggaaggauuaauucucauauuuaaugaaaugccauaucugucuaauauagauuaugcacauaagacauaacaaaauuauagaauaugucaaaaauauaugaauguuggaaauaugcaucuaaauggacauuuuuaaacaccuagaaaggguuaaucuguauaaccccugagaacccuggaugacauggugaucuaauaccucagggggucaaaaaguacuuggaaaguuuccuucauugacauacuaaauaauauucauaaaguuuuaauaauccugcuuauuaaguuuauauuucacaaggaguacacagauaauuucagguuagcccauucuaaaugauacauuuccaaaacaguguauacugaaugucccuggggcuuuuauaccauuuucaaucaaugucuguuuacccacuaguugugcaauguuaaauauauaguauauuccaccagagcacagcuuaggaucaaccacaagcucuacagaauucuuuuuuuuuauuauuauuauacuuuaaguuuuaggguacaugugcacaaugugcagguuaguuacauauguauacaugugccaugcuggugugcugcacccauuaacucgucauuuagcauuagguauaucuccuaaugcuaucccuacccccuccccccaccccacaacaguccccagagugugauguuccccuuccuguguccauguguucucacuguucaauucccaucuaugagugagaacaugcgguguuugguuuuuuguccuugcgauagucuacugagaaugaugauuuccaauuucaucuugcagcacuauucacaauagcaaagacuuggaaccaacccaaauguccaacaaugauagacuggauuaagaaaauguggcacauauacaccauggaauacuaugcagccauacagaauucuuuugucaauaaugacaauaacaauacuacugauugcagcacugggcauuugaaaaaaacaaaaaacaugaaauaaaaucaaucaucaagucuguauuaaggguccucuacauaaaaaaagauuaggguugagcacaacaggaaacacaaagacaucuaagacaucgucaccgaccuaaaggagcuuagaaucucauggggauugccaaguacaaugcaaauuaaaaaggacagcugguaauucuaaggcaacauaaacaacuugccaaaguaaacacuagaaguuuagaggcaggagucacuaugcauuguggucaggcaaaguuucacagcagaacuaagacucaagcugcaauuagaaagauggggcagaaggcuagugcuccaaauccugcaaacagaguguacuucaguccaucaggagagugagacucauggcgggagcggccagcacugcggucucuguacuagaaagcucaggcuuugcuuggagacaacugaggugcguuugcauaguggcaauacaauaacaaaugcuaaagcaauaaauaaccaccaguaugcacuguguauacaacuaccuaguuauccagaauugucaucuucugauaacuucuaucuucuagaaguaauuucuaaauacucagagagcuggggggaagcccaaccaugagagcugcucaucuaauuucuccuuucgccuucucucucacuggcugccaucuaacacaucaacaagugguaggugacuguccugauugccuuugcucucuauaugucagacuccagguguuugcucgauacaacaaaacuacaguguuucccuguuuuagagaugaguaaauggagcuauaauuuguccaaagucacuucgccucugcuagcagggcugggauuugaacugaggucugccugacucccaaauccaugccaccagccaaacuucuucauucuuuagguucucagacuacaaucaccaaacaacgagaugagucccacaccagccaaaggaaaaaugagggcugauaagugaaggaagacagacugaaacuacaggacgcaccugacuauacgucaccugauaaaauaguggaugucaacaacaaugacccugagucaucucucauuucugugucuucugguuaugacaucugagaaauauaaccauaagaaaugauuaaaauaaaauacauuuaccuauuuaaagagguaaccacugcuuaucugaugcauagggggucagugcagagaaguggccuugaguaagaagagccgggcuaagggagcuugggcaagugcucagccaaugggaaagcugguccagagggguaagggggacccggacuaaggaacugccugagaaaacaggaagcagcagaaauauaaaacucugcagaggagaaaaggugagacaugcugacagaugagaugugagagcaaaggaaagaggggacuagaacacauuuggggugccagaaggaguggggcuccacgagugagaaggaagaugggaaguggaguugaaguguugggggaggggagaauagaaucuguuuucaacauguugaauuaugagcacuaacgggauaucuacguugaaauguccaguguucagcuauucauacugaaacucugaggcaagaaauugcuuaauuuacugaagugucaggagcuaauggucuuuccuaaccagcacccaguuccuacuugcuagguugaauugugaaugacgaucacccacuuugaaaagggaauggaaaucaauaggaugggcugggccugcaugggauuaacuggaaggggaagagagcaaggugacccugaacuaguucauggguaaggccaaagacagagggacacagccaaaagaccagaaggccagaaugagaaauagcaaaugggaaaaagaucuaaaucaaagguucaugccccaaagggacuaagagaauggugcugcugacgguaagagcacaggccagcuagaagggcuugguuuggggcagauuuuguuuuaggcauuaguaacaacaaagaggaaauguucuauaugcaacaagaaaaaagccagguuagggaaugggcgcaaggucauggguggagauguggaccugaaggcugucaucaacaccucgguggaaauggaguccccguggguaaagcuguuucccaggagaaaugcuguagaaaguagagcagauggcaaaucaaguaauccucgggggcagagacauugucaaauaguaugaggaggacaauaugagucacagggaaacaucaaggaugaaaugaugauaaacacaauuaagggauugauccaggagaaugaaaacagagaaagaguggcagagccuggcugggaaugagccaauagcccucuuuucccacagggucaggagcagggaaagaagggugcucuccugggaagagaaccaaaugcaccaugucacgccuccugcucuuccaagaaaugugguucucuuaagaacguucaaaaucuuuuaugucaucugccuugaaucugcaaaugcuaccauaggcuguguuucuuugauugagaaaacauccuuuuccuaacauuugcaaauucuccacacaucuaucuacuuauugacucauuauuugucagaguuacauguucagacuuaauucucuuucugcaagcugcuaacuuggccccaaauaacuccuuuugguaacucugcuauacugcuuugaaugaagccaucaaccacugugggugagccagccuugcccugcagugggugaguacagacaacccauaauuguuuaucuacaggacauggugucaagagcucauaagcaaucugaaaauucccaauccaauccagugcugaagcaaacacugauaagacacaaacgcuuuuucagcuucuuucuccaggaaacugaugggaucaaugaaaagaaaauaaaacaauucaaagaauccuuuuugaaacaagaguggcauuggcuaauuuuuuuuuuuuuuuuuuuuuuuugagacagggucucacugucacccaggcuggaguagaguggugcaaucauagcucauuguaggcucaacuuucugggcucaagagauccucccaccucagucucccaaguagcugggauuacaggugugcgccaucaugccugccuaauuuauuuuuauuuuuuuauagagacggggucucccuauguuguccaggcuggucucgaacuccugggcucaagcgauccuccugccucacacucucaaggugcugggauuacaggugugagccacugugccuggcuggguuaagaaccuuauuuagaaaaacacaaaacaccacuuucuaaacauagcauaugaaucugccaggguugggguaccaaagcaccacugacugggcagccuaaacagcagacgcugucucacaguucaagaagcuggaguccaagaccaaggugucagcagggcugguuccuucugagggcuggaagggaagggucuguucuaggccucccuccuuggcucacugaugacugucuucucugugugucucuucacaucaucuucccucuguguguaucuguguccaaauuucccuuuuaauaaggacaucaguuguauuggguuagggcccacccugaugaccucacuuuaaccugauuccuucuauaaagucccuaccuccaaauaaagucacauucugagauauggaagguuaggaauuuaagauaugaauuuggcaggggggaaacacaauucaacccauaacaauaguuuuaaggaaaccaaaagcauuuuacuaaaguauaauuuucucagguuaaauaauuaccauauuccaaaagaagucucuucgguuuucccuucuuggagauaagacauuucacuuugugcuuucucuauaucuuaccuuaaaggaccuauaaguucauuucaauuagucuaauaucauagcuggaaacaaguaaaagcauacuaucuacuuuaaauuaagcucugcaugaguugauguuacaacgcuucugaaaaaggccauauaggaauguaucucucaaucuacugaggagcaacuguagucacuuugguauaaaagagaauuggagccagguucaguggcucacaccuguaauuccaaugcuuugggaggccgcgauggguggacugcuugagcccagaaguucaagaccaaccugggcaacauggugaaauccugucucuacaaaaaacaaaaaaaauuagccaggugugguggugcacacccauagucccagcuauucgggaggcugaggugggaggaucacuugaagcugggagguagagguugcagcaagcugugauugcaacacugcauuccagccugggugacagaguagacccugucucugagagagagagagagagagagagagagagagagagagagagagagagagagagagagagaauugggaguggcuuauuaauaacacaaaaacuagguuuccaguuuugauucugugugugucugaggcagaaccuaaguaggccccaaaagccaccucaagaguggcuggcagugggcggccaaguucaggccaccccucuucaugccccucagcaucgaggaggagccccggcuugguucuuccucgugugcccucucucaccugccauccacauuguucuguuuuucaacacugcauuuucuuuccaauggaggaucucaagaagacaaccuuuuaaauaaacguggugggaugaaaaaggcaaacacccacaaacuaugaaaacaaaaucagcuguacuucugguuucaacccagaggaauuccauuuaaauccacauuuuuucaaagaucuagaaggcugcuuaccuugucccugaaauguucuaaauaaggacgguuaaaguuucagcaguaccaguuuucagguguuugaaucacaaaccuuuacgaaagaaagcaccuucccugaauuuuucagccacuuccuaacaugacauaccaaugucccuccauucacuacugguucaaaauccucacugaccaccucaagagacaaguaaaccagaccugcagcagauacugaggaggccaggugugugccuggcaacggaagguaagccucagauggacuuuuccuauccuuuagaaauguuugguaaagucuaaaucaagacuaaaaaucugguaggcuuuuucucuucugagcaagagugaauuuguuagccuuaaaugucugguacuauguugguaaaguaaaaugaugcguuuuacuagccaaacacccauuuccggcccaguccacagcugaggugccuuuuugagcuaccucagguucuacuucagaaauguuuguggcacacagaaucagaacuggaaaucuacucuauucuuucccauuuugguguucuuguuaccaugucacugcaauuuuuucucucuuuuuuuuuuuuuggagacaaagucucacucugucgcccaggcuggagugcaguggugagaucucggcucacugcaaccuccaccucccagguucaagcaauucuccugccucagccucccgaguaguggggauuacaggcaugagccaacaugcccggcuaauuuuuguauuuuuaguagagaugggguuucaccauguuggccaggcuggucucaaacuccugaccucuggugauccaccugccuuggcuucccaaagugcuaggauuauaggcaugagccaucgcaccuggcccuaauuuucauuuaaacuaaaaacuguguagauucuauuacuauguguccucccaaaagauauguuaaguccuaacccccaguaccugugaaugugaucuuuuuuggaaauggggucuuuucagagguaaucaaguuacaauaaauucauuaaggugagccguaaucccauaugacugguguccuuguaagaggagacacagacauacacacagagugcgggccacacaucgacagaggcagagacuggagcaaugcagcuguaacccaagggaugcccagcauuguugggagccaucagaagccgagagaaggcaagaaggggauuuaccuggagucuucgagggaacguggcccugccaacuccuccaaaacugugagagaagacauuucuguuguuuuaggccaccuauuaauaguuuguguuaauuuguuacagucacccuaugaaacuaguacccucugcaaaauaagucaggauguauuucauugaaaaggcaugucuguacucaagcuaugauaaaguauuuauaacaaucgcaaagugacgcuggccaaauggcagguugcccucucagccucccggccugugucuguggccucuugguuaaaaagcaacagaagcaucuacagcuuuacucccacguuuuagucuuaauuccugccagggcacuauacaccuccucuccuuaugcaaauauauuuguucauugugauugagguuugacuucaaaacaacaaaauuucuaaggaaggcaucuaaaguucgaucuguucucaucagugacguccacaguuaagaggccacagacggcacuuccucaaaccugccuuuucuaaaccucaacuucuugcugaguuauacaaaggaaccaggacaaagggccgccaaauggguucugcgcucagugcaacaccuguuugcacaccccuuguacucauguuuauguauuucuuugagcauuucucucacaggcuguucucuaacugcaaagaaaacuuugugaaagauguuuugcagacacagugaugccggggaugugagaugcagauaacccuuucccccaggcucucuuuaaauacaggauucauuucauccccuucuuaaagcacaauaauccauccuucuuacuugauuuaaauagcaacugcuauuuacaacaggagcuccauguuacaacuguuuuguuccuuggagaauuguuucauuccccucaguugccuuuaacugacaccugacuaaacucaauuagggaucacuucgggaaagguaccaccuccacaacucgcagggagagggaagagcaggaagaaacgaaaggaagaaagcuggaguguggggaaaguuggcacggaugcugagaggaaaaggaaaaagaaacuaaagaugagaaaaaggugagaaaagagaaggcaagugaaauuauauuggagcacacuaagaauaauaaaguagcauuguaaugugcuuuguaaacuauaaagcauaauaaaaaugcaaugugguauuauuugcaauauuuaaauaggugcuuuuguguguguguuuguggauaugaaaaucagcugguacagggaucccuuggcagggcaaccaguggcccauucuaagcugugcaaauuaaaguggguucuuuggucuguugcaaggacauuuuucuacugugagucacugucaucaagccaguccuggcguuauuacccaacaacuccauggcacggagccacuuacacccagugcugggaggaggugcccacucagauaauacugguucuuguagcggggcgccuuccccacguacaucuaagaugucugauagcucuccuaugucuugcuuuaaaacagacaggauggcauuuggugauguaggccaucccuaucuucauaggggucuguauuccaagagcuaauuuucagauuguuucugcauucucaacaacuaggucagaugccagugcugcccuuucuagcucugugaucucagcaaguuacuuaaccccuuucugccucaauccccucaucucuaaaguggagacaguaaucauauuucauaggguccuugugaggaguaaaugaacauauauauauauaacuauauauaacauauauuauauaugacauuauauaacauauaauauauauaacauauuauauauauauguguguguguguguguguguguguauaaaauagugagucccugauaugguuuggaucaguguccccacccaaaucuuaaauuguaauccccaguguuggagguggggccuggugggaggugacuggaucaugcgggugguuucucaagaaugguuuagcaccauucaucuugguacuguccuugcaacgggagugaguuuucuugugagaucugguggcuuaaaaguguguggcaccuccccccucacucucucuugcuccugcucuggccaugugaaaggcuggcuccuccuucaccuuccaccaugacuguaaguuuccugaggccuccccagaaacugagcagaugcuagcaucaugcuucuuguacagccugcagaaccagaagccaauuaaaccucuuuucuuuauaaauuacccagacucagguauuucuuuauagcaaugcaagaauggacuaauacaguccuaaacaagcguuuagugaaaacugaggggaggguggucagcuagcucccagaggccuagcuaacacagaauagaauuuacuuucaaagcuucugcaucucuuuuccauguaacauuuuaaccaaaagcacuauccuuggucauaacugagacccaguuucuauguacaauaugcuuauugcagauuuguaucuacuguauaaacaaugaucucaacuuuuuugauuaagcacuuaaucaggggaaaagagaacacuccugauauaugugauuuuuauaauuaaaaauaaucuauguuuuacuuuccaauacaguauuguuaaccaaaaacacaaauauagaaaaauuuaaaggauaaagugagauaaaauauacauauucaaauuuucuucuguauccuaauacguugucuugcacccauuacuuugaaaagcugugcuguaauucagguaagcuaagccauguaacuuagaauuagucuuggccaaaugauccaccuuggacaauaagaaguacgcaagaaguagcauucucaggcaaaagccuuuccggccagugugugacuccucuuucccuuauauuacgguaaccaaccauggucuggggaggagcagcuccuuugccuggucagugaaagaggguaacaaagagcagagaccccagcugacccaagauguggcgcaagugugaagcaaaccucuguuguuuguuacugcuguacaacuuaggccauccuaaccagugcuggaauauucguuaaugcugccaucccuaaugagucacaauuaacgugguuuaguguaauucuauugugaggcacagcaugcucaccuagcaaaaccagagcacacguuuuuaaagacaacguuaaaauuccgaaauaguucagucccuuucuuccauguuuuagcaucacuuccauuccccaggagaaugcuucaggagaucaaugugucaaaugaugaaacuacucucaucaccaccaguguuagugauuucaagugugcacguacuaaucccccaccuaauaacuuuucugaacaaguggaaggcacgggaucuucagugacaaaugcucugguuugguuugcaaacuuugacgcaaaucacucucuggugacuaaaauuggaagaugcccuacaggagucuggcacugcugcauacaggccuaagugcccccaugggagaaucagcuuuuacccugggcugauguuuucucugggaaaaauggacuuuccacacccugcccccuaaaugcauucccaugcuccaugacgccacgguugugcucuugguaaagaauauuuaaguucugacaucaugauaaccauggguauuauucaugguaagcucacaagccugggaaggcacauucuguacucucuuuaucacugaagucagcaaugguuuuaaaaauagcauggcucacacacccaggggaccacugauucauuaauggccaaauacacacuacuguggacuccuaacuuguaugguguuuuagauugugauuucuagaaucaaggcacacacauuuaucauuucccucauaggaguguuaugcuguacuaauuuauaaauagagaucugcagauccuaaaugaaggaacccucaaaaauuacaaaaccaggauuugacaagccguaugauuugugacuccaaaaugacguaaaauguaauuaaugagaauaucuaccaacuugguauaacuaugauaugucauaccuaaauaaagagagaugauguuacaaagauaauugacacuaaucuuagugaagucuagaaguaagucauagguuuuucacugucgaggggggaagggaauauuugauucuagauaucccaugcagguucuuuaagagaaguaucccaugagcagagaauguuuucaugauuuauaaauacauuuagaaguacaugacgacuuaagccuuuugcuuaaauucugugcuaaauaagcaacuuucucaucucuuacugggauuccagagaggaccuucugaccaaggagaaaauaccuugauauguaggccuagcuucucuggaugcuaggauuaucucucuuuaaaugauucagauugauccaucagccuuuuauagaauuaguuaguaugaaccagucuuuuagaacccaauaauccuuaaauuuauggagucaaauuuccaaaucugcuaggcugaggacuguagaggacagagugagcagcauccaggaauaucugcugagcaccuacgauguccaagcaccaccccaagaguggcaggugaccacuggcauugugaaagaaagggcuaccuguuuuucaggucaacaggacgagaugggccaaggggagaagagauaacugaccacagaaggaagucgcaacuguugcccauugaacggugcaggcuucagagaguggauggagugcucucagagucagcgaccccuuuacacacgagagugcaccccaaggcgaagccaggggugagcugaaacacagaggccagugagcacuggguuccagggacagaugagacccauuuuuauuuaagauucauaagccauccacugccuacaggaccugggauagugugcagauacaauacaaagcacaauaugaaaauaagauaaaacaggaccaaacccaucuaagggaacaucaggaagaauaaaaccaugccugugguugagggcucugcauugcagugagugacaaaagggucuggaaaggcuggagucagcguggcaggucuuuggugccuaguuucgauuuuguucuguugaggagucacaggagguggcugagaggggagggaggaaugguaccacuucugagugggaaaugaaagcauguggccaggggcuuggcacccaccaugaaggcgcaucugagaggcgauaggaaccugcagggaaggugcagacaacaaacuagagggaugacccaaagacccuggcacugacagguaggaaaggaaccacgauaauguggaagccacaggaucaggugacaggagaaugaagggaaggcugguccccuuuggcguccuugcugacuucaaguggcagaggaaggcaugaccugguagacagaggggccaaugcccugaagaagcauucaccagggcacugcaacucuguuuccagaaggggcucgcacacaccagugucaggguggccaaggugcuucccugagggaacucccacagcaggacgcggagagcacacccuccuggcacagaugcccucugcucugcccugauucccagggagggcaucuccaaggccagagcugaccugaaacaaaaucagcucucaggcacuccuaggaguuacuguccugggccaauacccuuuguugaagcugggaggaugcuaucgaauaacauaaaaacuuaaugccuacgcuggagcuauggaguacaacaggaacuacaauccuacaaaacacagcaacccuugcggaaccacaaaggccaaucaaagccauuuacccaacuagggugccucauguuacgcauaagauauuaacagagaauguccgaauguauguuuuccuuccaacggcuggaugcagggaagcucucugguucuuucacuagcaucaaguauacucaauuuacuccuccaaacaagccacacaggcccagcgcuaagagucuucccugucaguucucaaaagguggucaagggguagaaacucuguugccaucuugcaccauacggcucucagcagcucgccuugugguccugaccuugccagccaagcccuuuucauuccguuuuaguuaagcagaaaaugaagcuaucagcuccauuuccacucucucugcaugaauucauuucccuuuuccauccuggcucaaacuacauggcucauauaguauuccuaccgaggucuuaccuugcuaaagauucuucucuucuaagacuugcugaauccaaacaaaaaggugggaggacguaugaggauacauucuaaggggcaacuugaaauauaggaaaggauacaagaauaauaagcccguugauuucuuguuucccagcuuuuacacccacaaaauccuaagaauuauuaagggauggggaaugucuauggaagugaagucagugacccaggaaucuguuuuccauaccuacucaugccaugaaaucccauuaagucaccagaaauccccuggaggauaagcucuaacaccaguuagugaaagaauaaaaaucacugcaauuugcucauuaccccagcuuuucacccaaaccauggcugaaaaucgcuagaagcccaccuuucuccuggacugcaggaaaaugagcugccaagggcccugcacauccggccucugcuacaccaggaguuuggggccggaagcuccccagugccccauugguccugggccgcaugaagugauucagagcuacagggucacgacuaagccauaaaauaagaaacaaagaacaaaaugagccuuuucuuaguugcaagcuaaaauuuggggaaagugauuagaaaaaagaaaaacagugcgguugcugggaaggccaauuuccuuuuacucacaggaaaucuuuucugcugauuuaagagcagagccacaccugcucacagaccaaaugucagcacaggaggaagcugcaccuugaguuauucaaccagugacaaaagcauuaaaacaauucugagcuaaggaaauucaaccugggcuccagggcccagacccgauccaucugcacaugaguuagagaaaggauucgaguuuauggaaagaaagggcauaggaaaggcacaggcucaauucaagacuuagcaguccuguuuuauacauguucccugaguacagaccagcagaucugggcucacaaacaagacccaagaccuccauucuaaaaggaaugagaacuccaccgggucaacugacaaaacuggaauguaaacaguggcucagauaaaaauauuguaucaguguuacauucucuucaguugaucucuguaccauguaugagagcgcccuauucuugggaaacacacgcugaagcaucggggguaacgcggagcuguccagaggagcucugugugcugcugaagagguucuguagucucuauugucugaugcagccacacaugugucuaugcagcccuugaaaauguggcuggugugacugaggaacugaauguaaaguuuuguuuaguuuuaauuuaaauagcuacuuguggcuaguagcuaccauucuggauggugccggaauaaagcaccaugauauuuguaacuuacccucgagucauauaacgaucauucgugugucuguauauacaaacacaccacaggcacacacacaacaaccaaaagagcaacagugagagacagcacauucaagggcaugacaaaacaaauggggugaagugauaacaggaaaaucuggauaugggguauaggggaggggaaucuggguauagggguagucuuuguacuauuuuuauuuuugcaauuuuuuaguaacuuggaaacuauuuccaaauaaaauguuuuuaaauguauaaggaugaacauuuauuuauuaaucacugaaaucuaccaggcaaaaagaggaacucauuuccgggcagggaauggaacccaggauguccaagacauuggcaaauuuugaaugaauauuguggaggccacaggacacuccucucugaacacugcuccuccacacccauggcacagugcuucucccacaguggcagaauaaaugcccucgcccaagauaaauuuucugacuucuuuccaucugaccucuagccuguccaugaaggacuuggcuacaaagguaaguuucgggcaaguuuuguuuuugaaacaggguuucacuauguuguccaggcucaaacuccugggaucaaaugauccuccuugccuuagccucucuauuugcugggaccacagguauaugccaccauccccagcagggcaauuuuuaaaguaacagcuuuauggacauaacaacucacauaccauaaaguucacauuuuaaaaauguacaguucaggccaggugcaguggcucaugccuguaaucccgcauuuugggaggcugaggugggcagaucacaugaggccaggaguucaagaccagccuggccaacaugacaaaaccucaucucuacuaaaaauacaaaaaauagcagggugugguggcacaugccuguaaucccagcuacucgggaggcugaggcaggagaauugcuugaacccuggaggcggagguugcggugagccaagauuguacugcugcacuccagccugggugacagagugagacccucuccaaaaaaaaaaaaaagguauaguucagugguuuugaacacaauugugugaccaucacugcuaucuaauuucaaaauauuaucaucacucugauuaucagaaaccccauacccauuagcagucacuccccauucccccuucccacagccccuggaaaccaugaaucucuacuuucuaucucugcggacuugccuguucuagacauuucauauaaaugguaucacacaauauguauauguccaucuggcuucuuuugcuuaacauaaaauuuucaagguuuacucaugugguagcauguaucaacauuccauucccuuuuauugccaaauaauauucaguggacuauuacugcacacuuuguguauccacuugucagcuuauggacauuugggcugcuucuccuuuucgcugcgaugcaaccauguggacacguguuuuuauuccucucggguacauaccugggaguggaacugccaggucagguggcgacucuauguuuaaccuuuugaggaccugacacuuguuuuccaaaguggccuccugaaguccccaggagucaugcaaagucccccagaggucccaggcaaagcgcacagaaggcccuucugcagagaugcugcccuucuguccuucgguaaaauaccagccuaaauucaaagcaggagucaggguuuguuugauuugagguaaauaaauuagagaagcugugacucgcucagugccagcagcaugcuuagccugguaucgccccggagaaagagccagcaccuggcauggcagacgaggguuggcacaaugcaugcuugcuugccagaugaagaggcgcucugugcaaagugcagcugcagcaggacgcaaacuggugcucucucuaccgucccucaccagggcaaagcugucugugcuccuggucaaagccucggaggacuuauuugcugucauccacacacugugcuccggaaagugccugcucagaaacuggcagggagaagacccggagggagugaggaccaugagaaaucagagagcaacuagacaaggaagauaucaaaagagacggguccuucgaggccugcacaccuguuaguccuaauauauuucagagcaagggaucagacuggugcacacaugggcugaagcccagggaaggagccaaguccaccaccaaugcaacuggugagucaguaucaggcauguguccccuccaagcuggcaguaaacaaacacucacacuucauguuugggcacuggacuaaauuaccaggcaaaaguacaaauuccggccaggcgcgguggcucaugccuauaaucccagcacuuugagaggcugagaugggcggaucacuugaggucaggaguucaagaccagccuggccaacauggugaaaccccaccucuacuaaaaauacgaaaauuagccggacaugguggcaggugccugucgucccagcuacucaggaggcugaggcaggagaacugcuugaacccuggaggcagaggcugcagugagcugagaucgcgccacugcacuccagccugggugagacucuaucucaaaaauacaaaguacaaauuccaaagcuaguuaagcaagcuuggggguuggugaagaguuggugaggaaaggaggauuucugcagagaagagcagaaguccuggaauggcuggcucucucuuucauucccuucacuuuucauccaugugugcgcccuggggagacacucgguuucaucuuagagucacugugcugagccucauaggccucuucuuucacucuggaccccauccuucguaucguccuguccucuugcaacauuucacuuguccuucaccuuugcccccucgggacaaacuuuguuggcaggccuggcauuauuuuuguuuuugaagauauuguauuucaaaagcaaacugcuacauauuuaauaaagaaagcucaaccacaguuugacgcgguggggaugcagaaguggcaggcagguagcuugagauccugaauauguccuaccagugcacagccuguucccucagcccccauuaaucuccacacucuagccugucccaccuuuguuauuucuccaauuccgugaacguugaucaguucaguauagcucugaauuuucacagguaacuccuccugucuccugugcauucauuuucucagucacuauucaauaaauacucaguaugaucaccaccauucacguuuuguuguuuguaauaugguucgucuuuugaaaucauagauaaguggcacagaaccugguaugaugaaaaaugucagagaaaacaaagauaagaacgugaacuugaucuuuacauacacucucucaucuaagccucacggcaacccugggaggucauuauuaucauccucaccuuacagaagaaagagauccagagagacuggcaggauucgcucccccaaggucaugagcucguaaaaucagaggaccugaauucaaacacaugucaguaugacccuaaugccuuuacauuuuccauuaggaauguaaaugacaacaucuuuaaaagucauaaacccuuacucagccacgacaugguuauaaauuguagaaagaacaauggagugggaguuagaaaauuuggcuucaagucuggcuuuguguugauuuugagcaagucacuuaauauuucugaacacagauuucuucuuccaugaaggaggccaugcuuaccaaacugggcugaguguccugugaggugcuaauauuuauuaugaaaaaagaagaaaaaaaugaggucaaaacaguuuaagaaaugcuggguuaaaucaaauaaagcgguuuucuuuuuugcaggacuucucagaggcuuuaauaucgcagugcacaccguggaucuccaagagggauauacaauaugcucugaagcccaaauuuauuuaccaaagggaaacuucuuuuuuuuuucuccauacaaaacacuuacucuuuuuugucaggauaggagauugaaaaauaauggauuggauaauccccaaggaaucuuuuagcucuaacaauggguaauuuucugauuuaucuuaucauuccaaauggacagcagauuuucugaggguagaaugugcuuuucuaugaaaucaagaaaauagcagcuagguaggggcaugccagaauguucagagaagcaaaaggagcaugaagacucaucauagacagcuguuccuauaaaagacuugcacaucuagggguaucuucuccccuuuaaaauaagucagcaucauccaaaugccauugggcuggcuuugucuuccaaaacaaauuucccgggcauuaacagagacuauaaacugucuugacugacuuaugaggaacaaucaauaacgucuguccaggacccaucaaauccaugucuaaggaaaggccaagucuuuaggacagaaacguggcauggcaguuucacaaacuaguggagauggcucucuggaggacagucuaggugggacucccaaggccuucacugcuuugcaggcaccucuuccccaggugugcaggaagagaccccagccaaagaaaaccuaagaggcuuuguuggggaggaacaggggacccugccggacccugcagguuucccuuucccuacuggcugaaagggagggcugcacacaucagggaggagaaauagaggaagaagaugaugggcacaaaagcagaggggcaacaaaguacagaucacaucuugggggcacaggguacaguucucagaauagagaagaauguccaggucaaagguuuccuagaaaacucccuucucuuuaaaacagacacaugauuuuccuugggacauuuuuauauacaacuuacaacugccagaucacucuuggaaaauccgcugcucaucuuggcaguggcaguggaaagaagccaguguccuuagacauaucucuuugugggccccagccccaacaugcagguguccauagcacaggacagaggacuccaugcagccaaaaaucagugcaguuacccccuaaguccuccaucuagaaaaaaaugagacuugguaguagccacugcccuguggauucagccagagcccaucucuagaccccaccuaucccccugcuguuccaaguuccagacuggggcuccaggaucaaaauggcucagggcuuugugcuaagaagagcucugaacaagacauaaggggaugguuuaagacucaggaugcugaggauuaagugucugggcaguuaguuccagaggucaccuaaaagacuacaggguucugcgagagaccuggaaugaggaacuaacauugauuguaugccuauuuaaaagccagguacaacauccagaguauauaaagaacucuuacaacucaauaauaaaaacacaaccuaauuuuuuaaaugaaugaagaacugaauauacauuuagccagagaagacauacaaauggucaauaugcacaggaugaucauuauuaauuauuagggaaaugcaaaucaaaaacacaaugggauaccaagaaaacugaaaacauaugucuacacaaaaccauguccacuaauguucacaggaggauuauucauaacagccaaaaaguggaaaccaccugcauguccaucaagugauuaacagauaagcaaaaugugguauauuccuaccgugaaacacuauuuggcaauacaaagcaaugaagaaccgauaccugcuacaacauggaugaaccucaaaaacaucaugcuaagcaaaagaagccagacacaaaagaucacacauugucugauuccauuucaaugaaauguccaggacaggcaaacccauagagacagaaaauagauuagugguugccaggggcuagaaggagaagcgaauagggagugaguuaacaggaaugggauuuccuuuugggaugauggaauguucuggaauuggacaguggugccugauguacaacuuagugaacaggcuaaaagcugaugagcuguacacuucaaaaaagugaacuuuccgguaugugaguuauaucucaauaaagccauuuuaaaaauagucacaaaaguagaugccugauacauauucucacccaccggaccugaaauacauaucaucaucccauuuuacagaugaggaaacuugaggacuggugaaaagcagcuaauugccaagaggcccgcugcgaagccacgugacggacuuacggcaaguggauuuuaacuagguuugcugacuccggaggccacguucugcucgcuucaccacgcugcucccugccaagaugauaagcuaaccagcaacugcagaacgguuccucuggaaaaaagaucacucccuggacaaaggaucacugaccuacauaaaaugcuagugcuggaagucacguuaagcggcaucucgccaaaucccuucauuucacagaugaauaaguagaguuucaaggcacuguacugaccuguccaaccaaagcagcaaggcuggugggcacagucacccucucauuuuacagaagacaagcuggcguauuguucacugcaauuaguuaggaaucaaaagguagaaggaguucacccgguuggggcaugcaggucaacaggcauucaccaaccuucaaacaugccagccucacauccaggucccagcuagaagaucacucgggccaguuauagcucacauuauucugcgguuacccugaaauuucucuucuaacccuaggagugcucugaaaagucccaccagggugcgacuguuccaaggaucccuuggagcuuuugaacuacuuagcaggaaugaggaguucuggauuuagcauucaagugugaggauaaaggcuagggagacugaggaagcaacuauccuccccccgagucuaaagugacuccauggggaaccacuugagaaggaaagggaaggaagcugaagccggauuauuucacacugcaaccgcagggccucgaggacucuaaguugggggucuuuuuauugccugcuuaaugucuccagggaauguccugucucaaacuuaaaaugucccaaauggagcucauuaccccacuguucuccaucccacaaaucuguuccuccucuuguuuucucuuucccccaggacuaucauucgcauuccccaguggcugaggcuaagcacccuggcucaccuuccacaccccccucaccccccaacuuccaggcaguggccaggccugcuggcucgagcucugccuccacuugccggcuggaaucaccuccuccucugcaugcucacugcaagcauuguccuggggacucaguaaauguuuacugaauugagaggucaauccuacccacuacuaguuaagucuuucacagcaaguagcagccacgauuauuucaacacagaaaaggagaaaaagaggagcuggaugaccucguguaaauaggugacagagagguuauuaaagcaaagcucgagccaggaggagcagagcagauggggcugugagccacucuuugcacgcauccugcuggaacagaaaggcacaccaagacaccagggcuaccaacugcaucugcaaauuauucauuauuucagugcagucccucugaacucuccaucugcugauggcuacuacagucaaauaauuacauucaaauaaaaaaaccugugaccuggaacuuguuccagucagcccaagugagacacccacugucccccagccgggccuugugcaccccuguguggggcaaccucgagcuugcucccuagccaccuuuccaaaucaagaccauccuucaaaccccagaucaaaugaugcaucccuugucacuggggaccucaggguuuucucuuugggccuaacagugcucaucacguauuacccugcaucgcuugaugucuuuuguugcuugguuuaaucuugccugcaaugaguuuaagagugcuuggaaaagacagcgacugugcugaaguggcuaauguauguaaaguauuaagcucagaacugggcuuggcacacuguaggcacuaccaauauaagcaucagcuacugacuacuuauugauguccccugaguccccaagcaugaugcugcacauguggcacaagcuaccaaaucugcuggagguugacaacagguuucucgcaccucuuuuaucuuccuaaccucuacucaaacuaaaacuccugcccuccaauucaaugccaggaauuccaucugcacauccaccaaccucaccacucagucagguggcucagcuccuuccuucuaggcuaucccuucacuguucagaguccagucggccaaggugacgugggccaggggagaggcaggcuguagccugacauagcgugucucugccucacaccccucgcuugucucgggguuagagauauuauaagacuuggugaaccauuuguuucuuucugaaaucagaaugauaacuaaguagagcuagaaaaagaggcaauuuuuaaauuauaccacgcacugagccaaagccgcuggugauacaaugacaacacucauuuguccagggcuggccaaaucagucacagggaccccuuuucggugugaaacugcaccaaauacugcccaguugggguuccaucucagauucugagaugucccaugugacuacucuccaaacggcauccucuggucacacucccugcagcagccaucaauucaggggcuggaggcaggguggcaacugugaagaacgcagagguggcugagccucaguagcuuuugacaggcaucugcaaucaauaagucuaguaugacagacucaggggaaacccuccuagcuucggagaagguggucugcaucuggacguucccaccuuccuagcguugggacuagcggccccucuggguacaucaagggccggcacuugaaaccugcaaagaaacaucucggucugcccauauccagagacccagcuuccuggcuuuucuucaaguaucuuaaucuaccccaucucuaucgagcacuaaaccagucgaagauacuuugggaucagagaaggaacggcagacaaagccucacauuaagcaucucuuuaguaaagcauccagaaaauucugccuguguuacuucacuuuuacucccaccuaggccccuguggcugaggacaagaccacacacaagggcacuagccaagccagggugacccaucagccccagcccuccuguggccuccacuggauauccaggcacccccgguuuuucccuugggucccaucccaccacuauucuggugaucuggagccauacugaccaacacauagaauuagcuagcgggcacaaguggcuauuuaaauuuaaauuaauuaaaauaaaacauugaguuccucggccccacuggccacauuucaagugcuuacuggucacguggcaaguagcuacugugggagagaggguggaccgagagagacaucaguacggaaagcucuaucaggcagagcuguucuagauggugacauuuaaacuugcagguggccaauuuuuuuuuuuaacugucacuuuguggucuugaagaaaauauuuuuccaaccugaaaggacaaaauugcuuucucuaaaaaacucagugagggaaaaggucaccuccacgcaaugaccuucacagaacacccguguucuucggaagcuggucugcccaucugagccgcuucucugcuuucuaugacacuuuuggaacccucagcccuacauccagacucccacgcuccgauggaaacuuuaaccaaagcauaggaggggcucuagcuuuucuucuggaauuuguaagucacuguuuuuccaugggcccuacguuacuuuauuuggccuaguauaacacagcaccacaagcuggggggcauaaucaacacaauuuauuaucucacaguucuggaggccagaaguucaagaucacggugucgacagggccggcucccuccgaggcugugagggacgguguguuccaugccucucuccuaguuuccggugggcgcuggcaaucuuugcuguuccuuggcuucuaugccuauuaacccagucucugcuuucgugcucaugagccauggucccugugggcgugucugugucugaauuuccccuuccuaugaggacacuagucauacuagacuaggggcccacccuacuuuagugggaccucaucuuaacuagccacaucugcaaugacccuauuuccaaauaaggucacaugcugaaguacuggggguuaggacuucaacaugugaguggggagggggacacaaaauucauccccugacaggcccucaaagccucaaagaaaaagcacuccuccuggcccaccaucugccuuccauuuuucuauuaauaugaaaagauuuguaagaaauuacuggcuacucagcuuugugggagcagcuggugaccccaggcagaagcuaacaccacaugaggcuauuuccaugauacaccaagucauucaagcccacuauccucgauuuaacaagguccaagaacaaaaaccugaccuugaauacagugugaaggaaaaacugucacaauugucauggucacaaguagagugcuggggaguuccuccaaguucaucaaaccgccuucuuuuacagggauguucucugggugauguggcaaaaacaaaugaagaaagucccuccugacccagacuccuuaacauacugcuggacggucacugucaucauacaaaucacugccaagcucaucagacgugauugucaugaacagaaagcuauccaccagcacaguggacccagaaaggugcugugguucauggcccacaucacgugucuggguuauaagacacaggugaauuaccuaugaauucaggcagcauggaacagaaaaaaccaauaagcuuuagugcuagaaaaccuggcuugaauccuagcuuugacacuuaauagauaaaagaucuugcacaagugaauuugucucucuaugccucaguuuacccugcuggaaaaugcagagccugagaucuacuucacaucaggcuaagaaagcucucuggauggccaucacuguguuaacuagcauuuacugggcguggaugacguguucacggcagcucccaacaggucugagguaagacgccgcuauuauccucguuugcugggagaagacucgggcuuagagccucugauuacacagcugcacucuaaccauuuccuaauacugccucucaaaggaggucagcaggugaaauaguggcaggcucuauaaaugcuuguucccugcacccuccucugguauccgccacgccgcacaacaguucauacuguccuggcacuguccacucccaacaucuucacaaggacagaagaucaucaaaagugguuuagaggaaauaacaccucugccaggacacagucauucccucauuugauauuuccccuaacucucuucccuaaccucuucccacauaacauuccugacagcugggagaacaucgcugaccgcucuccaaccucccguccagaccugccucugucuaucugcuccuucucacccucuguucauccccuggagacauuaauacagaaaccaacugucuggcuucugaccuccauacucuuuuaaaauugcaguauaaagaugacggugucccuggguaaaugguggugucuugguuauggccucaugguuuuagcaguuaggcuuugucccuuggagugguuaaauaaagacagacauuagcacaguuuuccacccaauuauccuauuuacaaaaauagaacucuccucugugagcauuuuaaauagaggccuuaauuuccacagaugucaaccuuaccaggucgauuccuaaagccucaauugaugagcuagaauacagcauggugggcaauggaaucuacccucaaaugaucucuuccuauauauauaguauuuuggauguauacaucuauucauaaauauacagauauauuuacacacauaggcacacacaugcgugaacacgccaguuaaaaaaaaguaauagucuugaagguugucugauaggcacguagacuggcaguucugcugaguguuuugggucuuuguguugcaucaaaccaguagaaggauaagaagaaguacucagaccuguuauuuuggccuuccagggaauaacauuugcugaguugcauuuucauguuaggccuugagcuuccaaugaggacugcugugagaagagcuguaagaacccaguuuuucaucuguuguggggaugccaaacacccuguucaugauaccucucagugcuuccuagauaaaaguccacaugcaaaauuuaguugaaaagaacuaaaaaaaucuuugcuccucuugaggaccuggugcaccuuccuucucugacagcaagaaugaccgcagcgaccacauuugccuuuucucuuugauguuaugaagcucagcuaaguagcaauguaagggacuuauugucugcauaucuguaauucuuuuucuuccuaacuuugaacuucuauauuuauuuguauuuauccugauccuguccuaaauucuuuuauguaucauaugguuuauugcaguauacguauuuauacuauaaaaucaaucaaaaguuguaaaacaaggugaauuacaaauaaucaaauagaacuuaauuaaaauaauuaccauaguaaacacagccaaauuuagagaauaguauaguuaaaaaacacuacaaucagagugaaacauuuaaaaaaaaaugaacauguugaagcagacacuguaaguugccuuccuaauagccauucccucuuucucuucuggagagacaggauuuaguuuagaugucacucuccccaccaccaccuccaaccaccuuccaccuccccuuugugugacucaagaaccaauccuggcuagucuaagcuaauuguuugcugugccugggagugaaugaucugggcuaggcauguuacccaguuauagccuauaagaaggggagagagaacagcugggaccuuuggggaagguucccuuauuugaugaaugauuuggagggagggagggagggagggagggagggauggauggauggaugguuggauggauagauggauggauggauggauggauggauggauggauggauggacaaacauauuucugcugggccaaccaugcacacaaaccaucacuuagugcuaggcacuaaacugcaugcauugagagauaugagaguaaauaauuaaugacuaagggcuugagaaggcagaugccauaagaaucacaaucuucuucagaagacaccccaaagauagaccuuccagauucucccagggaucauguuaaucucugagaaacauguugagaaauucuauguaaguaccaaauuuauaaucacuacauacaaauagcucuugcucucccacaaagaucacagaaggaaggaaggaugggaggaagggaagaagagagaaagggaagaagaaaaggagggaggaaggcaggccaaccagaaaaguuuacugccccuuuccaaaguauacuuuguauauucucuggauuagguagaauugcuuccauauucaaaaucaauuguaacugcucucaggccacucacaaccuugcuuuucucuaaauaccuuuucucuaagagacaccagccaugcaugugccugugugcacacacaugcucagaagcuauuucaaauggucuccaaccuccucagccccccaccccacaggggcagcuccuuugcuagaaaagggacugaaguccaagcuguuugcugcauccacuggcuccagugucccccagacaccugucaucgcccacccugggagcucuucuccacuccccaaacuaucuuguucacagcaaaauaaaauacuauucuuuuccacucuaauaagaugcccucuguccggccgugcagagucugucucgugguuuaucacuacucaacgugucugcaugugauuuucucccucaccucucccccuucugcaccaaaucaugcccaccucccuucugaacugcuggaaaccaaaaucuuccugaaagcaccccaagcuaacuuaugggguuaggaucaccacacccaggauucccucaguccuccuaucuuuagacuucuuuucuuuuugaggacacgauucuccaaaguuaacuucuauaaagcaaauccuauuucucacugacccauauuuuaccaaacagcuggcacugcuuuuuucacagcugaaaaaaaaaaaaaaaagaaaaagagaaagaaaacucugcugaagcacauggagaaccggccacacagcccugcugaagcaugagggauuuuccuucccaggacuuuccaggcucaaaauuccugaacuucccacauuagucaaaugcugcugcuacgggcuggacuucugcacauuagaugucaucguaaagagaaucuaggugacaaacgaggcagaaaugagcacaaguuuguccccaccacugggaaaucaauucccagugcacaucccacaagaggguggucuagguaggcuugggcaagcacagguaugccucugucccaagguucuccugucccucuuuacaguagucagaugggcaugguuguuuucuauuccauucuuggcugaaccagugggcacagggcuuugcacacagugggccccccagugcugcugagagacugacuucugagagggaggugauggagacugaggcugccuccgcagaacagagggcagcugcauuaccaggcaugcccucugagaggccucugcuuuaagcugaguggcagguaauaaaaacccagguuccaaaggagcuuaaucgagggugcuggcguggcagcugaacuggagaucagaggggaccagcaaccacgggagccuuccuacaugucacaccauuccuugggaccagcagugacucucuaaggaugaaccacaccaucgcacacaucugaagcugggaguggacgaggagaagggggaaaucuucauggagaaagacaccaaaugucaugagucauaaagcaaauucugacuuggaaccaucgagggagauuaucuuucagcucagagugcauuuuuuuccagcaagauacaaaaagcuucauggaucauaguaaccagcuugccuguuauugaguugagcacaguagggaaaaugcaaagguaaaguguaugcuugcagaguggcucugaacacuucugaaaaugaucacucaagggcuggagggccaagggagcgucucugcgagggcaggcgugcauacacaccagcggcccccagccaacgcccugacccaguacacauaggcagcaaaggaggugagccuuucccuuuaauuaugccaauugugagauggggaaggcgccaguggagaaggcauuuaaagcagauugccccauuuagggagauaugauacuuggaaaugaagacuggcacuuuuccuagacuaaagguugugcugaauggccagagagcaggagggcagcagcccugccuguggggcuuccaccugacuucaaagacgggcgccacgcuggagccagugcacaacacaaagggaagcgggggcucgaggccccaggcugcuaucugcuccaauuuaggggacaguccugcuucuuuccaagagacacccuuuggaaguggggagaaaguagcuaaacaggccugaaugggagggcuagaaagaggagauacugcaccucaggccuugcccuuuaauuucagagccauuuuaagcauaaauaucguaucuaagucuccgauagaaggagcacaaaugguaggcgcucaauuaaugucaucucacuuuugagucagagaaacaucuucacuuugcauuacugcugaacagaacugagggccaucaagaccacuuuguggaggccauaaggaaaagaccuagaaacgcaugcuucagacacauuccaccacaucagggcugaaacgagcagcaggaagaugucugugcacagagcaagaaagcugguuccaccaaagccagguuagaauauagauacauguacauguauauacacauagaaaagcuaagugugugagagagacagagagugugugugugcaguauguuaacuaaaccucuuacaaaagucauuaaaauuuucuaaaaauuaaauucugaacaauaauuaguuugugaaaccaacagaacaaagugcuaagagccugagaaaacaccaucucuucuuuacauagaucacugaggacuugauaagaaacuuccucugucacacagcagccuccgugggcagugggaggggagcugaaggggagagaaggagagacgaugauggaauucgaaagcuaggaggggcuuccaauacguucucuugcuauggaggacacaggugauacggcuucuuggagaucacacagcgagucucugauucucugacuacagccuggaugguucauacggaugauaccaccacggcacagagaucuccauaaguacuuuaaaaacaacaugcauugggugaucuuucuguucggauacugacucucagggaagacggccucacuuccagcaugggggggaugcacauccuggucaguuuaacucagccagggcucaucuucuuccuguugucaaugacuugacuuaggcacuggcacacaccaucagccuggucaacgaggugugaagggaggucugcaggaagcuucuggaaaagguuuucuugcuuuaaagagaugcucuuuuucccauggacacuguugaguuggaugugaugccuagaacuguggcagccaucagaccgacauaccacaaaccauggggcagaaauacagaaagaacaucaguuuuuuacaaccaacccuggagcugaugaccucagaacuucuuguuaaccagucagucaguuuucccuuuuguuuauacacuuuguguugguuucugucccuugaagcuaaaagcaucuuaaccaauaaucuacuaauaaacagaccaugaaacaaaaaacaauuuguuuucuaccauccuacucucucugaagagaaacaaggucuccugagcugacggggaaaauccccaccuaacucuuuuucccugcuucuuccuuuuuucucccucaauggaacuguaaacacgcucagaacuaccagccucucugagaagaagccuuaaagaugcucuggucccacauccauguucuguuggaugccagucuccggcagucccuucacaaggcacucaucuggaauaccuccaguaccagagaaaucgcaggccccauggauguccacauguggagggcuucgguacgguguccuuccuuagggccuggugggaaucugccuccuguggcuuuccagccauugauucgaguugcaccacagcuaccuucuauuauccaucugcccuucagauacugcuucuguaucauacagcuuaauucucaauuauuauaauuccuuucagacaaauguuuucuuacaggaaaugcauauucuucugagccauguucuaccuuccccaucucucaggcucagacaguuagagaaaucagucugucccauuuaaccaaugaacgaaugaaucagucaaccaaucaaucucccucugucuuuuuccuauccccaacccaaacacgucuaauaauauaaggguaauaauaaucuuaacagucacauauuuugaaagaaaauuggggcaauauaaaaauccaauauugucaaucucaaaauccuuggauaguguccaaaagucuccugcaaacacacacgaucugauuuaauuaaaauaccuuucuucaaacacugacauuaaagagaaauauuucuucuucaauauuauuuuucugauauuuaauuauuucccuuuuccuaaaaaguauauguauuucagcuguguucucucucacucuuuuuaaaaauuacuagacuuuauuuaguuuuuguuuguuuguuuguuuguuuuuuugagacggagucucgcucugucacccaggcuggagugcaguggugcaaucuuggcucacugcaaccucugccucccggguucaagcaacucuccugucucagccuuccaagcagcugggacuacaggcgcaugccaccaugccuggcuaauuuuuguacuuuuaguagagaugggguuucaccauauuggucaggcuggucucaaacuccugacuucaggugauccaccugccucagccucccaaggugcugggauuacaagcaugagccaccgcauccagucagacuuuauuuuuguagagcaguuuuagucucacaacaaaauugaguggaagguacagggaguucccauacacaccgccugcucucacgcaugcaucaacuauacucucccauaucuccuuuaaggcaagcuugagacccaaaucuuagcugauagcacuuuauuguuaacugugauguguccacacaacuagcuuacaaaagagguucuggaacacagcccuugguaaaccuagaacuuguaaaauacauaugaacugauccaucucauucaaaacucccuuuucccaggcccagaacuuuaccuaauuucucaccucuaucuuauacauauuacuaaguaguuuucaauaacaauuagaaucuagagcuaaaaaucauccuccugaaaagaugagacacagacacuuagacauauguaccagcaacucucaaucauucguuuuaauguaagaaaaaggaauauugaccagcacaaaccacauaucagucaaaacugcuuuuaccaggcuuucccggaggaaaaacucacccuguaauuauguuucaccuaggaaaagauaaaaauuaauuuauauaugccaaacuacauuuuaacuuuaaaauguagagguggccuagaaguauauuaaauccaagcauucauucaauaagcauuuauugaguaccaaauauuugcuagacacuuugggaggcacuggggaucuggaauugaaagccagccuccugcacucaugaaaucucacaaaagagaacuaaauacauauagaaaucagcaaaucugagccacagugguacccuucacacucacaaggauggcuauccuaaaaaaaggcaugcgacaacauggaugaaccuugauaacaagcuaagugaaagaagccagcugcaaaagaccauguauugcaugauuccauuuauagaaaacgucuugaauagaaauuugacuagugguuuccaggggcugggggagguugagaagggggaaugacugcuaauggguacagaguuucuuuuuggggugacaaaaauguuguaaaauuagauaguagugaugguugcacaauuugugaauauccuaaaaaccacugaacuauacacuuugaauggguaaauuacaugaauuauaucucaauaaagcugucaaaaauacauguggaaauaaauaguccucauaugcaaacaagaggagauaaugaaagauauuauuuacaaggauuaacuuaagacauguauacaaccuauauacagaaaacuuuuauacauuacuaaaguacacacaaaaaaagaacacauagaaaacauugucuuugacgggaagacucaaccuuguaaagauguuaauuccuccuaagaaauuuauaaauuuaaugugaucccaauggaaauaccaacaggcuuuuuuucuggaaucaagaauguugggucuaaaguucauauggaauaacaaacauggagaauagccaggacaaggcugaaggggaagagcaacgagggagaacuagucuuuucagauaugaaaagaugauauaaauuucaaacauuaacaacagaucaacccauggaaaaacauagaguccagaaauagacucccagaccuauaggaacuuaguaaaugauaaaguagggguuaugauacuaugggaaaaauauaaacuuuuaaacaaauaauguugggacaauugaguauugaaaaaauauaaaguugcauccaagccucagaacauacucuaaaacagggguccccaaccacuccccaccccgcccuggcccggccgcagacuaguaccaguucuggccuguuaggaaccaggccacacagcaggaggugaguggcaggugagugagcauuaccggcugagcuccgccuccugucagaucagcaguggcaucagauucucacagaagcaugaacccuacugugaacugcgcaugcgagggauccagauugugcgcucauuaugagaaucuaacuaaugccugaugaucugagguggaaugguuucauccugaaaccacccccacccccaguccauggaaaaauugucuuccacaaaaccagucccuggggccaaaaaggcuaggaacugcugcucuagaagaaacaccaaacguaccaagauguaaacagaaaaaaguaaaauuacaaaaguacccaaaggaacugaaaaauaugagacaggcaaagccucuccaacuuugacuaaaaauacagaagccauaaaaaaaauaaauuugacuacauaaaaugaaagagacuuccaaagggcaaaccaccaccacuaaguaaaccaaaacaugcaugaucaacuggaaaaaaaaugcaacucauagcaaagacuauacauaaagagcuuucagaauaaagaagaaaaagaccaacaacauagugggaaaaugucugaaauucaaaacacacuccacauaaaaauaaacacaaaaugacauuuaaauacaugaaaauaugaucaaccuuacuuauaauaacagaaauauaaauuaaagcuauaacaaaauaccauuucucaccuaccagcaaaaauccaaaaguuugacaacagauuccaugggugauguucuagggaaacaggcacuuucacauacugcuugcaugaguagaauacgguauaaacccuacaggaagaauuugucaauaacuuuuaaaaaugacagauguaucugucccuugacuauauaaucccauuucuaggauuucauuucacagaugcaccuacaaaaguauuaaaugacaugucuacaagguuaucuauuacaggugauuugaaaagacagaggauuagacacaauccaagauuauguuguugugccaucaucacacaucaacaaaauggaguacucuaagguuauaaaaaagacugaagauaaucucuauguacaaauaugcagaguuccagaauguauuauuaagagaaaaaaguuaagacguagaacaacagacuguauguguuauguuauccuuuguguaagggaauaagaacacacccauacacacacuagaaccucuaaaaaugaaagacgcaaggguuaagcgagauacuaagaaaaaugguuaucuacgagggaacaaagugcauagggcucaucugcaaaacagaaauaauaaaaaagaaaaaaaacaaaguucacagguuaagacuucauuguguauacuucucuauauuguuuaauuauuuuaacuuuccaauaucaaaagaaauguagagagaaugauuuaacaauuuuucacauacccaucaucuagauuaaacaucuaccuaguuguuuuuuuuuuuuucugagacagagucuugcucugucgcccaggcuggagugcaguggcgugaucuugacucacugcaagcuccaccucccagguucacgccauucuccugccucagccucccgaguagcugggacuacaggcacccgccaccacgcccagcuaauuuuuuuguauuuuuuaguagagacgguguuucaccauguuagccaggauggucucaaucuccugaccucaucauccgcccaccucggccucccaaagugcugggauuacaggcgugagccaccgcacccggcccacaucuacauaguuuugacccuucagccacguaaugcauuacccaucuuaaaaaagcuccauucaaaauguccuaaacugaaaagaaacugaaugauaugagccuaaccauacaucaaacugggugacaugcucucugaggaagaauuuauuuuuaggaauuuuagaacacaguauuuuuaauacauacccuuaguggaaugcauuuuaagaacaaaacaaaaauuacaaagaaguauuaaacuuuccucuguaguuccauauugguaauaauauaaauauugguauuucgaaacuacauucuuuacauuuauagguuaaagaaaaaauaaagauuuuuccauaccagaaaaagggaguuaaaauaauuacuaaggaaagugaaagcauaaggauuuuaaaacuaaacuggacauguccaccugaacucuuaaauuuuaacaguauauauuuuccagcuuuguccacugaaguucucuagaaacaagucaccucugcaccaauaaccacccccaauacccugauuguacucucuaauaccauugucccauaccacugaaaaguacaagaugagcuuggggcauuugugccaugaaugaacacagauuuucaagauuauagaaguucugucaaaaggucacaggaccuagcugaaggggucucacugccuaaaaguuguaacaaaagaguaaugauuagaacacaccagaucaauaaaaauccaugaauguauaauguuagaaagacagaaaaaaaccacguguuacuacgugaagugguuauuaaacuccuuacugugaaaguuaauggggaaagggaaagcauuagcacagauccugccuuuccagugggaaccaugugucaggguaaccagacggccccaggcaguacaggaaagcucuacuuuauagaagaaaugaaagaauuacagaaacauuucccaaaacccaaggaagguaugguucaggcaagaaugaccacuggguacaaaaccauuaaguaaacgauuuguaugcaaaguuauaccacacaagucacuugcuggucucuagggggaaaguguaacuggacgaugguggguucaggcugucacagcccuagaccaggggucaaucucagcauccccaguagugggccuuuuuaguaacagugagugaagcacacugaauuagcucuggugagaucuagucaaaaacaacuugaauccugcaagcuuuuccauacaggaaaucagaggauggagaaauaagccuaaccauaaagaagcaaccucacacucuagcaggucagagguucuggaggcaagaccagcaacuggucugcugcuucaauaagagacugugcuggauuaagagacuaaaaggaaguuacaaccagacauagggcacgauacucgauuagauggugauuucgacaaaccagccuugaaggguauuugagggccaguuauggaaaucggaauagaaacaagguauuaaacgagaugaacuuuauugaaauacaaaguuggagacugucauccaaaaaaaucagauaauaaaacaguaauacaucauuuugguuaaaaaaaugugcacacaucuaugcauacaaaaagaccuaagagauguaacaguggucauuucuggacagagacagagagagagagagagagagacuaacuguguguauguggaguguuuugcuugccuuuauuuucuaauuuccuuuaauuagaaaauguuauuucuguacuaaauacauaaaaaagcaguuacauaaggcuuuagguuucacuaguaaucuacagaaggucaucuuagaaaugaucuguuaccuuucuaaaauaugcuaaguggccuguccaucaguggcauggaggauuccuggaaugacuugggaacaacccccaaguuggaacuucauugcuuagaugauucucugacaaaucaaagauuucuuccccagaugguggcaacacuguagaaagaacaacaacuagcaccgacaaagucuaagagagaugaggugaugguuugagagaagaaacaagagcaaagucaauuuuuaagaggggugcugaaaugccuccucaagcaaacuuuaccuccacuuccucaugugaaaauguuaccagcaaaguuccaaagcucuaggggaaaagugagaccagcaggauugaaugcagcacucaagucccagggagaaaacuucacaccagauauaccuguucgcagagugucugucucagaaucacccuuugacaauacggauacacgugcacacccauuuacaaacucaccuaucaagaugucuuuugcuuuuaaucaucacugucaauuuuugaagauauacuauacacucuaaaaggguggcaauuuccucgauugcaguuucauacaaaaaucuguaugaacaaaagcauguuguacaaucauucacugauuugccaaguuuucagaagugucuauaaugugcgugaugguaacgggguagagaacacagagacaaccacagauggguuucuaucuucauggagcuugcagccuaauggggaaggcagguggaaaacaaauaugcccaaauaaguggguucaugaaaauuguuaagugucaugaaggaaaagaagagggugcucugagaugagaagaggggaauaugauuuacacuggaggaucagggaaagccuccuggaggaagugacauuugaggugugaccacagagugagcaugaauuaaccaggcugccaggcaggagaacauuccaggaagggaagacuguugugugggaaagggugcugaagcaggaaacagcugggaacagucacagaacugaaagaggccaggauggggcaaacagaggggaagacugguguccagggagaucagagaagcaagccgggacugugcugugauccaugcuguucaggauucaggauuuucuuccaagugugauggaaagcaguuggacaucugaaguacggcagugacagaaucuaaugugcacuuaauaucacuaugggaaacuggcuggggaaggucaagaacaggcauggagggacaagucaggaagccaguccagaugagacauuaugguggcuuaggcuagcuacagggauccaaacuacagacuggacaccaaauucaaacccaagucugcuuuuaggaguaagauuuugccggaacacgcccccccccccacacgccccucccaccacgugacucguguauguauugucugugcagcuuucacucuacaacuucaguaacggcggcagagaccagauggccugcaaagccucaaauaugcaccacguggaccuuuacagaaaaaguuugccaacccccagacaagggauggcaguggagacagaaauggauggcuucacgauaaacagucugucgucauuauuccuggauuccacauuugcaaauucaccuacucacuaaaagguguuuguaaccccaaagucaauacucagagcacuuuuggucaugccugcgcaugcgcagagcagcaaaaaaguugcgcuggucaacacacacauucccagcugagcuccacaauggugacacucugccuuccuguuucagcucuuauacuauaaacaaguacccuuucaacugucuauauagugccacauuuuuuuugcauuuugguguguuuuguuggugauuuugcuguuuaaaugguccccaagcacagugcuaaagugcugcuuagugcuccuaagcacaagaagacugugaugugccuuaugagaaacgcauguguuagauaagcucguucaggcaugaguuauagugcuguugggcaugaguuugauguuaaucaaaacuauaugcuaagauauauguuuaaacagaaacacacauaaaacaucaucacaccaacauauguaaugcuauaccaacguacaacaucuaccaacauacaacauuauuacaccaacgaaacugauacuacguauugaucagucaauggaaauaugaccagaggcucacaggaaccuaacucuguaucucccuuaggaguaaugauucaguauucacuaauucaguguuccuggcgacuuuagagaacacagcuauggcgaaugaugagaauggcuacaccugggaggcaaaaaucaauacaauuuggugauggguuaaauguuaaguaaaacaaagucaaggaugacucuggguuucugaugugaacuacugggugacagaaggugccauuuauggaaauaaagaauuccagaacagcaguauauuucaggggguugaccaagauguuuccuuugaauguguuaaggaugagauauccaaagagagagguccaguagcuugauggcuuuaugacucuggagcugaaaaaagaagucuagguaaagauacaacuuuaggagucccuaacagauagagggagcauugaaaaccugggaaugauaugucaccuggcgagagggguagaaugacagcagggcccaggccugagagcagcacccagacaaacagguggguuaacucaauuuuucaucuuggugguuugauuuguuuaauauaaaaguauuauacuuuaggcuuggugugguggcucacgccuguaaucccagcacuuugggaggcugaggcagguggaucaccugaagucaggaauuugagaccagccuggccaacauggugaaaggcugucucuacuaaaaauacaaaaauuagccgggcaugguggcgggugcuuguaaucccagcuaaucaggaaguugaggcaggagaaucucuugaacccaggaggcagagguugcagugagcugagaucaugccacuacacuccagucuagaugacagagcgagacucugucucaaaaaaaaaaaaaauuaaacuuuggcaaggaaauuaaccuggugauguaucuagaacccaacagauguucaaaucccuugaccuaguauaucuacuuuggaggaccuauccuaacaucuagacaaaccucaauguuacauagaauuacacugaggaauaacucaugauaguaaauaaccuuaacauuuggggaauguuuaugcugacaagacuaauaauauuuuccucugugaguucaucuacagcuucuaaucuuagaaauuucaacuccuccagagguuuaauaaauauccacuuccauuuccuucaagcuuuuguaaaaagcuuuguaaaaaaguggaacguuugucuuuaucugcuaaaacgcaagcugcuucagggcaggaauuuuaucuguuuugcucaaugcuguacacuuggcaccuaggagaguccccagaacacugaauguauuuugaacauauuuuugucaaaccucacauuuuaaucaggcagaauuuacauugguguaaugaugugaggugaugauacccacugagauuuuucagauugcucucauauagucccauucccauucagguaaucagccuuccuuuccccauggccucacagcaccuccuccaucuucuguuaaaugcucacagacuauggaaccugaaaucugccuccccccuucugccccauggaugggucugucaaauuuugucccagauuugaagcauuaugguuugacacuggauagagcuaaccccuucaccacucuuaugguccaugccuaaccuauguccuaccaccuuaucuuucaagaaaagcaacagaaauuggucucucaaguuuuaaaauacuuauccagauuuugaugaaaacaaagaccauugauacuuggagaagaaccaauguauuuacaaguugcccucucucaucuaggagggaugaggaagagucucuacugugcagcugguggucaggagucagcucuggacucagacugccuggagucgaucccaucucugcacucaggagcugccucaccugccugugccucuguguaacacuguggaaguggaaccucuuuugaguguuacuacagggauucaaugaauucacacauguaaaaucuuagugcagaacuggcaauagcaagugugcgguauuagcuguuaugaucaucuucccauaacauguuuuuccuuagaggucucaguaagaguauuccugaauauuugauauguuuugcucucaaaggggacucauggcuuggcugcccucuaccacauuccuacaugccagccacagguccaagugcuguacauucaccaccucacuugacccuguuugaugaacaggacaaauggaacaagagugucacagaaaucuguguuagcaccuucggucuccagcuugauugccucuuuuccaaggaggaucccagauccuucuuaccggagucagucuugcacauggcauggaucacucuaacuuaccugcaagaagcaggguggccugccagugaagauaagggcaugcgcuggcgacaaguggacugagguucaaacucuggcucuaccaauuacuuguuaugaguccuugcauacauuauuucauaucucuaagccucaauuuccucuucuguaaauggagaaaaucauagagcucuuaaauauuaguuaauaauaguguauuacuauugugaggaugauauuuggcccauuuuauucuggggccccaagaccaaacuggaugaacuacacagaccagcuggcucugaaugaacaagagaaaguggcuccugcacuuugugaccuucccugagaagaugugaaggcaggugagaggagaggaagucggaggcuggaucugcaugugccuauggcuucuggaagucacagccacaaaaggcaguagaauugcgaagaaugcuaaggccaggucccugacucucucacauccaagaaaagcuuucaccaaaacaaccaccaucugauucuaaauauuucugacuuuuuguucugaauguacucuuccaaaacaaugguccucaacuggaaaugcaaaugcucaagccuaccacagaccuacugaauuagagacucugggggugaaacccagcaaucuguuguaacaagcccuccagagaacugaagggcaaaaagguugaagaaccacuucuuccagacagucccuuacacaaauacaccccaaagaagguucuguguguacauccacuuagaccuucacaccuacaaguaaaacaaggcaaauacacgcucaaggaacacacagucaaagaauaaacagguagguaagggagccuggcucuguggguagacaagugggaaaaaauaaauagguggaagcagagagcagagacgccaucaaagaaggaugguaggagaggccauggaagucaguggcugaaacccacaaaacauaacagcugucagaauuaccagguucucugucagguuucaccagcagaaggaacauacugguuacugaacuacuuuggcaagcaacaggaaaugggucaguuucaucagcuuugcuuuaggaagcaaucauauguaugagaccaagguugaggaggaaaaggagagcagaggaugcagaaaugcaaccaccagccauauaaacaggaaacauuucaaguugccuuuguugcuucaguuuuugaagcaagguguccccuuaucaguacugccuuuaggacagggcaacaagggcucaagcccugaaccucauugggucaaggcccaagcucaccccucccaacaugggcugugcccauucauaggcugagcacccacccucuucuucaagaccaggcucugggucccuggggccaugagauucccugcccaaaaggcuucaugccugcuuccaggcccuuucccagggccuguggguguacauguagaccuggaaggugggcaagaggcaccccaguuccaagcggaggugggaguggucgcagcuuggacacacagaccaggaguagagagagagaauuggguggauggcagacugggggccucgcuucacacucuugacccaagacccacaaaugucagggcaagcucacucccuaguuugugucuuauaaccgugaaagucugaguguucaacuaauuucaaaugcugcucaucuggacugaaaugcuucccaggcagguggggaguagccccagacagagacuacaacaggacccuaucugaggucagacugucaugccuggagacaagaggcagggcucaaguuuuggugaugucaaagagauaaaaugacuuuaaacuguaccuugggaaaucaguuuuuuuuuuaaagcugcuuaaugacuuaaaagugcuuugagguucugugaaacucaucaugaucguacugacuucucuccugugauuuuuguuguuguuguuauuaaguagcucauggugacaagcugugaacuuucucagggaaacacaaggaaccacugagggcacuguggccuugcuuuccuugggacagagggaaacacucccugcaggaggggcucaguguagcacugugggcugcaaggggaccacgagaaccagaacucaggagcuuccguaugccucuggggaaaaaggaaguggcucugacagccugguaggaaccacuauaccuggagccccaccuggcagugcagccuagcaaagcuccacucggcauucuggaguguucuggggcuucugugcacacugcuacaggggaagggagaggaagagcccuagcucugcucccccagcacacauaacauuggaacagccucuucauugcucuggccucagauucucaugugucaaagacugaauaauaacgcaugaagaccccaccaggguuauacuaugacccagucagauucugugaaaugcgagugagccuacaaaaagagauucuuuagaaaaacagaacaucaugguauugccaaucccagcaaguuuuccugauccuagaucacugccauaagguguggggaggaaagcaaaaagaaaccaacauuuauugaaccucuggaccaggcaagccgacaagugcucgaugcguguucuccugcaccaccccaacagcagcccugccccaacuccacggccgcagugccuuccaccgcaccacaaggccucccagcauggcccaccuccaucuccacggccgcagugccuuccaccgcaccacaaggccuaccagcauggcccaccccuggcugucugguuccuucuauuauacccaggccaguaaaaauuaccuuguucaaguaucauucugauaauaucgguccccuucuccacaccacaaaaugucacuugaauuagaaccccuuuuaaaccuuuuaacaacugaucccaaacacuuaccauucucaucugcuagucuauuuugugcuuaccacuccagccaagcaaaaauuacuuugcaaaugaauuccauuaugcacucugcuuauucaccuuguuaagccaacaccagagcuuugccuauugcuguugucucuuucuauaggaauaccucauuuauccgacauccuuggaaagaagcuauccacaaaauugaucuacauaaauuaauuucccucucuaccagaaacuuaaccauuuaagcagccuuaaauccucuuuggaguacaucacuguaacaagcaaaugaaagaauuucuuuaaccacugacuaguggaagcauuucuguaauacauuagagaaccucccaggcucaguuaacagaacauaaugaaacugaugaaucuuuuccugaugguacaggucacacuuaaugaauaauaguaaugacacugugcuggagcugcagaggugagugguucaggggaaaaggccgaaagcacgugugcauucucucuuggugcuccuucucccugucacgaguuccccugacacuuacuauccuccagaagucccugcuauccgcucagauucuggugaguagaugccgugacacagaauucaggaagguguaacuugcugucuuucuguacaguuucaaaaacguacaugcugguuuuugucagagcccuauaaaucuuucauuagauacaaaauaaacaaauuuuaaaagaacacauuuccacaaucggcaauaagcuggaguuuuccaaaucucccugcccugugacuuuuuaaaauuuuuuaauuuaauacucacaaccucggcauuauaacccugugacuuuuaacagaaauccaggcacaaacaccauuaaaauuugcuuccuuaaugcuaugaaacuauaaguucuauauuguauagagcuggcuucuuaucauaagcccuuggacgaaugauuuuacuugggaauaacgauuccauagguugaaucaacagggaaauauuagugugaaggaaaaugguaaaaauacacaaacaaacccuuuguucuucaagaugcaaaucugugacugugugaagccagaagugcuuucguagucaaugucauggaagguucuauggugaucucucacugcggauggacagaaccaccuggaggaaaaauacccuuguccacucacauauuaggcugcauucuuuuugugacaaagguuuuuauagagucgacagcauuaacacaugcagaagaauugaucaaucuuaauucugcuuaaacacaguggcauuuaauugaucagaaccuacuaaggcaaaaguacuuaggcaagaauuguuaaaacagacuacugucaaaaacauuacaaauuuguucaaugcuguauucagaaauaaguagcuauaaaaccacaaagauauuuuggaguuucaaagguuuucugccuuuucuuuuuuggcaaugauuuuacuagcuugcuuucuaagggcaaagauaucugucagaaaaaacacaaccugcagugaugucguucauuacaucuuuugccuuuuccauuggcuuuaaaccaaagagagggaggacuacccucugaaagucugacuuguaaccacucucauaaacaccuagcucacucaccuuggagaaccuaguaaaacagguauggcuuuagcugacucagaaucuauaacgaauuugacaaacggucccuucuaaaugaggaugaccugacacugcucugaaucaucaagauucuucugugugcuugcucuucuuucaaguguaguucaaguuuuuauacuuauggccucugcauucuguuugucagaucuacgggagauaauuaagcaagauucuaaagaguuggaaguugaggggugaaaugcaaagugaucaguggagucaagcagaagguggcuuuguuggggugagggaugccagauacaaguacaagaaaaauaaagacggccgaaaugaaugcgagcuacagaugagucaccaauccagggcugcguaaguuauaacuuagaugcauuaaaaggaacagucaauuccagaaauauuuaugaagcgccuacuagguuuaaggaacugcacggcuauuguaggggacaaagaugaaucagacaugguuccugcccuccagggguucacgaugaugcaagaacccugaagucguuuuucucuuauaugcgguacuaaugagaacauuauuaaagagcuguauucaguuuuaacugccaccauuuuuuuaaauagggagaaacuagagagaguucagaagagagaaaggagaugcuuucagugacacaaaaccggcucugugaggaaaaagcuaaagagacccaguuauuaucuuuaaguauaugaaagguuuuagagaaaggaauugaguaaaagaaaacaaguuugaaugacagcaggcgagauuucagccaggcccaggaauuucuugacaaucagguuaauagaauacuggaauuggucacucagggaguuccaacugcccuuuccuggaaaaaauaauuaaauaaauaaugaacugacaauuucaagucacagacauucaccuuccugaagacgggggugaacuauaucugugucaaggucuucugcucuggggcucuaugccccugaagcuaggucaggcuuuucuuuuuccacaauucccugaaugaucugcucuggguaaguagccacugaaugcuucggagugacagcccgaucuauauccccaccaccaagugccacacaacuaccuggaauacaaggucucagccaggcgaaaaggcugggaaucaauucuccaacagccacauaugaugcaagaguccacucgcaacaaagccuacgacacaccaaauaucagaaacgaaagucucugagaacuugugcaaauaagaaacguauuugcauuggcaaggauauaaaauuuaaguaacaaauagaagaagacaggaucuucugcaaguuacagacaguaauauuuauggacauuucuaagaaagcuuguaaugaguauuuucuacacucagaaacacuuuuuugagucuacguaaagaaaacacuucaagagagauaggaaaauggggucuucccacucuuuauuuauuuauugagaaagacucucgcuccauugcccaggcuggagugcaauggcacaaucucagcugacugcaaccuccgccuccuggguucaagcaauucuccugccucagccucccaaguagcugggauuacaggcaccaccaccacgcccagcuauuuuuuuuuuuuuuuguauuuuuaguagagaugggguuucgccauguuagccagguuggucucgaacuccugauccacccgccucagccuuccaaagugcugggauuacaggugugagccacugugccuacccaagucuucccauucuagcugaagaaagcauaggcauguuagaaguaugaacugccacuaaaaaaaaaaaggagaagaaaaaauuccaucuugaaucagacccauggucuagugagucuaugcuucuuucacuucccccacccuguaaagucagggacagggauuaagauuuugucauuucgacaaacccagaaccugccacagggccugacacacagcagguccugcauaaauguuugcugaaugaaugcguuaaagaugggcccucgucugucaagagguggaacauuugaguucaugugggugaagggcgcagggcggugcacagcacaaagucaauauggccuaagucacagugaucaccgugacccucaagcaucuggguuucuuuuauaggaaaaauaaagaucugccuauacuguagguuuuucuuuucuuuuuucccccaaaagagaauagcuauaugaaauggaacucuugcgaguuugggccuuucaaguucacaucccaucggugguuauauaaagucuacugccauuauucugaagcccgucuuugacaccaacccaaaguccuugaauugucaucaauaagacuaccagaaagcacaggcgaauuacacguucagagaacaauaagaaaugcucacauaucacacccucuugaucaucacuacuuugcuccacacaaaccucaaaggugguuccccaagacuggucucuaugggaggaagggagagagagagagaugaagaaauauaaaacauaaaauacaaagaaucugagccccuguaacuuacagaaagcaccaaauugucuuuuguaggaaaaugauguuuaaugcauggugaggcagacccuggcuuguggugggcgaggagccuccccuuggaggaggcucuuggugaaccaccucugggugcucccuugcccagccugcugccuuguuuaggaauggaucuugguuaacggcaaagguuaucuuucauacuuggggauacuuuccaagaggcacagcugcagccccugaaacucugccccagcaguuuauuuccacauuuuucaaguagcacagaaagugccacuauagaagagaaauucucuaccugaaaccagcagaagcucaaugcaaauaaagaaucuggaaaggucacagagggaguaaaaagaagguucuuucuucuauggcuauaggggguuuauuguugcuggugcccaaacuggaaagggaaucgcaggagauuaauaauugaaauguugcuauuauugguuuucgaaacuauuuguggguuauucuuucccuggagucaucaugucuguaagcaucucagaagauagagggauuuaacacacucugagaagaugccuacuacagccagggacuuuacgugcacuaguuucuaauggaguuccugcacaguccaauaaagcccaaagucguaucacuagauucaaacucagguuucucugauucaaguaucauagcacauugucugaaaucaaggauaaaauuaaggcaccuuacucacuacucaaauguggcgagaagaaaagcaacauuuauacuuacucauuuuuaaaauauaaaaccuaaacacaggaacagauauuuuagggcaugugucaucaaacucugcuaacccaagaugauucagaaucucauuucuugguagacagcuugguagauaggcaucuucagguccaucugaugaugaauugcagcagacaguuuuuggaagucugugaaguguuccuuuacauaagccaauaguaaucaacacagcauaucucagggagaggaaaacauaaauaacuuggaauuuaggcuccucucauucagaacccauaauagagaccuuggugguuggccuuugcacuagauauugaaaaagccucgcaaagcaaguugauggaggaaauacaaucacaaggcaaauguuuaaccuucuaaagaaaauaaaccuuuuuauaagaaguucaguuccaaaccaccaaaaacuaacaugcuauuuauaaaccuauccuucaagcaagcccuggaagacugauucucuuugccacccauuaauugguauuaucaaauaccccuuguuucaaaaacagcauuucugucuaaaucucuggcgguucagaacgcuccauuaauguaucugggccuucaccugguauuccaacuuggugcagcagcaccccauugaaacaauucccucucgugucguuauacuuuuccugagaagaaucaugcacacucuuuaggagcucaaaacccacaaggaaucccucuucuuauagaaaucuacaggaaaagcucugcucguuuagcaugcacacagggaguccaugugcucugauugagacaggggaaaaaucagguuuccugaacccagaggaugucaccacggcaggagaaaggaggucaucagagucuuggcacacucaucacagugagugaaugcggguccuagcaaccuaauccuugauucuagaagucaccugucuguuuuagagcauguccaacaaucucuuucaaaaacacccagaucugggcuuuuggcagacugaugugggccaguugaggugggauggggaggaagauuagaaaaauaauuauaaaggugcacagauaaacauccggaauaaaagggugcacagcgcaggaacaaugaagagggcacacggacaagauggagggaaacugagggcugaaagaggccaccgcggaggucaccugagacagggaaggaaggcuggcaaauaaaaacaguucaugagacuuuugagauccaugauuauucuuaaaccguaacacccuacacaccugcaguucuuuaucuggcguaaggaacuggaagaacaauguagcaggaacggggagagccaagucucagccucgggggcauggccuaccuuccauauggauuuaaaaugaaaggagcaggaggagaacagugcaguucccaagauggcuuuccacaaaguugacaaaauacaccccaacucacauacccggucccuaguaacagggaaaccagccguuuacuauaguucugaauucaaugccaaguuccuucucucaacucaccgggaguguccagcagagggagucucaaggagguacuuaauaaagagaaaauuguuucauuuuaacacucuagacagugggagcauugacuguagcccccuccuguagacgcagaugaacaaugaacgcccgacauggguucucccgcauguucacauguccaccggcauguucuauucugcgugguggagugaucagaaauuucguuuuguuuugucgaaugguuaaauggaccuuguguucuucagaaucaaagaggaaagccccuggaauaacaucucucuguugccuucuaaacagccccuuuguuucuaagagagucugaaaaaaaaauauuuacagucuauagguuauuuacagccucguuauccagggccugacugguaacuuuauuccggccagaaaccuaauucauuuggagcccugaaacuaauaacagauuuucuuuuaaguuuuuuuuuuuuuaaucagccucuuauaacagagauaaaacuauuaaugccuucccugucucacuggccacaacuguucuccggauuuacaggaggauuacauuccccccucgugcccuccucugugccacacaaacccuguccccucucauuugcgauuucauccacagaauaucugaacaaaaccgaaagaaagccgggggacccacgcuaaaaguaugugaaggcugcgauuucaaugauuucaugagacaaacauuuacacgaugaaacgacugaaaaaucagacacacuuggguuuaaaauuucuccuacuacaagcacacaaaaacacaucgaaguguaaaaacuuaguugauucuggguugcuuucuggcuggaagcugacagaacggacugaagagaaacgaaagacagugugcgaggcagaccuacugcuuuucugccuugcguucuuuucuuucuugcuaaaggcagucaaauggggaaaaauaccccgaugccaggugaaggugcacaacacagaucgacccagaccgagccagaaaaacgucuccgccgcucccccggcuggaaaacccaaaguccacguccccuuccacacgcuaaugaggggagauuuucgccuauuucauuguucugccuggcucugacauggacuuuucaucucucuccucucuccccaccuagccccgugcauuccgauuccacagcccccccaaaaucggaggcucgcggagaauaaaggagcguggggugggcgcggaaagaaaugggaaggggcgcggggcggagagcgaaguggaaaggaggugcuccgaaagguaaugugggggggcgguggaagcuaagccgcaucaccuucauuuaucgcaaauaaauaaaaagcacagucaccgguccgccuuccccggcgucccugcccuccccgggcagccgcccacccucgcacacgcccccuccccuccugcgcccccggccccucuccccgcccuggaagcaagacccugccggcgccgggucccggucaucuuccgggcgagggagggggucgcggcccccucgggccccgggugggggcuggggcaggcgccgggggcugcgggcgcggggccgcgggcagaacaaagcugcgggggccgcggagggcggcgggcgcggggucggcggggccgggcgccccuuaccuucguacacgggggccaucggggccgggguguccgcgguucauggcaacggggacgggaaagcggcgcgcgagcucggcccccccagccucagucggaaucugccaucuugagccugugucuccgcucucggcgcagccgaggccgcccgcgcccgcaucaccgccucccguggccggcgccgggggagggggccgggcgcgccgccgccgccgccgccgccgcugccgcccgggcccggcgcggggggcucggggcucggggcucggggcggccgggcgggcggagcggccgaggccgaggcgccgagcggccgcggcccccgagcggauccgcggaggggcgggagccgggggcagcgcgcggccagggccggcggggcucagcucagcauggcugggcgcgggggc

SEQ ID NO: 21404 - RNA, 220478 nt, Homo sapiens
  misc_feature (73437)..(98436): n is a, c, g, or u
gcccccgcgcccagccaugcugagcugagccccgccggcccuggccgcgcgcugcccccggcucccgccccuccgcggauccgcucgggggccgcggccgcucggcgccucggccucggccgcuccgcccgcccggccgccccgagccccgagccccgagccccccgcgccgggcccgggcggcagcggcggcggcggcggcggcggcgcgcccggcccccucccccggcgccggccacgggaggcggugaugcgggcgcgggcggccucggcugcgccgagagcggagacacaggcucaagauggcagauuccgacugaggcugggggggccgagcucgcgcgccgcuuucccguccccguugccaugaaccgcggacaccccggccccgauggcccccguguacgaagguaaggggcgcccggccccgccgaccccgcgcccgccgcccuccgcggcccccgcagcuuuguucugcccgcggccccgcgcccgcagcccccggcgccugccccagcccccacccggggcccgagggggccgcgacccccucccucgcccggaagaugaccgggacccggcgccggcagggucuugcuuccagggcggggagaggggccgggggcgcaggaggggagggggcgugugcgagggugggcggcugcccggggagggcagggacgccggggaaggcggaccggugacugugcuuuuuauuuauuugcgauaaaugaaggugaugcggcuuagcuuccaccgcccccccacauuaccuuucggagcaccuccuuuccacuucgcucuccgccccgcgccccuucccauuucuuuccgcgcccaccccacgcuccuuuauucuccgcgagccuccgauuuugggggggcuguggaaucggaaugcacggggcuagguggggagagaggagagagaugaaaaguccaugucagagccaggcagaacaaugaaauaggcgaaaaucuccccucauuagcguguggaaggggacguggacuuuggguuuuccagccgggggagcggcggagacguuuuucuggcucggucugggucgaucuguguugugcaccuucaccuggcaucgggguauuuuuccccauuugacugccuuuagcaagaaagaaaagaacgcaaggcagaaaagcaguaggucugccucgcacacugucuuucguuucucuucaguccguucugucagcuuccagccagaaagcaacccagaaucaacuaaguuuuuacacuucgauguguuuuugugugcuuguaguaggagaaauuuuaaacccaagugugucugauuuuucagucguuucaucguguaaauguuugucucaugaaaucauugaaaucgcagccuucacauacuuuuagcgugggucccccggcuuucuuucgguuuuguucagauauucuguggaugaaaucgcaaaugagaggggacaggguuuguguggcacagaggagggcacgaggggggaauguaauccuccuguaaauccggagaacaguuguggccagugagacagggaaggcauuaauaguuuuaucucuguuauaagaggcugauuaaaaaaaaaaaaacuuaaaagaaaaucuguuauuaguuucagggcuccaaaugaauuagguuucuggccggaauaaaguuaccagucaggcccuggauaacgaggcuguaaauaaccuauagacuguaaauauuuuuuuuucagacucucuuagaaacaaaggggcuguuuagaaggcaacagagagauguuauuccaggggcuuuccucuuugauucugaagaacacaagguccauuuaaccauucgacaaaacaaaacgaaauuucugaucacuccaccacgcagaauagaacaugccgguggacaugugaacaugcgggagaacccaugucgggcguucauuguucaucugcgucuacaggagggggcuacagucaaugcucccacugucuagaguguuaaaaugaaacaauuuucucuuuauuaaguaccuccuugagacucccucugcuggacacucccggugaguugagagaaggaacuuggcauugaauucagaacuauaguaaacggcugguuucccuguuacuagggaccggguaugugaguugggguguauuuugucaacuuuguggaaagccaucuugggaacugcacuguucuccuccugcuccuuucauuuuaaauccauauggaagguaggccaugcccccgaggcugagacuuggcucuccccguuccugcuacauuguucuuccaguuccuuacgccagauaaagaacugcagguguguaggguguuacgguuuaagaauaaucauggaucucaaaagucucaugaacuguuuuuauuugccagccuuccuucccugucucaggugaccuccgcgguggccucuuucagcccucaguuucccuccaucuuguccgugugcccucuucauuguuccugcgcugugcacccuuuuauuccggauguuuaucugugcaccuuuauaauuauuuuucuaaucuuccuccccaucccaccucaacuggcccacaucagucugccaaaagcccagaucuggguguuuuugaaagagauuguuggacaugcucuaaaacagacaggugacuucuagaaucaaggauuagguugcuaggacccgcauucacucacugugaugagugugccaagacucugaugaccuccuuucuccugccguggugacauccucuggguucaggaaaccugauuuuuccccugucucaaucagagcacauggacucccugugugcaugcuaaacgagcagagcuuuuccuguagauuucuauaagaagagggauuccuuguggguuuugagcuccuaaagagugugcaugauucuucucaggaaaaguauaacgacacgagagggaauuguuucaauggggugcugcugcaccaaguuggaauaccaggugaaggcccagauacauuaauggagcguucugaaccgccagagauuuagacagaaaugcuguuuuugaaacaagggguauuugauaauaccaauuaauggguggcaaagagaaucagucuuccagggcuugcuugaaggauagguuuauaaauagcauguuaguuuuuggugguuuggaacugaacuucuuauaaaaagguuuauuuucuuuagaagguuaaacauuugccuugugauuguauuuccuccaucaacuugcuuugcgaggcuuuuucaauaucuagugcaaaggccaaccaccaaggucucuauuauggguucugaaugagaggagccuaaauuccaaguuauuuauguuuuccucucccugagauaugcuguguugauuacuauuggcuuauguaaaggaacacuucacagacuuccaaaaacugucugcugcaauucaucaucagauggaccugaagaugccuaucuaccaagcugucuaccaagaaaugagauucugaaucaucuuggguuagcagaguuugaugacacaugcccuaaaauaucuguuccuguguuuagguuuuauauuuuaaaaaugaguaaguauaaauguugcuuuucuucucgccacauuugaguagugaguaaggugccuuaauuuuauccuugauuucagacaaugugcuaugauacuugaaucagagaaaccugaguuugaaucuagugauacgacuuugggcuuuauuggacugugcaggaacuccauuagaaacuagugcacguaaagucccuggcuguaguaggcaucuucucagaguguguuaaaucccucuaucuucugagaugcuuacagacaugaugacuccagggaaagaauaacccacaaauaguuucgaaaaccaauaauagcaacauuucaauuauuaaucuccugcgauucccuuuccaguuugggcaccagcaacaauaaacccccuauagccauagaagaaagaaccuucuuuuuacucccucugugaccuuuccagauucuuuauuugcauugagcuucugcugguuucagguagagaauuucucuucuauaguggcacuuucugugcuacuugaaaaauguggaaauaaacugcuggggcagaguuucaggggcugcagcugugccucuuggaaaguauccccaaguaugaaagauaaccuuugccguuaaccaagauccauuccuaaacaaggcagcaggcugggcaagggagcacccagaggugguucaccaagagccuccuccaaggggaggcuccucgcccaccacaagccagggucugccucaccaugcauuaaacaucauuuuccuacaaaagacaauuuggugcuuucuguaaguuacaggggcucagauucuuuguauuuuauguuuuauauuucuucaucucucucucucucccuuccucccauagagaccagucuuggggaaccaccuuugagguuuguguggagcaaaguagugaugaucaagagggugugauaugugagcauuucuuauuguucucugaacguguaauucgccugugcuuucugguagucuuauugaugacaauucaaggacuuuggguuggugucaaagacgggcuucagaauaauggcaguagacuuuauauaaccaccgaugggaugugaacuugaaaggcccaaacucgcaagaguuccauuucauauagcuauucucuuuugggggaaaaaagaaaagaaaaaccuacaguauaggcagaucuuuauuuuuccuauaaaagaaacccagaugcuugagggucacggugaucacugugacuuaggccauauugacuuugugcugugcaccgcccugcgcccuucacccacaugaacucaaauguuccaccucuugacagacgagggcccaucuuuaacgcauucauucagcaaacauuuaugcaggaccugcugugugucaggcccuguggcagguucuggguuugucgaaaugacaaaaucuuaaucccugucccugacuuuacagggugggggaagugaaagaagcauagacucacuagaccaugggucugauucaagauggaauuuuuucuucuccuuuuuuuuuuuaguggcaguucauacuucuaacaugccuaugcuuucuucagcuagaaugggaagacuuggguaggcacaguggcucacaccuguaaucccagcacuuuggaaggcugaggcggguggaucaggaguucgagaccaaccuggcuaacauggcgaaaccccaucucuacuaaaaauacaaaaaaaaaaaaaaauagcugggcguggugguggugccuguaaucccagcuacuugggaggcugaggcaggagaauugcuugaacccaggaggcggagguugcagucagcugagauugugccauugcacuccagccugggcaauggagcgagagucuuucucaauaaauaaauaaagagugggaagaccccauuuuccuaucucucuugaaguguuuucuuuacguagacucaaaaaaguguuucugaguguagaaaauacucauuacaagcuuucuuagaaauguccauaaauauuacugucuguaacuugcagaagauccugucuucuucuauuuguuacuuaaauuuuauauccuugccaaugcaaauacguuucuuauuugcacaaguucucagagacuuucguuucugauauuuggugugucguaggcuuuguugcgaguggacucuugcaucauauguggcuguuggagaauugauucccagccuuuucgccuggcugagaccuuguauuccagguaguuguguggcacuuggugguggggauauagaucgggcugucacuccgaagcauucaguggcuacuuacccagagcagaucauucagggaauuguggaaaaagaaaagccugaccuagcuucaggggcauagagccccagagcagaagaccuugacacagauauaguucacccccgucuucaggaaggugaaugucugugacuugaaauugucaguucauuauuuauuuaauuauuuuuuccaggaaagggcaguuggaacucccugagugaccaauuccaguauucuauuaaccugauugucaagaaauuccugggccuggcugaaaucucgccugcugucauucaaacuuguuuucuuuuacucaauuccuuucucuaaaaccuuucauauacuuaaagauaauaacugggucucuuuagcuuuuuccucacagagccgguuuugugucacugaaagcaucuccuuucucucuucugaacucucucuaguuucucccuauuuaaaaaaaugguggcaguuaaaacugaauacagcucuuuaauaauguucucauuaguaccgcauauaagagaaaaacgacuucaggguucuugcaucaucgugaaccccuggagggcaggaaccaugucugauucaucuuuguccccuacaauagccgugcaguuccuuaaaccuaguaggcgcuucauaaauauuucuggaauugacuguuccuuuuaaugcaucuaaguuauaacuuacgcagcccuggauuggugacucaucuguagcucgcauucauuucggccgucuuuauuuuucuuguacuuguaucuggcaucccucaccccaacaaagccaccuucugcuugacuccacugaucacuuugcauuucaccccucaacuuccaacucuuuagaaucuugcuuaauuaucucccguagaucugacaaacagaaugcagaggccauaaguauaaaaacuugaacuacacuugaaagaagagcaagcacacagaagaaucuugaugauucagagcagugucaggucauccucauuuagaagggaccguuugucaaauucguuauagauucugagucagcuaaagccauaccuguuuuacuagguucuccaaggugagugagcuagguguuuaugagagugguuacaagucagacuuucagaggguaguccucccucucuuugguuuaaagccaauggaaaaggcaaaagauguaaugaacgacaucacugcagguuguguuuuuucugacagauaucuuugcccuuagaaagcaagcuaguaaaaucauugccaaaaaagaaaaggcagaaaaccuuugaaacuccaaaauaucuuugugguuuuauagcuacuuauuucugaauacagcauugaacaaauuuguaauguuuuugacaguagucuguuuuaacaauucuugccuaaguacuuuugccuuaguagguucugaucaauuaaaugccacuguguuuaagcagaauuaagauugaucaauucuucugcauguguuaaugcugucgacucuauaaaaaccuuugucacaaaaagaaugcagccuaauaugugaguggacaaggguauuuuuccuccaggugguucuguccauccgcagugagagaucaccauagaaccuuccaugacauugacuacgaaagcacuucuggcuucacacagucacagauuugcaucuugaagaacaaaggguuuguuuguguauuuuuaccauuuuccuucacacuaauauuucccuguugauucaaccuauggaaucguuauucccaaguaaaaucauucguccaagggcuuaugauaagaagccagcucuauacaauauagaacuuauaguuucauagcauuaaggaagcaaauuuuaaugguguuugugccuggauuucuguuaaaagucacaggguuauaaugccgagguugugaguauuaaauuaaaaaauuuuaaaaagucacagggcagggagauuuggaaaacuccagcuuauugccgauuguggaaauguguucuuuuaaaauuuguuuauuuuguaucuaaugaaagauuuauagggcucugacaaaaaccagcauguacguuuuugaaacuguacagaaagacagcaaguuacaccuuccugaauucugugucacggcaucuacucaccagaaucugagcggauagcagggacuucuggaggauaguaagugucaggggaacucgugacagggagaaggagcaccaagagagaaugcacacgugcuuucggccuuuuccccugaaccacucaccucugcagcuccagcacagugucauuacuauuauucauuaagugugaccuguaccaucaggaaaagauucaucaguuucauuauguucuguuaacugagccugggagguucucuaauguauuacagaaaugcuuccacuagucagugguuaaagaaauucuuucauuugcuuguuacagugauguacuccaaagaggauuuaaggcugcuuaaaugguuaaguuucugguagagagggaaauuaauuuauguagaucaauuuuguggauagcuucuuuccaaggaugucggauaaaugagguauuccuauagaaagagacaacagcaauaggcaaagcucugguguuggcuuaacaaggugaauaagcagagugcauaauggaauucauuugcaaaguaauuuuugcuuggcuggagugguaagcacaaaauagacuagcagaugagaaugguaaguguuugggaucaguuguuaaaagguuuaaaagggguucuaauucaagugacauuuugugguguggagaaggggaccgauauuaucagaaugauacuugaacaagguaauuuuuacuggccuggguauaauagaaggaaccagacagccaggggugggccaugcugguaggccuuguggugcgguggaaggcacugcggccguggagauggaggugggccaugcugggaggccuuguggugcgguggaaggcacugcggccguggaguuggggcagggcugcuguugggguggugcaggagaacacgcaucgagcacuugucggcuugccugguccagagguucaauaaauguugguuucuuuuugcuuuccuccccacaccuuauggcagugaucuaggaucaggaaaacuugcugggauuggcaauaccaugauguucuguuuuucuaaagaaucucuuuuuguaggcucacucgcauuucacagaaucugacugggucauaguauaacccugguggggucuucaugcguuauuauucagucuuugacacaugagaaucugaggccagagcaaugaagaggcuguuccaauguuaugugugcugggggagcagagcuagggcucuuccucucccuuccccuguagcagugugcacagaagccccagaacacuccagaaugccgaguggagcuuugcuaggcugcacugccagguggggcuccagguauagugguuccuaccaggcugucagagccacuuccuuuuuccccagaggcauacggaagcuccugaguucugguucucgugguccccuugcagcccacagugcuacacugagccccuccugcagggaguguuucccucugucccaaggaaagcaaggccacagugcccucagugguuccuuguguuucccugagaaaguucacagcuugucaccaugagcuacuuaauaacaacaacaacaaaaaucacaggagagaagucaguacgaucaugaugaguuucacagaaccucaaagcacuuuuaagucauuaagcagcuuuaaaaaaaaaacugauuucccaagguacaguuuaaagucauuuuaucucuuugacaucaccaaaacuugagcccugccucuugucuccaggcaugacagucugaccucagauaggguccuguuguagucucugucuggggcuacuccccaccugccugggaagcauuucaguccagaugagcagcauuugaaauuaguugaacacucagacuuucacgguuauaagacacaaacuagggagugagcuugcccugacauuugugggucuugggucaagagugugaagcgaggcccccagucugccauccacccaauucucucucucuacuccuggucuguguguccaagcugcgaccacucccaccuccgcuuggaacuggggugccucuugcccaccuuccaggucuacauguacacccacaggcccugggaaagggccuggaagcaggcaugaagccuuuugggcagggaaucucauggccccagggacccagagccuggucuugaagaagagggugggugcucagccuaugaaugggcacagcccauguugggaggggugagcuugggccuugacccaaugagguucagggcuugagcccuuguugcccuguccuaaaggcaguacugauaaggggacaccuugcuucaaaaacugaagcaacaaaggcaacuugaaauguuuccuguuuauauggcuggugguugcauuucugcauccucugcucuccuuuuccuccucaaccuuggucucauacauaugauugcuuccuaaagcaaagcugaugaaacugacccauuuccuguugcuugccaaaguaguucaguaaccaguauguuccuucugcuggugaaaccugacagagaaccugguaauucugacagcuguuauguuuuguggguuucagccacugacuuccauggccucuccuaccauccuucuuugauggcgucucugcucucugcuuccaccuauuuauuuuuucccacuugucuacccacagagccaggcucccuuaccuaccuguuuauucuuugacuguguguuccuugagcguguauuugccuuguuuuacuuguaggugugaaggucuaaguggauguacacacagaaccuucuuugggguguauuuguguaagggacugucuggaagaagugguucuucaaccuuuuugcccuucaguucucuggagggcuuguuacaacagauugcuggguuucacccccagagucucuaauucaguaggucugugguaggcuugagcauuugcauuuccaguugaggaccauuguuuuggaagaguacauucagaacaaaaagucagaaauauuuagaaucagauggugguuguuuuggugaaagcuuuucuuggaugugagagagucagggaccuggccuuagcauucuucgcaauucuacugccuuuuguggcugugacuuccagaagccauaggcacaugcagauccagccuccgacuuccucuccucucaccugccuucacaucuucucagggaaggucacaaagugcaggagccacuuucucuuguucauucagagccagcuggucuguguaguucauccaguuuggucuuggggccccagaauaaaaugggccaaauaucauccucacaauaguaauacacuauuauuaacuaauauuuaagagcucuaugauuuucuccauuuacagaagaggaaauugaggcuuagagauaugaaauaauguaugcaaggacucauaacaaguaauugguagagccagaguuugaaccucaguccacuugucgccagcgcaugcccuuaucuucacuggcaggccacccugcuucuugcagguaaguuagagugauccaugccaugugcaagacugacuccgguaagaaggaucugggauccuccuuggaaaagaggcaaucaagcuggagaccgaaggugcuaacacagauuucugugacacucuuguuccauuuguccuguucaucaaacagggucaagugagguggugaauguacagcacuuggaccuguggcuggcauguaggaaugugguagagggcagccaagccaugaguccccuuugagagcaaaacauaucaaauauucaggaauacucuuacugagaccucuaaggaaaaacauguuaugggaagaugaucauaacagcuaauaccgcacacuugcuauugccaguucugcacuaagauuuuacaugugugaauucauugaaucccuguaguaacacucaaaagagguuccacuuccacaguguuacacagaggcacaggcaggugaggcagcuccugagugcagagaugggaucgacuccaggcagucugaguccagagcugacuccugaccaccagcugcacaguagagacucuuccucaucccuccuagaugagagagggcaacuuguaaauacauugguucuucuccaaguaucaauggucuuuguuuucaucaaaaucuggauaaguauuuuaaaacuugagagaccaauuucuguugcuuuucuugaaagauaaggugguaggacauagguuaggcauggaccauaagaguggugaagggguuagcucuauccagugucaaaccauaaugcuucaaaucugggacaaaauuugacagacccauccauggggcagaaggggggaggcagauuucagguuccauagucugugagcauuuaacagaagauggaggaggugcugugaggccauggggaaaggaaggcugauuaccugaaugggaaugggacuauaugagagcaaucugaaaaaucucaguggguaucaucaccucacaucauuacaccaauguaaauucugccugauuaaaaugugagguuugacaaaaauauguucaaaauacauucaguguucuggggacucuccuaggugccaaguguacagcauugagcaaaacagauaaaauuccugcccugaagcagcuugcguuuuagcagauaaagacaaacguuccacuuuuuuacaaagcuuuuuacaaaagcuugaaggaaauggaaguggauauuuauuaaaccucuggaggaguugaaauuucuaagauuagaagcuguagaugaacucacagaggaaaauauuauuagucuugucagcauaaacauuccccaaauguuaagguuauuuacuaucaugaguuauuccucaguguaauucuauguaacauugagguuugucuagauguuaggauagguccuccaaaguagauauacuaggucaagggauuugaacaucuguuggguucuagauacaucaccagguuaauuuccuugccaaaguuuaauuuuuuuuuuuuuugagacagagucucgcucugucaucuagacuggaguguaguggcaugaucucagcucacugcaaccucugccuccuggguucaagagauucuccugccucaacuuccugauuagcugggauuacaagcacccgccaccaugcccggcuaauuuuuguauuuuuaguagagacagccuuucaccauguuggccaggcuggucucaaauuccugacuucaggugauccaccugccucagccucccaaagugcugggauuacaggcgugagccaccacaccaagccuaaaguauaauacuuuuauauuaaacaaaucaaaccaccaagaugaaaaauugaguuaacccaccuguuugucugggugcugcucucaggccugggcccugcugucauucuaccccucucgccaggugacauaucauucccagguuuucaaugcucccucuaucuguuagggacuccuaaaguuguaucuuuaccuagacuucuuuuuucagcuccagagucauaaagccaucaagcuacuggaccucucucuuuggauaucucauccuuaacacauucaaaggaaacaucuuggucaacccccugaaauauacugcuguucuggaauucuuuauuuccauaaauggcaccuucugucacccaguaguucacaucagaaacccagagucauccuugacuuuguuuuacuuaacauuuaacccaucaccaaauuguauugauuuuugccucccagguguagccauucucaucauucgccauagcuguguucucuaaagucgccaggaacacugaauuagugaauacugaaucauuacuccuaagggagauacagaguuagguuccugugagccucuggucauauuuccauugacugaucaauacguaguaucaguuucguugguguaauaauguuguauguugguagauguuguacguugguauagcauuacauauguuggugugaugauguuuuauguguguuucuguuuaaacauauaucuuagcauauaguuuugauuaacaucaaacucaugcccaacagcacuauaacucaugccugaacgagcuuaucuaacacaugcguuucucauaaggcacaucacagucuucuugugcuuaggagcacuaagcagcacuuuagcacugugcuuggggaccauuuaaacagcaaaaucaccaacaaaacacaccaaaaugcaaaaaaaauguggcacuauauagacaguugaaaggguacuuguuuauaguauaagagcugaaacaggaaggcagagugucaccauuguggagcucagcugggaauguguguguugaccagcgcaacuuuuuugcugcucugcgcaugcgcaggcaugaccaaaagugcucugaguauugacuuugggguuacaaacaccuuuuagugaguaggugaauuugcaaauguggaauccaggaauaaugacgacagacuguuuaucgugaagccauccauuucugucuccacugccaucccuugucuggggguuggcaaacuuuuucuguaaagguccacguggugcauauuugaggcuuugcaggccaucuggucucugccgccguuacugaaguuguagagugaaagcugcacagacaauacauacacgagucacguggugggaggggcgugugggggggggggcguguuccggcaaaaucuuacuccuaaaagcagacuuggguuugaauuugguguccagucuguaguuuggaucccuguagcuagccuaagccaccauaaugucucaucuggacuggcuuccugacuugucccuccaugccuguucuugaccuuccccagccaguuucccauagugauauuaagugcacauuagauucugucacugccguacuucagauguccaacugcuuuccaucacacuuggaagaaaauccugaauccugaacagcauggaucacagcacagucccggcuugcuucucugaucucccuggacaccagucuuccccucuguuugccccauccuggccucuuucaguucugugacuguucccagcuguuuccugcuucagcacccuuucccacacaacagucuucccuuccuggaauguucuccugccuggcagccugguuaauucaugcucacucuguggucacaccucaaaugucacuuccuccaggaggcuuucccugauccuccaguguaaaucauauuccccucuucucaucucagagcacccucuucuuuuccuucaugacacuuaacaauuuucaugaacccacuuauuugggcauauuuguuuuccaccugccuuccccauuaggcugcaagcuccaugaagauagaaacccaucugugguugucucuguguucucuaccccguuaccaucacgcacauuauagacacuucugaaaacuuggcaaaucagugaaugauuguacaacaugcuuuuguucauacagauuuuuguaugaaacugcaaucgaggaaauugccacccuuuuagaguguauaguauaucuucaaaaauugacagugaugauuaaaagcaaaagacaucuugauaggugaguuuguaaaugggugugcacguguauccguauugucaaagggugauucugagacagacacucugcgaacagguauaucuggugugaaguuuucucccugggacuugagugcugcauucaauccugcuggucucacuuuuccccuagagcuuuggaacuuugcugguaacauuuucacaugaggaaguggagguaaaguuugcuugaggaggcauuucagcaccccucuuaaaaauugacuuugcucuuguuucuucucucaaaccaucaccucaucucucuuagacuuugucggugcuaguuguuguucuuucuacaguguugccaccaucuggggaagaaaucuuugauuugucagagaaucaucuaagcaaugaaguuccaacuuggggguuguucccaagucauuccaggaauccuccaugccacugauggacaggccacuuagcauauuuuagaaagguaacagaucauuucuaagaugaccuucuguagauuacuagugaaaccuaaagccuuauguaacugcuuuuuuauguauuuaguacagaaauaacauuuucuaauuaaaggaaauuagaaaauaaaggcaagcaaaacacuccacauacacacaguuagucucucucucucucucucucugucucuguccagaaaugaccacuguuacaucucuuaggucuuuuuguaugcauagaugugugcacauuuuuuuaaccaaaaugauguauuacuguuuuauuaucugauuuuuuuggaugacagucuccaacuuuguauuucaauaaaguucaucucguuuaauaccuuguuucuauuccgauuuccauaacuggcccucaaauacccuucaaggcugguuugucgaaaucaccaucuaaucgaguaucgugcccuaugucugguuguaacuuccuuuuagucucuuaauccagcacagucucuuauugaagcagcagaccaguugcuggucuugccuccagaaccucugaccugcuagagugugagguugcuucuuuaugguuaggcuuauuucuccauccucugauuuccuguauggaaaagcuugcaggauucaaguuguuuuugacuagaucucaccagagcuaauucagugugcuucacucacuguuacuaaaaaggcccacuacuggggaugcugagauugaccccuggucuagggcugugacagccugaacccaccaucguccaguuacacuuucccccuagagaccagcaagugacuugugugguauaacuuugcauacaaaucguuuacuuaaugguuuuguacccaguggucauucuugccugaaccauaccuuccuuggguuuugggaaauguuucuguaauucuuucauuucuucuauaaaguagagcuuuccuguacugccuggggccgucugguuacccugacacaugguucccacuggaaaggcaggaucugugcuaaugcuuucccuuuccccauuaacuuucacaguaaggaguuuaauaaccacuucacguaguaacacgugguuuuuuucugucuuucuaacauuauacauucauggauuuuuauugaucugguguguucuaaucauuacucuuuuguuacaacuuuuaggcagugagaccccuucagcuagguccugugaccuuuugacagaacuucuauaaucuugaaaaucuguguucauucauggcacaaaugccccaagcucaucuuguacuuuucagugguaugggacaaugguauuagagaguacaaucaggguauugggggugguuauuggugcagaggugacuuguuucuagagaacuucaguggacaaagcuggaaaauauauacuguuaaaauuuaagaguucagguggacauguccaguuuaguuuuaaaauccuuaugcuuucacuuuccuuaguaauuauuuuaacucccuuuuucugguauggaaaaaucuuuauuuuuucuuuaaccuauaaauguaaagaauguaguuucgaaauaccaauauuuauauuauuaccaauauggaacuacagaggaaaguuuaauacuucuuuguaauuuuuguuuuguucuuaaaaugcauuccacuaaggguauguauuaaaaauacuguguucuaaaauuccuaaaaauaaauucuuccucagagagcaugucacccaguuugauguaugguuaggcucauaucauucaguuucuuuucaguuuaggacauuuugaauggagcuuuuuuaagauggguaaugcauuacguggcugaagggucaaaacuauguagaugugggccgggugcgguggcucacgccuguaaucccagcacuuugggaggccgaggugggcggaugaugaggucaggagauugagaccauccuggcuaacauggugaaacaccgucucuacuaaaaaauacaaaaaaauuagcugggcgugguggcgggugccuguagucccagcuacucgggaggcugaggcaggagaauggcgugaaccugggagguggagcuugcagugagucaagaucacgccacugcacuccagccugggcgacagagcaagacucugucucagaaaaaaaaaaaaacaacuagguagauguuuaaucuagaugauggguaugugaaaaauuguuaaaucauucucucuacauuucuuuugauauuggaaaguuaaaauaauuaaacaauauagagaaguauacacaaugaagucuuaaccugugaacuuuguuuuuuuucuuuuuuauuauuucuguuuugcagaugagcccuaugcacuuuguucccucguagauaaccauuuuucuuaguaucucgcuuaacccuugcgucuuucauuuuuagagguucuaguguguguauggguguguucuuauucccuuacacaaaggauaacauaacacauacagucuguuguucuacgucuuaacuuuuuucucuuaauaauacauucuggaacucugcauauuuguacauagagauuaucuucagucuuuuuuauaaccuuagaguacuccauuuuguugaugugugaugauggcacaacaacauaaucuuggauugugucuaauccucugucuuuucaaaucaccuguaauagauaaccuuguagacaugucauuuaauacuuuuguaggugcaucugugaaaugaaauccuagaaaugggauuauauagucaagggacagauacaucugucauuuuuaaaaguuauugacaaauucuuccuguaggguuuauaccguauucuacucaugcaagcaguaugugaaagugccuguuucccuagaacaucacccauggaaucuguugucaaacuuuuggauuuuugcugguaggugagaaaugguauuuuguuauagcuuuaauuuauauuucuguuauuauaaguaagguugaucauauuuucauguauuuaaaugucauuuuguguuuauuuuuauguggaguguguuuugaauuucagacauuuucccacuauguuguuggucuuuuucuucuuuauucugaaagcucuuuauguauagucuuugcuaugaguugcauuuuuuuuccaguugaucaugcauguuuugguuuacuuagugguggugguuugcccuuuggaagucucuuucauuuuauguagucaaauuuauuuuuuuuauggcuucuguauuuuuagucaaaguuggagaggcuuugccugucucauauuuuucaguuccuuuggguacuuuuguaauuuuacuuuuuucuguuuacaucuugguacguuugguguuucuucuagagcagcaguuccuagccuuuuuggccccagggacugguuuuguggaagacaauuuuuccauggacugggggugggggugguuucaggaugaaaccauuccaccucagaucaucaggcauuaguuagauucucauaaugagcgcacaaucuggaucccucgcaugcgcaguucacaguaggguucaugcuucugugagaaucugaugccacugcugaucugacaggaggcggagcucagccgguaaugcucacucaccugccacucaccuccugcuguguggccugguuccuaacaggccagaacugguacuagucugcggccgggccagggcgggguggggagugguuggggaccccuguuuuagaguauguucugaggcuuggaugcaacuuuauauuuuuucaauacucaauugucccaacauuauuuguuuaaaaguuuauauuuuucccauaguaucauaaccccuacuuuaucauuuacuaaguuccuauaggucugggagucuauuucuggacucuauguuuuuccauggguugaucuguuguuaauguuugaaauuuauaucaucuuuucauaucugaaaagacuaguucucccucguugcucuuccccuucagccuuguccuggcuauucuccauguuuguuauuccauaugaacuuuagacccaacauucuugauuccagaaaaaaagccuguugguauuuccauugggaucacauuaaauuuauaaauuucuuaggaggaauuaacaucuuuacaagguugagucuucccgucaaagacaauguuuucuauguguucuuuuuuuguguguacuuuaguaauguauaaaaguuuucuguauauagguuguauacaugucuuaaguuaauccuuguaaauaauaucuuucauuaucuccucuuguuugcauaugaggacuauuuauuuccacauguauuuuugacagcuuuauugagauauaauucauguaauuuacccauucaaaguguauaguucagugguuuuuaggauauucacaaauugugcaaccaucacuacuaucuaauuuuacaacauuuuugucaccccaaaaagaaacucuguacccauuagcagucauucccccuucucaaccucccccagccccuggaaaccacuagucaaauuucuauucaagacguuuucuauaaauggaaucaugcaauacauggucuuuugcagcuggcuucuuucacuuagcuuguuaucaagguucauccauguugucgcaugccuuuuuuuaggauagccauccuugugagugugaaggguaccacuguggcucagauuugcugauuucuauauguauuuaguucucuuuugugagauuucaugagugcaggaggcuggcuuucaauuccagauccccagugccucccaaagugucuagcaaauauuugguacucaauaaaugcuuauugaaugaaugcuuggauuuaauauacuucuaggccaccucuacauuuuaaaguuaaaauguaguuuggcauauauaaauuaauuuuuaucuuuuccuaggugaaacauaauuacagggugaguuuuuccuccgggaaagccugguaaaagcaguuuugacugauaugugguuugugcuggucaauauuccuuuuucuuacauuaaaacgaaugauugagaguugcugguacauaugucuaagugucugugucucaucuuuucaggaggaugauuuuuagcucuagauucuaauuguuauugaaaacuacuuaguaauauguauaagauagaggugagaaauuagguaaaguucugggccugggaaaagggaguuuugaaugagauggaucaguucauauguauuuuacaaguucuagguuuaccaagggcuguguuccagaaccucuuuuguaagcuaguuguguggacacaucacaguuaacaauaaagugcuaucagcuaagauuugggucucaagcuugccuuaaaggagauaugggagaguauaguugaugcaugcgugagagcaggcgguguguaugggaacucccuguaccuuccacucaauuuuguugugagacuaaaacugcucuacaaaaauaaagucugacuggaugcgguggcucaugcuuguaaucccagcaccuugggaggcugaggcagguggaucaccugaagucaggaguuugagaccagccugaccaauauggugaaaccccaucucuacuaaaaguacaaaaauuagccaggcaugguggcaugcgccuguagucccagcugcuuggaaggcugagacaggagaguugcuugaacccgggaggcagagguugcagugagccaagauugcaccacugcacuccagccugggugacagagcgagacuccgucucaaaaaaacaaacaaacaaacaaacaaaaacuaaauaaagucuaguaauuuuuaaaaagagugagagagaacacagcugaaauacauauacuuuuuaggaaaagggaaauaauuaaauaucagaaaaauaauauugaagaagaaauauuucucuuuaaugucaguguuugaagaaagguauuuuaauuaaaucagaucguguguguuugcaggagacuuuuggacacuauccaaggauuuugagauugacaauauuggauuuuuauauugccccaauuuucuuucaaaauaugugacuguuaagauuauuauuacccuuauauuauuagacguguuuggguuggggauaggaaaaagacagagggagauugauugguugacugauucauucguucauugguuaaaugggacagacugauuucucuaacugucugagccugagagauggggaagguagaacauggcucagaagaauaugcauuuccuguaagaaaacauuugucugaaaggaauuauaauaauugagaauuaagcuguaugauacagaagcaguaucugaagggcagauggauaauagaagguagcuguggugcaacucgaaucaauggcuggaaagccacaggaggcagauucccaccaggcccuaaggaaggacaccguaccgaagcccuccacauguggacauccauggggccugcgauuucucugguacuggagguauuccagaugagugccuugugaagggacugccggagacuggcauccaacagaacauggaugugggaccagagcaucuuuaaggcuucuucucagagaggcugguaguucugagcguguuuacaguuccauugagggagaaaaaaggaagaagcagggaaaaagaguuagguggggauuuuccccgucagcucaggagaccuuguuucucuucagagagaguaggaugguagaaaacaaauuguuuuuuguuucauggucuguuuauuaguagauuauugguuaagaugcuuuuagcuucaagggacagaaaccaacacaaaguguauaaacaaaagggaaaacugacugacugguuaacaagaaguucugaggucaucagcuccaggguugguuguaaaaaacugauguucuuucuguauuucugccccaugguuugugguaugucggucugauggcugccacaguucuaggcaucacauccaacucaacaguguccaugggaaaaagagcaucucuuuaaagcaagaaaaccuuuuccagaagcuuccugcagaccucccuucacaccucguugaccaggcugauggugugugccagugccuaagucaagucauugacaacaggaagaagaugagcccuggcugaguuaaacugaccaggaugugcaucccccccaugcuggaagugaggccgucuucccugagagucaguauccgaacagaaagaucacccaaugcauguuguuuuuaaaguacuuauggagaucucugugccguggugguaucauccguaugaaccauccaggcuguagucagagaaucagagacucgcugugugaucuccaagaagccguaucaccuguguccuccauagcaagagaacguauuggaagccccuccuagcuuucgaauuccaucaucgucucuccuucucuccccuucagcuccccucccacugcccacggaggcugcugugugacagaggaaguuucuuaucaaguccucagugaucuauguaaagaagagaugguguuuucucaggcucuuagcacuuuguucuguugguuucacaaacuaauuauuguucagaauuuaauuuuuagaaaauuuuaaugacuuuuguaagagguuuaguuaacauacugcacacacacacucucugucucucucacacacuuagcuuuucuauguguauauacauguacauguaucuauauucuaaccuggcuuugguggaaccagcuuucuugcucugugcacagacaucuuccugcugcucguuucagcccugaugugguggaaugugucugaagcaugcguuucuaggucuuuuccuuauggccuccacaaaguggucuugauggcccucaguucuguucagcaguaaugcaaagugaagauguuucucugacucaaaagugagaugacauuaauugagcgccuaccauuugugcuccuucuaucggagacuuagauacgauauuuaugcuuaaaauggcucugaaauuaaagggcaaggccugaggugcaguaucuccucuuucuagcccucccauucaggccuguuuagcuacuuucuccccacuuccaaagggugucucuuggaaagaagcaggacuguccccuaaauuggagcagauagcagccuggggccucgagcccccgcuucccuuuguguugugcacuggcuccagcguggcgcccgucuuugaagucagguggaagccccacaggcagggcugcugcccuccugcucucuggccauucagcacaaccuuuagucuaggaaaagugccagucuucauuuccaaguaucauaucucccuaaauggggcaaucugcuuuaaaugccuucuccacuggcgccuuccccaucucacaauuggcauaauuaaagggaaaggcucaccuccuuugcugccuauguguacugggucagggcguuggcugggggccgcugguguguaugcacgccugcccucgcagagacgcucccuuggcccuccagcccuugagugaucauuuucagaaguguucagagccacucugcaagcauacacuuuaccuuugcauuuucccuacugugcucaacucaauaacaggcaagcugguuacuaugauccaugaagcuuuuuguaucuugcuggaaaaaaaugcacucugagcugaaagauaaucucccucgaugguuccaagucagaauuugcuuuaugacucaugacauuuggugucuuucuccaugaagauuucccccuucuccucguccacucccagcuucagaugugugcgauggugugguucauccuuagagagucacugcuggucccaaggaauggugugacauguaggaaggcucccgugguugcugguccccucugaucuccaguucagcugccacgccagcacccucgauuaagcuccuuuggaaccuggguuuuuauuaccugccacucagcuuaaagcagaggccucucagagggcaugccugguaaugcagcugcccucuguucugcggaggcagccucagucuccaucaccucccucucagaagucagucucucagcagcacuggggggcccacugugugcaaagcccugugcccacugguucagccaagaauggaauagaaaacaaccaugcccaucugacuacuguaaagagggacaggagaaccuugggacagaggcauaccugugcuugcccaagccuaccuagaccacccucuugugggaugugcacugggaauugauuucccagugguggggacaaacuugugcucauuucugccucguuugucaccuagauucucuuuacgaugacaucuaaugugcagaaguccagcccguagcagcagcauuugacuaaugugggaaguucaggaauuuugagccuggaaaguccugggaaggaaaaucccucaugcuucagcagggcuguguggccgguucuccaugugcuucagcagaguuuucuuucucuuuuucuuuuuuuuuuuuuuuucagcugugaaaaaagcagugccagcuguuugguaaaauaugggucagugagaaauaggauuugcuuuauagaaguuaacuuuggagaaucguguccucaaaaagaaaagaagucuaaagauaggaggacugagggaauccuggguguggugauccuaaccccauaaguuagcuuggggugcuuucaggaagauuuugguuuccagcaguucagaagggaggugggcaugauuuggugcagaagggggagaggugagggagaaaaucacaugcagacacguugaguagugauaaaccacgagacagacucugcacggccggacagagggcaucuuauuagaguggaaaagaauaguauuuuauuuugcugugaacaagauaguuuggggaguggagaagagcucccagggugggcgaugacaggugucugggggacacuggagccaguggaugcagcaaacagcuuggacuucagucccuuuucuagcaaaggagcugccccugugggguggggggcugaggagguuggagaccauuugaaauagcuucugagcaugugugugcacacaggcacaugcauggcuggugucucuuagagaaaagguauuuagagaaaagcaagguugugaguggccugagagcaguuacaauugauuuugaauauggaagcaauucuaccuaauccagagaauauacaaaguauacuuuggaaaggggcaguaaacuuuucugguuggccugccuuccucccuccuuuucuucuucccuuucucucuucuucccuuccucccauccuuccuuccuucugugaucuuugugggagagcaagagcuauuuguauguagugauuauaaauuugguacuuacauagaauuucucaacauguuucucagagauuaacaugaucccugggagaaucuggaaggucuaucuuuggggugucuucugaagaagauugugauucuuauggcaucugccuucucaagcccuuagucauuaauuauuuacucucauaucucucaaugcaugcaguuuagugccuagcacuaagugaugguuugugugcaugguuggcccagcagaaauauguuuguccauccauccauccauccauccauccauccauccauccaucuauccauccaaccauccauccauccaucccucccucccucccucccucccucccuccaaaucauucaucaaauaagggaaccuuccccaaaggucccagcuguucucucuccccuucuuauaggcuauaacuggguaacaugccuagcccagaucauucacucccaggcacagcaaacaauuagcuuagacuagccaggauugguucuugagucacacaaaggggagguggaaggugguuggagguggugguggggagagugacaucuaaacuaaauccugucucuccagaagagaaagagggaauggcuauuaggaaggcaacuuacagugucugcuucaacauguucauuuuuuuuuaaauguuucacucugauuguaguguuuuuuaacuauacuauucucuaaauuuggcuguguuuacuaugguaauuauuuuaauuaaguucuauuugauuauuuguaauucaccuuguuuuacaacuuuugauugauuuuauaguauaaauacguauacugcaauaaaccauaugauacauaaaagaauuuaggacaggaucaggauaaauacaaauaaauauagaaguucaaaguuaggaagaaaaagaauuacagauaugcagacaauaagucccuuacauugcuacuuagcugagcuucauaacaucaaagagaaaaggcaaauguggucgcugcggucauucuugcugucagagaaggaaggugcaccagguccucaagaggagcaaagauuuuuuuaguucuuuucaacuaaauuuugcauguggacuuuuaucuaggaagcacugagagguaucaugaacaggguguuuggcauccccacaacagaugaaaaacuggguucuuacagcucuucucacagcaguccucauuggaagcucaaggccuaacaugaaaaugcaacucagcaaauguuauucccuggaaggccaaaauaacaggucugaguacuucuucuuauccuucuacugguuugaugcaacacaaagacccaaaacacucagcagaacugccagucuacgugccuaucagacaaccuucaagacuauuacuuuuuuuuaacuggcguguucacgcaugugugugccuauguguguaaauauaucuguauauuuaugaauagauguauacauccaaaauacuauauauauaggaagagaucauuugaggguagauuccauugcccaccaugcuguauucuagcucaucaauugaggcuuuaggaaucgaccugguaagguugacaucuguggaaauuaaggccucuauuuaaaaugcucacagaggagaguucuauuuuuguaaauaggauaauuggguggaaaacugugcuaaugucugucuuuauuuaaccacuccaagggacaaagccuaacugcuaaaaccaugaggccauaaccaagacaccaccauuuacccagggacaccgucaucuuuauacugcaauuuuaaaagaguauggaggucagaagccagacaguugguuucuguauuaaugucuccaggggaugaacagagggugagaaggagcagauagacagaggcaggucuggacgggagguuggagagcggucagcgauguucucccagcugucaggaauguuaugugggaagagguuagggaagagaguuaggggaaauaucaaaugagggaaugacuguguccuggcagagguguuauuuccucuaaaccacuuuugaugaucuucuguccuugugaagauguugggaguggacagugccaggacaguaugaacuguugugcggcguggcggauaccagaggagggugcagggaacaagcauuuauagagccugccacuauuucaccugcugaccuccuuugagaggcaguauuaggaaaugguuagagugcagcuguguaaucagaggcucuaagcccgagucuucucccagcaaacgaggauaauagcggcgucuuaccucagaccuguugggagcugccgugaacacgucauccacgcccaguaaaugcuaguuaacacagugauggccauccagagagcuuucuuagccugaugugaaguagaucucaggcucugcauuuuccagcaggguaaacugaggcauagagagacaaauucacuugugcaagaucuuuuaucuauuaagugucaaagcuaggauucaagccagguuuucuagcacuaaagcuuauugguuuuuucuguuccaugcugccugaauucauagguaauucaccugugucuuauaacccagacacgugaugugggccaugaaccacagcaccuuucuggguccacugugcugguggauagcuuucuguucaugacaaucacgucugaugagcuuggcagugauuuguaugaugacagugaccguccagcaguauguuaaggagucugggucaggagggacuuucuucauuuguuuuugccacaucacccagagaacaucccuguaaaagaaggcgguuugaugaacuuggaggaacuccccagcacucuacuugugaccaugacaauugugacaguuuuuccuucacacuguauucaaggucagguuuuuguucuuggaccuuguuaaaucgaggauagugggcuugaaugacuugguguaucauggaaauagccucaugugguguuagcuucugccuggggucaccagcugcucccacaaagcugaguagccaguaauuucuuacaaaucuuuucauauuaauagaaaaauggaaggcagauggugggccaggaggagugcuuuuucuuugaggcuuugagggccugucaggggaugaauuuugugucccccuccccacucacauguugaaguccuaacccccaguacuucagcaugugaccuuauuuggaaauagggucauugcagauguggcuaguuaagaugaggucccacuaaaguagggugggccccuagucuaguaugacuaguguccucauaggaaggggaaauucagacacagacacgcccacagggaccauggcucaugagcacgaaagcagagacuggguuaauaggcauagaagccaaggaacagcaaagauugccagcgcccaccggaaacuaggagagaggcauggaacacaccgucccucacagccucggagggagccggcccugucgacaccgugaucuugaacuucuggccuccagaacugugagauaauaaauuguguugauuaugccccccagcuuguggugcuguguuauacuaggccaaauaaaguaacguagggcccauggaaaaacagugacuuacaaauuccagaagaaaagcuagagccccuccuaugcuuugguuaaaguuuccaucggagcgugggagucuggauguagggcugaggguuccaaaagugucauagaaagcagagaagcggcucagaugggcagaccagcuuccgaagaacacggguguucugugaaggucauugcguggaggugaccuuuucccucacugaguuuuuuagagaaagcaauuuuguccuuucagguuggaaaaauauuuucuucaagaccacaaagugacaguuaaaaaaaaaaauuggccaccugcaaguuuaaaugucaccaucuagaacagcucugccugauagagcuuuccguacugaugucucucucgguccacccucucucccacaguagcuacuugccacgugaccaguaagcacuugaaauguggccaguggggccgaggaacucaauguuuuauuuuaauuaauuuaaauuuaaauagccacuugugcccgcuagcuaauucuauguguuggucaguauggcuccagaucaccagaauaguggugggaugggacccaagggaaaaaccgggggugccuggauauccaguggaggccacaggagggcuggggcugaugggucacccuggcuuggcuagugcccuuguguguggucuuguccucagccacaggggccuaggugggaguaaaagugaaguaacacaggcagaauuuucuggaugcuuuacuaaagagaugcuuaaugugaggcuuugucugccguuccuucucugaucccaaaguaucuucgacugguuuagugcucgauagagaugggguagauuaagauacuugaagaaaagccaggaagcugggucucuggauaugggcagaccgagauguuucuuugcagguuucaagugccggcccuugauguacccagaggggccgcuagucccaacgcuaggaaggugggaacguccagaugcagaccaccuucuccgaagcuaggaggguuuccccugagucugucauacuagacuuauugauugcagaugccugucaaaagcuacugaggcucagccaccucugcguucuucacaguugccacccugccuccagccccugaauugauggcugcugcagggagugugaccagaggaugccguuuggagaguagucacaugggacaucucagaaucugagauggaaccccaacugggcaguauuuggugcaguuucacaccgaaaaggggucccugugacugauuuggccagcccuggacaaaugaguguugucauuguaucaccagcggcuuuggcucagugcgugguauaauuuaaaaauugccucuuuuucuagcucuacuuaguuaucauucugauuucagaaagaaacaaaugguucaccaagucuuauaauaucucuaaccccgagacaagcgaggggugugaggcagagacacgcuaugucaggcuacagccugccucuccccuggcccacgucaccuuggccgacuggacucugaacagugaagggauagccuagaaggaaggagcugagccaccugacugaguggugagguugguggaugugcagauggaauuccuggcauugaauuggagggcaggaguuuuaguuugaguagagguuaggaagauaaaagaggugcgagaaaccuguugucaaccuccagcagauuugguagcuugugccacaugugcagcaucaugcuuggggacucaggggacaucaauaaguagucaguagcugaugcuuauauugguagugccuacagugugccaagcccaguucugagcuuaauacuuuacauacauuagccacuucagcacagucgcugucuuuuccaagcacucuuaaacucauugcaggcaagauuaaaccaagcaacaaaagacaucaagcgaugcaggguaauacgugaugagcacuguuaggcccaaagagaaaacccugagguccccagugacaagggaugcaucauuugaucugggguuugaaggauggucuugauuuggaaagguggcuagggagcaagcucgagguugccccacacaggggugcacaaggcccggcugggggacagugggugucucacuugggcugacuggaacaaguuccaggucacagguuuuuuuauuugaauguaauuauuugacuguaguagccaucagcagauggagaguucagagggacugcacugaaauaaugaauaauuugcagaugcaguugguagcccuggugucuuggugugccuuucuguuccagcaggaugcgugcaaagaguggcucacagccccaucugcucugcuccuccuggcucgagcuuugcuuuaauaaccucucugucaccuauuuacacgaggucauccagcuccucuuuuucuccuuuucuguguugaaauaaucguggcugcuacuugcugugaaagacuuaacuaguaguggguaggauugaccucucaauucaguaaacauuuacugaguccccaggacaaugcuugcagugagcaugcagaggaggaggugauuccagccggcaaguggaggcagagcucgagccagcaggccuggccacugccuggaaguuggggggugagggggguguggaaggugagccagggugcuuagccucagccacuggggaaugcgaaugauaguccugggggaaagagaaaacaagaggaggaacagauuugugggauggagaacagugggguaaugagcuccauuugggacauuuuaaguuugagacaggacauucccuggagacauuaagcaggcaauaaaaagacccccaacuuagaguccucgaggcccugcgguugcagugugaaauaauccggcuucagcuuccuucccuuuccuucucaagugguuccccauggagucacuuuagacucggggggaggauaguugcuuccucagucucccuagccuuuauccucacacuugaaugcuaaauccagaacuccucauuccugcuaaguaguucaaaagcuccaagggauccuuggaacagucgcacccuggugggacuuuucagagcacuccuaggguuagaagagaaauuucaggguaaccgcagaauaaugugagcuauaacuggcccgagugaucuucuagcugggaccuggaugugaggcuggcauguuugaagguuggugaaugccuguugaccugcaugccccaaccgggugaacuccuucuaccuuuugauuccuaacuaauugcagugaacaauacgccagcuugucuucuguaaaaugagagggugacugugcccaccagccuugcugcuuugguuggacaggucaguacagugccuugaaacucuacuuauucaucugugaaaugaagggauuuggcgagaugccgcuuaacgugacuuccagcacuagcauuuuauguaggucagugauccuuuguccagggagugaucuuuuuuccagaggaaccguucugcaguugcugguuagcuuaucaucuuggcagggagcagcguggugaagcgagcagaacguggccuccggagucagcaaaccuaguuaaaauccacuugccguaaguccgucacguggcuucgcagcgggccucuuggcaauuagcugcuuuucaccaguccucaaguuuccucaucuguaaaaugggaugaugauauguauuucagguccggugggugagaauauguaucaggcaucuacuuuugugacuauuuuuaaaauggcuuuauugagauauaacucacauaccggaaaguucacuuuuuugaaguguacagcucaucagcuuuuagccuguucacuaaguuguacaucaggcaccacuguccaauuccagaacauuccaucaucccaaaaggaaaucccauuccuguuaacucacucccuauucgcuucuccuucuagccccuggcaaccacuaaucuauuuucugucucuauggguuugccuguccuggacauuucauugaaauggaaucagacaaugugugaucuuuugugucuggcuucuuuugcuuagcaugauguuuuugagguucauccauguuguagcagguaucgguucuucauugcuuuguauugccaaauaguguuucacgguaggaauauaccacauuuugcuuaucuguuaaucacuugauggacaugcaggugguuuccacuuuuuggcuguuaugaauaauccuccugugaacauuaguggacaugguuuuguguagacauauguuuucaguuuucuugguaucccauuguguuuuugauuugcauuucccuaauaauuaauaaugaucauccugugcauauugaccauuuguaugucuucucuggcuaaauguauauucaguucuucauucauuuaaaaaauuagguuguguuuuuauuauugaguuguaagaguucuuuauauacucuggauguuguaccuggcuuuuaaauaggcauacaaucaauguuaguuccucauuccaggucucucgcagaacccuguagucuuuuaggugaccucuggaacuaacugcccagacacuuaauccucagcauccugagucuuaaaccauccccuuaugucuuguucagagcucuucuuagcacaaagcccugagccauuuugauccuggagccccagucuggaacuuggaacagcagggggauagguggggucuagagaugggcucuggcugaauccacagggcaguggcuacuaccaagucucauuuuuuucuagauggaggacuuaggggguaacugcacugauuuuuggcugcauggaguccucuguccugugcuauggacaccugcauguuggggcuggggcccacaaagagauaugucuaaggacacuggcuucuuuccacugccacugccaagaugagcagcggauuuuccaagagugaucuggcaguuguaaguuguauauaaaaaugucccaaggaaaaucaugugucuguuuuaaagagaagggaguuuucuaggaaaccuuugaccuggacauucuucucuauucugagaacuguacccugugcccccaagaugugaucuguacuuuguugccccucugcuuuugugcccaucaucuucuuccucuauuucuccucccugaugugugcagcccucccuuucagccaguagggaaagggaaaccugcaggguccggcaggguccccuguuccuccccaacaaagccucuuagguuuucuuuggcuggggucucuuccugcacaccuggggaagaggugccugcaaagcagugaaggccuugggagucccaccuagacuguccuccagagagccaucuccacuaguuugugaaacugccaugccacguuucuguccuaaagacuuggccuuuccuuagacauggauuugauggguccuggacagacguuauugauuguuccucauaagucagucaagacaguuuauagucucuguuaaugcccgggaaauuuguuuuggaagacaaagccagcccaauggcauuuggaugaugcugacuuauuuuaaaggggagaagauaccccuagaugugcaagucuuuuauaggaacagcugucuaugaugagucuucaugcuccuuuugcuucucugaacauucuggcaugccccuaccuagcugcuauuuucuugauuucauagaaaagcacauucuacccucagaaaaucugcuguccauuuggaaugauaagauaaaucagaaaauuacccauuguuagagcuaaaagauuccuuggggauuauccaauccauuauuuuucaaucuccuauccugacaaaaaagaguaaguguuuuguauggagaaaaaaaaaagaaguuucccuuugguaaauaaauuugggcuucagagcauauuguauaucccucuuggagauccacggugugcacugcgauauuaaagccucugagaaguccugcaaaaaagaaaaccgcuuuauuugauuuaacccagcauuucuuaaacuguuuugaccucauuuuuuucuucuuuuuucauaauaaauauuagcaccucacaggacacucagcccaguuugguaagcauggccuccuucauggaagaagaaaucuguguucagaaauauuaagugacuugcucaaaaucaacacaaagccagacuugaagccaaauuuucuaacucccacuccauuguucuuucuacaauuuauaaccaugucguggcugaguaaggguuuaugacuuuuaaagauguugucauuuacauuccuaauggaaaauguaaaggcauuagggucauacugacauguguuugaauucagguccucugauuuuacgagcucaugaccuugggggagcgaauccugccagucucucuggaucucuuucuucuguaaggugaggaugauaauaaugaccucccaggguugccgugaggcuuagaugagagaguguauguaaagaucaaguucacguucuuaucuuuguuuucucugacauuuuucaucauaccagguucugugccacuuaucuaugauuucaaaagacgaaccauauuacaaacaacaaaacgugaaugguggugaucauacugaguauuuauugaauagugacugagaaaaugaaugcacaggagacaggaggaguuaccugugaaaauucagagcuauacugaacugaucaacguucacggaauuggagaaauaacaaaggugggacaggcuagaguguggagauuaaugggggcugagggaacaggcugugcacugguaggacauauucaggaucucaagcuaccugccugccacuucugcauccccaccgcgucaaacugugguugagcuuucuuuauuaaauauguagcaguuugcuuuugaaauacaauaucuucaaaaacaaaaauaaugccaggccugccaacaaaguuugucccgagggggcaaaggugaaggacaagugaaauguugcaagaggacaggacgauacgaaggaugggguccagagugaaagaagaggccuaugaggcucagcacagugacucuaagaugaaaccgagugucuccccagggcgcacacauggaugaaaagugaagggaaugaaagagagagccagccauuccaggacuucugcucuucucugcagaaauccuccuuuccucaccaacucuucaccaacccccaagcuugcuuaacuagcuuuggaauuuguacuuuguauuuuugagauagagucucacccaggcuggagugcaguggcgcgaucucagcucacugcagccucugccuccaggguucaagcaguucuccugccucagccuccugaguagcugggacgacaggcaccugccaccauguccggcuaauuuucguauuuuuaguagaggugggguuucaccauguuggccaggcuggucuugaacuccugaccucaagugauccgcccaucucagccucucaaagugcugggauuauaggcaugagccaccgcgccuggccggaauuuguacuuuugccugguaauuuaguccagugcccaaacaugaagugugaguguuuguuuacugccagcuuggaggggacacaugccugauacugacucaccaguugcauuggugguggacuuggcuccuucccugggcuucagcccaugugugcaccagucugaucccuugcucugaaauauauuaggacuaacaggugugcaggccucgaaggacccgucucuuuugauaucuuccuugucuaguugcucucugauuucucaugguccucacucccuccgggucuucucccugccaguuucugagcaggcacuuuccggagcacaguguguggaugacagcaaauaaguccuccgaggcuuugaccaggagcacagacagcuuugcccuggugagggacgguagagagagcaccaguuugcguccugcugcagcugcacuuugcacagagcgccucuucaucuggcaagcaagcaugcauugugccaacccucgucugccaugccaggugcuggcucuuucuccggggcgauaccaggcuaagcaugcugcuggcacugagcgagucacagcuucucuaauuuauuuaccucaaaucaaacaaacccugacuccugcuuugaauuuaggcugguauuuuaccgaaggacagaagggcagcaucucugcagaagggccuucugugcgcuuugccugggaccucugggggacuuugcaugacuccuggggacuucaggaggccacuuuggaaaacaagugucagguccucaaaagguuaaacauagagucgccaccugaccuggcaguuccacucccagguauguacccgagaggaauaaaaacacguguccacaugguugcaucgcagcgaaaaggagaagcagcccaaauguccauaagcugacaaguggauacacaaagugugcaguaauaguccacugaauauuauuuggcaauaaaagggaauggaauguugauacaugcuaccacaugaguaaaccuugaaaauuuuauguuaagcaaaagaagccagauggacauauacauauugugugauaccauuuauaugaaaugucuagaacaggcaaguccgcagagauagaaaguagagauucaugguuuccaggggcugugggaagggggaauggggagugacugcuaauggguaugggguuucugauaaucagagugaugauaauauuuugaaauuagauagcagugauggucacacaauuguguucaaaaccacugaacuauaccuuuuuuuuuuuuuuggagagggucucacucugucacccaggcuggagugcagcaguacaaucuuggcucaccgcaaccuccgccuccaggguucaagcaauucuccugccucagccucccgaguagcugggauuacaggcaugugccaccacacccugcuauuuuuuguauuuuuaguagagaugagguuuugucauguuggccaggcuggucuugaacuccuggccucaugugaucugcccaccucagccucccaaaaugcgggauuacaggcaugagccacugcaccuggccugaacuguacauuuuuaaaaugugaacuuuaugguaugugaguuguuauguccauaaagcuguuacuuuaaaaauugcccugcuggggaugguggcauauaccuguggucccagcaaauagagaggcuaaggcaaggaggaucauuugaucccaggaguuugagccuggacaacauagugaaacccuguuucaaaaacaaaacuugcccgaaacuuaccuuuguagccaaguccuucauggacaggcuagaggucagauggaaagaagucagaaaauuuaucuugggcgagggcauuuauucugccacugugggagaagcacugugccauggguguggaggagcaguguucagagaggaguguccuguggccuccacaauauucauucaaaauuugccaaugucuuggacauccuggguuccauucccugcccggaaaugaguuccucuuuuugccugguagauuucagugauuaauaaauaaauguucauccuuauacauuuaaaaacauuuuauuuggaaauaguuuccaaguuacuaaaaaauugcaaaaauaaaaauaguacaaagacuaccccuauacccagauuccccuccccuauaccccauauccagauuuuccuguuaucacuucaccccauuuguuuugucaugcccuugaaugugcugucucucacuguugcucuuuugguuguugugugugugccugugguguguuuguauauacagacacacgaaugaucguuauaugacucgaggguaaguuacaaauaucauggugcuuuauuccggcaccauccagaaugguagcuacuagccacaaguagcuauuuaaauuaaaacuaaacaaaacuuuacauucaguuccucagucacaccagccacauuuucaagggcugcauagacacauguguggcugcaucagacaauagagacuacagaaccucuucagcagcacacagagcuccucuggacagcuccgcguuacccccgaugcuucagcguguguuucccaagaauagggcgcucucauacaugguacagagaucaacugaagagaauguaacacugauacaauauuuuuaucugagccacuguuuacauuccaguuuugucaguugacccgguggaguucucauuccuuuuagaauggaggucuugggucuuguuugugagcccagaucugcuggucuguacucagggaacauguauaaaacaggacugcuaagucuugaauugagccugugccuuuccuaugcccuuucuuuccauaaacucgaauccuuucucuaacucaugugcagauggaucgggucugggcccuggagcccagguugaauuuccuuagcucagaauuguuuuaaugcuuuugucacugguugaauaacucaaggugcagcuuccuccugugcugacauuuggucugugagcagguguggcucugcucuuaaaucagcagaaaagauuuccugugaguaaaaggaaauuggccuucccagcaaccgcacuguuuuucuuuuuucuaaucacuuuccccaaauuuuagcuugcaacuaagaaaaggcucauuuuguucuuuguuucuuauuuuauggcuuagucgugacccuguagcucugaaucacuucaugcggcccaggaccaauggggcacuggggagcuuccggccccaaacuccugguguagcagaggccggaugugcagggcccuuggcagcucauuuuccugcaguccaggagaaaggugggcuucuagcgauuuucagccaugguuugggugaaaagcugggguaaugagcaaauugcagugauuuuuauucuuucacuaacugguguuagagcuuauccuccaggggauuucuggugacuuaaugggauuucauggcaugaguagguauggaaaacagauuccugggucacugacuucacuuccauagacauuccccaucccuuaauaauucuuaggauuuuguggguguaaaagcugggaaacaagaaaucaacgggcuuauuauucuuguauccuuuccuauauuucaaguugccccuuagaauguauccucauacguccucccaccuuuuuguuuggauucagcaagucuuagaagagaagaaucuuuagcaagguaagaccucgguaggaauacuauaugagccauguaguuugagccaggauggaaaagggaaaugaauucaugcagagagaguggaaauggagcugauagcuucauuuucugcuuaacuaaaacggaaugaaaagggcuuggcuggcaaggucaggaccacaaggcgagcugcugagagccguauggugcaagauggcaacagaguuucuaccccuugaccaccuuuugagaacugacagggaagacucuuagcgcugggccuguguggcuuguuuggaggaguaaauugaguauacuugaugcuagugaaagaaccagagagcuucccugcauccagccguuggaaggaaaacauacauucggacauucucuguuaauaucuuaugcguaacaugaggcacccuaguuggguaaauggcuuugauuggccuuugugguuccgcaaggguugcuguguuuuguaggauuguaguuccuguuguacuccauagcuccagcguaggcauuaaguuuuuauguuauucgauagcauccucccagcuucaacaaaggguauuggcccaggacaguaacuccuaggagugccugagagcugauuuuguuucaggucagcucuggccuuggagaugcccucccugggaaucagggcagagcagagggcaucugugccaggagggugugcucuccgcguccugcugugggaguucccucagggaagcaccuuggccacccugacacuggugugugcgagccccuucuggaaacagaguugcagugcccuggugaaugcuucuucagggcauuggccccucugucuaccaggucaugccuuccucugccacuugaagucagcaaggacgccaaaggggaccagccuucccuucauucuccugucaccugauccuguggcuuccacauuaucgugguuccuuuccuaccugucagugccagggucuuugggucaucccucuaguuuguugucugcaccuucccugcagguuccuaucgccucucagaugcgccuucauggugggugccaagccccuggccacaugcuuucauuucccacucagaagugguaccauuccucccuccccucucagccaccuccugugacuccucaacagaacaaaaucgaaacuaggcaccaaagaccugccacgcugacuccagccuuuccagacccuuuugucacucacugcaaugcagagcccucaaccacaggcaugguuuuauucuuccugauguucccuuagauggguuugguccuguuuuaucuuauuuucauauugugcuuuguauuguaucugcacacuaucccagguccuguaggcaguggauggcuuaugaaucuuaaauaaaaaugggucucaucugucccuggaacccagugcucacuggccucuguguuucagcucaccccuggcuucgccuuggggugcacucucguguguaaaggggucgcugacucugagagcacuccauccacucucugaagccugcaccguucaaugggcaacaguugcgacuuccuucuguggucaguuaucucuucuccccuuggcccaucucguccuguugaccugaaaaacagguagcccuuucuuucacaaugccaguggucaccugccacucuugggguggugcuuggacaucguaggugcucagcagauauuccuggaugcugcucacucuguccucuacaguccucagccuagcagauuuggaaauuugacuccauaaauuuaaggauuauuggguucuaaaagacugguucauacuaacuaauucuauaaaaggcugauggaucaaucugaaucauuuaaagagagauaauccuagcauccagagaagcuaggccuacauaucaagguauuuucuccuuggucagaagguccucucuggaaucccaguaagagaugagaaaguugcuuauuuagcacagaauuuaagcaaaaggcuuaagucgucauguacuucuaaauguauuuauaaaucaugaaaacauucucugcucaugggauacuucucuuaaagaaccugcaugggauaucuagaaucaaauauucccuuccccccucgacagugaaaaaccuaugacuuacuucuagacuucacuaagauuagugucaauuaucuuuguaacaucaucucucuuuauuuagguaugacauaucauaguuauaccaaguugguagauauucucauuaauuacauuuuacgucauuuuggagucacaaaucauacggcuugucaaauccugguuuuguaauuuuugaggguuccuucauuuaggaucugcagaucucuauuuauaaauuaguacagcauaacacuccuaugagggaaaugauaaaugugugugccuugauucuagaaaucacaaucuaaaacaccauacaaguuaggaguccacaguaguguguauuuggccauuaaugaaucagugguccccugggugugugagccaugcuauuuuuaaaaccauugcugacuucagugauaaagagaguacagaaugugccuucccaggcuugugagcuuaccaugaauaauacccaugguuaucaugaugucagaacuuaaauauucuuuaccaagagcacaaccguggcgucauggagcaugggaaugcauuuagggggcaggguguggaaaguccauuuuucccagagaaaacaucagcccaggguaaaagcugauucucccaugggggcacuuaggccuguaugcagcagugccagacuccuguagggcaucuuccaauuuuagucaccagagagugauuugcgucaaaguuugcaaaccaaaccagagcauuugucacugaagaucccgugccuuccacuuguucagaaaaguuauuaggugggggauuaguacgugcacacuugaaaucacuaacacugguggugaugagaguaguuucaucauuugacacauugaucuccugaagcauucuccuggggaauggaagugaugcuaaaacauggaagaaagggacugaacuauuucggaauuuuaacguugucuuuaaaaacgugugcucugguuuugcuaggugagcaugcugugccucacaauagaauuacacuaaaccacguuaauugugacucauuagggauggcagcauuaacgaauauuccagcacugguuaggauggccuaaguuguacagcaguaacaaacaacagagguuugcuucacacuugcgccacaucuugggucagcuggggucucugcucuuuguuacccucuuucacugaccaggcaaaggagcugcuccuccccagaccaugguugguuaccguaauauaagggaaagaggagucacacacuggccggaaaggcuuuugccugagaaugcuacuucuugcguacuucuuauuguccaagguggaucauuuggccaagacuaauucuaaguuacauggcuuagcuuaccugaauuacagcacagcuuuucaaaguaaugggugcaagacaacguauuaggauacagaagaaaauuugaauauguauauuuuaucucacuuuauccuuuaaauuuuucuauauuuguguuuuugguuaacaauacuguauuggaaaguaaaacauagauuauuuuuaauuauaaaaaucacauauaucaggaguguucucuuuuccccugauuaagugcuuaaucaaaaaaguugagaucauuguuuauacaguagauacaaaucugcaauaagcauauuguacauagaaacugggucucaguuaugaccaaggauagugcuuuugguuaaaauguuacauggaaaagagaugcagaagcuuugaaaguaaauucuauucuguguuagcuaggccucugggagcuagcugaccacccuccccucaguuuucacuaaacgcuuguuuaggacuguauuaguccauucuugcauugcuauaaagaaauaccugagucuggguaauuuauaaagaaaagagguuuaauuggcuucugguucugcaggcuguacaagaagcaugaugcuagcaucugcucaguuucuggggaggccucaggaaacuuacagucaugguggaaggugaaggaggagccagccuuucacauggccagagcaggagcaagagagagugaggggggaggugccacacacuuuuaagccaccagaucucacaagaaaacucacucccguugcaaggacaguaccaagaugaauggugcuaaaccauucuugagaaaccacccgcaugauccagucaccucccaccaggccccaccuccaacacuggggauuacaauuuaagauuuggguggggacacugauccaaaccauaucagggacucacuauuuuauacacacacacacacacacacacacauauauauauaauauguuauauauauuauauguuauauaaugucauauauaauauauguuauauauaguuauauauauauauguucauuuacuccucacaaggacccuaugaaauaugauuacugucuccacuuuagagaugaggggauugaggcagaaagggguuaaguaacuugcugagaucacagagcuagaaagggcagcacuggcaucugaccuaguuguugagaaugcagaaacaaucugaaaauuagcucuuggaauacagaccccuaugaagauagggauggccuacaucaccaaaugccauccugucuguuuuaaagcaagacauaggagagcuaucagacaucuuagauguacguggggaaggcgccccgcuacaagaaccaguauuaucugagugggcaccuccucccagcacuggguguaaguggcuccgugccauggaguuguuggguaauaacgccaggacuggcuugaugacagugacucacaguagaaaaauguccuugcaacagaccaaagaacccacuuuaauuugcacagcuuagaaugggccacugguugcccugccaagggaucccuguaccagcugauuuucauauccacaaacacacacacaaaagcaccuauuuaaauauugcaaauaauaccacauugcauuuuuauuaugcuuuauaguuuacaaagcacauuacaaugcuacuuuauuauucuuagugugcuccaauauaauuucacuugccuucucuuuucucaccuuuuucucaucuuuaguuucuuuuuccuuuuccucucagcauccgugccaacuuuccccacacuccagcuuucuuccuuucguuucuuccugcucuucccucucccugcgaguuguggaggugguaccuuucccgaagugaucccuaauugaguuuagucaggugucaguuaaaggcaacugaggggaaugaaacaauucuccaaggaacaaaacaguuguaacauggagcuccuguuguaaauagcaguugcuauuuaaaucaaguaagaaggauggauuauugugcuuuaagaaggggaugaaaugaauccuguauuuaaagagagccugggggaaaggguuaucugcaucucacauccccggcaucacugugucugcaaaacaucuuucacaaaguuuucuuugcaguuagagaacagccugugagagaaaugcucaaagaaauacauaaacaugaguacaaggggugugcaaacagguguugcacugagcgcagaacccauuuggcggcccuuuguccugguuccuuuguauaacucagcaagaaguugagguuuagaaaaggcagguuugaggaagugccgucuguggccucuuaacuguggacgucacugaugagaacagaucgaacuuuagaugccuuccuuagaaauuuuguuguuuugaagucaaaccucaaucacaaugaacaaauauauuugcauaaggagaggagguguauagugcccuggcaggaauuaagacuaaaacgugggaguaaagcuguagaugcuucuguugcuuuuuaaccaagaggccacagacacaggccgggaggcugagagggcaaccugccauuuggccagcgucacuuugcgauuguuauaaauacuuuaucauagcuugaguacagacaugccuuuucaaugaaauacauccugacuuauuuugcagaggguacuaguuucauagggugacuguaacaaauuaacacaaacuauuaauagguggccuaaaacaacagaaaugucuucucucacaguuuuggaggaguuggcagggccacguucccucgaagacuccagguaaauccccuucuugccuucucucggcuucugauggcucccaacaaugcugggcaucccuuggguuacagcugcauugcuccagucucugccucugucgauguguggcccgcacucuguguguaugucugugucuccucuuacaaggacaccagucauaugggauuacggcucaccuuaaugaauuuauuguaacuugauuaccucugaaaagaccccauuuccaaaaaagaucacauucacagguacuggggguuaggacuuaacauaucuuuugggaggacacauaguaauagaaucuacacaguuuuuaguuuaaaugaaaauuagggccaggugcgauggcucaugccuauaauccuagcacuuugggaagccaaggcagguggaucaccagaggucaggaguuugagaccagccuggccaacauggugaaaccccaucucuacuaaaaauacaaaaauuagccgggcauguuggcucaugccuguaauccccacuacucgggaggcugaggcaggagaauugcuugaaccugggagguggagguugcagugagccgagaucucaccacugcacuccagccugggcgacagagugagacuuugucuccaaaaaaaaaaaaagagagaaaaaauugcagugacaugguaacaagaacaccaaaaugggaaagaauagaguagauuuccaguucugauucugugugccacaaacauuucugaaguagaaccugagguagcucaaaaaggcaccucagcuguggacugggccggaaauggguguuuggcuaguaaaacgcaucauuuuacuuuaccaacauaguaccagacauuuaaggcuaacaaauucacucuugcucagaagagaaaaagccuaccagauuuuuagucuugauuuagacuuuaccaaacauuucuaaaggauaggaaaaguccaucugaggcuuaccuuccguugccaggcacacaccuggccuccucaguaucugcugcaggucugguuuacuugucucuugagguggucagugaggauuuugaaccaguagugaauggagggacauugguaugucauguuaggaaguggcugaaaaauucagggaaggugcuuucuuucguaaagguuugugauucaaacaccugaaaacugguacugcugaaacuuuaaccguccuuauuuagaacauuucagggacaagguaagcagccuucuagaucuuugaaaaaauguggauuuaaauggaauuccucuggguugaaaccagaaguacagcugauuuuguuuucauaguuuguggguguuugccuuuuucaucccaccacguuuauuuaaaagguugucuucuugagauccuccauuggaaagaaaaugcaguguugaaaaacagaacaauguggauggcaggugagagagggcacacgaggaagaaccaagccggggcuccuccucgaugcugaggggcaugaagagggguggccugaacuuggccgcccacugccagccacucuugagguggcuuuuggggccuacuuagguucugccucagacacacacagaaucaaaacuggaaaccuaguuuuuguguuauuaauaagccacucccaauucucucucucucucucucucucucucucucucucucucucucucucucucucucucucucagagacagggucuacucugucacccaggcuggaaugcaguguugcaaucacagcuugcugcaaccucuaccucccagcuucaagugauccucccaccucagccucccgaauagcugggacuaugggugugcaccaccacaccuggcuaauuuuuuuuguuuuuuguagagacaggauuucaccauguugcccagguuggucuugaacuucugggcucaagcaguccacccaucgcggccucccaaagcauuggaauuacaggugugagccacugaaccuggcuccaauucucuuuuauaccaaagugacuacaguugcuccucaguagauugagagauacauuccuauauggccuuuuucagaagcguuguaacaucaacucaugcagagcuuaauuuaaaguagauaguaugcuuuuacuuguuuccagcuaugauauuagacuaauugaaaugaacuuauagguccuuuaagguaagauauagagaaagcacaaagugaaaugucuuaucuccaagaagggaaaaccgaagagacuucuuuuggaauaugguaauuauuuaaccugagaaaauuauacuuuaguaaaaugcuuuugguuuccuuaaaacuauuguuauggguugaauuguguuuccccccugccaaauucauaucuuaaauuccuaaccuuccauaucucagaaugugacuuuauuuggagguagggacuuuauagaaggaaucagguuaaagugaggucaucagggugggcccuaacccaauacaacugauguccuuauuaaaagggaaauuuggacacagauacacacagagggaagaugaugugaagagacacacagagaagacagucaucagugagccaaggagggaggccuagaacagacccuucccuuccagcccucagaaggaaccagcccugcugacaccuuggucuuggacuccagcuucuugaacugugagacagcgucugcuguuuaggcugcccagucaguggugcuuugguaccccaacccuggcagauucauaugcuauguuuagaaagugguguuuuguguuuuucuaaauaagguucuuaacccagccaggcacaguggcucacaccuguaaucccagcaccuugagagugugaggcaggaggaucgcuugagcccaggaguucgagaccagccuggacaacauagggagaccccgucucuauaaaaaaauaaaaauaaauuaggcaggcaugauggcgcacaccuguaaucccagcuacuugggagacugaggugggaggaucucuugagcccagaaaguugagccuacaaugagcuaugauugcaccacucuacuccagccugggugacagugagacccugucucaaaaaaaaaaaaaaaaaaaaaaaauuagccaaugccacucuuguuucaaaaaggauucuuugaauuguuuuauuuucuuuucauugaucccaucaguuuccuggagaaagaagcugaaaaagcguuugugucuuaucaguguuugcuucagcacuggauuggauugggaauuuucagauugcuuaugagcucuugacaccauguccuguagauaaacaauuauggguugucuguacucacccacugcagggcaaggcuggcucacccacagugguugauggcuucauucaaagcaguauagcagaguuaccaaaaggaguuauuuggggccaaguuagcagcuugcagaaagagaauuaagucugaacauguaacucugacaaauaaugagucaauaaguagauagauguguggagaauuugcaaauguuaggaaaaggauguuuucucaaucaaagaaacacagccuaugguagcauuugcagauucaaggcagaugacauaaaagauuuugaacguucuuaagagaaccacauuucuuggaagagcaggaggcgugacauggugcauuugguucucuucccaggagagcacccuucuuucccugcuccugacccugugggaaaagagggcuauuggcucauucccagccaggcucugccacucuuucucuguuuucauucuccuggaucaaucccuuaauuguguuuaucaucauuucauccuugauguuucccugugacucauauuguccuccucauacuauuugacaaugucucugcccccgaggauuacuugauuugccaucugcucuacuuucuacagcauuucuccugggaaacagcuuuacccacggggacuccauuuccaccgagguguugaugacagccuucagguccacaucuccacccaugaccuugcgcccauucccuaaccuggcuuuuuucuuguugcauauagaacauuuccucuuuguuguuacuaaugccuaaaacaaaaucugccccaaaccaagcccuucuagcuggccugugcucuuaccgucagcagcaccauucucuuagucccuuuggggcaugaaccuuugauuuagaucuuuuucccauuugcuauuucucauucuggccuucuggucuuuuggcugugucccucugucuuuggccuuacccaugaacuaguucagggucaccuugcucucuuccccuuccaguuaaucccaugcaggcccagcccauccuauugauuuccauucccuuuucaaagugggugaucgucauucacaauucaaccuagcaaguaggaacugggugcugguuaggaaagaccauuagcuccugacacuucaguaaauuaagcaauuucuugccucagaguuucaguaugaauagcugaacacuggacauuucaacguagauaucccguuagugcucauaauucaacauguugaaaacagauucuauucuccccucccccaacacuucaacuccacuucccaucuuccuucucacucguggagccccacuccuucuggcaccccaaauguguucuaguccccucuuuccuuugcucucacaucucaucugucagcaugucucaccuuuucuccucugcagaguuuuauauuucugcugcuuccuguuuucucaggcaguuccuuaguccgggucccccuuaccccucuggaccagcuuucccauuggcugagcacuugcccaagcucccuuagcccggcucuucuuacucaaggccacuucucugcacugacccccuaugcaucagauaagcagugguuaccucuuuaaauagguaaauguauuuuauuuuaaucauuucuuaugguuauauuucucagaugucauaaccagaagacacagaaaugagagaugacucagggucauuguuguugacauccacuauuuuaucaggugacguauagucaggugcguccuguaguuucagucugucuuccuucacuuaucagcccucauuuuuccuuuggcuggugugggacucaucucguuguuuggugauuguagucugagaaccuaaagaaugaagaaguuuggcugguggcauggauuugggagucaggcagaccucaguucaaaucccagcccugcuagcagaggcgaagugacuuuggacaaauuauagcuccauuuacucaucucuaaaacagggaaacacuguaguuuuguuguaucgagcaaacaccuggagucugacauauagagagcaaaggcaaucaggacagucaccuaccacuuguugauguguuagauggcagccagugagagagaaggcgaaaggagaaauuagaugagcagcucucaugguugggcuuccccccagcucucugaguauuuagaaauuacuucuagaagauagaaguuaucagaagaugacaauucuggauaacuagguaguuguauacacagugcauacuggugguuauuuauugcuuuagcauuuguuauuguauugccacuaugcaaacgcaccucaguugucuccaagcaaagccugagcuuucuaguacagagaccgcagugcuggccgcucccgccaugagucucacucuccugauggacugaaguacacucuguuugcaggauuuggagcacuagccuucugccccaucuuucuaauugcagcuugagucuuaguucugcugugaaacuuugccugaccacaaugcauagugacuccugccucuaaacuucuaguguuuacuuuggcaaguuguuuauguugccuuagaauuaccagcuguccuuuuuaauuugcauuguacuuggcaauccccaugagauucuaagcuccuuuaggucggugacgaugucuuagaugucuuuguguuuccuguugugcucaacccuaaucuuuuuuuauguagaggacccuuaauacagacuugaugauugauuuuauuucauguuuuuuguuuuuuucaaaugcccagugcugcaaucaguaguauuguuauugucauuauugacaaaagaauucuguauggcugcauaguauuccaugguguauaugugccacauuuucuuaauccagucuaucauuguuggacauuuggguugguuccaagucuuugcuauugugaauagugcugcaagaugaaauuggaaaucaucauucucaguagacuaucgcaaggacaaaaaaccaaacaccgcauguucucacucauagaugggaauugaacagugagaacacauggacacaggaaggggaacaucacacucuggggacuguugugggguggggggaggggguagggauagcauuaggagauauaccuaaugcuaaaugacgaguuaaugggugcagcacaccagcauggcacauguauacauauguaacuaaccugcacauugugcacauguacccuaaaacuuaaaguauaauaauaauaaaaaaaaagaauucuguagagcuugugguugauccuaagcugugcucugguggaauauacuauauauuuaacauugcacaacuaguggguaaacagacauugauugaaaaugguauaaaagccccagggacauucaguauacacuguuuuggaaauguaucauuuagaaugggcuaaccugaaauuaucuguguacuccuugugaaauauaaacuuaauaagcaggauuauuaaaacuuuaugaauauuauuuaguaugucaaugaaggaaacuuuccaaguacuuuuugacccccugagguauuagaucaccaugucauccaggguucucagggguuauacagauuaacccuuucuagguguuuaaaaauguccauuuagaugcauauuuccaacauucauauauuuuugacauauucuauaauuuuguuaugucuuaugugcauaaucuauauuagacagauauggcauuucauuaaauaugagaauuaauccuuccuuugaguucuuuauuaugaaaaaaaaaaaaaaagaucuguagcaucuauuaaguacucauuauucagccagagcuuguguccagaagauuuuaggaaguaaggaaguuaguaccucuuaaaaucagguguucaugauuccauucucuugaauaauauaacuggauucugagcgguaaucuguuuuacaucugccaaacccaaauuaaauauuacauaccgauaaaauuggugccacuauuuuagagaucaccucccugggaaucagggcuugagcuuugcuagaauucagugaaauugaauucaauuuauuuuuuuuuauuguaguugaacccucacucauccuuguagucugaucuuccaguagauaauuuauuuagggguggugaaauggaaaggaaauguuacucagauaugaagcaacuuuucaguucaucuaauugugaaauauaaaguuaugaagaaacuaaguaaauaguggggggaaaauaugcuaaaugagccagucccuuaacaaaugucauuuuuuaaaaaacugugugaguuggcugggugcaguggcucacgccuguaaucccagcacuuugggaagccgaggcagguggaucaccugaggucaagaguucgagaccagccuggccaacaugcugaaaccccaucucuacuaaaaauacaaauauuagcugggcgugguggcgcacgucuauaaucccagcuacuugggaggcugaggcaggagauucgcuugaacucgagaggcagagguuguggugagccaagauugcagcauugcacuccagccugggugacaagagugaaacucugucucaaaaaaaaaaaaaaaagaagaaagaaaaaaaccguaacugugugaguuaagacuucaagaaaucaugaagauuuuuagauauucuuauuauuacauuauuuguagccccagaccaaugaauuucucauuaaaccauuaagacaaagagaaaccaaaaggugcauagaauuacauagguuugaagccgggcaugguguuaugcuccuauaguccuagcuacuugggaagcugaggcaggagaaucaugugagcccaggaguucgaggcugcaaugagcuaugauugcaccacugcacuccaaccugggcaacagagagugagauccugucccaaaaaaaaaaaagaauuuagaucuagguuugaacuucuggggucagggucugauuuuuuucacuuaucacagaagcuuaaacccaucacaugacuucccaguuuucaaaguaggaccuuugugagaaugaaaguagggagggugcucugaauaauugaauuggccuaacaggguaagcauacguccaaccggcaguaggacguaugcuuacccuguccauaaaacaucuguccuggagccugcuguguacuuaguacucaagauuuuaaaaccuggagacucauaaguguuuuaagaauccugaggaauagcagaugaagucaagucuagcauuuuauagacauaaauggcaucuauaauuaaggcuagaaggcagauguuuuaaaaauaguauuuugaaaugcagacuugcauacaugcuuuuuauaaaugcaaaaugagaauuucaauaaaguaacuaaaagaagggucagaacccucauugccuuuagcauaucaaagugcacccuaagucuggguaaccuggauuuguuucggcaugagagacuuugucagcuuuaugguaauaaggaauaaugucuuacaaauaguggacuuuaauucuucuaacuauagcauauauuuuaaugucaguuuuauaggugcuauuuuucauuugucauaugcaaugaagaguuuauuauauauaguuguguaauagaaguuguuuuaaauuuuaauaaauuuguucuucagugcuuuuuacuuaucacuucuguagcaaccacaugaacucgugucuguguaauuaacaagcauguaagaaccccaugcauaucugagauucaguguuuaugacuucagccuguuuaugagacagagugguaugguaauaggcaugcuacuuguuaaaagcuuuaguucuagguuauggugacucccuguccuuuagugaaugaaaauguggccauuuugacagguuuuaucuugggaggccacuaaggcuuuuguggaaaagucugggucaggucauuccuguaggagcaggugugguuauggcagauuuauccuaccgugaccuccuggguuccucuuacugcuccccaugggcucgaaacuugcccucccaaguccaguagucccccuggucucucaccuagaaggaguaaaauccgccuucucuuucaagagccaacuaggaagugcagagauaacuuaaaaagcaguugagauuuugccauuggaucaaacugacaaugugcauuaagccucuguuuuuccugaaaaggauauugacaaaugaggcgggaaguagccuugacuaguccagaggucaauacagaaagaaaugagaggagacauuuagcuuuuacuuucaaguggaaaaaaacauugagucccccucugcacccccacuuuauugucccucacuuuaggaucugaauaaauagagaaguaauacguugugggcucaacucucugaaagcuaaacuaauagggaagguuuguuccagagaaauacucucaaggagaaauguuuggaaauaaguguguugccauaagauuauuuuaagauuaagcuacaaaaccaccagcagugucuuauuccuuaugaagguauuucagggauuuaaaaaaguauuacuguuaaagacuuuaacuauaucuuguuggagcauuuugcugccugaagcaaaguggccucugcuacagaacaaagguaacacgucugcacugagcguuggguccagucauuggaauagcggcuguugacuucauaaaggggcagcaggggccacaccaggccaggccggagucugaggcagccggcuguggugcaggguguuuccagccauguaggccuccugucugauccugggcaucugucaucagaggcagccagugaugauuuccacaauuuuaugacccuuggcugucaucccaauaacaaauaagucauaagccacccucuuccccucuguaaaauuccacuucugcaccguggacggccuuuccaccaagaucuuuuugaaacagugaaaacagagacuagcaccucaccuucuuuauguaugaacagcguauuucugcugucgcucucucugaccgcccccuuccggguacuuaaagacugaaaaauaagcagcaggcuugacacgaaaggaugaaggaaauggcuguuuugcuuugacucuucaguggcuaaguuacugaaagccaaguaauuggucauuucuauauuguauacaacaucuagaacaauauggauauucacuugauacugauaaauagggaauagccauauucuguguuguucuagaauaagggggauguugacuuagaauaagggggauguugacuugaacaaaaagaacagugggaagaaacgggugaaguacggauucugaauaagcaagccagaauagucuugucaggcacgaggauuccuacagacgugcagucacagugcguagauggaggucggagcucaggauugaagcaagaagggaacacccuccagcagauccaugggcccaggguggagguggggcuccaaucaggugcuggauguuagcagaacugccccuaggaagucagagcugaagucagaugguacauaugguaagugcuguaggaacagugaguugggaaugaucacuggguuagaguggucuggaaagagaaggaaucuaagcuggcuggucuuuggauaaguugagaaaagcagcaaaggcaugccagguaaaggaauaguguaagagugugaagauaggaaguauaagagacauucuagaaacagcgaauagaccagcuucauucaaguuaaggacccaggaagguuaguagagcuggagcuaacaagguaguuggaaucaacauguaaauguaucgaguucucagcuuuaucuccuugacaguaaggagccaguggaaguuuggagaggggaguggcaugcucagagauguuuuaggaagauuaaucugguagccaaauauaggcaaauuaaagggagacagagugcucagguagaugagaugucuagauuugcuuuaguccuucuagaaagugauaaauacauucacuguggaaguggcagcaacagcagaaauaaagaauuggaugcaagagauguuuugaaggaaggagaaauuaauaaggcuuagcaccuucuugucuaugaauguaaagaagaaccaucauaguucauaguuuuggagccaagugacuagaacagucauggagauguuaggauagagggugagauggcuagauuuuuaggaaaaaauaagggguucagcuuuggaagcgcaucuuugacauuguagcaggaggcugcaauauaucacuguaaccucugagggagagcccagccugugauaaacaugugggggucaccuacacagaggugacggcuuaaacugcuugaauggaugauagcugccagagagaacagagucaaaacgguggaaaugccaacauuugaaaggaggaagagggcugggugcgguggcucacaccuguaauaccagcacuuugggaggcugaggggaguggaucacuugagaucaggaguuugaggccagccuggccaacaugaaaccccgucucuacuaaaaauaugaaaauuagcugggcgugguggcgcacaccuguagucccagcuacucaggaggcggagguugcagugagccgagauagcaccacugcacuccagucugggcgacagagcaagacucugucucaaaaaauaauaauaauaaaauaaaggaggaagaggaaccacccgagcacacagugugcaaucagacacgggauggggagauuacagauucacugaaguccagagaagagcaucaagaaggaagucguggucagcaguaucagauguugcagagguuaagaagaacgggcugaaacaaggccauuggauuaggcaauuaggaagucauuuaccuucaagaacaggagccuauagugcauuaacgaguugggggagauggauuaagaugugggcauugaagaaaagggagcauaaaccauugaucacaggugagaggagggaaagaauuaagaggggggaaugcggcuguuacuccuuuugccuuccauguugggaguuugugugugcacgcacaugaaggcagaagaaaaagaugaggugaccgauucauuuggacagccauauuaaguuccuacuaaauacuuggauccaauuaaguacagggagaaauggaaagcuacaagagaaagaacagugguggaagcagguucaagagaaaaugggacaaauauggaucaugagaaucgggaacuuuuuuaguauuggaaaagagcaacaccucuuucucucagacuggagagaaggaaugaaggauggaggaugauguagauucaggaauguucugaaaugaagaaggaaauaaaggaggaaaguaaggcugaccucaggcuucuggacaaaguggaaguugggucaucuacugagagagaagguggacuagggugaugguugauggaguggaaaggauuaccacucuagguaaugccaggggcucagagagacaggaacacuagguuagccaacccccaacagggcuugcagaagcugcacuuccuugugcuucugugagaaauguuuguugauaguggcuuagaagaugggcaauguuuguuacucuuuuaaccuuuaaggaguuauccuucaucaccuuauuauuuuugcuuaauauauuuucuaugaauuuuuguuucaguaucaccguaauuuguacaaguguuccagaauaacggucucauagguuucuaaguuuaucuaaauuguggaugagauguugguaugaaauaauaguacuucuggccagacacgguggcucacgucuguaaucccagcacuuugggaggcugaggcggguggaucaccugaggucaggaguuugagaccaggcuggccaacauggugaaaccccaucccuacuaaaaauucaaaaauuagucgggcgugguggcaggaaccuauaaucccagccuuuggaggcugaggcaggagaauggcuugaaaccugggaggcagagguggcagugagccgagaucaugccauugcacuccagccugggugacaagagcgagacucggucucaaaacaaaaacaaacaaacaaacaaaaaaaaacaaaaagaaauaguacuuucuagagaaauguauugauauaugaauuuagcaggaagcgugagugaauggagccaugaauugugcuacccaguccccaccaguaaggcugauaaaauguuuuaugcuguugaaaugaaaaacgucagaccaacugcugauccacuaaacccuacagaaucgaugacaaagaugccagcugguaauuaggguucauccaggauccagaagauccugaguggccuggugauggggccugugugggaagauguuuucucaaaccaguaaacuugacagggucuguggacaaggcugagcugaugaugugggcaacgaaguacgugacagcagagccuccugaguuucaguagaaagcaacccagggagaacugaggaagaauccauuucugucacaaguaauguuuacaaaaaaaaauggugaccuauguccugauauuggaauucuguuucugagucucagcuguguugcuggcaccuaaugguggcaaguggcacccuggaaccacuugguuccacaaacucagugaccagaaugugcuucuggguggaagagauucacuuuuucaaccuuguuuucaagugggaggaauauauucuguauggcccaagccacagaugagaacugaaggggaucuguugaguuuacuuguaccaaggugacuccgauacuuacuuuucguuuuccuuuccuuguagguauggccucacaugugcaaguuuucuccccucacacccuucaaucaagugccuucuguagugugaagaaacugaaaauagagccgaguuccaacugggacaugacuggguacggcucccacagcaaaguguauagccagagcaagaacaucccccugucgcagccagccaccacaaccgucagcaccuccuugccggucccaaacccaagccuaccuuacgagcagaccaucgucuucccaggaagcaccgggcacaucguggucaccucagcaagcagcacuucugucaccgggcaaguccucggcggaccacacaaccuaaugcgucgaagcacugugagccuccuugauaccuaccaaaaauguggacucaagcguaagagcgaggagaucgagaacacaagcagcgugcagaucaucgaggagcauccacccaugauucagaauaaugcaagcggggccacugucgccacugccaccacgucuacugccaccuccaaaaacagcggcuccaacagcgagggcgacuaucagcuggugcagcaugaggugcugugcuccaugaccaacaccuacgaggucuuagaguucuugggccgagggacguuugggcaaguggucaagugcuggaaacggggcaccaaugagaucguagccaucaagauccugaagaaccacccauccuaugcccgacaaggucagauugaagugagcauccuggcccgguugagcacggagagugccgaugacuauaacuucguccgggccuacgaaugcuuccagcacaagaaccacacgugcuuggucuucgagauguuggagcagaaccucuaugacuuucugaagcaaaacaaguuuagccccuugccccucaaauacauucgcccaguucuccagcagguagccacagcccugaugaaacucaaaagccuaggucuuauccacgcugaccucaaaccagaaaacaucaugcugguggauccaucuagacaaccauacagagucaaggucaucgacuuugguucagccagccacgucuccaaggcugugugcuccaccuacuugcaguccagauauuacagguaagaccguccacaaggagacaggagcugcugaaugcccaguggcacucacagagaaugugccaccuuagucacuguggggagauaaaauuauaugucuacaguuccugccuucaagugaucuuaauguacuuacgaaauuaggacaugugcacauugcgaugucaauuagaagucacauuagaacggagccagguaagauccguggcacagguguucagcguuggaagggcucccugggaccuggggugcagagcagaagaguuccguccucccggauggguaggauccagacaggugguggagagagagggaugugccauccacaguccgcagucacacuagugggaauuuacaggagacaagaaggacacccgccuggccagaacaguuugugaguggugggagaugugagugaaagccugguuggaaccaggucacugggggucuuaaauaucagaucaaggaauugcaacuguauccucaaacccagagcaagcccuggaaaccuugaacaacauaagguaacggguugaaagggauguuccgagaagguuccuugucuauccacgugcagaagggcuggaggaagggagagacuagucuggggccagcuggguggcuccugugguaaggugacuucaggcuuugggucaggaugagggaggaaugauaguguccguggcagggaaguguguucagucauggacucacacaugcagucauucaacaagcuuugauuucacuuuuaauaugugccagccgcagugcuagguauagggauauagacagggcccuugccauccugggguaucuggaagcuuuucagggaccccuguaugcagucaggauuggaaccgcugccgacauggagcugagaucggagugcuggcuuuggagucaggaaaggccagagugaaccuggucccuccucuccuaauggccugauuucuccaugccuucauuuccuaacccaugaagugggagaaauccucucaccagccucgugggcagcugggagguaacauggcuguaacauggcuuaggugugucacuccguggcuggccauggcgggugcacagcggggaggcggcagggauggaaagcaagacccugcucuguggaaccagccuggggguguguuugggguggugccgaacagugcaguggagauagaggucacaagaaacaaaacugaaacucccaugagaagaugggacggaugcacauuuaagagcgugccacguaggcaggaagaccgggguccccggaggccauccugcuugcaagcaagcacgcucgcuugcccgugugcuuucuccaugcgccuuucaaggccacagagagaaggcuggaacaugccccagggccuugucgacacagcugaccugucacccauuccuggggcugaccugggccagcuuccccuucuugcucccuguccgggcccccauccuggcugcaggcagagcuguugcaagucuccucccagccccucccucagccugcugggcaccaggcccuccuucccugggagagcaacagccccuccguucggauccccagaugcccucccaccuuccaccccgucuccuuucauccuaauccugacucacacaggagguuucgaggccucuucacccaugcuguuucugucucuucccucuucccuuuaggaggcauuuccugaguuagaacagcucucugcgagccucuucucugcccugcccugaggauuccuuucccgcucauuuccuaugcgcagaaaggucuccacaggccugugcuuucaccaccaggccccgugcggacagacgggucuacugcugccccuccacuugcucuccacucccucguccugaccaggccauccacucugugccccgcuggccccagagccaauggcagggagaaguaagcccagggcaggagccuccaaggaagacaagaagccucuccuugucuccagaggagaaggaugggcaaugguugagugaaucuggaggguugggugcccgguaccgacagcacauauucucuguagagagugccugggccucugaaagccagcucugguggccgucccggguaccagccccauugggggcuagcuggugcugugcuggcucugggaggcugcugugccacuucguauuuagguugguaaauucagcaugccaaaggcuggcucuuucuaguucuuggccugaauucagggugaacagccccugacuuggcugcuagggcuuuuauguaguucaucugaauugcugcaucaugaacacguaccaguguuauuaacauucacugaaagcuagcauggcgacuuguaaaaagacuucgacaaacucuguuuaaaaggcagcacauccuuagagcgaaacuuggugaaucgaguaagcugaauuggggauucuuaagacccccuugucaucuugccuucuggugcccaugugacgcuuccuggagcccucccugcccauccccuuggacucugcgaguuuuucuuugcuuuccugccuggugcuggugccccuagugcugaggagacaggucgcaaaaucggggauccuagcucaggaagccugcggcagcaguaaaaguuugccugugaggguuggggagggcugacuccuucaccuggacucacagcgauccucuccugccccccucugugggugagaucaggccuuuuggacgccucuggugggugugguaggcugguuugcuggcgguuccugggcccucaggagcccucuuuuccccacuucgugacaggcacagucacaucuggccccuguguccccacaucccucugaaggacccuccguuuaguugugauaguacccucuuuucaccccugaaaucaccauugccuaaaauucugagcaagaaggccucuuucuccuuucuguggucaccuucaggcccucaugucagccucccugugcccagcccugguuccaaaaauacggucagcaggaaagacagcggcucuucugccugaaaugaggcuucauuucuaaguuggugcaauguucuguuucucccucaggccuugucugagcccugcagugguuugccaccauauagaucgauccgauuuuucgaggacagucucuagugcucugucucuuuucgucccagcugugugggacagccagcucuaggccauguuuaucaaguugauuuuccugguggcuuugccucuuauaggaaagaaagggggcaagaaaagcucuuuaauuguccaucguuaaggcccaugucccagaaagaagacgcuuucagaugcuuucagcugcaucugcaucgugagggaauggcuguguguuugagccgccugggcuggaggagucauugcaugcugugcauccagccucccagcagguuggccuuuguccugcaggugguggguggggacuuucuccccucggcccccuguaucugagcugggcacauuaucgucccaggacaucugacuuucaaaagguagaguacuuaugugucccucugucauuuugcaugggacugggcuaagugucucaucccaccauuguccccaccuagugacacagaaacggugugagacaaggauauguuauccucgccuuggggacuuggaaaaggaggugguguccccggagccaacuguuuuccccagcucucaggcaugugccuggccacaguggcuguugguauucugugaggcaagcccacugguguguuuuucaggaaacaaaggcugcuuuuuaaguuuuuuucucgagucugaagcagggguauucccuuccaauucgaaggucaguuaugucauuaacugucagcugcccagguucucaggcuuuacugugcacaggaaucuccuggagagguugcugggaacagagucucccugggaguacccugggagaaaguccacacccaccaccacagagacuugccucagagaacuggaggugagccaggcagggggucuuaggaccagucuuugagaaacacuauucugaaggacagagggauuuucuuaauggugucaccuuucagguguugacacccaaaagaacagaguugcagguaauccuugcuuguauuacuucaccuugggcgccccugcccuuuuguuauuuaauucuacauugaugccaguucauuuuguuuguuuuuaguuuuuuuguuuuuuuuuugagcaagcaauaaauugguacugggguauuuccauuaucagcagaaccaguaaacuacaaauaagaccaaauguuaaacuccacucucagaaaaaaacacaaacaaaaagacaugccauucaggcaaaggguaaucagugauuaaaauauauagauuuuuuuugguuucuacucuggauuauucaaaauauucuugucuagaguuuuuugaaacacguaggacuguuaccaggacccaaaaauugaacauaaaaaauuaggacaugaaaaauagcaaauaauccacuuuuucagaauaaucuaaccuuuuuuuuuugagacggagucuugcucugucucccagacuggagugcaguggugcgaucucgacucacugcaaacuccgccucccagguucaccccauucuucugcuucagccuccugaguagcugggacuacaggcgcccaugaccacgccuggcuaauuuuuuuguauuuuuaguagagaugggguuucacuguauuagccaggaugaucucaaucuccugaccuugugauccgccugccuuggccucccaaagugcugggauuacaggcgugagccaccacgcccagccuuuuuuuuuugucugauucuuuggggugcaaagacugucuucaaguugauuucauggugguuuuagguggggguguguauuauuccauucuugcauugccauaaagagcuaccuaugacuggguaauuuauuaaaaaaaaaaagguuuaauugacucacaguucugcgggguguauaggaagcauggcugggaggccucaggaaacuuacaaucauggaggaaggugaaggggaagcaggcacaucuuauauggcuggagaaggagaaagagagaggugggguaggugcuacaugcuuuuaaacaaccaaaucucgugagaacucacaaucacaagaacagcaagggggaagugugcccccaugacucagucaucuuucaccaggccccuccuccaacguuggagaucacaauucaacaugagauuuggguagggacacagauccaaaccauaucaggguggagauuaauuuucaguucaauucaucaaacauucauuacugagugucccguaguagauaugugcuccagagugcagaggguaaggcaugaucccuaaucuugcagaguucacagucucuuugaggagauggaaaacacaaaccaacugccaagacugucauucugaugcuucaauauuuuaaauguuuggucauucaacagagauuuauugugaaccuaccuucugccagacucuagggaaacaaugaugagcaaagccaguucaagaaauuaaaagucagugaaagauuuugccagauggguuaacagggaaguuaacaugagauagggauggggaagucuaggggucauggagacuggaauaaauaagggaagaugggagaaaugauggugacuccuuagacagugacaccuggcgggagucgaaggccuguacuggaaaauaauaauccggugagugaagccugacaauagagaguuuugaauacaggcuugaggggcuuggguugagccaaagugccagagcugggagccauuguaaauucuggaacaaaggagaaguuuaaugaaaauuaaugaugguauaaaucaauuggaauggcaaagaaaaaaaaaaguuguggggauguuuugagagccagaggcuaggagacaacuguuguuacucaggaaugaagggaugaggcccuagauuauaaugggggguucuaccccccgauaguaugaauguggacauuguuagugcauuuaacuuuuccgaugcuuugauugcagaauugacuuagagggaauagcuuuuuguuuauuuugcuuucuuuuguuuaaugaccuugcugucucuaaggcucaguucugaagcuccagucuuucagagccuaguuucaaaucccaccacugcuauaaagaaauaggcucugaaaggagaaaccagagaccuuagcaccaguccuagcccugccccaagcuguguuccauugagucacggucaguagaaugucagcugugacuguccacacuccuccaucuggaucccauuaugaccugggccuguguuuaugaggcgguuggccagaauuggugguucagucuguggccagggagcaguuuucucuccuguggguugaccuuggccucauuagcugaaacugggaacccuccaugauccccugaucaacagagaacagagcauauucuaaaaugccaugcucugggcuggaaauaucaaucauuucaaaaaggggcauagcuuuauaaagccauaaauauaagucauuucaaaaauugcauagcuugugcagauuacagcauauagaaagugagugacuagaaguuagguuugauugaaaagagggucucugaaagcaagugcaucgcaggcaugaacuuuuaaaauuaauuugucuuuuacuaauagaaacaacaggagaagguucuaguuugcacuugaagauaugaagugaacuguucaacccaccgacaacuucauuugcccagggagacuguuauaaauacguacauguaugcguuucggguugcagcuucucuuuugaagagaaguaaucaauaaguuauguaggcuguuagguuaucuucaaguuucccuuauucaucucugggaccuucagcuguaugguaaaauacuuugcaauuaaaauuucucuuaauaaguauuauuauuuaauuauaaguaugaaauaacugaacuggaaugcucuguguauacugcccugguacugcaguccccucuucacacacacacaggugcacacacacacaugcacacacacagacucaggcgacacaguuuaagcccaugugugacaugcaggcacaggugugcuuaugagaaccauggugaccaagaagcugacacucagcccuccauacagagcuacugauaaugcacacacgcccaccauguggugaaagacacaaggcacacgcagcaagcaugcuuggacaugcaagggcacacgcacacacuuaaagacaugaaaauaccccaguguccccagagacagagggcccaggugcagacgcaguguucacgcccuggaaacuuggcccaguuuucugccuugccacagagcugccaaauacaugucucuaaccugagaacaguagggccagaacuacucuugggcucaagguagagaccagucauuuuccaagugggaucuaaggacccuccugccccaucaucacccaggguacuugccgaaacaaaccuaaugagcaggcccucuggggguggggggccaggugacaugcauuuggacaagcucugcagcuaauucuuaaaaacacacacacaguuuauugagguaugauuuacuuacagaaagcuguacauacuuaauauccaugacuugauggguucggggcugaguauauacccaugaaaccaccacagccuaugccauaggcauauccaucaccuccgaaaguuuccuccugcccucuuuauuuauuuuauuauuauccuuugagaauuguugcuuagauggcaugggcuccagagugucagcccaccaggguguaguguagacccuguggaggugagagggugcggccggcaugacagccuggcauugagcuguccgucugucucccaagugguugagagcccuucugcagggcccguuugucagauuccuuguggucagacccuuuaugccccagggguggcaacagaagagauccagaauaauugggggguaccauaggaggggucauguggguuggugaacuggcaagcagugggugguuaggaggggaacgccuggacugggugggaauagaaaggugaacagcagaggagacaugaacgugccuuccuuccugcaugacuuacgauggauagcgcacucacugccaaggagcugcugaacucucccuguagccacagcuggguuuggagcuguaacucucauguaugcauccaacagguaauuuuuugaauuccgaagaugugccauacacuguguugugcugagguuucaggacgugaguaggagugcccucggcucugcaguaucuguccccagucugcgauggaagaggcuguccccgaguagacagccagcccccacuguccuggcccacccuggucucccagcuugaacaucucucauuaaacugaaaaggcagaguuugucaccuugaaucauuuugccaguuccccuggcuuuuagggccacuagcauguucugaguccucgaugccgcccugugagagcaggucgcugcgucgcagcagugcagacagggccacccuucucucgcucaccaaucuccccugcggggucuuacggagggugauugaagccagcaaacccacggccagugccggauggagccucagggcuuugcggguauugggcuuguggcccuuguuccgggacagauugagauggugcuguuacagaagcaacugucucgaauuuccccaagagcaagggcuugggugcagaucgccuguuuaggagaugaucacaggccuaagggaaucgggagagugaugcugagaggaguaagccccaugauucugggcugcuguacacucagggcuccgucccaccucugaggagccugcccgaggccuccaggagugugccugggaagggccaaaggcggggcucuggucgcagggguugagggcuccccaggguguuaacuccccuguggcuuugcuugggcagagcuugugccaggacugagugggcuugagcagggucagagguggcucugaagcagaaaagcaaagcgaugcaaggugcaccugacugaggccacaguguggccgaaucagagaaagugugacccacagugugcugggacgucacucuuuguccuucccaccaaucacauguguggcauuuguaaauggaaagagaauaaaaggaaaaugccuuuauagacaaaucugagaaugcaagcuaagaauucacaguugagcucuaaacguuugcgaggaguuggggaucucuaccucccgugugagcaggcgggagccaggcugggcucugagauagaauuccagagcaggggaggggcugaaagcugaaauacaagcuccagaaacaguagaagcagguugagcucaguuacucugucccauguuuucucccuuaaugcuuauuaaauguugcagacaccauuuccuaaggcucaucaguggaaugagugaaugaccgaaugccugcaugcauuaaugaaugauaugagcggcaucccaugccuuguagcucagcucaucucgucacccaccggaaacccucgcaugcccaguuucuugucaucuuucaugcaggaacuuucacugcugccuaaguccugggccacagcaucuagcaucucugaacccugaaucacaggggccgcccgcuuccgccucuuggggaacguacacaucucaccaaaaacacuuauucccaucucgucuuuccaccugugugaaguuuauauuuaaggccugcagacagcugauucagcuucgaacagaucaguucccugaaaucagccaacaucugucuugucccauuauaccuucgcagaaaaugagaagcgacuuccccagcauaaagaaggggccaaaugcagcaagaccuggcugagucaccuugaggauagaaagacagcaucauccccggggccucguaaccuccaaccugcuuuucuguuuuugaggcucuguggacaugcugcucacguuccuuguaacuuugucuucguacguaagagcugcaugaacaaagccuuccuggagagaguaaggccaaucgucagcugcucaacccgugccuggcacauagugagcacucaggaaauguuagcugcucuuuuuuuuuuuuuuuuuuacuaaucuuuucauccuuguuauuauuuguauuaucauuacuaucaucuggcagacagagcuggauuugaauuccagaucugcuacuuuacagcugugugacuccaggcagguucccaaaccuuucugaggcuuauuguucuuuuuucuuaaaagagaaaacuuccucacaccuguaaucccagcacuuugggaggccgaggcgggcggaucacgaggucaggagauccagaccauccuggcuaacauggugaaacaccgucucuacuaaaaauaccaaaaaaucagcugggcguguuggugggugccuguagucccagcuacucaggaggcugaggcaggagaauggcaugaacccaggaggcggagcuugcagugagccgagauugcgccacugcacuccagccugggcgacauagcgagacuccgucucaaaaaaaaaaaagggggaaacuacuagcaguugguaguaguuuucccuuuuaagagaagaugagguugguagggacugaaugagauagccgcaugcguguaacucgcccucugccaugccuggcacacagcagcucugucacgaauaagcaccaugcuuuccccagccuccccacccagauccaugcuucugugacagcaugcauuuuccuuggccuggugucaucauucaugauuuguaagcugggcauccccaguauucccaaucauuucuuuuucaucuuacaggcgccuggaggcccagcaucguauaucagacucacuaggucccaaaggaacaagggccuggauguugggagugugguuaguugguuuccucuggcaccaggaagggacagggcccagcauuuggggagagaggagacaccucuuccugaguccagagggaggaggacagaucuugguugcuuggggaggaagguggggguauacuuccugacuugagagcugcaccuccaggcugcugcuucuggcccaggagcaacgcuagaguccuguaguccgacgguggagugcaggggccuccgaggagaguggugggacggggcgcuggaggccuuggggguuaaacugccuuugacaccugcugguaccuccugcagccacguguaucaccacugacaucacuagggucaaaaagccaaggcuggagugaugccaaagagccuguuuaagacuccccugaagacagagcacgucuguguguaugggguguguguuggguguguuuauguaugguaggcauguguaugguuugnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaucaggccaccagggaauggugggcuugucucaaucagugaaccuuggcagguggcgagaacgcuuugagacccaggcagaccacaacagacuccccacgugguuccagagaccagagguggaucugggcuggggcaggaaugaccccucagcaugacagugccccgugccuuugguccugccuugggaggagacaccugucggagcucugagccguguguugcugggauacgucaugaucaucgaucugagguaucuuuguguugguaauggguaucuaucacugggcuaggugacagaaccuugcucuguugauacauaucuggugucuuguggagcguguaaggacacacgugucucuggcagaguggagcauggcagacugugagaguuacaggaggauggauuaaaguucauccguuuauuucaugagucagaaagagcagaugaauuuuugcuaauucgaagugcaucuauuacagccaggucaaaagagaaaucugagaaaccuucuguacugaguaaugcagacccuucagacuuaaccuuucuugaugauuuauugaauaggaaaaaaaguauauuucugcuuuugcaguuccaaguuucuucucgguuuagaaucagucacuucaaggaaagacugcacucuuuaugcauguggaaguggcuuguuuuuagaguuggauuaucacuccuuucauguguucaguuugcagcaagcauuuauugagugccugcugccugcgggauacugcauuuuaguaucugauaagugcacauguuuuuagaaauguuuaccugagucacacauuauuggagaauaaagauaucauguguguauacauuucccaagugacuaaaacuuacccauuucaacaccauacuuaaaauguuuuuuuuuuuuuucuggacaaaaauuuaacaggaagacaucauagcaucccauaccuucugauauagaguagaggacgaaggggaaugaauggcacuggcauuuuaauaagcaucugcuaaaggccagaggccuacauuuaaucuuugggacaacuccccauuuaguggaugagaaaauugagucugaggaaaccaacugccaaguggcacaaggcuagaaguagugcugcugggauuugaaccaggugugucugacccccagacacacguuucuucuaccaagugcugcucucucuccaacugaaccccuuccuaaucccucaggguuauuauaaaugugaugaaauguguucaaacacagacaugcacuuaggugcucuacuuagaguuuaauucucuuugcuccaguuaaaaggcuccuuguaucuguguucauugaguuaaaauucuaacucuagcugccauuuauuaagugccuguuauaugcaaggaauuuuacaugcauuuucucuguucuucacaaggcauuuuuuccauucuguagaugaggaaacaagcucaaggagguuaaguaacuugccccaaauccuauaaucacuaagugauagagccuuuggagucuuucugccuccaaaagcuuugcaucuucucacagugguuggucucuguuccucuugggguuaggaacuguugucauuaugccagccccuuccugcaguggcucucuccuguucuaaugucguguucccaucucuucaugacagcagaaucaagucaccaaaccuguuggagguaauggaaaaaauauuggcauaggaaccaaacgaccuggcuucuagccccaagcugggcauguggccuuaagcaagcccuuggcuccugaaauuuagagccguacuucuucccugccuaggaugggcauuuaucacgaaugugugagaaucugcauaugcuccacccacauaauggguacugacgaaauuauguuugggacguaagcacauaacuguuuuuuuuucugaugcauauagaugcuauugugauuaauaaauuggaaaaugugacuugccuacugugacuuuuugguauuuuguauuuucucaauugggagauaguaacaaugcaauuacuaucaugugggaucuaaccauucccccaccccaaauucuacagaugacaauagaaaccuacuucaugucagggagccacggucaccccucucuguacacaggaaaagaaccuguccugcucccuuaguaggauugcugugaaagucuaggaugugggaacauagugcaggguauacagagcuagcucuauaccuuugaccuuggcauuaagcaggcucucggggagggccugacacccucucuguagccagugugcaugagcuuaaugcacagauuuuacaucuauuuuuggugcucaaaggccuuuuugaguucacuuccagguucuggguuauguucuagguaguuguuggugccaaaugaaaaugagcuucaaauguuauuaaauguauguauuucuuuaaaaaagaaaauacuguuucagauacuucagaauuagaaacugcaccagguuggucauuucuuugagcacuggccuauuuaaaauuuuuagaaaaccaaaaagcuguccaucuacugucuacugauaugccuguaauguuauaucaaaaaccuguuaccuuaaguuuuauuuuuuaauauaugaaugcguagaaaucaucuuuuuauaaauauccugguuuugguggauuuaauaccuucccugaaaggagaaauaaguauaccacguauauuucuauuccccaaaaacucuggauuuuuuucauaggccacgguuuuuaauguauuauuuauuuuugagguauuaauacaauuuuguacuugacagagcaccaugauguauacaguuucauuuaaucaucagagcagcuccguuucauccccacuugcacagguggaaacugagaaucugcccugucccuggacgcagagccaggaaggagucaagccagcugguccccagccagcucucuccacaccaggcucaccuccuuaucccagcugguuuugcugcuguggggcagcucacugugccagacuuuucccacaugguuuaugagggcucaugaggugaagggucaggcuuucauuuugguccaguguuucacauagaaauugugcuccaugcagcagugccaggucagaguguaagugauuccaagccacauauuacucuuggguaggcagggagcaggguugcaaaagagcaagacuuaaugacauuggcuaucugcuauuauugucuuauuacaugaaaagagggccuaaguuuguugucacucucuccgcagauaugaacacugaacuuucuuagucauaauggggacgggcucgucagagugcuaaauuaccagcaacugcaguguuauuugauguucgguuuuaucagcaagggugccagauguuugcacaaucgaaacuauggaacuauagagacauauaaaccagcucugcagcuagccacauauagagccaauaccacacugugauaguaaggguaggggggcguuuuccuuuuguccaaagaaaagagguuucccacagaaucucaacacugugucccugaaagugaucuuggcaauuaucuaaucucaccuccuucauuacagauuccuguuuuuuaugucaaauacauuggaggcuuaaggcucucggccagaugcuaaaggugagcauuugcaggcuucccaggccgagauuguccaggaucaaacacccgguucguaggaugucugagucccuuuaguguugcuaucaaggaauaccugagacuggguaauuuauaaagaaaagaaguuuauuucgcucaugauucugaugucugcaaaaguucaagauuggucaucugcaucugguaagggccacaggcugcccccacucauggcugaaggugaaggggagcuggcgugugcggauuacauggcacuggaggaagcaaggcgggggcaggggagugccaggcucuuuaaauuuguauuuauuuuauuuuauuuuuaaaauuuauuucuauuuuuuguagagacagugucucacuauguugcccaggcuggucucgaacuccugggcacaaacgauccucccaccuuggccccccaccccaaagugcuggggcuggcucuuuuuuacaacuagcucucgugggaacaaauagagcaagaacucauuuauuacugcgaggacaacacuaagccguucaugagggaucuguccccaugacccaaauaccucccauuaguucccaccuccaacacuggagaucacauuucaacauaagauuggagggggacaaacaucaaaacuguagcauagggaagccagcaucuguccacagccugcuguaugucccuacucuucuuggcccucugcccuccccugacucugugugcacugcucauaccacuaaauagggaccgaugcucuagcaaauggcccuuguguugaugcauucaccaccccuuuacacugacguaguugggcaagcaaguguucaggaaugggucugagggcuuucugggugcagcucauuucccaagcgcuuuccccuggcaucccuuuaaaccugcugugucagcugucccuccccgcacucccccacccccgcccccaccgcuucucauggaccugcauagauugggccccaccuugaggcucccccagcccccugugcacaccgaggugcccggcacccugcgugagcucucacuguggauggugagcaaggacauccacccagcgucuuucccccucacaggcugccugaggccuuugucccuguccugucagggaagcucugccgcucuccuguugauugacucaccaccugacuccuucccaguccucuuuuucucauuuuggaguuagaagucuccagaccccaguuaguccuggcuccucuucaagcaaagcgcaagccauagcuugggauuucugagccacacgauuacauguagggccagauaugacccuuggaccaaugggaagcuguguguggcagagaugggcagguuuguaauaggaaaguuccaggcugggcucaucaggugagaaacauuucugcacaccucccccauagcagacccaguauucuucaccaucaacagacauaagguaacugagacaggaagauguuaccugugaggaacuugcaauuuagcuaauacauauaaaugauguugugugaaaguaauucugggcuguuucacaagaaauauuuauuuucauuccaaauuggauagcaagccaauucuuucuuauaagacagcauauaacauacauaacuucaaaaugacacacuuggacugccuaaaucuuaauccugagaacuucaagguuccauuugguaugugggcuucauugugaugauugaauuaggcagcccuguuaacgccaacaaaauaugaccgcuuuucucugauugcauuuccugacuucuaaguuuucccgauagcaguuuucccuaccagcaguucauuuccccagcucuuggggagcacucugugggguccguggcugcauuuacaccccagccaaacguggcacucaucgggcgucuccaggcugcacgaagauucaacuuuagcuuuggcucuugguccaccacuuggcaguuaggaaaguuuucauuuugagaguuucucuucauuugccuuguuaauauucagguuugacuuguagugguaccauaagguauaaacucuuaguaagacuggaaauaaaauugugguauuuuacuguacauaagccccugaauguacccagaagucuuauacaaguuguuggucacuuugacuuuuuuuucaucauguucuauacugguggcauuaaauucacaugcaggcagaauccgucuuauaaugaacauuaguauuuuuaaguuuugcugucuggauuuuggugaggugggaggugggaagagggaaagugauuuuacaugggaacucaucucugguguuaaaaauagucaauugaggcauaugauugauaacaaauauuauccugugccacauuauucaggggaggacuugaugcuaagauuguaggcugcagaugaaaauaaguagccuaccagcccucuuaaacaucucccuuuaacugggaucauacccccaaccauagcccuuggaagagaaccggcagcagccaucagcuccugccuuuuggcccuugacauuggcccagacucuagaguugagggagugagaagcccguucuuccacaccuuccugugucuuccagucucuagcugucuucaacugcuucugauauucagaggucaaguuaucauuuacuugacaaucacucccaguuagggggagcgguaaggagaggaguuugaaaaggaaaaaguggaaaaguggaggagacugccagaccaagagaaugagaggagggagugccucuugaucucgaugaaugagucaucagcuccagauucacguggucacgaaagaggaggagcucacacaggccuggucuggccaggcuucagagggcaagaagagggauggggugugugugugcccaguggauugucccugcaggcccaaugggcugcguguguguguguguuggcccaguggauugucccugcaggcccaaugggcugccugugugaguuggggugacaagaauccaugcugcuugagaacaagggugagcuuaucccuggaugugcucaagcacagcuuugcagaucuuggcuaaggaagauccuagaaucugguucuucccaaggaucuuugccuucucucugggaaauuucaucuccucucaucucuggauccuucucccaaucacccauacauccaccagcccccaaacugccccagaauauuauuaagcacaaaucuaagcuguuucagccagaauuguguuuagccugggacaggaagagcugguuccucugcccuguacugccugaggugugcaaguuuaggaauccaggagacuaguauuuucucccagguucuuggcauaccaauccuagugaggggugccugcugagggacuuuagacaugggauaggaugagaugggaugggauagacugagacaagaauugggggcagcuuaucacccauacccuguguuaaaauuaaaaccaaaauucuuaagcaacauuaaauauccuguauuuacuauguuagucuguuuucuucaccaauguauucuauaucccaaccaccuaauaaugccuggcauauuauaaauaccucagagauauugcaggcuugguuucagaccaccucaauaaagugaauauugcaauacagugaaucacaugcauuauugugguucuuagugcauauaaaaaacuguaguguagucuuugugugcaaucauuuguacuuaccucauuuguaugcuauaucaugucuaaaaaauugcacauacuuaauuuuaaaauacuagagcuaauuuuaaaaugcuagagcuaggcuugcaccuuuaaucccagcuacuugggaggcugaagcagaagaauugcuuguagugaugaguugagaccagucuggccaacauagcaagacaucauuuuuaaauaaauaaaugaaugaaugaaugaauaaaauacuucauugcuaaaaaugcuagugaucuucugggccuucagugagucauaaucuuuuugcugguuggagggucuuaccucgaugucaaucguugcugacugaucaggaugguggaugcuaaagguugggguggcuguggcaauuuugucaaaaugacagcagugaaguuugcugcaucacuugacucuucccuucacgaaagaguucucuguagcaugugaugcuguuugauaacauuugagccacaguagaacuuucaaauuuggagucaguccuuucagacccugccacugcuuuaucaacgaggcuuauggaauauuguauuagucuguucucacgcugcuaugaagaaauacccgagacuggguaauuuaaaaaggaaagagguuuaauugacucacaguuucacagggcuggggagcccuuagaaaacuuacaaucauggcagaaggugaagcaaacacauccuucuucacauggcagcagcaaggagaaguacagagcaaagugggaggaaagccccuuauaaaaccaucagaucucaugagaacucacugucaugagaacagcaugaaugcaacugcccccaugauucaauuaccucccaccaggucccucucacaacacuuggggaugaugggaacuacaauucaagaugagauuuggguggggacacagccaaaccauaucaaauauucuaaauccuuuguuaucauuucaacaauauucacagcaucuucaccagaaauagauuccaucucaagaaacuacuuuuuuugcucguucauaagaagcaacuccucauccauuuaaguuugaucaugagagugcagcaauucagucacaucuucagcuccacuucucuuucugguucucuuccuauuucuaccucauuuacagugacuuacaccacugaagucuugaacccuucaaagucauccauguagguuggaaucaaccucuuccaaacuccuauuaauguugacauguugacgucuuuccaugaaucaugacuguucuuaauggcauuuagaauggggaaugcuuuccagaagacuuucaauuuacuuuggccagauccaucagaggacucacugucuauggcagcuauaggcuuacaagauguguuucuuaaauaauaagacaugaaagacaaaauuaccccuugaucuaugggcuacagaauggauguuguguuagcaggcaugaaaucacauuaaucuuguacaucuccaucagagauccugggugacuagguacauugucaaugagcagucauaucuugaaagaaaucuuuuuguucugagaaguaggucucaacaaugggcuuaaaauauucaguaaaccaggcuuuaaacagauguccugucaucuaggcuuugcaguuccauuuauaaagcacaggcaaaguagauuuagcacaauucuuaaggaccuuaggauuuucagaaugguaaaugagcacuggcuucgacuuaaagucaccagcugcaucagcccuuaacaagagagcaagccuguccuuugaaucuuugaagccaggcauugacuucuccccucuagcuacgaaaguccuagauggcaucuucuuccaauagacggcuguuucaucuacauugaaaaccuguuggccgggugugguggcucauaccuguaaucccagcacuuugggaagcugaggaaggaggauugcuugagcccaggaguuugagaccagccugggcaacauggcgaaaccuugucuguacaaaaaauuagcuggcugugguguugcaugccuguaaucccagcuacuugagaggcugaggugggaggaucaccugagcccaggagguugaggcuguugugagcugagaucgugccacugcccuccagccugagcgacagagugagacccugucucaaacaaaaaagaaaaucuguuguuucauguagccaccuucaucaaugaucuuagccagaucuucuggauaacuugcugcagcuucuguaugggcacuugcugcuucccuuugcauuuuuauguuauggagauggcuuauuuccuuaaaccuuaugaaccaaccucugauagcugcaaacuuuuuuucuacaauuuccucaccucucuuagcuuccacagaauugaagaguuagggauuuguucuggauuaggcuuuggcugaagggaguguuguggcugguuggaucuucuauccagaccacuaaaaaaccuucuccauaucagcaguaaggccauuuuacuuucuuaucauuccuguguucacuggaguagcacuuuuaauuucuuucaagaauguuuucuuugcauucacaacuuggcuguuuggcacaagagaccuagcauucagccugucucagcuuuuuuuauguuauuaagacagucucucucuguuguccaggcuggagugcauuggugcaaucauaggcuacugcaaccucaaacuccuggauucaagugauucuccugcauccagaguaccuaggacuauagguacacaucacuauguccagcuaauuuuuuaaaauauuuuguuuguagagauagggucucacugugucauccaggcuggucucaaacuccuggccucaagcaguccucccgccuuagccucccaaagugcugggauuacaggcaugagccaccacaaccagcccugugucagcuuuugacauaccuuccucacuaagcucaaucauuacuagcuuuugauuuaaaaugagagacaugcaacucuuucuuucgcuugaacacuuagaagucauuguaggauuauuaauuggccuaauuuccauauuauuguaucucagagaagagagaggcccgagaagaaggagagagaugggggaacagcucauagauggaauacacaccacauguuugauuaaguuugccaucuuauaugggugcaauucauggcacacaaguaccauuacaauaguaacaucaaagaucauuaaucacaggucaccauaacagauaucacaaugaugaaaaaguuugaaauauugugagaauuaccaaaauguggcacagagacaugaagugagcacaugcuuuuggaaaaaugguacugauagaccggcucgaugcacgguugccacaaaccuucaauuuguguaaaaaaaaaaaaucaugguaucugcaaagcucagucaagcuaggggcaauauaaugagguaugucucucuauauauaugccccuccccaaauuccaagcccauucaguguuuaaaacuauuuucuaaaguauuuguagcccuucaaaaccacaggagagugaguaagaccuaacuguugguguaauacagaauaaugaaucuaucuauuuuacucuggaaaggacauagccaacccucaugaagcuguaugacaugccauugccugccaaugguaugaaugccauugccaggguaugacaguggcagccaaccuccaggaaggccccuaaugacccucaccuccugguauucaccaggauuggucugugugacccagagaaucuggcagaaaugacgguguuucacuuccaagauuagauucugagagguucugcagcuucugucuugguaugcgugugucucucucucugguauuucucgcuuuggcucccguguugugagcaguccuguggaggcccccguagggaggagcugaggcucacagaccgcagcugccuuggggagcuuggaaacaucuugaucgcagccucaugagggacccugcaccagacccggcuaggccgcugcugaagcacuggccuagagcaaccaugaaguaaugguuauuuuaaggcacuaaguuuugcgguaccuuguuacacauuaacaggcagcuaaugcagucucuguucgcauuuuuauccucguguguggcacgcguguuauauaguuaagcaugaagcaggucacguccaggcuccgaggugagagccaggcccuuccagguaaugcuaaauauuguacaaacagcaagguuuuguucaucaacccaggagugaccuuacugaguggcguguuggugguaaaaaugccuuauauuuaagagagaacacacauucuccuuucucucccaccagaaagucugguucuugcugcucugucauuucccagaaaggaccagccucucuugcuccaccccacuuccugucuguggcccugugaugccagggggcccuccacuguccuacagaggaggggacaaggggcaagaggggccagaagcaucucuggaaugcacacagcucaugagcagcuaggcuugcuccagcagucacauguccugacuggagucuuccagcgccuucuguccccucuguuagaagaaaggggaacgcggguccuuaacacagugcuuuugggagauugccauugacucagagucugagauuuaccauuaggcgcauuugaaacaauaaacaugcauggagcacuuacuguguggcaggacauggugcagggugcuguggggaggagaugaguaaaacaguguuccugcucuugaggagcagucaagcacagucauuacggccccacccaccacagggacccagaggagggcacaggcacgcagcgggagggaugagggaaagcuucccguaagaggugguguccacacugcaccugaagaagguggaacugacaucucuguccuaggugccucaacagagcccuucauuccaaccccucauugcacauguauaguuacaggucuggcuaccccugcucauggaugaguuucuugaggcuagagauggguuuuacccaguguuccuggugccaagcccaggucuugacucacuaugggcucucaguggauguuugaugagugagugagugagggcaugugguggaugaugaggcuggagagguaacaggacugaaucauaaggaccuugccugucgugaauauugaacagcuuggcaauagaggggguuuuccuucugaggaguggaagcaacguggucuaugguaugugccaagugagggcagaagcuggggcaguagccacauuggcaucucaccaugaguccucuacauggcccagggucuguaccagcaugacauaagccgugcacgaguaacaggagugucagccagauccgagggcuccacugugaugccugcccuggaaaagauagagcccacucaggccaggccauggugguuugagcaccuccagcaccaggggagaugcuguccuagaaccagggcccccagucaguggacaaagaaauguaggaagauuccagcucagagaacaucagaccuucugcucccuggagcagugguggcugcauggacccagggcuuggugcauggaaaguccaggcuccgcacgcugugacucuccuuaaagugagaauauuuuucccaggagugcaagggccuuucaugugaggaguuuuaaaugugcucucuggugguagccacagcauccuuaauuuucuuguacagcaaaagucaauuuggaauugcaggaaaggaggcuuuguucucaggugauguugagcagccucuuuuguggucaccucuugacacccacacugagcgggaggaggcgaggggagugcagcacuggcgcugauuauagaaaacagcagggguuccggaagaagccuuuggcuuuggaauuggguuugugcuuccauuuaaauguggaggugccagguguucugauaauuucacugcaaaauuuugaaauccgcuaauaaagaccauuuagaaggaccugagaagugggcuguguccucccuccucucccacccaccucucuccugccaccagcucugaccugggauggacggcagcaugcuucuguuaucaaaacaggccaaaaagaaugaaaagcuaaaagcagggaaaacuucacaaguuuagauaaaguuuucaagugauuaagugcuguggcagugaaaacauugacccaauugcaacuuguaggcuccaucagagagcugugguugacgggcucuccuguacauuuauaucaggagagauguguuaccggcucccucagaguguaaaguguacccaaaauagagcuugaagaguggcuuuaucauggagugacucagcgccagcuaagaggaaagaugaauauagcgugacgauguucuccacaggaaacccauggcacgaaaaccaggggcggggagggugcuuguagcacaguggcccuguggcugccucacugggcccauggcugaguaaugggcugacugauggcagcccuguggaagcuggccucagacaacacaggaagcccgcucagauugucucucagagccuguucccaaaugggaagccaccagcaaaaaaaucccagugggcugugcucuucauguccugguugggaaauucaggaagcacacgugaacacacacaugccacagacaugaaaaagguucugucuucugaaggcuguuggccgaucuuaacaugaauuuuaaaaaaugauuugcuacauuugaggcauuucuucaagccaguuuuggacacaaucccugguuacuuuguuccuggggacauucaguacccaugucugccaagcccuguaguuuugaaaacaucccuggcccucacaaaagcccucauaaaacagcauccccucaaaacccaaggcaccugguaaggaaagaauuaaagccagugacgugaauuuaauguucgaucccaaaaccagaguugacuuggcuugucuggguuguucacccaggggagggcucuccuccacaaggcccaagcccuacuggggcugcuugggcaccagccacgcuguggggaggguguuaaucgugacugaaucgugauuccaugugggaaacaguccugcagucgggggacaggaggagccaggcuggaauccaacacaaacaguccaggggcagagggaacauucccggguaccugugucccugagugacuugaaaaugcugaacuuaugcugaauucuguuuaaugauuauuugcgggaggggaacaggcauucuuaagagaucgguuuaccuuaggaaauccuguacucccccugcuuuccggccuuccggccuccuuguauccugcacacgcuauuccuuugcauacauuugcagcgaacuuugcuccccaggguaucuggcuuuugggauaaagacuaauguccaugucaaaaugauucuugauaaaagcauccuagauguuaaauauuuauuuuaagcuaaauguucuacuucugagagguuaaaaaacaaaugccuuuucaugcagagccuuuugccagucaauguuugaguuucuuuaggcuuuuuuauuuggcucugcagcagcuagcuaaccaacugcauuccugagaugagcugacaaggaggcagaaaugaagaaauaaacaaaaagccauguuaauuucaagcuucaguaggaauacaaagagaaauauuaacauuugcugaaugacaaauaaugaaauggcuggaaaauuuuaaugcuucuagcaugcuuuuauaagcucuccuggaauuuuccccccaucagguauugcacauuuauaaccagcagugcaccauguaaaggcaguucgauagguuguuuaauuuaaagauugguauuucugagcauauaguguuccuaaugcaauuccuaaccccauuuacacuucucugucuacccgaaguacccacaucuucuuagcauaaucuuuauaauuguuuguugcuaugguuuuaauggguccccuucaaaauucagguguugccaaugugagaguauuaaaagauagggccuuuaagaggugauuaggccgugaaggcuucucccuggugaauggguuuaaggcccuuuagaaaagaggcuucaucauucccuuugaaaacuggcacaagacaaggaugcccucucucaccacgccuauucaacauaguauuggaaguucuggccagggcaauccggcaagagaaagaaauaaaacguauucaaguaggaagagaggaaaucaaaucgucucucuuugcagaugacaugauuguguguuuaaaaaaccccaucgucucagcccaaaaucuccuuaagcugauaagcaacuucagcaaagucucaggauacaaaaucaaugugcagaaaucacaagcauucuuauacaccaauaauagacaaacagagagccaaaucaugagugaacucccagucacaauugcuauaaagagaauaaaauaccuaggaauccaacuuacaagggaugugaaggaccucuucaaggagaacuacaaaccacugcucaaugaaauagaagaggauacaaacaaauggaagaacauuccaugcucauggauaggaagaauaaauauuguaaaaauggccauacugcccaaaguaauuuauagauucagugcuauccccaucaagcuaccacugacuuucuucacagaauuaaauuucauauggaaccaaaaaagagccuguauagccaagacaauccuaagcaaaaagaacaaagcuagcggcaucaugcuaccugacuucaaacuauacuacaaggcuacaguaaccaaaacagcaugguacugguaccaaaacaguuauauagaccaauggaacaaaacagaggccucagaaauaaugccacacaucugcaaccaucugaucuccgacagaccugucaaaaacuagcaguggggaaggauucccuauuuaauaaaugauguugggaaaacuggcuagccauaugcagaaaacugaaacuggaccccuuccuuauaccuuauacaaaaauauaaaaacccuagaagaaaaccuaggcaauaccauucaggacauaggcauggcaaagacuucaugacuaaaacaccaaaagcaauggcaacaaaagccaaaauugacaaaugggaucuaauuaaacuaaagagcuucugcacagcaaaagaaacuaucaucacagugagcaggcaaccuacagaaugggagaaaaauuuugcaaucuauccaucugacaaagggcuaauauccagaaucuacaaagaacuuaaacaaauuuacaagaaaaaaacaaacaaccccaucaaaaaguggccgaaggauaugaacagacacuucucgaaagaagacaucuaugcagccaacaaacauaugaaaaaaagcucaucaucacuggucaucagagaaaugcaaaucaaaaccacaaugagauaccaucucacaccaguuagaauggcgaucauuaaaaagucaggaaacaacagaugcuggagaggauguggagaaauaggaacacuuucacacuguuguugggaguguaaauuaguucaaccauuguggaagacaguguggugauuccucaaggaucuagaaccaggaauaccauuugacccagcaauuccauuacuguggcgggcuaggggagggauagcauuaggggaaauaccuaauguagauaacugguugaugggugcagcaaaccaucauagcacauguauaccuauguaccaaaccugcacguucugcacauguaucccagaacuuaaaguauaauuuaaaaaaaauaauagaaaaguggcuucauguagcuguuagcuuagcuugcucucuugaccuucugccuuccgcugugugagggcucagcaagaaggcccuccccagacaccaaaugccggcaccuugaucuugaacuucccagccaccagaacugugagaaauaaacuuuauaaauuacccaauguuggguguuguuuuauaguagcacaaacgaacuaagacauuuucucacuaaaugaagucacuuuacccagcuagaaggauggucacaggaucauuauuguuguuuaaaaaauguguauauaugugugugugugugugugugucuccauauauauauauaauauauauaauaucagccccucucucucuacauacacacacacacacauacacacacaucccacauuagaaauacuaugguuuggccgggcgugguggcucacgccuguaaucccagcacuuuggaaggccgagguggguggaucaccugaggucaggaguucgagaccagccuggccaacauggugaaaccccaucuccacuaaaaaugcaaaauuagccaggugugguggugcaugccuguaaucccagcuacucgggaggcugaagcaguagaaucacuugaacccaggaggcggagguugcagugagccgagaucaugccauugcacuccagccugggcaacaagagcaaaacuaucucaaaaaaaaaaaaaagaaaaagaaaaaaagaaauacuaugguucuaauacuuguguucauuugucaauuagauguauggcacuauuaauuucaguuuaauucaguuuaguacauguuuuucgaguaccuacuguguacaaggaacugugugggguaccuucugagcacuucaccugcucuccagagaugccuacugaguguuucauugcagaaaagaagugcuauggcauguuggaagaagggggacucauaucuagcuuuggucuguugaaccaaauaaacagaucuguuuguucuucccuacuagaucuuagugcucacagaaaaagggcugucauucacuuuguauacccaguaucugggaggugcuuggcacaugguggguaaccaacaaauaucuguuaaauggaucacauugggugagcacaaagaugugauggaaaucugugaggcgggcagaggaaaguguagggcucuugacugucagugauggaugugaggauacuucugguaaggagacuauuguguaggcucagacacccgcaggagggcaaccagaaguucagcaugggugagcccagggauucccuugccaggguuagcaaacuaggguccacaggccaaccacauccauucauguaccuguggucucuggcaacucuugugccacgucagcagagaugaguagaugcagcagagaggaguugcgguguauagauagccugguaagccgaaaagacuuaguauuuguuucuuuauggaaaguguuugcugaacucugccauagaggcacagaacaaaaaugagcgcaguuaccuuagggggccccauugcaaagugacgaugcauacuugguucucuuuugaucaggagacgacugaccugauuggagauauguaagguuuaggaaaguugacaugagaaugauucaguggacuggagcuuuugggaaagggaccaaguaugagaaaaccaauuaggaguauauuacagccaucuguucaggcaucauugaagaaagagcaucauuuugagucuuaucuaagcguugggguuggcaaguauuaccuccuaggccagaaagccuuguccuucucccagucccaguucaugucacuagauuggggguccaccucacagcuccagaaaccucaggucaaccccacccaaucggucacaugcuaacuuccucucuggugaucuuugcacaaacauauaacucacagcauggugucugguucuugcugacaucaacuuuguaacuguuuucagauuauuuuuucuuuucuccacaguaacucucaggcuucuugaggucagaaccaugcauucuuguuuugcugccaccuccccaccugccugccccucaugcugugucgaguccgcaugugagaaauaagaugagagucacuggcagcaaagugagugccgacauuuaaauauggaagcaagucuggggccccagacuccaagcgccuaguaccuguggccuugcucacuguuuuucauaugcuguccucuggucuuguuuguaaagugaccuguugcacaaccugucaguacccugaaggucagugacuguguccacaccucuuuguguucucggugguuagcauaauauuuuuaacauaacggacucuuuuuaaauguuuggugaugacacagucacugagcaggaugugcuguaagaagaaaacauacucucccucauucugugaauuagucagaauauaucagguuaauaacgguaagagcaagcuucuguuggucugaugcaccagcaucuauuggaucaagcaauuaaacccaugucagucauuuugguacaauagaacuaaaauuagacacagcauaaauacaaucaagacgugagcacguuucccagcauuagccuuacgaugacaaaggcaaaugcagaagugugcgaacuuccaggacagguccggagauggcuguuccagagaagagccaggguggauggcaggaagcggcagcugggauggaaccuccaguccauauguggcaccucuuuuacaucuucaucguaagcgcuaccaggaguuugaaaugcaaaaguuuuagaaauauaaaccaggcuuuacuuaguaauauucauuaaugaccuaaaccaagagagaaucuccuacuuaaugaagugauuaauuagcucugggaauugaagucgaaaacagaagacuaauugauuaauagauuacuguguucauuuuucuuccuuucguggaaaggagccagaauuugguccaugccagguuugcugcuuugggcuagcaccaugcugccuggaaucuguucucgccuuucccacguagccugucugcuucccauccucaugccuuucuuccugcccucuccacagguggaaggccuuccguuuaaaaccuugcucuuucaggcucagcacgcaucucauccccaggauggauuugcgcucuucugacacuaccgagcucuccuuuaagucaccguuuuaccuaaucaauaccauacggcuuagcauuuaauuuuucuuauugcuuuauguguggaauaauggaaaagaauuaaaagauugaaaaaccaaacacccaccucacuccacauuaggugugucaaaucugagcugaugagaggccuuccccaccacagcucugagcaccaaaugagaugauguagggaagauuccuuauaaacuaaaaagugccgcacaacauuuaguuauuggcaccgucuuuuuuauauauuaaucuuaacuucucuacuauauuuguaauuaaaaucuccagccaaaagucagcaaauuuuucuuuuuuuuuuuuuugagacagucucacucugucauccgggcugaagugcaguaggcucaucucacugcaaccucugccuccucagcucaaacgauuguucugccucagccucccgaguugcugggacuacaggcguagucugcagucugccuagcuaauuuuuuuuuuuuuuuuuuuuuuuuuuuuuuuuuuaguacagauaggguuucaccaugguggccaggcuggucuugaacuccugaccucaagugauccaccuggcucacccucccaaagugcugggauuacagaugugagccaccacgcccuguccaaagucagcaaauuuuuuaacauuccuuaggaaugggcuuugcucugugccaauuuuaaaaagucagacuucuucagguuaccuaccaucacuguagguagaaggauagggaagaccccacaugaaacaguuagagaacuuacaugauaaugguaagcaccuggugucagcccagucucuacgucccuccucacagcucccucagccccugggaguccucacacagauggccuaugacagcccucagccuccaggggcuuccccaacccacuuaguguuacaaaaagaggcagaagcugaucagagaggagguugggggaauuuggccguaugcucagaggcauugguagcuaagugacuuuuucccagacaggcuggucuccuguaagagagagagagaacugacagauuaugcgagagaaugcggcuccgccaccaucaaggucagaagccugccccuacucucauuauguguugcuagccaacacacuccuucaguuuguuuccagcugaucaucuuucugucuucugcauucccaguucguaaucugcacucucuucucucuccacgggccccagagcagaugggucacuucuuuugguuucaaauacaauuuaguggccaucuucccucccaucuuuuucauuaaaaaaaaaaaaaaaguucuaaccacugcuuuucuaaucaccacuguucuagccacuaggacuuucuguccuccacaaaucuauugcuguuaaaauauuuguuuugauuguuccaggugguaaauguuaccuuaugggcuuuguuccagcucgcauuacuuuuugcaaggaggauacuaaguucuaaaacauugagucauaccaugacugagaauagugaaagugcaaauucuuuauuaauacagaaguuaaagaugagguagucauguagaagacaaccugcgaugauuaaauaaacuaugauucugguucagugauucuaauuaaucaccagaagugaauaaaaauguuacuuguggccaggcgcgguggcucaugccuguaaucccagcacuuugggaggcugaagcggguggaucaccugaggucaggaguucgagaccagccuggccaacauggcgaaaccccaucacuacugaaaauacaaaaaauuaggcgggcgugguggcagcgccuguagcuacucaggaggcugaggcaggagaaucaccugaacccaggaggcagagguugcagugagccgagaucgcgccauugcacuccagcuggagcuacaagagcgaaacuccaucucaaaaaaaaaaguuacuuguaauuauuuuuuuugaagucuucauguucuaagucaagacuuaaacugaccauuuuuuuuacaaauaguuaaugguuacuugguaugacauauuuagaacuuacccaguaguuuuuaucaucuugacugguccucgcuaugaaagauauuuuauaauuucaugccaacuuacauaaauguagcauuugauuuucagguaacuaaaucacuagcuaaucaauucuacuuaucuucaaguguuaugagguagauguaaauuccgugagggcagggagucaucuguaggcgaaucaucuguuuuauucccugcauuaucuuuagcaucuaaaucaguguucagcauacacuguggucacuagauaaauauugaacaaugaaugaguaagcuauagacauaaacuauaagaaacucauaaaaaucuuuuauaaaaaucuagaaucauauaauguuaaacuucagauguaucuuuuuaaaccagagguauaaguagcaaacaaaugggaggaauuaaaaaauucuuugccuugaaucugaacuaucacauucaaggcuuagauuuuagugaugaccauuucucauaaaugcauuaaagucacuucauuaaaacuugauucucagccgggugcaguggcgcacaccuauaaucccagcacuuugggaggccgaggcaggcagaucaccugaggucguucgagaccagccuggccaacauggugaaacccugucucuacuaaaaaugcaaaaaaauuagcuggggugguggcgugcgccuguaaucccagcuacuuggaaggaugaggcaggagaauugcuugaaccaggagacggagguugcagugagccgagaucaugccauugcacucuagccuggguggcacagcgagagacucugucaaaaaaaaaaacuuuauucucaacugaaaguacuaccaaugagucuaauccauuuugguacacagaucagauaaacaguucuuaaucaucuucaauuuucugaucuacauucagcaguguuuauggagacucauguaaagauaggugcagggcaauuacaauguuagaaaaaaugucacgcuagaaguucuuuuuaaguaagucaguaaauacaaaguucaccaguguuguuuucuauaaaccugucuuugguauaauuacuauuucuuuuaauuauucuacuuuuuaccuuuagaaucuucuauuauuguuugacaugccaauuucaauucccugaauuccaguuguaauacuuuguuuucaaguauuauaaaaauaucuuaauguucuuucuguagcagaucacucuuuugguucauuguuuccaguuguggaguuuuaaaguguuauuuuucaaguuguaaugagaacuagaagguauuuaaaauuggcuuuaaaaaccuauuuugggccgggugcgguggcuuacaccuguaaucccagcacuuggggaggcugaggcgggcaaaucacuugaggccaggaguuggagaccagccuggacaacguggcaaaacccugucucuaccaaaaauacaaaaauuagccaggcaugguggcgcaggccuguaauccccgccacuaggguggcugaggcagaauugcuugaaucuggaaggcggagagggcagugagcugagauugugccauugcacuccagccuggacagcagagcaagacucugccucaaaaaaaaaaaaaaaaaaaaaagaaagaaagaaagaaagaaagaaagaaaagaaaaagaaauaaaaccuauuuugaaugauugggaaugcaaaggugguagcuacacaccucccuuuuuaauagcugcagucagcaggaaucaaauaauuacaccauuuuuuuuuauuuuuccuucacuuuuuuuguucuuuuuuuuuuucaagacagggucuugcucuaucacccaggcuggagugcaguggugcaaucauggcucacugcaaccucagucuccuaggcucaagcaauccuccuggaguagcugggacuacaggugugugccaucaugcccagcuaauuuuuuuuuuuaacugauuuuuuguagagauaggcucucguuaugaugcccuggcuggucuugaacucuuggccucaaaugauccucccucuucagccuaccacaaugcuggggucacaggugugagccaccauccccagccacaguuuccuuagacauaugaagagcuggguggcaauguccagaaucucaauucagaaugcagaucagggggacucuuugagucuggcaaccccaacccgcccggaaaaacaaacagccuuguaggacaacagccuuuuaggacuugaaccuucucaggcccgccucucaaaacaauaugacuugaaaauguuuaguuuuucuuguauugucucacuugccaaaccuccgaaagcaauuugagaguaauuucaaccacaucuuuuagcaggccuugugaaaaauaaauuuaacagguuaauugugugccguuuugauuugucuuggcaucucaauaaguaaaagguuaaaaucauggccacaaaaaguaaauaaagcuugauuauuccaguugaaaauucauccauggguacucuagugccuggcuuucguguugaccucauugccauaugaccaccaucaauagcucuuuauauuuaauuaauuuccuaaaaaaaccacacucacacauuuguaauguuuguaaucuuuuuauuccaugauaauugauguagccuagcguaauuguaguuuuugugugugugugaaguaucugacauucugugcuuuaguacguuuuauuucaucacuuaaugugucccccccacccgcccacuggcugugacaguguuuuugcgaaugaaacaguucagugagaccugggaauuuccuguggcauuuauguggucucaugcucaucucuauuugccagauaccauccguguaagaaccaugcucaacagauacauuuuggagaaccagaugucucauuuugucauucaccaaugagucuugaaaggcugaauucaagaagacaacuuuuuaagaucuuucucucucagucuacaaaagaaaaaacgggcuuauuacugucaccgcugccuuuaauuauguacagucacaauacaauuaucucccuauuuggguguuaucuccccugccagaucaccaaugccucaaauugggagagcacggcuucuguuuauuguucauccuuugaaaugacuuaaaaggaagcugaguacacaguugacccccuagccaaggggauugauaguggucucgggcuggggagaggacucugugauucuucccaaaaggucacucccuauccagaaugauaaguccucaguuuuuagaauguaguuguuagguaaagggauuaauccagagaaagagauuuuaaggcugcaucauugauuuuauuguuuuggauaagaacguggaauuggcuuuucuguaaauugaguacauuauauaaggcacagguuaaagugauccuuccacgugaauucuuucaugguuauuugauuauuuucagaauaucuugacauuugaaaggcauacagacaaaagccaaucauguaaauaauugcauuucuaaaacagucaucagucuucuuuuacuucaccauuuuuaaccauuuggauucaaagcuggauuuuaucucaacuaaauagaacagcuaauauccaauuuaaugugcaacuguaaccagucagacccagaaauuuugaauagcauuuguaacuuuuaaucacaaaauuaauggcauuaaacucuaacagaauagauuccauuuguuaauuuuuucuaaucaaacuucagauauuuauccaugccucaggugagaaaugucucaccagacacccaguuaaaugaaaaguaaaucauaccuuuuuuuuuuuuuuugagacagagccuugcucugucacccaggcuggagugcaguggcgcgaucucacuggagcuugcucacugcaagcucugccucccggguucacgccauucuccugccucagccucccgaguagcuggaacuacaggcacacaccaccaugcccagcuaauuuuuuuguauuuuuaguagagaugggguuucaccauguuagccaggauggucuugaucuccugaccucgugauccacccaccucggccucccaaagugcugggauuacaggugugagccacugcacucggccaguaaaucauaccuuuuuaaaauagcauuucacauuaauuauacuuacuuaguuaacacugagguuaucuauuauugcauaagauaccguugauuuuaguugcauaucauaugcagguaacugcuugcuugcuugcuuuuuuuuuuuuuuuuugagauggaguuuugcgcuugucacccaggcuggagugcaaugguuugaucucggcuugcugcaaccuccaccuccuggguucaagcgaucgccugucucagccuuccgaguagcugagaugacagugcaugccaucacacccggcuaauuuuuguauuuuuaguagagacaggguuucaucauauuggucaggcuggucucgaacuccugaccucaggugauccacccaucucggccucccaaagugcugcugggauuacaggugcgagccaccgcucccagccacaaguaauugcuuucuuuguucuuaccuaaaagauaagccaaaguaaaauagaauauauuuacuacuuaacaccuaugaaacuagauuguucuaauguauaaaggaaauuaaccaauauguuuuauauauuauacaaauguacaaauauuuucccgagaaucuggcaauguuucuaaaaagcagcucauucuuuguuguuguuuucugauuauaaaagcuagugagucaguaccacuucugaaauggcagucacuacauuaggauccugcagcagugauucagcaccagauuagugacacucugcaguguuacuaguugucacaaaggguagaucaaaaaguauaaaauuaauuaaaaacuauguauguguacaguucuucuaaaggucaguuuuucaaaucauauccccagccaugaauauuuuuauauccuuuuaccugaugaucucauuccuuaaaauuauaaguaauuaauuuuuuaaaagcuauauguguauaugugauuauccaacuguuucuaaagauuaaauauuaaaaacaaccaaaaucagcaaaugagcagugacaaaguuuauaagauggaauauuaauaauugguggacuugauuauaaguagaaagaccaaaacuaugcaaggguaacuauaggcuaucaagugacaaaaagaaugcaaaauuauaugauacuaugauuacaacuauguauuuaaggaguuaaaugaaaauuuauuguguuagaguuagaguguggaguuuuuuuguuuuguuuuuuuuuuuuaagaaggagucucgcucuguugcccaggcuggagugcaguggcgcaaucucggcucacugcaaccucugccccccaacaagguucaagcgauucuucugccucagccuccugaguagcugggauuacaggauccugccacuacacccagcuaauuuuuguauagcagcagagacggguuucgccauuuuggccaggcuggucuagaacuccugaccucaggccgucuaccugccucggccucccaaacugcuaggauuauaggugugagccacuguacccagccagaauguggauuuuuuaaauuuuguuuucuucauguuguuacgaaguugucuaauacauuucuaacaucuuuuuguuauaucagcacuuuauggaggacuagaaggcaucaguccauauccccaaaauauggugucuuguuguacuguggugccucuuaacaaaugauuguauucauuuguggccuucuaaaagagugacugcuuuucugagagucuuuuaccuacucccagaaaguuauuuacucugugggacaguucauucuguugcaucuuaucugaguacuuaaagccccaaggaagaagaugauauuugccaguacauaaacugacauuuuggcaccuaaucuuugacuuuaagaagaaccagaggacccuugaugguuccagugagcccugggucuucugugcuuucguggcgaaggccucuuucagaggacacaccacggcagccccugcuccucaagucucagaaggccugaacccaugguagcuggaaauaauagcuugacauuccucccucauuuuaaacugugauuuuuuuuuuaaacacucuucuugaccuuuucuuugaaggaggaacaaaacagggaaaacauugcucuucaguacacuagugaauuauuuugacaauggcagucucccgaaacaggcuaccaugucaucccuacgcuuuucucuugugugucuuugauugggugucauugccaguccuuacagaaauuggcuucuggcccccaauagucacugucuaucggcaggaccuaucacauaauugcuaucuugaaagcaccaucugggcagcucaguguuuaaaaaaaaaaaaaaaaaaggcagaccuccuuauugacuugaaagagcuuacagucugcuuguaaacagaagacaugaaaugacugaagaauguucucaaagcucaacaugaacaagucacauuacagacauuugaacugaacugaaugcugaaggaccuugaacaaaugagcaucugggucagauuagcuaggcagauggcacugggugcccaaauggagugagcaugcauggaagaaaaagugaaggcccaggcacucauuuagaggggaggaguuugguaauauaaugaggauaaagaaugcuuguagauuucugguuagugaguaguagaauaaaaauugugacuaagcaccauggguggauggauggauggauggauggauggauggauggauggauggauggauguggccaggaggcugaaggcagugcucuauccaggagagccaggucagcgcaugcauagcuagggcauaagcuaagaaaauggggaagacacagcaaauuccugauacuuuacauaaaaggaguuuguuggguuuuauuuuaaaaguguugaaugugagauaaaaaagaagaaggguugggaucccuaauguagaugaauagcuuuguuucagguccgcccuucugggcacagcgggucacaccuguaaucccagcacuuugggagaccaaggcaggaggauugcuugagcccaggaguucaauaccagccugggcaacauaguaagaccuccaucucuguaaaaaauucaaaaaucaaccuggcauaguggcaugcaacugcaguccccgcuacucaggaggcugaggugggaggaccaccuaagcgcaggaggucuaggcugcagggagccaugauuguaccacugcauuccagccugggugacagagcaagacccugucuaaaaaaaaaaaaaaaaagagagagaaagaagaaggguaaccaaggaaagagcuggaaggaauuuuaagccuuuggaaacuguuguuauggugguguuagagacacucuguauuaaggucagaggaaggagucugagcgcuuguugguauguuguaaauagcugauaucuguaggaugucuaugcaaaugauuaagguaaaaaaauagggagcaguuaguagcagagauuagguuuuuugaucauuucugcuuuggcugaauuaauauacagaaggaaaaacuaguugaaagucaaaggggcaccuaaguuaaugguggagagugagaaaagagacagcagagaaauuuagggcuacaguacagcucagagccacucacuaccaaaagaagagaccagcggagguggcccucguuguccccugaaagggauguugcgccauagcaggaaggguggaagccaugugggaggaauaaaaaucaaggguuugcaggagaaaaauccucaagcuacuuuuuuuuuuugagacagucucacuguguugccccggcuggagugcaauggcuugaucucggcucacuguaaacucugccucccagguucaagcgauucuccugccucagccucccuaguagcugggauuacaggcacccaccaccaugcccggcuaauuuuauauuuuuaguagagaugggguuuugccguguuggucaggcuggucucgaacuccugaccucaggugauccaccugccuuggccucccaaaguugcugggauuacaggcuugagccacuauacccaaccccucaagcuacuuauuguaguugagaaagaagggugcggaugacaggaaaaauaaguagaugaaugcaaagugagauuaacaugagauauuugguugguugguugguugguuugcuugcuuguuuguuugacuucaggagaaaccuggaucagauugggcaugaggggaggacgcugaagcgagaugaccaagugugagaggagggucgucagggacucgguaccaagcgugggggcagaguccuccuugaagaauggccccuuggcccaggccucugggguuugaucccuggucacccuguauguggacacuggcuuggcagaagucgaggacaagaauauuucugagagcuggugaaggaagacucgugggccggcauuaugggugggcuucgggaaagcaggagauagaauugaggaaguuccuggcuaguuccuucuccuugcucagucugucuccagcuucaaaggucagcacuguggagagugcuaaagucucaagguuaaauuuuaccccagagucuaauugaauuuaacuuuuacauuuuguuuguuuguuucuaaugucucaaaagccuguuuuacccaaagcuauuuacaguugccguuggguugggaucccuaacguagaugaauagcuuuguuucaggucugcccugccuggagccccuccuucccaccaguuaccuuuaugguuacauaugguuuggcauagaauaccaguaaaauaccaguagacacagcugaggugcucuuuuuuguuucugaaggauuuucaguauagugucauauccgaacgucaggacaguggaggaagcccacgaggccuccagcucaucaguggcagagccagcauucagggccccugugacucuccagcugcauugcacugcugccccugagcuguaaacccgcuuccuaguuaggaagaaagcugaauuaggugaucuccaguccagccuuccaaguaaggcuucugugaauccauggcuguaagcauuugaaugaaugucguauaaagaaggugaaggucaguggagaccagaacugggaggagaagcuucaugguggaggggacuugaagugcacucugaaaggccagugggcaugagaagggcaggaugcagggagaguuccugggcugagggaagugugagcaggaauuagugucgaaggucauggacagaaaggagcuggccugaaacccagucagaggccaugguggccagugggaagguggggucugaugauggagagcccugauagucagagacaggacuuggauagugucaggaaugucugaacagcagggcaacaugaagaaaguggcauuuuaggccaggcacgauggcucaugccuguaaucccagcacuuugggaggccgaggcaggcaaaucacuugaggucaggaguucgagaccagccuggccagcaugugaaaccccaucuuuacuaaaaauacaaagauuagcugggugugguggcgugcaccuguaaucccagcuacuuugaaggcugagguaggaguaacgcuugaacccaggagguggagguugcagugagccgagaucacgccacugugcuccagccugggugacagagcgagacuccgucucaaaaaaaaaaaaaaaaaaaagugguguuuuaggaaacuucgccuggcagucguacacaggagagacagcuagggacaggcuuguacaccccugguauauggcccgagugguaaacucaaccugaaugugauugauucccaaggaaauuucuuacaggauuucuuuggcaagugguuuauaagcaacgauagaaagaccacaggguacccaugugaccucacugaggaaaaaggcaugccaaaugaaucccauuuauuuucuucauaacauucucagagaguucuggcagggaaauaacagacaaauccuuaccuuuauacagugcuuuccugcuaaaaguacauucuaaauuucaacuaggcacuugacaagugugugaaauucugugagcaagauggagaaacauagauuggagaguggugccgcuggcuggauguuagcuaaggacuauacucaaagagcauggauuaaagagggcgaggucccuuguagaugcugcaaaaaucuaugugagugaauugaaugaagacauaaaaggcuuuuuagcacguuuguggguaacacccuuuggaagaauaaagaagaucucaguagaggucagaagccaagcuaaacauauaacaguuggugagaauaauguagucuuagcaaguguauuuuaauaaucaauuaaugugaaaaaccugaaauaauauuaaaagacucugggaggagggaaaggcuuugggggagauaguuauguaaggaugaaugguuaguaucagguggcugucaaaaggguuaaugcaaucuuaggagaguaagaaaagcauaguauuuagagcaagcuuguccagccugcaggcugcaugcagcccaggacagcuuugaauguggcucaacacaaauuccuaaacuuccuuaaaacauaugagauuuuuuugugugugugauuuuuuuuuaacuaaucagcuaucauuaguguuaguguauuuuaugugugaugcaagacaauucuuacucugauuagcacaagggagauaauggccccauuguguuauguuacauuugggacauuuuuauguucauuguauugugggugggcuguuauacuuuugaugugaaggguaguagaaggaucuggggauauguuucagcauggagaagaaaggagaagaccccaagguucaugaccacugucuucaaguauguaaaagguugccauguugaagacaccacagauggguagacuuauccugcacuucuccagugggcauacuuagggcauucuaagcuaggcagauguuagacuucaugagcagcucaccaguggagagcaaaacagguuugguguacagcugucagggauucuguagaagagacgcuuauauugggugucggauuguucuccaggguuucuaguguguuaaguauuauccaguggugugcuggagccaguucauaccagcuugcaggagcugguuguuaaauaaugaggauuuuuaagggcuaguaguuaaaauguuguuugcuugaaaugggccauggaagcaguauuuauaccaaggaaauuggcaauagaucaaccccaccccaccccaccccuacccagugucagcaugccagcauaccaccaguauuauccauaauaaaaaggugucuuuuagaggccgggagucucuggaauguggaagagcagacgggugugggaacauccacgugcguguucuuuggaguuuucagauucuguuuccuuguuaauggugcguagcuccccuuuugugcucauaccacuuccuaucuccugccaagaucuggggccugugaguuucucugucucuggaucugccaggaaaacgcagauaucuucuguugcuuggaauaauucuuuccuuguuacguaucuagacuggcuagcccucugugagaggugccucccaccucauucucagcacuagccucaaggacugugaauaucagaugaauucaaccagugaaauaggauuuggaaacaccugggcuguugagaacaagugauuguaggaguaagguccaacccacaaauauaacaaagccccgcaggccauauggcaauaacagcccaaccgauggggccuuuggguugaccucagaucagccucuguccccaugcugccugggcagagagcaaacaaugacuuuauuucugucacuuuuaucucccuuauuucuuuguaaaaaggauuuaaauaaagucugagucaugcuguaaccaggaaaagcaaauguccugugguauacaugauaggcgaauucagcuguggucaugcaaauuguauuugaguuugguugaggcucuaauuaaaaacaacaacaacaacaacaaaaaauugguuguuuuuacuuuucuuaguugccuacuguguucuauuugaaacccuauaggcuuugccauuuuccccaagggugccuacuuccuacucuuuccuuuagugguuucccaagagacagacaauaacacccuugaccaguugggcuacaaccagauaugagcuucucaaacuaugggaggccauuccaguaaaguguguauugccagccagugaacuguuuguuuuugauaaaagguuuucuuggcaaaacaacccgcccaaaggugauuuuugaaccauggaacaauuccgaauuucaaaauucaaauuauaaauaagagagcugaaguauagguguugcauuuaacaugcaguuauauauugggaagcuauaaauaggucuguuuuugaagagacuaaacccaaguaaagauuagcuauaugccuguaugaugguggcauauguagagggaucagggagaacugaauaaaggaaaucaagaaauaacccuaauuuucuaauagggugucaggaagaaaagagcagaaaagagagagaaugcagcucuagccagccagaaguucgugggcuggagacacacccuuuaaaggaagggucugucuuccuuuaaagggcauaggcauaggccaaggcauaggccaaggacagggaauaaagagaaaacugaaugccuacugcagagacuauaggauagcaacagcagaggugacagugacgaccauauuaaccagaguccagaccugggacacuaauagcccaagcaggaaucucucucuauccgugcacaagcugcagcugcagccgggggucugugcugggucuucuggcuggagaucugaccccgcggcucagggccagggaaccuaccaaaaagauggacucaaaaaaggcugcuccuacuugaagggugcagaaagaaucggauguuauuaaauuaugccuguugaaucuucagcugcaugaaauggcauaucugugaaugcuuuuagaguagaaaauuugguuugaauggccuaauugugaugcguggcagggaaaggguuaagacgagagacagucccaggaaagaaguagggcagugagggaaauguggacacaagcggcauagaaaagcaagugaguucauuaagguagugcuccucagugaaaaaaucccucccggcccccuugcagcagagacagggcccuauuguuuuuggucagccaaugccaauaccacaugccgucggccucagcgagaaauauguccaucagucaguguuuagccuuccccaacuaggguucccagggagaaauaagcccuccugcuuuaagacauccauuguagugaaucgacuccucuccuggccacugagagugguauauaggaagguuacagucacacagaucauuuucugugcucuguaguucagauagaaaacccugguugagaaagacuaguagugcagugacccagaacuggccuuccaauauaaaauuagcaggcacuucagcaaccugggguuuugccugaaggagauggcagaaagcaguuguaauaaaagggcacucagaauuaggauguacaaaacaagaucuuauccccaccuucacagcaccucccaacucugccguaccuaccagaacucugacugucuccucuuccuaccuagguuguauauugucaaagacucuucucuguccaaauuucugguauuugguuuauaaaauagguuaaacuagugugggcauuaaauuaguuucuauggagaaaauuuugcuuucgcuuuccuacuucucaugaagucacuuucccugaaaauaauucaguggaauugaaaacucuuggcucaucuucauuucauaacauggccauuuguguagcauacauacauugaaugauuugagugagugaaugaguuaauuaaacauacaaugaaguuugucaaauaugucaacacucuguuugccuuuuccccguucauuuuuuuuuuuuuuuugagaccaaguuucacuguugucaccuaggcuggagugcaauggcacgaucucugcucacugcaaccuccgccuccuggguucaagugauucuccugccucagccuccugaguagcugggauuacaggcacacaccacuccacucagcuaauuuuucuauuuuuaguagagacgggguuucaccauguugcucaggcuggucuagaacuccugaccucaggugauccccuauugauucuuaaggugaucaaguaggaauggcugcuaccaucuuauggcugagggaacuuaggcucauaacauuuaagugacucaaccaggaacacaaaguagauagugacaaggucauguggagaacccaggucuccugaucccugugcagaccucuuaaagggcaucuggaaggaugguggccagucacauggugugacacaaaauaagucaaucaguuguguuuucgugagcacuuauuguguaacacuguguucagugauagcuguccaagaaaggaaggugccauguuucuguuuuuguuuuuguuuuaaucaagaagcuuauagcuuaauuggagagauuaaacugcuacaccuagaaacaagugccuggcaugacucuuacaguuuaauggaaggugugugaagggaaagaagagccuucuggaaggcaucaaaaaguuccucaggaagaacugaaacugaacauugugcagagauagcacuggguaaauccagaggccaaugagaguaaaggucuacccaggcaggggaugauggccaagaaucauuuggguggaggcagaaugugccaguccugucucugucuagagaugugcagcugaaggugaagucugauaagcucagcguagauaaggccuggggauuugggaccaauacagugaaaaaucgaauggacgaggucugaaggaacauuugggucaacacaagccacccuaacagcauaaucacuaccuaggaugguagaugaaugcugucuaacagacgacucugacugacguaguaccucccacggagggucagcgugcaagguggacacagugcaguccaaggcucuugacuacagcagaagccugggugagcugucgggggacugcuaauagaaguggacguagaacuggcaagccaggcaugggggcucaugccuguaaucccagcauuuugggaggccaaggcuggaggaucauuugaggucaggaguucgagaccagccuggccaauguggugaaaccccgucucuauuaaaaauacaaaaguuagccaggcgugauggugcaagccuguaaccccagcuacucgagaggcugaggcaggagaaucacuugaauccgggagguggagguugcagugagccgagauugugccauugcacuccagccugggugacagagcaagacuccaucucaggaaaaaaaaaaaauggagguagaacugaacucugaggauguuuaggauuugaauaagagaaggagagagcaucgcagaugaagaaagcaacaugcacagaagugucgaguaaggagaguauugcggugugcacaaaugacagggaagggucagaccuaaaagaagaggauguuaugaacugaacacagaaaaacaugaugggguaagggagggcagcuguggggccuugggagcaauuagaauuuggauuccgugugauaggcaaguugguucuugaggaaagcugugggaugaugaaagugagucaggcagcaggcuguaaauuggauuggacggagggaaagauuagaggcagagaaacuagccaagagacuguuucaguuaucgggcccaggccaagggaguaguggcauugagaauaaagaagaaaaagugacugugagguaaaucccaaaaagaaggcagaaacucaagaaauaaagguaaacgugauaagcaaagaugacucuugagcauccuaauuuuggagaugaaaaaaucaugguucugcuggaauaaguggggugagcuggagaggagccccguuuuguggggguggagggacaugaugacuucacuuugaggcauccaauuagagauacuuaagucaaugagaauaugguacuagaacccagggagagauuggggcugggaaugcaucugccuggugguagaugccuggcagugaaugaguucaccauggagguggaccaggguacagagugagggagugggagaaggaagaggagagagaagaaugaugggagaaaugagcagagaccagcaaaacacauuagcaacccuaaggggacuuggaaagcgaguugaggucaacagggucaguuaucaaagagaggcaaggcugaggaugagaaccaagggaaggccccugagucccaaaagcagcuugguggugaugugugagugcagccuuuccagcuucccuggcacgagucuccucauccaugguuaaaugaucauccaauuaucauauaggccuccugacuugccuccccacccugagccuucuugacccuaauucauucuccaguugcccauuacaagagugugcccuuccuuuaaaaucauaaccacaaucaaucauuauguuuccaaaauacaaauguaaucauacaucuucaccuggacuuguggguugcuuaggaaaugaaagagggguguguagaccccuccacuugugcguccaucagugcagggcagggagcagggacaagcauugccaccuuaaaggaagaaggagagaaagggccaaggagaaaagaaagaggaagugagcauguucagaagcaagagccaagaagacccugccacgucggauaagcggaaagacuccagaggaagacagaguugcugugcagguucccacacgccuucugucuacagccaccugcagaacugcaggcagcagccuccuugcccggcgggagccucuugcacagggccuccccauucacucucuacuggcuccacugcaacuuacgucuuugucccaaagggaagacugacauuuguuuguuuaucauaacuagcuucgcuugcucugaauuuauuugugugccugcucaacccuuuucugaacuauuuucugguuuguauuugucaugacuguggucccuuaacugacugugauccuugucaucaacucugcaccuuaugggcacugagaauucaguaacuggcucaucaauacucagcuccaggcuggggacccuaauuccuagggacacuuucuuauccaagcgaauuccccccacagucagagcagcccuucaugugaauuagcuauuuucuauugcucuuugucgccugugaauauguaauugcaugggaucgggaggaaggcagugauagaauccuagauuguguguuggcaagggcuuuagaaaucacccuauucaaccucccacucgcaggaaucccuucaacagcuuuuauuuaacuuauuaauagcuuuucucuugauuuaaacuguucccaaaaauaaauauuggguaggugauccaaggaguaguuugagaguugauauuaccaggaauaucguaaugaacaggccucuucuuaagcacucagaauuuggcuggacucgugagcguccauguugcgcuuuguccuucccaucugaguuuuguuaucuugcuacugacugcaaccccgccauggagacagcacucagaguuuucacaggggcuuggugaagccucaagcccauaacagaccaccauaaggacuccaugcucccuaaaugcauuaaacaguuccaaagauguguuuuuugcuuugggguuuuuuggggguuuuuuguuuguuuguuuuugagauagggccuugcucugucguccaggguggagugcaguggcgugaucaugacucacuuuggcuugaaccucucagacucaagcaguacuccugccucacccuccagaguagcugcgacuauaggugugcaccaccacaccuggcuaauguuuugauuuuuuuuuguagacaaagucucgcuguguugcccaggcuggucucaaauuccugggcccaagcgauccuuuugccucagcuucccaaaaugcugggauuacaggcaugagccacugugccuaaccucaaauauguguuuuuaaugauguuuaagagccucacuuguauagcagcagcuuuuauguguaucucaugcuguuaaaccuauaggaacaggggccuggcagccccugugucauugaggcucuguuuugcugcuuuaucauucaauaagcugggcugcacauacacaaaccugucucuguaguaaagaaacaguuuuggcugggcacaguggcucacgccuauaauccuagcacuuugggaggccgaggcaggcagaucacuugaggucaggaguuugagaccagccuggcaaagauggugaaaccucgucucuacuaaaaauacaaaaauuagccgggcgugguggcaggcaccuuuaaccccagcuacucaggaggcugaggcaggagaaucgcuugaaccugggagguggagguugcagugagccgagaucaugccacugcacuccagccugggcgacagagcgagacuccaucucaaaaaaaaaacaacaacagucucgaggaggccagaggagcauguuuuguuccccccaccuuuggaaagaaaaaaacauuguacaaguggaaaaucuucacuaaugcaacauaaaacuuggcgauuuucaucacaccaggucagguaaucccaggcugugcuucuugaggcaguggaagcugauuuccuuugcucacuuaucaccugugccucucaauggcaugucuguaacaggaggcagaggccuccuucccgagguccaugggucagaguuuuaccauacgagauggcggugugggaggugugauuugucccauaagaucucuaaaucccaccacccauucuguaacaguugauaguccucagcacugcauuuuccaguuacucauguuuacagacaaaugucucuuugucuguaguugcucucugaagaaaucaaagagcagcuguuguccugccucagcaccauggcauaggagguccagaguuagcaucgaggaugacagugacgcuguuucugcucugguaucacuugccccuugcuccuacugcccuagcccuugugucacuuccuuguucuccugaacaguuuuuuuuuuuuuuuuuuuuuuugagacagagucuugcucugucacccaggcuggaguagcaguggcgugaucucggcucacugcaaccucagccucccaggugcaagccauucuugugccucagccuccugaguagcugggauuacaggcccccaccaccacacccaucuaauuuuuguauuuuuaguagaggugggguuuuaccauguuggccaggucucaaacuccugaccucaaaugauccacccaccccggccucccaaagugcugggauuacaggcgugagccaccgugccggcccugaacagucuucuuuguguuuuccugccucuguaccuucguuaaugauguuuucuuaccugcagugcccucucccuucucucaacucugaagucggugguaccuaacgauucuauuuaaauucugccuccuugaauucucuccuguucuucccagccuggaguggaguccgcugaggucuacuagaguucaaguuccaugagaacagagacugucuuuuuuuguucacucucuaauuagugcccagcacauaauggaugcucaauacauguuuauugaaugagagagauugcucccucuaaacguagcuggcaucugacauucaugauuucugucuguauuccuuuuuccauacguguacacgagaugauaagcuucuugagaacagcaaccaugacuugguaucacccucuagcagagucuugaacaugcugggagcucaauaaauaucagugauugaacuuacuacauaaucacucaauaauccaaucauguccccgagcucaggggaagggggaggcagacagaaugccuuccuccugcugucuuauacaaagccacucgugagcagcgucuuaugcaaacacaaggccccauucucccccagcccagcacuugcccaccuaggaaggauauucucaagaacaugaggcuguugacaucacauuccuuuuccaaaaaugugcaaaggacuacagaauuguucaagaagcagugauccagugcuuggcuaguuaauuccugaguaagccacucugaaaacugauuauaauccuguuucaaauggagaauugggagaaggccaauaaaggguauauuauuguaucuuguaggagggaagaauccggcagauauucacugaguuauggcgccagagccuuccucucuaauguuauuguaaauaauuguuagaguagaaagccagaucagcaaagugagacuccagcauugcaguuccucuccacggaggucuuauauaacgaagaccuccauaaacaaacauugcagaaacauaacaucggaucucuccucuuaaaguucacacuguguaauguaaaguggaauaaucauuuuacauuccuuguaaguucuaagaagucccuucuggggcagcuguuugcuaaaccuuuuuuguuuguuuguuuguuuaauaaaagaaaacaaauuguguaccucuccacagugcccccgcuauagagcuaaaagcagugauuucauguaaguguuucauuugucccccuccagcucgccucucuccuaggagucacgaacucaagugccuccagggccagguagguggucagugagcugguaaugacuaaggucugcaucuggugacacacacgugcagagggcagccuuauccagccccaggucauugugaccacgaacugacaaguggcccagaguugccagagcuuuugauuuucagcaggaaauccaaacuuuuaggaauaucaccugaguucuaaauguuaauagcuaguugaaaaaauuuaauaucuaugcaggccaaagagugucugucucugugccggguucauccuguggaauagcagcuugcaaacuucaugccauccguucagucuugccugcauuugggugcuuggaaguccuccucaggcuguguuuuccuugugccuccuaccuuuuuagaaagugcuucauugguucccaucagggcagggcaggggcuggauggaggaccuagugauguguuggguaucagggggugcugaccuaaggcuuguuggaaacacaaauccagagcuucucugcgugcucccuccccucuuagagacgcccaaucaguaucugucacugcauaacgaaguaccucaaaauuccguggcugacacaauaaacauuaucucaccguugcugugcuccaggaauuugggagcaacaugacaggacgauucccacuccaguucugucaugagguggcggugagcucuuagcccaggcugcagucacccaagggcgugacuggggcuggaggguguucuucccaggugggucacccuuguggcuggcaagccagagcuggcuguuggccagaggccuggguuccauccacguggaucucuccacagggccauugaggguccucuuccagaguaagugauucaaggcagagcaaaagcagaagccacaugccuuuuacagccuagucucagaagccacacauugucauuucugcgcugucuuauugguuacacagguuugcccugcucagugugagaggagaccacaccaggguguugacuuccaggagaacuggguccucaggggccaucuuaagggcuggcugucacagcugugaucacaacccucagucggucccuuaugaacaaaugguccaacccugagaauaguuuaaaaaaaaaaaaaacccgaagggaauaaaauauaugucauagugauuugcaccuaauauucagcccacuuacuauuguguuccccagaucagccucagaaauuaaauauccuuuuuuuuuuuuuuuuuuuugagauggagucuugcucugucgcccaggcuggagugcaguggcacaaucuuggcucacugcaaccucugccuccuggguucaagcgauucucuugccucagcuuccuaaguagcugagauuacagguucaugcuaccacacccagcuaauuuuuguauuuuuaguagagauggaguuucaccauguuggccaggcuggucuugaucuccugaccucaggugaucugccugccuuggcaucccaaagugcuaggauuacaggcgugagccaccaugccuggccuaaauauccuauuuuuauaucccaucuuagaacugucuucccugaauguaucuaaagucacuuuuuaaaaauauuuuuuaaaauccuacccauaccaccucuucaagcgauagacugagguguaccaaacagaagaacccuugcuuuucaagggaacccuuucgcuugcugcuuaccccugucugcuuccagggguauuccuaggucucucaguugcucgagcaacuaaaccuaaccaacuucucuacuaaaccuaacguuuuguaaagauuugaaaggaaaaucacucugaacaaagaguagucccugcuuugguauaccaguagcaccugugaagacagguggccccagaaguuuucugggacccucugaauugguaggagaggggcaccaguuaaucagaggcacagacagggaggagcaggguugcuccuguuccugcagcaguauccauuucugggacccacuuuccaaaccacccccccgaauucuaacagcaggagacacacacacacacauacccucaggcucuacaucaccucugccuccuucaagaccacccuuaauauucauuuuaaccagauuuugccugaauaaaaacgugaaggggaagaaaaggugccccaguguguuuuccccuaggaaaaucccuacugguaacuagucuuauuugcucaauaaacaaaaucuuaggcugggaacugaaggucagcacaagcagcaucugcgggugugcaccggggcucuggggcccuguaacauuugcgcguguaccugggggaaggggugcugcaucggcccgccccccgcagccacccgccgcagcaguggucaccgagucaggguguggggagguggaaaugaaaugcauaauucauaggccgcugugguguccagucugugggaggggugguaauuacagaacugagaaaugaggcugcagcgggcaagucaccucuagguuagaggcugcuaugauagauggccugcauuguucucuuucugaccuuuuucugaacuuccccuuagaagaacagaggaaauauggugcugccuuuucccauauuguuuuugaauaauaccuucagacgccagcuuuuagaguuucuguucuuccguuugggguuuugcuucccccuccacccgcccaaugccuugcuucuuuccauagaaaaaucgaaucacuaaugacuuuauccuaguauuaaugguaaauacagacuacacaaauauuuguccacacugaacacaauacauacggggaaaggaaaaaaaaaacccgcagcacccucucccuccuucugcuccgcccuccacugccaagcaagacaaucccaagagccguccuccguccuccguaaugaugcagacggggcugaugagaaggguggggggcguugcucgguaggaagugauggaaccuaagcucuggcuugcagaauagaaucguuuuaaccggacgugaaggugcaagcaggaaugaugcucacucccauguaagcuauugaugcuaucccggggggauaaaguaacaaggcuggggacugugugccguauucccuucaucagccuuuccacuguguaacccgaaagccgcaacgucguuucccuccacgcuucucucugccgcuagugauuuccuggucugaacugugacucccuagugauggccuguaacuuuggguucugugaucaucugaagucuaucaaccucuauauagucagggaaacccagaagagggaagagggaagauuucuguuugauuuucacacaagcaagacuuacuaaagaguuaggcagaauuguucacuuagccuucaauucaaaauugaaucucagguugaaacuuugggguaugugggguuguuuuguuuuuugaaaaauguaccccuuuugaggccaaaugaaaaggaacuagacaguucugugucagagccuuucagacuggggguggaauuugguuagcuccauuuagcggguuaauguugauugaacuccugcugugugcaucaccacccugagcuguguggcagcugagcacuucccugggaagcaaauauagguucugucuccucaaggaacuuuugaucucuugggggaauccaggacaagccuaaauacaaccauacaaagaccuacuuacacagcugacacuacagagacaggccugccaggcaggcccucgcugauuuccagugaugccacaaaacuuuucuuccuuggcaaaaaagaaacuaagcuguucauaccaaugaucacugucauucuuucaaacaucucacagguuuuuuuauggguuuaauugcuuauggguuuuuuuuaauugaauuuucaaaaucucccuagcugccuccucccuaucuccacuuauucucucuucuucuucagguagguaaauaguaucuccuuuaucaccugcuuuucacccacuauuccucagcauauauauagauaucuagauagauagauauagauagaugauagauagauacaaacucccuaugucaagcuucuccuauuaaaaaguggagcuuuauagguuucuauucacauuucaccauugaaauccuuauuaucagagaagaacuaaaagagccacuuauuuccuuaaaaguaaauaaacaguaagaaaucccaguuuucacuucuucuucacacaaucagcuacucaguucagcaaacaucuguguauuggguauuuacuguucuuagcacagugcuuggcgguaggaaagaagauaaugaaaccacagcuucuuccagcucaugagugugaacaaugacacccaaugucugcagacaccgacccucucaccccaguagacaaggcuguacgcugggugcugugagguguacagagaucagucaugcacaggccauggccucgggaugcuuccagucuaggagcugauuauagaugauucuuauuuaaaaaaaaaaaaaaaaacuaucagugcaaggaugagugaaagagcugaauuggcaguagagacauaguuagcguuguaggaauagagcacaggagggagccucagucagcagggagugcuagagcagguaagguuugaguagaaagcuucaaaggcuuuccaugagagccaggccagacaugcuuuccacagggccacugacagaggugcggaggggaagccugggugugcucagggagagucugggaccaccaagagucucaggugcugccucaccgccccucacucuuucuucucugacuucccucaagagucccucccucccuuccuccugccuuccuuucuucccuucuccacccaaagccccagcugaugugugacagcucccugauuccauaagcugguuagcucaguuggcuggaguaguguuuggggcucacgagaacaaaaugagcauucucaucucuuuugcugaauguugcuccguuccaaaggcacuguaggagagucccuguucuuggacuacaaagaggccccauuguuaggauaagaaaacugguuaaugagaagauggagcagugguauccucaucugaaaacuuucuuuucuuucuuuccuuuuuuuuuuuuuuuuuuuuaagacaaggucuuacucugucacccaggcuggagugcaguggcgugaucacagcucacugcagccucgacuucccaggcuuaugccauccucuuaccucagccuccugaguagcugggacuacagguguguacaaccacuccuggcuaauuuuuuaaaaaauuuuuuguagggacggagucuuacuauguugcccaggcuacucuugaacuccuggccucaagugauccucccgccuuggcuucccaaagugcuggcagugcaugggugagccaccgcaccagccuuaagggaaccguuuguucccuuacccagugggucgcgucccucugucuccauggaaguugaagguucagguggcuuuccgagccugugucuguugcacuucagcgcccccuagugggagguguaaagagccagcuuaguauuuccucugugacccaaacacaagaaggcaaacuuugguuugguuugguuugguuuguucuuuuucagcuccuuuaagaaaaguugaguguuggaagguuuccccugaguaagcugcccuuggcuggagaccuggaguuuaugcccauuuuguuuggcaagaucuucuuguuccuaacuccugcuggaauaaccaaccagucaccgugagagcucgcucuuguccggaccacagcagguccuaaccaggagugcugugagcagacgggccauggccacauuuacucuguggaugcucccugcucuaaaauuggguaaaaaacauacccucagugaguccuguuuugcugguuugauggcgugcacgucuccagagagcaaggccagccucauccaccuggcuccccucaccgcacucacaccugccugcuuagagucaggccgcauccuguacuuacaggaucagagccuacuccaucggccaggaguaguggcuuuauuuggaaaguugcuuagguaggguauuaguggguuucggcccugcuuucucaguaguuuuccaccuaacacacagugcagugggggagaccuccucagacgauaccuguuuuauuggaauaucccuuaggcugcaauggaaauucacucucuaacuuguguuugacauuuuuacugaguggguuccuuuucauagcucaaguuucuggcuucuguucucuuaauugguaugucuccggcuggugacacugaauguaucucccuuucaaagaaggagcaaguuucugucuuuuaucccagacugucagccauaaagacugacugugacuuagcuccacaagccacaugaucagauggugcuguaaggaaagaaaauaccccaaagaugagccuugucuauggcacagucacucaucugagaguuggggauucggggcuucuccaguggaggcacugggaaccuuggaaaggaaagcaucguguuucuucugccuguuguugguucauucauucauccagcaaacacuuauugaggccucaccaugaaccagucgaagcuaaauguugaagcaaugagaaguuuugcauuuaaaucaguaaaguugcacauaagugauguuacuuucuuaguaugcauccaucuagaguagagggugaaccuugaauuaauguguuaguguggaagagaccagccuuuuccccagccucacaucucaugaucacuauaaguggguaacaucaccaggcugaauaaagugaagacgccacaucugcaguugauccacaggaauugaaauuccaaaucccuugccagugcagagaaaagaagaguggucccagaaagcugaaaagugacagcaggugacagugggacuuggguuaggccuucccagaaucagcaggcuucccaacacagcucuaaaugcccaguuucaacccucggcuucagucaacagacuaacaaugaaucggaagaaaaacagucaacaaaaggauccaugaugaggaccaucauaaaagaauggcugaggccuggcuccuuucucagccacuguguugggauucccagccucuggccuuugcgcucaccugggcaggagccucaucugagcacaguggcagagcacagcgaggcaugggggcugccacaccgaugugcacccauacccaggcuugagugugcaggcugcaugucaccucccacacauggugacuucagagccccuuugaggaggagggacagcggaugggaggaaauaccacagggcuuuugugauguugacagugcucuguuucuucaccuggcugguagugacacuggucuuuguuuuccaauaaguuguuaagguauacguuuuuguuguauacuucuuuguauauauauucucuuucauaauuaaaaaaaaagauaaaaacauuuaaaaagagccuggagcaguauacauaugaaaagauuacauagauaggcaccugcagagacacaugguuccauuucucuggcugauaggugcuucugcaaacauuuguugagcacauucuuugacaaaagucaccaagcauaaagcguggccuggugacacuguagucugguagagugcugggaggucagaacaggcuuucuccagcaacgcagagcuucaugguauagcaccagagaccagauugggggauauugggccacccaggccagggauggguaaagcaggcacagcacgugucaggaguauaaggaucucaggaauuacagggcagcgugaguaucuuugaaauacuuaucauggaguccaaacugguucuucuaggaaccuuccucauugacauuacaauucauaguuuucuuuuuuucuucuuuccuucccuucuugcuuuucuuauuucaccaagucaagucaauaucguuuagguggauccaugucccuggcuguacuuucuucacuuuauucuacaugcacaagcacauaaccacaaauuuagaggccaguaugcucuggacaucugagaacugguuuccaguuugcaccaacaucaccagaagccuuuggagauuauauucauuucaguugcagaugcaaccuucuccucuggcauguaaacaagugaguuagauuuuggugcuacgcuuagcagaguuggagcaggacuaagaacgaaggaucagugugaaaauguguguguguguguguguguguguguguauuuaguacauauucagagccaagauguucacugccaauaugaauagaaaaaaccgccaaucugauucuaacauuauacagggaauggccaguugaaucaaggaagccugcauccuuuaagagacuguccaagugugccaugagaaugaugucaacaucuagacccaacugcaauuauaucaaccuccauauggauaugaugguucauucugaagucuucagcacuuguauuggugauagcugaagauacucaguuaugacagaaucaucagugagggucugaaaugauccuccuuagcacacaguuuuauggacaucaguagcggccccuuagguagaaaaucucugcaacagugguucuacguguauuacaucaagcugcaaccacccagaaguuugggugucgugucuguccccccagcucuccuuuuggaguuggaacccuguucccuugcagcagcucuccaccuuaauuucuucagcuuauaaccaggcaaaaguacccugcugcagagugcacagagaucuugggguccacgguguuuggcuuggccauuccaaggauggcuccguggaagccagcgcaaugggugggccccuugucaaccucccccauguuuugcuccuagagcuucaucucugggucccuuuuuccuuuugcuugucugccuaucacccuaaucaaagacaaaacuauuucucuuugaucuccuguuugccuaggaagcugugugucuuuuuaagaauccaaucacagguugaccugggauuagcucaccucaauggccaucuacaucuccacuuggaccuucuggaucccccuaggcaugguguggauucauccuguggggaggcugccccuguuuucccagcaggcuugccuguggucacagggcguguugucucuccaugcagcugccccgaggugcuuuccagcccuugccuuucuggcugucuucugugcagcucucucuuaccucuggcuccaauuccucugaaauagccuccuccuccucccugcucuucagauuucugccacuguuucuuggguccugugcugcuucacuguaaucccucgccucccacucccggucaccagcucaaacagcggcucagagcucaagacagcaaugcaagucuccuuauuuuugcaguggaaacauaagauuuaacaacccaucugaaauacaguuuuacauuuugauugcuucugccccagccauacugagguuacuuucaaucuacauauauuugugggaacggacuuuuucucugcaguucgaguacaccuuauaauaccagugauuauaaaauaccauggacuaauagagugucuugcuuccaaggaguuuaaacuguuuuauaauucugccaaccauaauuuaucuucauaagcugccguagagacaagagaaaaagugagauuaauaaucacauuuuauagauggugaaauaaaaacucagagaaauugaguaacauuuuuccagaaaugcacagcuccgccugugcgcuccgauuagcgcugcagauuuauuacccaaguucggaguggcagugaacccugcccuuguuuugucagugaacuauguaaaugagcaagacauugacucuggucucagacuugaccaaaguguuuggggugagcaagggacuauacccugaacccugcgucccagcccuuguugccgccgaugccauaagcagacacaguaauacagguugacucugcccaccgggguccucagacccacgggaccacccucccaaaccuguuccccgggcugugcucccugggcaucacucugaccucuagccuggcacacuguuaggacuccaagcagcccaagcgcauggcugucuuuucagucuucauugccuaguguacugcauguacccagcauucaugugagaugaaauaaaaggaacacuagguuacgguaguauuucuccacacaaggaagaagcaagaggauuguggauagggaguuuuauuccuuuuuuuuuuuuuuuuugagacugagucuugcuugcucugucacccaggcuggaguguaguggcgcaaucucagcucacugcaaccuccaccuuccagguucaagugauucuccugccucagccucccaaguagcugggauuacaggugcgugccaccauguccggcuaauuuuuguauuuuuaguagagacgggguuuugccauguugaccaggcuggucucgaacuccugaccucaggugauccaccuaccucggccucccaaaguacugggauuacaggcgugagccacugcacccggccagggaguuuuuauuucuaaagcuaggugguagguacuucacuguugguuauauuaaucuuuucagcuuuuuguguaaauaaaugaaacaguuguuuaguguauaugcuuuaauguauuucaacagaguguuccauaucagaaagaaaguggcuuuaaaaaaugaggaagcugggugcaguggcucauacccauaaucccaacacuuugggaggcugaagcggaaggauugcuugagcucaagagcucaagaagagccugggcaacauggugaaacccuguuucuaugugccuguggucccagcuacucaggaggcugaggagggaggguugcuugagcccaggagguggaaggugcggucaaccaagauugugccacugcacuccagccuggacaacagagcgagacccugucucaaaaagaaaaaaaaaauaaggaagagggaugaucuguuuauuucauugcuuucacauggacuuagacguguuauagauaagugguuuaguauuguucagcugacuacucuaugccaggccucugcaaggugccccccuaugaugcucuguuuaaccuagucuucauaccuguacccagaaguagguacacaaccaguaccugacagggcugggauucaacccggugaacacugggaucccaagugcgggccacgcccucuugacuucugcagccucuacaccuccacuggaggccauuccccugcagggucauaugaucuggacaugaucugggaaugcuucucagugugugcagucaagagagcgaguggagcuaaaucaucaaagcuuccauauugaugguguccaaaaugacaguuguuuuuccucuuucuuuagaaagauagaauuuucagugucuuccuaugagaauguuggaaagaaauuaucccccucuuucuuaggugcagauuuugucugacacuucauguguguuuaaaguauuuuugaugucccaaaauaguaaugaggcgauucuuuaagaugguuccaugggguggagcuguagcagugaaggugaggaagagcaaaugagagaucaguuaugacagaaccuggaaaugcucacucacaguauucaggaaccagcagcccuaccugccugaaaccgaaccgagaacaggaacagccccuguggaagcaaccgacaugugaugaucaacccaaaaaaccauguaaacucugaaacagaaaggccaagcugucugccucucacauaggagguacugacaagguggcauugccagcuccagggaaaacuggcaacugcugagggugugcacuugacauagacucauuccuucuacaaauguguauggagcaccuacaugcccaggcugcgugcuaggcgcuggagauacagcagugacauggggguugggggacuugcgcugcucugugugugguagccaccccugccuggccacuuacuaaggcucagcucagacuccuccugggaagcccauccugcuuucucucuccuccuccaauuucccccaucuuuguguacuauguacacacuucacacauuguaugucagaugucgcuaugcugcuaccuuggcuagacggugaacuccuggaagagcugcagggucugguuuacuuuuugaucuuuagcacccagcacaguaccuggcacagaggaaacacuuaguaaauggugguugaauauucuaauaagugagugaggacagcuugaaacaaauucuggcucagaaugacugucagaaugagcuucccugaagauuaagcaugcuuuagcaaccauccaacaugcuucaggugggcuggaugaaaagaaacauuuuagacuugacuuugaacuucuaggaccucagagccuuauagacuagcagagcagggggacaaggccucugcaagaucagaucccagcaaaauggucugaaguccccaaagauuccugggggccaaauggggaacuaccucccuuaccugaggguuuaugggcuggguguugagcagcuguuuacgaagcagcuucugugugccaggcugaggaucaaggacaagugagaugcagacccugcccuccaggagguauaguagaggcagauaugcaaacguauuugugugucaaaaaugacaauuauuggcugggcgugguggcucacgccuguaauccagcacuuugggaggccgaggcgggcggaucacgaggucaggagaucgagaccauccuagcuaacauggugaaaccgcgucuuuacuaaaaauacgaaaaauuagccgggcaugguggugggcgccuguagucccaacuacucaggaggcugaggcaggagaauggcgugaacccgggagguggagcuggcagugagccaagaucgcgccacugcacuccagccugggcaacagagugagacucugucucaaaaaaaaaaaaaaaaaaagacaauuauuuacucucuuucuccagaacaagaauguuuaguggcuugcuuugggaauguuggaaaggaaugaguccucuuucuuaggugcagauuuugucugacacuucauauauauguuuaaaguauuucugaugucccaaaauagcgaugaggaaauucuuuaagaugguucuguggggccagugggugcucaguuaguauuuauuggaccaaucuggucugaguaugucauugaucuuuguaugcuugucaccugguagagccagcacagagacagugggcagugucuguuugaauaaggaagaauggaagcgggcagggaggggagcaggcuguaucugaaacaugucucaugagugcagagaaaaggcugcacccuuaggggugggagagggauccagaguggauuggaaaagguuaaaaccaaaggcaagagagcagcagguggcuguagugaggcccagauggaagagcaugugauuucgcaugcugcagugggacugcgcaggauaaagucuucaacauaagagcuaagguggaggcucuagagggcguaaugacaauggccauaaaauaagagguuugggcuaaaucccugaggucccaaguccuaacccugcaugagccaggugccacuucuagcccuccuguuccuccucccugucauuuuugcuguaauucuuuuguuggccaccugcaaguagguguccuuggcacuccugcugucugcccugcuguggugagugugagccggguugcucgugccccucucugagccucagcuucugcuccuccuugggcuaaauccugcccccucaugcccaaaccuugauugcugcauaaugauucagcccuucuacucucuuuuaucugcacugccuuagagcuuugucuuaauccauauuuuaacacuuucuuauauuuaauaaagguuuauuugaucaacaaaugcuuaaugaguggcuaccgaaugccugcgcugcccucauagacuuggucagggaagacagacagugagcagguuaagaaagugcugugaaguggcauuuauggcacccuauaugaagacuaacuggugucaagggaggccugucuguagcgugacagcugagcuaagauuugagggaugagaaggaggcagccaugugacagccagcagggagagcauuuaaggcagaagcaacagcaucccacgaagacucuggcuccaaaggagcuccagguacucuugcaaauggaaaggaaaccaacgggccugcaacguauuaagcuaggagagugguuggcagugaugguggagaggugggcagggucccaaucguggaggccccauggccauggaggggucuagauuucauuccaaguccaguggggagccccugaaggcuuacggcaaggggguggggugccaucuguucccuguggcugccauggaggaagugggcacaaggaagggagagacaaguggaaaggcugcaguggaagcuccaggugacgcaggggugaccagcgccacugcugcggcaggggggauggagaaucaggggcugacuugagacuuuggagcuggccauguuaguggauagaugguggggaugaagaaaucaaacaucuuuccuggauuucugccuaagcagcuggaggguggugguucccuuucauaaaaugaggaggacaguggaaggaauauguuuagagagggggaucagagaauaguucccuucuagacguguggaauuggagaugacuaugagacauuccagaggcaauaccaggcuuccagaaugcaaaucuagagccagaaggagaauuccaagauggagacaaaccugggaauacaaauggaauuuaaaccuauggagcgaguaagaugacugucaguuuccuagggcugcugaaauagguaccacaaaauaucuggcuuaaaacaaaagacauccaaaaucaaggugucaacagggccaugcucccucugaaggcuccagggguagagccuuccuugucucuuccugccucggguggcuccagguguuccuuggcuuguggcagcaucacuccaaucucuuccucccuuuucacaugaccaucuugcugcugugucaguaucuauguccagauuucccucugauauggaugcaagucacauuggauuagggcccaccuacuccagugugaccucaucuuagcuaauuauaucugcagcaacuccauuccuaaauaaagucacaugccaaggugccaggaauuaggaguucaacauaacuuuuagggggacacaauucaacccauaacaauuaucuagggcuggguggaaggagagaagacggugggcuuaggacuuggccaacacacagcaguuggauagaagagggcgagccuacaaaggaaaugggcaagccacaagcagagaggcgggacagauauggggagcaagcgaugucaugaaaaccaagaauaaguguuucagggcaggaaggaaugaucacccgcgugaaaaaaauguggcucccaggucacagagcuaagaaguugaucaacagaugugacagcguggagaucacugcugaucucaacaagugcagcgcgucagugacgcagaguguccaacuccaauuagaggaagcugagcaaaugcugugaggugaagaggugggaaccacagggggagaugacucucuccagagagugggccuugaaggggagcugagaacuagggcagcagcugcugggagacgaagggauuaggaaagguuuguguuuggggcuuuuguuuuguuuuuuguguucuguuuuguucuuguguucugcuuuguuuucuaacgugggagccgcuagagcauguggugugcugugucggcucgauuuuuaugucugugucuuucugugacacacguuuuguauucgacucgaguuguccugugugcuuugauguggcuuucgcagcaucagaggccuucgcagacaguacugucucccagccaccuagccagaugccugggcauuuguucuuuacggucgcagcaggaacauucugcggcacguaucaugguaccgugaauggcugccauuucauuuucuugguggacuacaagcaauuuucccaggccccguucaugucacgucagucgucaaaaucuaugucugguguuuccugcuaaagaacaucacuaaagugccuuuguguggccauuuuaguuguugcagucugccuuguucaucacuggggaauggaaacuggaaaacgagguuuccguggguuaggaacagccuuccgggccaugagaaccacguaacuaaccugauaggaagggcaggcccauagucaaguucagagaaguccccuggggccagaccggccuuccuaagacuuacuugagugucaaacauccaaaccuacagacuggagcgucagacuuccaaacgucaggcugcaagagggcaggggccagccaagaggccaggugacaagaaucgggggacagaggugagaaugugcuugauccuugagccagcaguccaggccaaaacucuccucccaugaagaggccuagauccacgugagaggaggcaggaggccaccccugacucuagaacagggagggcagagagaaaagcagguucugacaccauaauacuuuuuuugguaguguucuuuucagauauucccuucuuuucuggccagguaugguggcuccugccuguaaucccagcacuuugggaggcugaggcagguggaucacuugagaucaggagcuugagaccagccuggccaacauggugaaaacccgccucugcuaaaaauacaaaaauuagccagaccuggugguaggugccuguaaucccagcuaccuggaaggcugaggcacgagaaucgcuugaacccaggagguggagguugcagugagccaagaucaugccacugcacuccaggcugggcaacagagcaagacucugucucaaaaaaaaaaaaaaaaaaaaaccugaaacagauagucccuucuuuuuucuaagggaugugauguuuuaaauaaacugaaacgaucucuaaaggcacugcuagaggcaaccuggcaguaaucuuaucaguuacacacaaugaugagugaaccugggggcccugguauguggccaacacugacacagguggccuaggcagguggugggcucguggucacauggaagacaagggugcagcagggacaugucuuggagccaccacaggcauccccagcucaucagugccagugaguaagaguggccccugacaauacaugcgcaguccaauguggggaccaaaggagacaaaggccaaagggggugaagugccaagcagaacacuggcagcugaagacgcccagcagcaggcgauggggacaacggaagguucauuaaauagcaacaaggcaacucacuccagcccccagcggucacuccuucugcugcccagaccggcaagugugacugguacucuagaagcacguaguagccaguacccagucucuaguugugaggaaaggaauaaacuaaaauuuuuuuuuuuuuuugagacagggucuugcucuguuaccaggcuggagugcaauggugcaaaucauggcucauggcacccucaaacuccugggcucaagcaguccucccacuucagccuccugaguagcugggaccacaggugcgcaccuccaugccuggcuuuuuuuuuuuuucuuuuugcgacggacucuuacucugucacccaggcuggaguacaauggcacgaucccggcucacugcagccucugccuccuggguucaagcgauucucaugccucagccuccugaauagcugggauuacagaccugcgccaccacgccuggcuaauuuuuguauuuuuaguagagacaggguuucaccauguugaccaggcuggucuuggacuccugaccucaagugauccucccaccuuggcuucccaaagugcugggauuacaggccugaaccacugcgccuaaccccuuuuuuuuuuuuuaagaaacagggucucacucuguugcccaggcuggucugaaacuccugggcucaagugauccucccaucucacccucccaaagugcugggauuccaggcaugagccaccacaccuggccaaacuccauuuuacuugugaaaaaucagaacuugguaauaagacauuuuuggguuuuguuuguuuucuucuuuucaauacuauuauauaaagaaaaaagauuagcaaugagaacaaauuuaaagggggaagaggagguacuuuuucaguagagaaaaauucagcuagaagauccaagaccaguggggguguuucugaucgcccucuuccuccccacucucaugcuaggugugugaaagguaaccaagagaaaggucuccccagcucccuucacucccacuccaggcugcagaaaggguaggaaaguagccucuucuaccaucucuuagugaaguggaaaauuuauagagaaaacaaaaaucaggcuaaugcauuucauuaucagcagaaugccuugagcuacuuucuuucuuuuuuuuuuuuuuuuuuuuuuuugagacagggucuauuucugucguccaggcuggaguagaguggugcaaucucagcucacugcaaccuccaccucccggguccaagcaauccucccgccucagccucccagguagcugggacuauaggcacacaccaccgcacccugcuaauuuggguuuguuuguuuguuuguuuguuuuugguagagacaggguuuugccauguugcccaggcugcucuugaacuccuggguucaagcaguccaccugccucagcuucccaaagugcugggauaacaggcaugagccaccgugccuggccuugagacauauuuuuuuaaaaaaacauaagcuguguucauaucucaaacuuugagccugguuuuguccaaaacauaccccuaccuaaucaugacagauucuuagaaaagaagauguaccuggguggucucuuuaguguugauuaccaacucccugugaaauguucucuugggguuuaggugauuuccuugaagggacagaacuccugcauucaggaacagguuguucauggaguuuacgcuggaauccugguugauaccagacucuguauucaugaaugggguucuauaauuguaauauuagguaacuucuaagaagauuagcuuuuuagaagcuaauaaaaaauagcaauguuuccuuaagaaagugugauguaaauucuuaagaaaggauaauuggcauaaacagauauuggacuuaaucccguuauuuugggaaggggacagcuuguuuuacaucuuccugaagauagaauaccucgaguuaggugugguugugcauuccuauagacccagcuacucaggaggcugaggcagaaggauuguuugaguucagaaguucaagacuauagcgagcuaugaucaugccugugaauagccacugcacuccagccuaggcaacauagugaguucccaucucuagauagacagaagaaaauagaagaccugcguuucagaacuccuuuguaaaaaccaggcauucucugaagauuaguuucccagacuuucagcuacaaaagauaacuucagaauaucucuaaaaugguuguuagcucaucugauuggcgugugaagguaaugaagucaguagacgugguucucuguagguguguucuaaacacacagacuuauccuucaucucagccaaccuuccaagugggcccuccacuaauggaggggaccaagccaaagaauggaaggauuguuguagcacagcgccucuccugagagccacaggcccuucagaggaggagucaguaauggcaccccagguuugaaagauaguauucauauagaaacagcuuccugcauuuccaacuugcuaaugguuucuuccauucuuccuuuucagggccccugagaucauccuugguuuaccauuuugugaggcaauugacauguggucccugggcuguguuauugcagaauuguuccuggguuggccguuauauccaggagcuucggaguaugaucagguggguccagaugacacagauauucacaagaccucauucuucaucuggaaaauagccuggauuagcauuucauugauuacaugacaaaugggcgggacuguggaaugucacguugucucccaaaccuugcuucccuuaaccuugcuauuuuuucuuuauuccuuucucuuuucccuuuuucuuuuuucucuuuuuuguuaacuucuuucccuacaaaaauugucauuuucauuuuucucaaagccagcagagccauuaguauaccauauguauagugacaggaaaagcccugaccucauucuuaucuuuucuugcagauucgguauauuucacaaacacaggguuugccugcugaauauuuauuaagcgccgggacaaagacaacuagguuuuucaaccgugacacggacucaccauauccuuuguggagacugaagguaggaagagcgucuccuccacuccucacaguggcccagcgcuuagggaagagggccguagacccauuaguggggagcuuuugauucagucagcaaaaugagggcacugggggugcuguuguuaauacaugguauggcugaaucugaaugcucagaagccccucuuucccuuggccuaucgccgccugugagaguccaaccuuaugauugcugaacucccaggauuuaauccgauaagccuugaugacugucugauuugugcuagggagagaaacgaaccccacucugcccuugagagcuggcaguccagagggagacaggaccaugugccacaagcucccgcccacuguaguaagggcccuguuccuggucaagaaugggugugggugccaagaggaaggagcauuuaauucugccugcagcagaggggcaaggaggagcauuugaacugggcccuaaagaaugaagagggagcgugguggcucacgccuguaaucccagcacuucgggaggcugaggcggguggaucacuugaggucaugaauucgagaccagccuggccaacauggugaaaccccgucucuacuaaaaguauaaaaauuagcugggcgugguggcaugcuccuguaaucccaccuacucaggaagcugaggcacgugaaucacuugcaccugggaggcggagguugcagugagcugagauugugccacugcacuccagccugggcgacagagugagacugugucucaaaaaaagaaaaggaagaaugaagcggguuugcccaguauagaagugugggguggcggcuggggugauggggguuagggagagggguuccaggcaaaggaggcugccuggugagcccaugggaauauccuaaggcccagggaggugucugguucacacaaguaaccauaaaccugaaacuccgggggcaggggcuucacuuuaacagaaacauaguuugcuuucacuuugaucugugccuagcaauuaaaaucaaaguauuuuccugguaaaaagaaaauaauaaagucuuaaauauguuucauuuuagguauuucuuuuuuugcagcaggguggguggguguuuguuuuguuguuguuuuggauuuguuuuuuuaauggaaucugcagccaaauccuaauaugguuuaaagauaauauauauccaguagucacaaaagacugagaaaagagauuugggaacugagcaagcacucaggcuauugaugggaggccuggcauuuggcaacugugagggugagugucaaggucagguccaguaaaaagaguccuccgguggaggagggugaggcuggaguuugcuguuguguuuuauugaagagccucagucccacauguccagcuguucccaggacuuaagccgcuccaggugugcuguccuugagugagauuuugaagacgaauuaccucuggauuaccucauggaugaguacagaaauccauaguaauuggaaacagcaguaucuccagccauuuggggaauguaggucugugucucagccaccaauagaggggcagcccagccacaaacucuggggccagcugccaccuauuggccaugugaccauggcaagugccuggagcuuucucuuccuguuuccccaucuggaaaauggggauaguaacugugcuaccuaaugugguugucaaaacuauuaaaugaauaaaugugcuuuagaacaaugucuggcacguagcaagagcuaugugcauaaggguuuauuaaauaaaauuggaaaaugcaugggaaagcccuuugcuuuuccacaauggaaucuugccuuauuccuuagacucagagaaggcuguaagcugaucgaggauguggcauaccuugaucagccugugguauggagcaagacugcuccauaccugacccggagccagccccugacacgugugcauaggaaggaggagggauggguugguguggaugaagagagaagggaauugcaggugugcaggucauugaagaaucaaaaucucuuccgaaaugugggaaagagacccucugugagacacaggaguuccaaggcuugagucccagugaugaggagcuaagucacgcuaccaauuggcuuuugccucucuugacagacaccagaugaccaugaagcagagacagggauuaagucaaaagaagcaagaaaguacauuuucaacuguuuagaugauauggcccagguaagcuucaugggugaguaugcaacguaagcccuuuaaaaccaagggcagcaagacuucugcaauaguaauagaagauaauggguugaaauccacauuauucaacugcagugguugaccuugaccuuaaauaguuacagccagucuuaguaagaauaccauuuggugugugaaacauuuuuaaaacuucauaccagcuccuuuaaaaucguuccaguuggccaggcaugguggcucaugccuguaauccuagcacuuugggaggccaaggcgaguggaugaccuuaggucaggaguucaagaccagccuggccaacauggcgaaaccccgucucuacuaaaaauacaaaaauuagcugggcaugauggugagcaccuguaaucucagcuacucgggaggcugaggcaggagaaucacuugaacccaggaggcagugagccgagaucacaccacugcacuccagccuggacaacaagaucaaaacuccaucucaaaaaaaacaaaaaaacaaucauuccaguguauugguucccaguuguaauauaguacuggccuaucugccugauguuaucaugagaagaauuccagcccauuaguacccauggguuuaaugcccauaauuuaguguguauguuuccuggggcagccguuagaaggugccaugaacuggauggcuuaggacaacagacuuucauucccccacaguucuggaggccagaaauuggaaguugggcuucagcaggcccauguucacuguaaaggccauaggggaagagcauccgugucugucucccagcuucuggcagcucuggcaauccucagcguucuuugacuuguagcugcaucccucuaaucucugcuuccuucuucacauggcuuuuguccugugucuccucugugccucuguguccacaucucccuugccuugucacugggcccacccuaaucgaguaugaccucaucuuaacucaauuugauuacaucugcaaagacccuauuuccaaauaaggucacauucacaccaacuggggacugggacuuuaauauaucuuuuagagggauacaauucaaucugcuacacagucucagcucacuggcagggaccgcaggcucucaccuuugugccccagagaaaauucuagaacuucagcuauuuuuagugugaaaauuagucugaaaccagggcaacccaaagugaguuuucucuuuaaagcaaugagaaacaaagcuauacaccaguaaacacuuagcaccccucuuacuguagaugacuauaaccaaaaaucaugauucugaguaaagugugcuugucaguugauuagcagcuuagauugucugagaaaacugaaauugguuuccagaccauguccuggaaaauacagaaaucaccacaaaacaagccuuuuaaagucgauccuaguauagacucacccuuggaagaaaaauccuguguucagauauccugccugucuuggccagaggugacuccauugaacacagggacuaaaauaauucuggcccuaacuggggaacccaugagaaggaugauaugcuguagguggaggacgggcacacucaggcccuuccacuucccucuaaagguuaaauacaugcauacauacauacauacauacauacauacauacauacauagacuuuuuuguaucuuauuuguacugcuuggccgugacucuuuuuuaaaaauuguggcaaacacacacauagcauaaaauuuaucaucuuagccuuuguuaaggguacaguucaauaguauuaacacucccauuguuaugcaaccagucuccagaacucuuuucaucuugugguuauuuuuaaugaggagugaugaaagcugcauuucaacuuaacugaugaaagcaggagcaguuuacauccugucauucagauauauuugcaggucccagcagcagcccucuccccuuccuggggcacagccccucucugccuuuccugcagagagaaaagccacauccugugggcaaugacaacauguggguggugccucccauaggggcagaguuccugggaacugagaaagggggcuugagagaucaggaggaaguuacagggcaaaaaauaaggggagccaggagaggggaggcacgcuggggucuuccuugguaaccuguccuuacuugcguccaggugaacaugacgacagauuuggaagggagcgacauguugguagaaaaggcugaccggcgggaguucauugaccuguugaagaagaugcugaccauugaugcugacaagagaaucacuccaaucgaaacccugaaccaucccuuugucaccaugacacacuuacucgauuuuccccacagcacacaguagguguccugccugaugcuucguaccagggaucggcaaacuuuaaaggcccagacacuaaauauuuuagguuuugcggccauaaggucuugguaacaacuacucagcugucacuguagcugaaagcagccacagaugcaauacauaaacagaugagugaggcugcauucuaaugaaacauuuaugaaagugggcagggcugggcguggugucucaugccuguaauccuagcacuuugggaggcccaggcagguggaucaccugaggucaggaguucgagaccagccuggccaauauggugaaacccugucucuacuaaaaauacaaaaaucagcugggugugguggggcgcaccuguaaucccagcuauuugggaggcugaagcaggagaauugcuugaaccugggaagcagagguugcagugagccgagaucgcgccauugcacuccagccugggcgacagagcgagacuccaucucaaaaaaaaaaaaaggaaagaaaaaaagaaagaaagugggcaguggcuggacugggucccuggccugcaguuggcuucacacugaaaaggagggaagaggagagcacagagcuggaugaaccugacucuggguaucugugcaggaagagaggugcccgaaacgguagucucuguagcgcaaaacuagucucagggccaaagauugcucccagaaccuucccagaguggacccagucuaguuuggguuuggauuuguucauucauuucuucagcgugcugugugccgggguacaguggugagcagagcagacggcccugcccacuggagcuugcaguccguaagagagagaaugguauaaaacaagugaugcccaaaucaccaggcugcuaugaggacaaguaucaggugugaugagagcauacccacaggggagccucauuuuggggcaaaccaggaagacucccaggaaguggccugugaaggaugaggaagaggaugggcaugagcaggcagggcauugccuguauggacaggacacucccccaugggcaggaccaugcacccaucccagaaggcaguaggugagacagugaggcauccagucagccagggcaggccguacauguuaagguuuuuaaucuugauccaaaaagcaaugggaacucauuaaaugauucuucagcaagggaauagcugguuagaucuguguugagcaaagaucugucugcugccacacaagucaaaugagucuggaaaaaaauguccauucgguuuaacaacucacaaguugucaguaacgcaguggcagccauucaguggagugguaaaagcagaaaccaguuuaccagguugaaagaccaagugagaggugaagaaauagcaaccuuucaugaagugaggcuaugcaagagaagaaauagaggggugacuggggaggggucaaggggauuguuuuuaagacaggguucagagcacagggaugggccagugucauuggaaggauagauggacgaggggcauguggaugucagcguaugugcuggucucauggagaaaaguugagggaguccugucagacagcuucugcuucucagaaguaggcaaugagguuaucuguugagaacgagguggagggugguuuaagaaggguagaaaguuuagguagcuggagcagaagguggcagagcaaacugaccagagaaauacgguggaauuguugagcccugagguucgacaugaaucguuuauaguguaacucaucuccccaggugaaggcauagagaagacagaugagucuucugaucuagguuuguccagguggaauuuuugccaggcugguaagagaagaagacagauugacaaggaagcugaugaggcuagccagagaguaacuguaauccagaaugaugucuauuggagacuuugcccaaagggaaaggaagugaagaugggaggggauccaaguaaacgugguguucuggucaaugcagagaaggguuaucauagucauaguggaaugagccagauggaggaagaauguggcugggaaaacaggaugcuuaaacuuguaguuucuggagguggagcaauuucagguuugacgguccagggaaugaguggcuguacuggguugagaacaagagucacuggacaugagaaguaagcgggaagccaggguauuuaaaaagggaccugugacuucugaagccuuccuagcgaggcagggaauggcuuggagaggaagguccagccaguggcaaaggccucagugaacgaaggggagaggaaacgaagucauggccgguugcaguggcucacaccuguaaucccagcacuuugggaagccaaggagggcggaucagcugaggucaggagcucagaccagccuggccagcaugguaaaaccccaucucuacuaaaaauacaaaaauuagccaagcgugguggccgcacuucuguaaucccagcuacuugggaggcugaagcacaagaaucgcuugaacccaggaggcggagguugcagugagcugagauagugccacugcacuccagccugggcgacagagcgagacuccgucaaaaaaaaaaaaaaauaggaagccguugguggaugggaagguaauggagggucucacuucagccucucaacccugagguacuugggauguaaaagaauaaauaaucacauccuacgucugcagggaaaaggggugugcucaagagagcagcagauucuauaaggaucaggaggggaagggaauccugugagaagagccuggagaugugagaauugugcguaucauggcgggcccugcugucuccagagucagagggggcugggucucaaggcuggacccgccccuuucuggccuacaggaagugaguggguggcaccaccauggauaguggggccuccauuucauuucugugccuuacuaucagugaagcaagucaaauggcauugcaacaaacagauagugccucuuuaauguaaaaccaugcuugaaacaacugaacuccgguacaaaggaaucuggacccaucccuccccuacucuuguuaugggauuuguccuuuuuuucuuuuuuuuuuuuuuuuuuuuugaaguagagucucacucuguugcacagguuggagugcagcaguacgaucuuugcucacugcgucacugcagcuuccaccucccagguucaagcgauucuccugccucagccucccgaguagcuggaacugcaggcacacgcaccacacccgacuaauuuuuguauuuuuaauagagacaggguuuccccauguuggccaggcuggucucgagcuccugaccucaggugaucugcccgccucggccucccaaagugcugggauuacaggcgugagccaccgugccuggccuggauuuguccuguuucugagugccauaggggucagccacagagcuguccaucuguaccacaagaagaagaaaagcagacuuggcaauuuacuggauagggcucccaugauuucagucuuuugauaucacggguaaaaugggaugacugagaaacagcuacggauaggagacugaggauaggggugcccucuacagagguccucuuagccgucugcaccaaaacagucagauagucacccccauaaagccuggggcuuuaaugaccucagaguccuuccaccucuggguucuguaaggaagaaucaguagaguguuucacggcuuggucacauggagaccgugagcaucagcaaccaauucagaacuucaucugggacccaagaggggcacugacaagucagaacucagaaauuagccuaagaaggaaaggugggucucugaacacaccuaggcuugccugaaaguaggccugaucccuaaaguucucuagaacuugcugggaaaaccuugaagaacuccagggcaaggauaaaucuccaggcccaugcagcuguagcgccccugcccugggagcugagccacagcuacuggauuacuaggugaaacagaccccacuccuuucuccauaccaggauuccagugcacaauuuuuaaaaaaccaaucuucuuauaaaccuaaagugaaaggacuugcccuuuccuaaaacccaaaacuugaaauauuucaguuggaaaauucugaagggguauggaaauuuuguguugaauugucacgaaaccaaaugcuuuaagcccauuccaaaaagaauauaaaaugcauugguuuuaugcugcagccuccacgcacaagaccuugguacuuaguaggagcugaaaacacacuggcauuaacagcauuauuaggaguauuuuuaccuacuggauaccgcagaauauguuuucuuuucucuucagcaucaucaguccguaaaugguuaugucgugugcaugacgcagccaguguaaguggucagaaucuuagaaagaaguaggacucucuaagucgcgucucagucagucauuugaaacuuggaaugcauuuuucacaggauguuugggaauagcccacagacaccugcuuagccccaaagauagcauacccacagaguacugaaguaguacacguuuguaauccuaaaauaguagaaaacuuuuauuuuacucauucaguuauuacauuuuuuauaauuaaaauagacauuuugaguugaaaauuaaaugaguuuuuuuucuuuuucuuuuaauuuuuuuuuuuuuuuuuuuccugagacagggucucacccugucacccagacuggaauauagaggccuaaucaugacucacuguagccucgaccucacaggcucaagugauucuccgaccucagccuccuaaguagcugggaccaugcgcacgugccaccacagccagcuaauuuuuauauuuuuuuuguagagaauaggaucucccuauguuguccaagcuggucuugagcucuuggacuccacccaccuugaccucccaaagugcugggauuaaggcgugagccaccccacccagacuaaaagggauuuuauuaucuugaauauuagcauuugaggaaaaguaaguuuaacuacaagaaaugaaugagaagcgcuguauaaauucugaaggacacuuuuuggucgauuuucaagaauuuggguggcugaagccacuuguggcuuuccuuuucccugaugcugguuucagcaccacuuuuauacuuuacuuuuguaguugggguuuuguuuugauacacagaugcaaugggggaagaaaaggagaaaauuucuauuucauguagcuggacaagacuuagacaagaaaaugaaggcugaaguuggugaaagaggacguauguguauacacgaagguagccagugauuaccuauccuuggcaaacucccuaccucccuaagcuucagccuuacucgugaaguagggacgagaaucaugucuccgucuuauggauguugccggaccgagugagagguugcagaguauuauuauuaggacacuaauaaauguuaaccacuauuauuaauuauuaguauuauuacuguuuccauuaccuaccugcacaaccccugugggagaaaguguggcaauagggucaccauacuggguuggagaguuccuuggccguccccuagguggugcuggugacccaggguagcugaagcaggugacuacaaggguugucuuugggaaagguggaggcggguuauaagugacuaguuaauguucccauucagagagcuuauacauugguuugugggccagaaaccaggcugagaguugagaaugagcagugaugcugcagguggaccugaugugagaaugcagugugagcagucaguuuuguugugauauauagaaccuauauggagaaaggguaguagggcacuggagaaaauucaucugaauaaccgugccuguugcaaaugcacaggcuuugcacaagcaauccaagaaacuuagaccuaaaguuuaguuucccugcuuguccuguuuacugaauuaacccuucucuccuuuccuuuguuuucuccccuucaucccacguuacccucuuccccuccccuuaugucucaauaugccucugccuuuugcaugaacagcgucaaaucauguuuccagaacauggagaucugcaagcgucgggugaauauguaugacacggugaaccagagcaaaaccccuuucaucacgcacguggcccccagcacguccaccaaccugaccaugaccuuuaacaaccagcugaccacuguccacaaccagguaagugggaaacagaagggaaggagaggcggggcugcacagugugagccucaggacuuguauuuuccaucauaccuagucaggaggcaaaauuccugcugucauguucaacaacuaaacaaaguauuugcauccaagguuauuuccuuugagggacccaggcacauuuuguguugacuucuggccccauugacaggucccagaaaggacuggugagggccauucuuucugagaugguuccccuuacugcuuuccucuguccugaugugggaauagggggaagggggugcuaugauccuuuuaugccugauaugugccugguaaagaauucuagaacuggccaggcacaguggcucaugccuauaaccccagcacuuugggaguucagggugggaggaucacuuaaagccaggaaguucaagaguagccugggcaacacagugagacgccaucucuacagaaaauacaaaaaauuagcuggguaugguggugcaugccuauagucucagcuacucaggaggcagaggugagagaagugcuugagcccaggacuucagggcuacagugaacuaugauuaugucauugcacuccagccuaggggacagagugagaccccgucucaaaaaacaaagaaaaagaucauggaaacauggauuuaaucuaaaaaaaauaaagauucuagaacugggaaggacucagggaaucacccaguucaggcccuuccccucguccccacauggcuggaucuaccugaucuccuuuugggacagauaaacccuguccuuucuccgagucauggagaaaaucaguucaucagccugucaccagaaucccagcagcuggaacuaaaugggaucaggaagcuaagguuuucuucccacagauuuccaggaaauuggcagaaggagcagcuaacauacugcuugaaacuuggaugacacccaggcaauauuuauugaaugaauaaucuccaagucugagcugagacugccucuagugucuaagaaacuguaacuccuacucccaucuuucaauccuccuaguuccccuaaagaagggcccccagauuuuuguucuuaauaucaaucuggaaugaaaagacuucuguguggauguguguguaccugaaaugugaauaccuuauguccauucuuuuugaaaggucccuccugucacugaagagucacugcccccugcuuuucagccgcuccccuucccacccuuuuccccuaggccauccuuguggcacauuggccugcucaggccuagcuuuucuucccagccugccaucucccuuugcccaaauucuaggagacaccaccugguaucugcugcccucugggggccguuugcauucuugaagcucuccuuagggugaaagagcuguugggaguccgaaaacuaaccuugcccagcccuaaggcuaaagcauccauagccagaccugugagcuucuugacaaaaaucagcaugguuuuguucauuaccuccuugaagacauuuguuucucccaccagcccucaugaggcaccuggucuuaacucccuaaccccaaacuaccuguccccaucuaacaucugccccaucagguaucaaaggcaucugugaaacaggaggaaggagcaccccuccaaugcaggcgucaugucaaguggagucuccccagcaggcuguccuucccauggaugucuuucugccaggcuggagaacuguggucccugaccagacgcgggguggggggccaccgccaucuugcuggugauaugacagccagcauauccacuccaaagggugucgcaaagacucugcaaaacuaaaaggguugcucaucaaaaggcaguugucaaauaagaacacccgucuucuccacggcacugagaccauccagaucuggcuugggacuggggugaaguaggaguagcugguaacuuagugugaugcuugggccagagucguggguaagggaaaaugacaucccacaaaagcaaaggguccaagaacaggauuucuguucucuugcauuggauucuacuacucccuacuuuugaauacaucaggaaaaaaaaauuacucaggacacaccuagccuuaagcacuaaggcaugcuuucccuccacugauacuguuguuauuaaauaacaucauuacuaauagcuaacacuuauuaugugccaggcuuuacuaagcguaccauaacucuuaauccucccagcaacguugugagauagguuuuauuauuaucauuuccauuuuagaggaggaaacugaggcaccgagugauuaauucucuuacccaaggcccuugcucguucaugagaggugggcuuaggcuuugcagccagcaaucuggcuucagagucuggacucuuaaaauauacauacacagcagcauaaguaagucuuaaguaagucuuauggagguccccaaaugccuuuccuaggugaugucugcucuuuaaauccaacaagacuucuucuguucauugcugguucuaguagcuagcuuucuacaugagcuccuuggagcuguuugcccauuuagauauuuagaagcaauacaauauaugcauaguuuuauguuagaaguugaaggacauuaaacuacuuaaagaaucucuugcuaccuuuaacauauauccaguagacuaaccaaagaaccauuucccaaaugaucaugaaucuacaaucuuuuaggucucaaggaagcugggucaauaauucauaacccguuaagucucaaggcagcugacuuccucuacuuucuaaaacuuucagguuacccaguugguaacauguugaauaauaagucuucucucagcuauuccuuguuuaucauguggaucagcaacuucucuaacauuuccguggaauucuauuauuuggaccuagccuucuaccaagaauuugaauuugaguuuauagaccaagcucaaaccccuuccuucuggaaccauuugaacgucuacuacaacugcuuccaggaaucacuucuuccauuuuuggaaaaccugugucaucaauaaacuugcuuuuucacuaggcacaguggugcacaccuguaauccuagcuauuuggaaggcugaagugggaggaccacuugagucaggaguucaaguccagccugggcaacauagcaagaccccagucucugauuuuuuuuaacuuguuuuuucuuguuauuacuaucugucagcugcaagagcucuucccaguucucugugugcuccucucuggcaagugauaggcuagcuaccuuucugagagcuaaaggaggauauacagaaguagaaaacuuuuuguugcccucacaugggcuucuucaacugguccuuaagcaggguucgaaacuaggggaaaaccuuaugcaugucugauggucacacuggagacuggguccauaucaggacacaagugccauuuguccuugagucuacagagcuggaagauucagccucucaaggagcucauggucuccauggugagacaggcuguaagcaaaaauaguuuaaucaaaaugcagaauagcauguacuaggggccagguagacaaacagauuauguguuacagaaucgagaggaaggagagaccacugcaggcuggaggaaaacaccacuaagacacagccccucccucccaggagacuuuaggcuggaaagaccaacuguacuguaaggcagauuguaacaggagcugggcuagaaggcuauauuguacugugugauagcaaaggaaggagcaauucauuuccauuaauggugucugaaaggguuucacaauggggcaugugggacccaggcuaggccuuaaagcccaaaggcuuggagagaaugcuaugggucagagagcuuguaugaagggaaaggccugugcucacaguaugcuuggaaaacaaugaguaaacuaaucuuggugucagaagaguggagagcagagggagauaagucuagaagguaagguuggccaaaccagggaaaacagggcacuagaccaggcgcauaccauguucaucaagcuguaauugggauuuuggagcaggggugcugacaugcacaaaggugucuuguggaaagaaugaucuacccucugugcucaagaaggcuggaagggaaguagagaccagaacauuucuagucagggccuuauaggucccaggcaccaggaagucacaacugaaaagagucaguggauuccagggacaucaggaaggaagcagcagcaggagcaguggcuggcaagaaaguggaaccaccgagcagaaguuugggaaccuagaggauacaggugccaggacccccagcagggacacccacaggggcuaagggcuggggggagucuagauaugagcagaccauggggaauguggaggguugagggggaagaagccuccggaagagaucgcgauauggagaaaacaggaaauacaagucaugucaucugacaaaacacagacacugaugcccacauauguacacacgugucccaagcagacuaugcgacgcugcaaaagcacacccacuuuaaaauauguggcuuaaaaucagacaucugugccacucaauuucgugauuauuuucaaacaaaucaauuugcuuugcaaugaaauuuagcacaaaaucuaaguauagaaaacauauguaaaauaagacuuuguccuuuuuaucaaaugugacauccauacacacccuacuugaaauucuauuuguguccaagauaucuucgugguuucuuccuauguauucccugguccuuguaacuucuagaggcaaaaccucuuguagacagugcugaaugugaaaccacugguaaccaccuaucuugcuaaaggaucaguaugaaggcuaagauaggggaaacuggagaauuccaaaguuggaauuuauuuuccuuauacagccucauuuuucaugcaaguucagucucaagugaugucuuuuucugaaaaagaaaggcaagaggacauaaugucaauggcuuguguuugucaaagccaccuccauuucaguuaucuggacacaccagcaucuuuucuaucugccaggcuuugucacugcauaccaacaugaaugcaugggaugcagacacaaagccccaggcucaacaugucccucucccucucugcauacaucuccuguacuucucuaagcuuugcagccaucuaaggacaucuguaaacaguacugcccauaguccugagccccuccucggcccugcucuccgccuguugcaugugcuccugugccaagcucuggguacugagaccauaguccuuuagggccugcaagagccucccccuggauuuguccucccacauguggacugcacccaccaggcccgaggggagugugagcagagcuuggacgugcaggcuggcagguccaggcacccagagcucaucauguugugggauggaauggggcuugggcagagagaaggagggcaagguccagcucucucccugucaccaugugucagcacagaacccaaggaaucccauaguccucaacucacgccuggucuucccgguuauugggaagguguauuugucaaaaugaaaaggcagaacauuuuauuaaacaguuuucuagccuaauuuuuagccuuuucagcauuuagacaugguagcaggcauccguguguccucuugucugggccucacaaaugccaggagcaagucugaaugugaacaccaaggugacugucucccauguuuucagggaccugcuuuucccugcgacuuucaaucguguuuccacuccucucugcuuuugccuuucugcucuuaguuuuuguuuguuuguucuucuuugaguucauuuauuugauuuagauucgugucucccaacaugccaccucccucauuuuuuauuuuuguuuauuuuuguuuaauccccaucacuccuuuaggcucccuccucuaccagugccacuauuuccuuagccaaucccgaagucuccauacuaaacuacccaucuacacucuaccagcccucagcggcauccauggcugcaguggcccagcggagcaugccccugcagacaggaacagcccagauuugugcccggccugacccguuccagcaagcucucaucguguguccccccggcuuccaagguaagauugagcagccacagccucucaccugcuucuuacagaacggccucuggggcuccggcaccugcaguuuucugucacgcucauuuucauggagaaaggcccuccucauuucuuccagugagagcgcugguaucacugaacuagagggcuccucuccuacuguggccaaccuagaaacaauagggcuuaugccucagcaccaagucaauccuuugugacucucacaccugccagggacugugucccuggccagcugucuguaaauaaguacauaguuugugcuuucauuguuaugcugaugucagcucuugcuuuuccucgcaugaaauauccucuguguggguuaucuguagaaaacugccaaucucugacagccgacauagucccagcucccaugaagaauauccaucagucugaaaaguacuucccugggaccccuccucaaaacaauucuuuggccaugaccccagcacuccucuccuguagacucuaagaagcuagacuguguacuuuguuacaauuuacccagaaagcuuaagaauuuauuuuugcaagccucaugguguaaacugugugguuacagucaaugcaauuccaaauggguucauacaucuccccaacaccccucauuuugacauacacagguacaucuugauggucagaagcccuuguuuuccuguuguaaucugcgagcauaucuguccuacuuuuggccuuacagccuccuuaaucugaccuucuagccuuugaagacauucaagauuucaggaggaguuuuguuuuuuaauuuguuagaagccaaaggggagacuuccaaggaccaggcaauaccugguuguugucagugaccagugcaaagggaagcagaaaguugacauaacugcccaggaagguucuuuucauccagcuguucacagcgucucagcuaacccuucucucccucacacugucuggaacaggcuugcaggccucucccucuaagcacgcuggcuacucggugcgaauggaaaaugcaguucccaucgucacucaagccccaggagcucagccucuucagauccaaccaggucugcuugcccagguaauucuuucuccuuuauuauuacugguauuaccauuaccuguguuaauguuguucacaaaagauauauaucuccacucccucucucccuaguaaugaguuaggugcuucuagucauuggaauguaucuguaauauucuaaaugguccccaagugaauuaccuuccuaaguaucugcuuacaauuccaagaagaaauuuagauacagggagagucuggggaaauuauuauuauuauaucuuugaaaugcaaauuaaucugggauaccuagguuuuaauccuaacugcuaguaacuugucuaugaccuaaggcaagucaguuaauaucucuuugccucaaauuucuuucuuguaaaauagaaaugaguuuuuagagccaaaaggagccuuggugauuauccucucauuuuauaguugaaaaaccaggcucaugguuacuguaagcuggaaccuucuaucucuguauccauguaggugcucugaugguagaaugagauggcagagaugaaaaaugguugaaaauuuguaaaguguuauguaaacguaagguaacaguagugaugcaaugauaacaguaacaauccuuaaugacacucgaacccugauaacaaauacaucaucauuauaccagggcacuuuacaguuguuaauugauuuaauccccacaaugccacaguauuugucuccauuugacaaauagggaaacugaagcagaauaacuugcucaucagagucacacaacaauuagguaacagaaccaggacacacacccaguaagucugaugccagcaucuguauuucaaccaccaagcuauacuacuucuguauaaucauuucuacuauugaguagcuugaccuaaauguuauuaguuuagaagcagcuuuauuuuuaaauaagguagguucacaaaggcuuuucccaaagacacuauuuguccugucuuguuaaauggaaguuguuuuuguuguuguuuaauuuuuaauuuaaaaaauuaaaaauuuaauuuuuauguaaucaaauugcguagguuuguucugugcucuucuauuccauuggcuucucuaauauccuguugucuuaaccauuguaacuuuagucugucuugguaucuaguagggaagcccuguucccagagaguucuucaaauuuuccuugucuguucuugucccuucauguuuuuaagugaauuuuaacaucacucuuucauaagaauuuuaguuacagaaaccaaaaaucugcuuuauauuuacuggauauacauugaauuuauauuuacuucaggaacaacugacaucuuuaaacguguaagucauuuuuauccaugaacaugguauaacacucuguaaugggugugguggugcacaccuguagucccaggccuguagucucagcuacucaggaggcugagaugagaggaucacuugagcccaggaguucaaggccagccugggcaacauagugagaccccaucucuacaaaaaaaaauuaaaaauuagcugggcaugguggcacaugccugcagucccagauacacaggaggcugaggcaaaaggaucacuugagcccaggaguuugaagcugcagugagcuaugaucacaucauugcacuccagggugggcaacaggguacgacccugucuguaaagaaaaaaaaaaauuaauagaaacacuuuaucauguuuaaguuuuguaaugaauauugaauuauaucaaauguucuuucuguaucuauuaagacacucauaugcuuuuuguuccuuaaucuacuaaugggacaaguuauauuaauauauuuuguaauauuaaacuacccuuuuauuuaugauauaaacuccauuugcucaugugcuugauaugauaugcuuuuuaauauuggauucaguuuguaaguacuauaguuaguauuuuuauaucuauguucauaggugaaaaauggcauauaauuucccuuuuuauaaaauccuuaucugauuugaguacaagguuacaccaggcucauaaaauaucuucuucuuguuguuacccacacgaguggguuuggucacuugacagguaccaacccaaugaccacagacaaggauuuagcaaggggauuguauuacuuguaacaaguaaggagaacacuggagauaguucccaaagcagugucucugagcaaagggcugggucagguuuuauaagcauaggguaaugaggcaugaucugauuggaucuugcaacgaauugauaucagaggcaugaucugacuggauccugccaugcagugaugccacagcucgaucugauuggauccuggauccugccaugugguauccauuucuaaauuccauucacucgccucaauccaggcacuuagguucugccuguuguuacauaccugguucaucugggcaugcucagguuaugugaccuuuaaccuguggauccauggcaaaugaaaaacaacucacaacuuuguuacauaaaaguugaaccagacugcugugguuacauuauuaucuauucuguuuuccggaacaguuuguuuaagaucgauaugaaguauucuucaucucugugcuuagguccagaaugacacugugcaguugaccacuaacaccagugacugguagcacacaaaguuuugucuuauugaaaguuuguaaacagagaacuuuuuguauuuaaaacaggccuucucuucguuccucucucuccaauggguccuuguagcuuccuuuuauuugcauaguucaguagcggggaguucagaaaaggccaagauagaucagagaaagaacuacagcucaguccaggggcaaaaaagcuucuucauacuuuaucugaguggcaaaaauccacaccagucucccagugcuccgccuuugugagcccaaaucuacagaacucacgugugcuuuuaaaggauaauuacagaucuuuuuuauguuugcacacuuaacccuaguaagccaggagccaucucugaaagaaauaauaauuagcauuucuuauuagccaaaauagggauucuucguuguucaguuugguggaaccaguagacucagcagucagaauuuguuucaguccuuuaaucguagcaggggagaacuuuaccuuuugcuuccuugaaagagagucccuagaguguuguaaaucuccaaguagauuuaaccuaaagcuguaauuaggaaagugaacaaaaaauacguguguaaggauuuuaauugcuacuguguuuauaacugagauuguuggaagaaacuugaauguucgucaguaagggauugguuaaauaaguugaugcacacguaaaauggaacaccauguagccauuaaaagaacaugguagaccuuugugucuugacaugcagagauuucuaagauauauuaagugaaaaaaauccugcccuauccaguaucguguugugucuuuuugucaguugcuuuuuauuuuucucucugcuugucacuuaauccaugccaauauguuagccuguugagaugggcucucuccuagauauuuuuaaacauucccuucaaaggacaaaaauaaguuaauuuauaaaacucuuaugguggcuauaaaaaagcacaauuaagcauuuaaacugaaggcuucguuuuucuacaguuaaauuucuaggcaccaggcagaggcauuccaaauccuauuauuugacauaaauguauucaaaaaguugacauuguucuuuuucucuaaauacugaaaaucuuuuaaaggauuuuacuuaugaacacuuagagauggagucuuugaauccacuccucauguuaauuucauuuucuuugcccuuuuccuccccaccucccagcagcaucacauaaaacuuucagggaaacaggccucuguggggcacccagaggaugugugcauggcagguggaaaugguaaucauucugcuuauguuagugauaugggagugaucuuuguggaucaccuugcaacaaaagcuuuuuugguacugccuaaaaggagcugucaacuccauccucccaagccccaugccacagcuagcaucuuggccaccaacagaaauugugaaugaguagguaauaguggagagaugggaagcacaguucuugauugagacaguauugaauuuaucugacuugucaaaugucaggaucuaaaaucuccuuugacuagcaggguuagagaaaucacuguagacuccacccuuccaugaaguguuuuguguucuucuagccaaucaaaucauaucaccugaaccucuuuauuuuuuacuuauuuacuuuauuucuugggcucauauuugaccaacugagccuuuaaauguuucccugaaaacaaacuguuggcuugaacccuuuaaacuguucgaaauacaaaauuuuaauguuucucacucaaaaguuccucugauaacauuuucagcaaccagucuuuccaaccauuguccugcugucugccugucucuugacuggcaccugauauucuuagagaauaaggaagacuuguucaugccaccuuuaugcaguuaccaccaaugccugauccugaauaggggccauuauuuuuguguauuaucaacacaaggagagguguauauuggcugaaagcaugggcacuggaauuagguugcccacauucagauggcugccucaccacuuacuggcuauauggcuuuggggaaguuauuuuugaaauuuaaauuuaauuccuuuucaaaguaauacauguacauaauuuuuaaaaguuaauuaauaccauaaacuuauaggaaaauuauaguccucugcucuaucccauccuuaaugucuccuccccauaacaauauauauaguuacauuauauauguauauauguauauauauacacauauauauuaucccuguuauauauauauuuuauauauauaauauauauuaucccuaaaaguuuuuauuuauacacacacacacacacacacacacacacacacacguauuuuuuugagacauagccuugcucugccaccaggcuggagugcaguggugcaaucucagcucacuguaaccuccgccuccuggguucaagcaauucucgugccucagccucccgaguagcugggauuacaggcaugugccaccacgccccggcuaauuuuuuuuuguauuuuuaguagagacuagguuucaauguguuggccaggcuggucucaaacuccuggcaucaagugauccacccgccuuggccucccaaagugcugggauuacaggugugagccacugugcccuggccauaacgauaauuuuuaacuuaacuguuuaaucuguucuuuaacucuguguuucuaaauaauaugcuuagacugcuuuuuauggauuuuuuuuuccauuuuagguauuauccauugacuuccuauuauggaagaugaagauuuagcuuucuaacccacugccauccccauaacacacacaauuucucuccuguuccuccuuucacucacucuuuucuccuauuccucccacauaauuuugauucaacuacuuuguaauauuuacauaauuaucaauauuauauaauauuauucuuaguugagccuuauaauauacugugauuauguuuucuuucuaacacaucuuuuuguuuuuccuggaguuaaugauugccucauuuuucccauuggguuaguuuucuguauaucucauuauacagccccaaacccuuccagagcuauaaaagguuuguauguuugauguguugauguguuugagcacacugaucucaguauguuguuuuuucuuucucugaaagcgacuuucuccucauccacaguggacucacauuucaugacuacaugccuucuuuugggucuuuuuucuuacauuguccugaacacccuauuugcccuuuuaaucuggauuuuuuuuuuccuuugauaauuucuuccccuccauuuucucuguuucuccuuugcagaauucuuauuaauugaguguugguacuucuaaauugaucuuccgauuuucuuaucuuuuuuuccccucuauuuccuauauauccucugucugcacuacuuucuaagagauuucuuaaacuuuuuugaaaccuccuuuugaaugguuaauuucuguuguuguaguucucauuuccaagaguuuguucucugcucccuccauaccaaaaaagagcauguucucugaauauagauauugauucuuuauaugaucuuguuucauggauauauuuuuuaacucuguaaaggcauuaauuauagauuuuagaaaauuuucuucugauucccacacuguuuuuguuuccucuuucuuuuguuugcuuauuuuauucucuuucagguuagaggcuuccuuuacugucuggugaucauuagcuauucauuccuauuuaagacuaaagcacuaaaaaacuaauuggaaaccuggaggguaggggagagacuauugaaugugggcuucucuauagacugaaaagaggcaaguccagcauuuucacugacagauccccugauccuuaaaugucauaucuguaguuauuuucucuuggacuagucauuuccccuagagagaauugucuagccuccugcuuuggggcggggaguggagggugguauaagcauguacaccaaggaucugggaacuaaggggaaaugaagaccugaucuuagauuccuucagucuguuaauucacuuaguaauuguccaucaguuuuucagcuucuaaaauuuuauucauggugauugccucucuccuacucucuuugcccuuaugaaucuguauuuuuuauuccuuuacuaucauuuuaguugaguguaaagaaggcaauaaauguauauguuuaauuuaccauauuucagggcaaguuauuaauauuauuaaccucucugugucucaauuuauuaaucuuagaaauggaagaaaauaacagucccuaccucacagaacugguauuaagaagucagaaaaaagaaguagucagaaacucauuuaugacuuaacucuguguuuggcacacaauauccauuaagaaauguucacuucauucuuguuaguaguaauaaauuauaaaaaugucugaugaagcguugucacaaaugagccaagcauaucaaucagugaaauaagucaaaaauagucuuucuacccuaucucuuugagguaaaauguuaauauccauuucagggaaauagaagaaaaaugauaaccuuagcuugauaucaagauuuauuuuuuaaaugacauuaguuaaaacuaaugcuuuucaugagcucugaaaugaguuccaauuggcuaagucaguagaaaccuuacugcaaacgaaauuguuauuuauuuaauauuuggaauuugcaacuguuuuaaucaauuaaauuauguuuccgcuuucugugaguuaaguaaaccugaaauacaauuaacuguaguuaauagcguugguagaguugcuucuuucauuuuaucaacagauauuaagcacucaugguaugcgcauggucccugagcuucugccuauaucaaaagcaaacaaacaguaucaaaaacaucuaagagauugcacugggccucaggugcaacaugaaaauaacggaacaggugaacugguccacucagcucucaaaugugauucucucauuuuuauaagcgucaauguuuuuuaggcccugacucaaaucuguaauccauuuccagaauugcguauuuguaccuauaaaacacccacacugagcacaugcacaguuugugaagcacugcauucgauaaauuacccaauguuagucacauccacucugauagaaagagagauggcuaagauaucaaaccuuuaaauauuugaucuguccaaaagguauuuuaccuuagugacuaugcuuuaaguguccaacuuuaggcagugguauucagucugaaucaucuaaugaccaaagacaagcagaauagugaucauggauuaaaagagcuuaaaacacaacauacacacacacacacacacacacacacaccagugaaucuaucaaggaagaaucacaaacguucauuuuagauuucuuagaaaaauuagguucaagcagugacuuccgccucucucucauuuuugcuuugagaaaucaaaguaauucucaauuaagcuauagucacagcuaagaauuuuacuucauacuugcuugcucucagauguagguuccagauauuuggugaucuuagaauuguguaaacuuagauucagaagauaacacaagcuggaaccuagauucuaauugauaaaucaaagguaaaauguuaaauaaaggauacuaggcagaaagcuucuugagggccagcggucacccucaucuagcucaacucaacuacccuaauccccuguacauaguugugggacagaacaaguaaauaaauaaacuuucagaaacuucaagcauugcucauuagagcaaauuuauaaagaaaucauucuucaacaugaaugaaucccuuccauacagcugugucccuguacuuaauuaucuucuacuuaguucauauauguucuuuuuuuuuuuuuuuuuuuuuuuuuugagacggagucucgcucugucgcccaggcuggagugcaguggcgccaucucggcucacuucuucaagcuccaccucccagguucaugccauucuccugccuuagccucccaaguagcugggacuacaggugcccgcuaccacgcccagcuaauuuuuuguauuuuuaguagagaugggguuucacuguguuagccaggauggucuggaucuccugaccucgugauccgcucuccucagccucccaaagugcuaggauuacaggcgugagccacugcacccggccuguauguucauuguuuaucuccccuuacuuuaguuuuugaggccagagaccaggcccucacucucacacccaugagaaugucuagcacaaccccaggcacagaauaaguguggguucaugcaaaucaauuaugugauuagcaaacauggucauugcacauguccuguguucuacagcaggcuuggccaagugggacccagcagauccugcuucccccagcauggcagcaacugacuggaguggccacccacacaucagugcagcaugccaccgugauucccgagaccauggcaggcacccagcagcuggcggacuggagguaagcaggaaaccccucuagggugagugggugugucugggaugggaggcacguccacugccaacacagggcugccaggcuggccuguacuucaauuccccgguuuguagagagcuuuuuaaagcuucuaaaaauauuguguggacuaugagugcaggguaacaagaagcaauuuuuaaauaauauaccaggauacaagaaaaucaguuucauuaauuuaugcuugguugucauuuccacccagaauucaguuaugucauuuacucaucaguguaauucaccagacuugguucuggaugauguuugguaguuucucagaauuaaauucuacguucagaaaacaaaggucugucaccagugaaagaaugcagaagaggguccccaaagcccuaagcaauucuagaaaguguucugaagauguuugagacggggguacucuggagucuaucugaccucccacgggauggcuugacagaaugggguuuauuuggaaggguaaaugcuggcauguuugcugagugugccucuucaguuaauagucauaucuuacagaucagagucuacuucccacacaccccagaggcguccaccugacugccugccagcacagcauacccccugcaucuguuuccagaacucuacccugcccaacucaugauuuccucacagaugcgcuccucuguuauuuuuauggcuagauacccuuguaccuucccccgaacaccaccacaauggccccuucaccagugcagagccagauggcaacccuccaaguuguccccaacuccucauggcccuauugggcuaucucucauucugcacgaauaucaggacaggucacuccccucaacccccugacagccuccauaucacacagggaaccucccacaguucuuauucugaccuacaaggcuauugugaauuaagaucucuccgagaaaagaagaaagguggugauauaagcccccagucagaccccuacugcagcuuccuccauuccuccaguucauuuucugcccaguacagaguaccugggcccuuccccacagucccacucacuucccuucuggcaacgcccucaugccaccacuccagccugggcaacagagugagacuccaucucaaaccauguagagcugaguucaauccuggcucugcaugaccuggggcaaguuaaccuuuaugcaccucaguuucuucuucaauaaaguggggauaguaaugccugcuucacaggauuguugggagguuuaaaguaagauaaaauacaaagcacuuggccuauauuuaacaugcaccaucgcagugcccgguacaugacaggcauuaaauaaaccugucaucuucccuccccacuaucacaucggcccaugcucagcaagauugccuuuccuccuccagcuccuuaggagcagccgaguggaaagcugucugaccaacuggguuuuuuuuuuucccucgccccuuuuucuccuaaaagaccacacacaugacauauuccuuuuuuucccuuuugucuuucagcauuuauagcucaucuaauuucagaaauacacauacacuuacuaauuccuacauauuuucuuauuccuccucccuccuuccuuucguuuugacaucucuuaccuagugaccacaggagacaucuaaagccagcauacucucuuccuggucucucuccauuucaugugugagccaaagaacaucuauuauuguggcuaacaaacagaaguaccagugcuaggccugacucaaaagagaaagagugccaccugucuacaggagaaagagcuacaacaaaauaaagaagccauaauaucaguuucuuggucggaugcaguggcucacgucuguaaucccagcacuuugggaagccaaggcaggcagaucaccugaggucaggaguuugagaccagccuggucagcauggcgaaaccccgccucuacuaaaaauacaaaaauuagcugggcguggcagugcacgccuguaaucccagcuacucgggaggcugaggcaggagaaucgcuugaacccaggaggcagagguugcagugagccgagaucgcaccacugcacuccagccugggcaacagacugagacuccaucucaaaaaaaaaaaaaaaaaaaaagaagccauaauaugaguuucuaaaguccauguaaaugcccaaaaggcgcuaucaaaaucccuacaaaaguguucaucuacuucuuuuuuccuguucauccuuuuccccauguugcaacaauagguucuuauaauuuucuaaaauucaaaugaauuauccuuuagcuuugaauuuuauuauguguuaaaugagcucuuaugggccaaucucugagucagucaccaccuuuaacauuucugugggaaaacaaggcuuuaagcuucauacaacccaaauuauaagaauugugaaacauaacccguuuuuaggaugagggcugccaguauuucuaucaugacuguuauuaauuuugauuuaauaccaacuuuauacuugucuagucaaccuucaguuaaucuaauuauucauucagcaagcguguaauuaauugaucagcugcuauaugccugagcauuguuccagccacugagggaauucaaaagaacauuaacacuuccuaacaccagaagcauauggcucccaggcuucaaaguuuguuuuucacguaaaguauaauuucuucuuuaauaaaaugguauugcuaagauauccugccuacgucacagaguggaauaaaauaacccauugaagacacuguguaaauuccgcuuuuucuucauuuaaaaauuuuuuuuauaaaauuaaggugaaacuuuuuuuuuuuuuuugagacagugucucgcucugucacccaggcuggagugcaguggcacaaucucggcucaugcaaccucugccucccaggcuuaagugauccugccaccucagccucccgaguagcugggcccauaggugcaccccaccaugcccagcuaauuuuuuguauuucugguagaaaggggguuuugccauguugcccaggcuggucucaaacucuugagcucaagccgucugcccuccucggucucccagagugcugggauuacaggugugagccaccauaccuggccuguaaauucuaaaauagaauauuguucaggauaaacaccuaggugcucagggacuuuaaaaguuggagggaauauuuaucuccagucccuagaacuuaaaaacuuggagccgguguacuuggcauucuucccacuugaaaguccucuuucucacucacagccaguuauguuucaccuacuccuuaugaguagaagaaacccacccguugagcacacauggccaggcucaucccuucagcagcugcacagcuagugagauaaccaacugcagucagcguuuaauuggggaggaagcuugaucuuauagaggagcucuacuuuuagaacaccucuaaggcaccuuguugucccgguugccuuucagaaauacgcaugcucacggaagccauuauaaucccaucaugcagcagccugcacuauugaccggucaugugacccuuccagcagcacagcccuuaaauguggguguggcccacgugaugcggcagcagccaaccagcaccaccuccucccggaagaguaagcagcaccagucaucugugagguagguggugagagccacccuagggaagagaaaucccaggggaugugagugcuaaagaaauguaguuuagggaguaucagcacccacucugaacaugggacaguugcaugggaugggggcacuccucuuccugcagugacuagcaaaacauccuguaccaccugguuuggccuaggguuugcaggaagcacuugguuuaagaccgugguaauaguguagggauggaugcaauggaaucuugcagugggcaagagagauugggcucaacuccauacagcgugggcgagugaaaauuuauagccaaggcaggguuggggggugucgguggaugggaaguuacuaagaggaagcaucagggguaagggagauucugccuaaacugaccuaacaggauucuugcuaaugacaggcccgggugaucagauaucacaccuggaggaugaggaaccucaucagauaucgagggugaucagauaucagggaugguggguucuugcuaaacugacuuagcaagguuuuuugccaaaaguagauuguacagcagagugcacaguuagaccuaggagaagguucacaagccugacuaaaguuuggugaagcaaauuaucuuuugucacuuucuacuugucuggagaacacucagcuucaccugaaguuucauuuuggaaacaauuuaccauaauaauuguuuuaaaauauuuuaaaauguugaaguuguuuaaaaauguuuuaaaaaauacuaaagaaaugugcuuucuuuguaucuaagaucagaaguuuaacugauuuagcaccuugcuuaaauagaagcaauagcuuguuuaaucccagacacuaaccagcagaacacaaaucuuucccauucccuuuaaauccauucucaucucaaugaacacuuugaaaaaaucaaggucaacaaaaggcugcaugcuguaugauuccaucuauauggcauuucggaaaaggcaaaacauagagacagagauccgauuagggcuugccagagaccaguaggagaggaggagauugacugcgaagaauccugaggggaaaagcucuaagucuggauuguaggggggguuaugacugugcauuugucaaaacucaucaaacacuucaaagggagaaauguugcuauaugucaguuauaccuuaauaaaccugacuuuuuaaaaaauggagauuuccaagccagagagagagagagagaucgugugacuacaggauugcuccugcaucucuuccuaauggcacagcuuugaggugcuuaauugcuuauuugcgauaagucaaucaagagaaaucugguauacaaaaugucuagugauuuugguuuucugcuuccucauauaagcagauaccagaaacuaggccuuuuucuuuucauucuuauucaaaaauucauccaagggcugaaguugucauccuccaagauuccuuauuuggguauuucugacaacucagggaaauuuaucucagaucauuggcagcuuuccagaacgcuuuuguuuggcagccuugugacagcucacccaugucauuauuagacuggguggcaacaaaguccacugucucaauccucaugggcugucaugcccagcaaggucacauggagcacuacucugucccaggacugagcuuagcaucuuugugguucaccuuggcugaguaggggcaguaagaacccuuagccucccaaccuguuuagcaagucccuccuuuuuguuuacucaccacccagcugacuucaugaagccucauugccaguacauuucaagaucgauauaauuauagugaaagguauguauuugcuuauuuuuaagaccaaugccuuagcaaaacagucugaaagaccagaagucucucccuuguuggugauguggccaggcauacuuuuccuuaacaaugccaaguggagauacuaaaaccauugguagugaaaaacauaaucuuaaaauuguaauguauuagcaacgacaaauacauagguuuauaguaaguacaaacaaugguacaaucauaucagugaaacauauuaccagucccuagaaggagcaagcaauguaucuggcacuagcuagauaggaaaauaaauccaccuuuauugaauuauuuucauuuuacugccaucccuuuagcuagaaggugcuagaaucucuaaagacauauaaaagucugaguuucauuauacauugcuguuagucucucacugcauagauacuacagguugagcaucccuaauccagaacuccaaaauugucccaaauucggaacuuuuugaggauugacaugaugccguaaguggaaaauuccacaccugacauguggucucagucaaaacuuuguuucauccagaaaauuauuauaaaauaauguauaaaaugaccucaggcuauguguauaagguguauaugaaacaaaagaauuuuguguuuagacuuggguuucauccccaauauaucucauuauguauaugcaaauauuccaaaaucugaaaacaaaaauccgaaacacuucuggaccaagcauuucagguaaaagauguucacccugugccagagucagugaggaucuaauagggaggggagaaaguauuuuuccccuaaaguuaccaaaaaucacacugguuaauuuaguaaggaauuucaaguugaucaaaauuaagauuaaaaguucucuuuuuaagagugcuuuuucaaaacucuugcacuuuuccaaauuuucuauuacaauuuagacuaaugcgccucccaugaggcuccacgaggcaaaauccagaaaaaucauuuuuaagguuuuuagcaauuauaugcacacaaauacuuugauggucauguucuuuuuccagaggaggaaagaaggaaaacugaaccacuggucaccaagguuagguccuuuagauccugaaacucuuaaggaaugaauguuucaguagaauaaccauuagcaaggaaaccaaagcuugauguggcaaacaccaauucuuccaccacccccaaaacaagacuuaaguaccuuugaagggaugacacaagacagagcucagaaguagggccuugacccugaaggcgaggggguguguuggggcaaacacagcuggaauccuggcaugacaucugcuccuacaagaccuguagagccuggggcacaagagcccccucccugcuccgaaagcccuggcugcucccuuuguccugcugggagcaggcauguagauccaaaccagagcccagagaaggccuguguagccgcucacugaaugaucccuuucccagucacagauggaggcucauugggcagccacugacguguuuuacagagauuuggcaaagcagguguuucuaggcaauugggcuccuucgaaggaguuguggggccugaccuuccucugugugagagugugguuuucucauuacagaaaugucuccaccugugagguguccuccucucaggccaucagcuccccacagcgauccaagcgugucaaggagaacacaccuccccgcugugccauggugcacaguagcccggccugcagcaccucggucaccuguggguggggcgacguggccuccagcaccacccgggaacggcagcggcagacaauugucauucccgacacucccagccccacggucagcgucaucaccaucagcagugacacggacgaggaggaggaacagaaacacgcccccaccaggugaggcagugccaccuuagccuuccaggaaggagccgggaggguuugcauugugugcagaucugaccaucuuccaucaucaaacauaaggaucccucucuucugacccuuacaguuugguuuugccaucuacugugguccuaaaguuauuucaagggaaugucaaacagguuuuccauaauuguuuaaaaccaaaauaaugucgaaucauguuggucuuaaaagauaauuauaggcccuauacauuuggggaacuugagaccauaaaaaucgggcacacaaugccaguguauuucauccucuguaaguuuaaaagucucugccucaagcuagugaauuuauucccaguuggucaggauauuucucuaacauugccuuggcucacucagaauacgaaguaauuguccaauuaaucagaaauuucccugugucugauuaaccuaaucuuucaaaacugccaguuggcucuucacccagagagcauuacuguuuaucccaaaguaauaauaauucauuuuagucuuugugugcuuccuggggagagggaagaaaucuuuauuauauuuacaaaacuacuaacccuggcgccagagccucuuuuucuguacugcccagccagacuucagcaaaaugugguuuuuguuugggccacucagcucagguucugagcaaccccucuagaacaguuggccuccuggccuucugcaucccuagaguguggccuuguagagcccaaaaucucauggccccacccugcuggcuccuuugcacuggaaccgagagccagggaagggaggccugccccucccaggcccagcgcugccagucagcacgcauccugcagcuggauaugaagccuaauucacaauuaggcucgaauuauuaauuccugauuggaugcaauguaacuaauuaguaaucacaaauccuuugauuagauaauaaauucucacauuugaaaucauuacaaaauguauagauagacugaugaaaacauucucauuauaacuauuccugcauaggacguucccuucccucuuuauaaugaaguccagugguuuuaguuuguuucugggugggguuaguacaugucucauucaaguguccucuucccaccaauuagguacagccuaauugucauuguauuucagagaagaauguaguggagcacuuguggccguagcauugugccaggugucagaggggacccaggucaaagguccaggcauagcacugaauacuuuggcagcccaggacugccuuuuacuccccaucugccuaguccagaaauggccucaggucccuuuuugaugacagccucaaguugagugaaugguccauucuccgcagugcccccacaccaccacccaggaauacugucgguucaguccucacgugggcucagcagucucuucacaaaggggacggcccugcccagccccagacugaagccuggccuugagcagccacccacacguggguagccuuggucaucagaaggguccagcagccuugcccggcccuuugccacaaauggaaaaaagcaaaagcaauuuaaaaucugacaaucagcuagauuggaaucucauuccuaacguaugagaucugaguugacacagacucucaacaucugugcccaggagagaauugaauagcgugucugagaaggaggaugagagagccgucucuccaccagucagagagcugacagggcugagaguggaacgcaaagccagagcauguccgugccucugcggcagccccuaaggcccccagaaagaaaugauagaaccgagaggcugggcagcagaugaggaccuucaugggaacaacucaaagaaaccugggagagagagccaggugcacaggugaggggcagccacagacagacaguagcaguggcuacugagucccacagcauccugcagugaagaguggcggggacugccagccugccagggucgugaaaaugugccggacacaugaggcugaauagggaagcugcagacugaggcuagggagucauccaaaaggcuucagcuguccacaguugugacugggagcucccagaauaauguuuucuagagagaucuaauggcaagugccuuagaaaaugucuuugcacucaagaagguaggaaaguguauuugagucugaguaggauaaaacagaaaccaguagcuguuuuauuuauagagaaaccacuguguaacugugaucacauuauugugacuacauuuugggaucagaaaaaaaaaauguggggaaauaugauuacuuguucuuagaagucagaauuaucauaaaauuuaacacagucaguauuuauuggccccacuaguguaagauauuaugcugggaacugcagguguuacauaaauaagguagacaguuuguguccucaugagguuugcaggguaauaaacaagacgaaacacauacaaaucauuauaacacaaaacacagugucagucccauaaaaaugagcaaaguaccaugggaacucaaagggaaaauagcuuaagggaauagcaggggaggggggcuuugaaggccaaaggucuggacagguccacacaguagaggaggugcgguugcaaauucaagugaggugauugauggggcagagccuccaaggcaagcgaacaggaucaagaccccugugcaggagcuuauccaaaaggggcuucaggauggaaaggggguuggggagggaucuccccuuacauggggguggucagcuuugucaggagauacugaggggcucaaggggaagcaucaguccugggaaaacaaggaugcacccccaagugcagccacauggaggggucaccuggucccucuccagcugaagagcuuccccagcccuucugugucccagcuggagcgauggagaccuucccuccuacacauugaucauccuuguucucgagccugauuucuccaugcugugggcauguugauucccaccuucuguguucccagccucguuuucuauuugcuacuuaccccagugccaguccuguaacuuugccuaaaaugcugguuaauuccccuaacauggcucagccucagcuuggcagccagagucaggcagccgaugaccuucagagggauggcagugccuccaccaccaaaggggcuuuuagaccugauugagggugucacuaaaccucuaggacuagaugauauagccuagaauuuuuaaaagaaagccaaugcaaaaucauuauuccugaccccacguauguggcacuguugguugcacagcagauggcuggccagcagcuccacucguaagaacuccagggcauguuggaggcagaugcugggagacacugagcuaaagacaggagaaucauagcaaacaugcacuggguguuccacccgcacuagcuccuccaucauuugauggggcaugcaaggcugauauuucuauucccauuugauagaugaagaaacugaggcucaggaaagguaggugacucacccaaauugauacagguucuaaauagcagaauugggacucaggugccaugcucuugaagaaaugucaaacuuaauaacuggcaaaaauaacugauuucagucauucauucaaugaauacagauucuauccugcucccuccugugacuaccacuaugccacugugugcaggucaccaugccagggccauagggagucuagaguauuguccacugagcccccucuuggugcugggcguuugucagagugcuggagccauggcacugagaagggcggagucagcucuuuuuaaaguaagaagggcagggaagagccagggaacuccuuuucagugaauuacuguuggacuaggggacucuggucauggcuagagaauuggccaaaagauaagacaaacagauauuguucugggucccccaggauuaaguaguagaacuggucuucuuuuaaauauuuauagacaauuucgauuagaaaagcauuuaauugucuacacauacugaacaagccaucuuuucucuccuggacucucuugauccacgucuccugauccagaccccccugcuaucuuuaccuuguguugaaauggucuuguaaaggcuguagcauacaaccuuuagucaugaggguaauuucuuuuuuuauuuuuguaagaacuagagacagugucucacuauguugcccaggcuggucuugaacucccaggcucaagcaguucuccugccuuggccucccaaagugcugggauuacaggugugagccuccaugccuggccgagaguaauuuuuuaaguguguaaaccaaagugguucacaucaacugaucauauagaaaugauuuuguccagcuccauuauucauucacgcauucacucauucaguuaccuggauauuucugguagguggguuguucugcuuaggucaucaagugucuccugcaggcugcacuucacugugccuguguaagcagccacuguuucagccgacguuaccaaaaaugaaaacuuuaagaaaauugauucauaaauaucauucaguauuuuagauauaaaaacaguuacuuagcucacucuuaacauguuuauauauaaaaaaaauuugacccgaaauguuuuccuuguuuauacuaaguugaaagucuagagaaaucauuauagauaaagcaagguuagaaaacugauaaacugcagcucaaauuacuuuggccugaaaaauuaacauccacuuaacagagggagcaaaaaccacacacacucauuuauuauugcaugggcaaaaagcccaaagugggauuagccuccauugcuaccuauaaccauguagcuugcuccauccugccauugguugagaagcugcuacagccagccuccugccaugcucauggagacgugggaaucaggcuugagugaaggaacaaaggaacccagacacacagugccauuugaaggaacuuuggugucucuccauuuugaguacaauacauccccaguugaaaaauauuucagucaugugacucaucucaagaggugaugguaggaucuuuuguccagcugacuucgccacacccucuuuacagggcuccauuuaagacacuccagugggcugaguagaguggcucagggguguauuuugaagaagagacacuucacccuacuguccccagcugcugucacauuacaaagcugucacugauaugccacagcuuccugguuugcuccuugcuuuccacagggaagaaggaggaagagggguggcagaggguuggauaccauagggcagagcggugcucaguggauagacugaaggugaugaggaaagaugagucaaaacucccaggccaguugggaagagagagacuggacuucagaagaagauggaaggagagcaaacacuuccuuccgcugcaucugaugggacaaggacgaggugacuacucauggcuacuucugcgacccuguuucugauuucucuagaaaguagucauguaaaaaugaucuuaagggugauauauguguauuuauauacacacacguguagacauagacauagacauaaauaugcagauaauacaauuugaaaggaggagccaggcaugguggcucacaccuggaaucccagcacuuggggaggccaaggugccaggaucacuugaggccaagaguuugagaccaaccugggcaauauagcaagacccugucucuacaaaaaauuuuuuuaaauuccccaggcacagugguacgugccuguagucccagcuacuugggaagcugagaugggaggauugcuuccgcccaggaguucgaggcugcaaugagcuaugcucauaacacgauacugcagucuggaugacagagugagacccugucucuaaaaauaauaauaauaauuugaauggaauguaugugccauauuaaaaugaagauuuuuuuuuucucucuaaugacucuaagucagcagcuaucaggaaggagcauacuggucuggaggcacacuggaauuaccagcgugagccacugugcccagccaaaaguagucauauucuuuaccacaucaucuugccaugaugauuaaaggagauaaacauauaaagcacuuuaagcuguaguuaguaugcauccaauaaauguuaccuguacuuaauaaucagcaucauaguaauagaacacauagcauugacuaugaaaucagaaggguaaaagaaguuauuggaggagaugaguuuugacccuggucuugaaggaugaaauugacucagauuagcaaauagaaaucagagacacauuccagauaagacccuacagggaaggggucacagguuauaucugaucuucugccagugcuuucuccuuuagggauuucuuuacuuuuuagcuccuuauuuauuuucaucauuuugaaaugaugaaaauuaucuauugccaugacaacauaaugcaauugugaacucugacagcuuuguucuuuauucagaagugauguucuuccaaggccauuucagcaaauauuucucacucugccccuaucgcuaucucucucacuugcauuaaccaacucauaaugggauugauaagcugucaauaauaacuagacgcaaucauggaaugaaucccaguaguaucgauagauacgagccuaaagaaucugccguagucaucugaaaugugugcucauuucuaaagugacucauuuaacagcuucccauuaguucucuaaucugcauaguguguucagguagagcgcagagcuuucuaacaauggaagagaugaaaaacagcuagcaaaugaauucaccuucugcaaauaaaugugucacuuguaaauccaaaaagguaggcaaaucagcaucaagcugugccguacauauuugcucauuaagccaggggcuccccagcuacaacaaagggaugggaccugggaagaguuuauaaagguuuuaucccacacuccuuguagauaauuagacacugacaugcagauucuucagucucuucagugggaggcucacuaccuguuggguuuccaucaaggagauggcccucaguucucacaggucacccacgccaagcugucagcucucacaagacucaugccagaaagccauucuucagugacaagaagcucagugacucaugaaguggcuguugugucuugagauaguucuaguuguuagaaaauucuuauucauauuaagcugaagcuucuccacaauuuccacauuugagugaagagcuccaaauaugcccaauuugaauuuuacucgagggcagauuacaguuuugccaaaauuaguguguguuuuugucuuuuuguuguuuuuuuuuuuuuuaaaugcucauuuucuaaacuacucagauccuaaggaagauaugaucagcaagaacuggccagaucugggucuauagguaagguacaucugcuaaaaggaucucuuuccucuccagauuagggcuagaccauuccuauuuuagaaugucucuaggaaucuuucagagauccucauaauggcuccuuuaaugccaugaguaaucucucucaaugaauuucagagcagauuggagcuggauggauguuacagguuauccaggccacuguccagagccacaccaguaaaggaacagcagagcuaggacugcagugccagcucccaggacacauuugggagucagccuccauccucaccugggguccuccacccacagaaugggcaccugcaacagaacaugucugcguuucaugagaugaccagaggcauguucaucauucaggaguagcugugcccgaagcugagagugaagggcagggcagcgccaucuccucaccuccccucgggagccagcagcugcucccagucauggcucccagcucuuccccuggcccucagaguacuucgaaacagugugaggugggaggaguucccuuauuacacaagagacugcagcagaccaguuguuucccuuuacucccccgcauucaucccagaagacagcugcagguuucucugcccuugucuucuuaaggcagcucuccuucccuccugcucccuccucguccucagccuccagcaucucccugcuuucagaucccuccucccuaccuccuagcucagagaccuccuagagucccacuuccuuuuuuugcuuaauuuauauuuauaaaauauuucgagauauucuuuuuuguuguuauugguagacagcaaucuuuuuuuuuuuuuuuuaagacagucuggcugugucaccccgacuggauuguaguggugugaucucagcucacuacaaccucaccuccuggguucaagcaauucucccaccucagccucccaagaagcuaggauuacagucaugugccaccacacccaggauuguuuuuuguuuuuuuguuuuuuuuuuucagcagggggccagcgcggugugggggcagagucucacucugucacccaggcuagagugugguggugugaucucugcucacuguaaccuccaccucccggguucaagugauucuccugccucagccucccuaguagcugggauuacaggugcacaccaccacgccuggcuaauuuuuguauuuuuaguagagacgggguuuugcaauguuggccaggcuggugucgaacuccugaccucaagugauccgcccaccucggccucccaaaguucugggauuacaggugugagccacugcacccagcagauuucuuauuuuuaguagagacaagguuucaucauguuggccaggcuggucuuaaacuccuagccucaaaugaucugccugccuugaccuccccaagugcuaauuacaggugucagccaccguaccuaacuauuuuuauuuauuuauuuauuuucuuuagaguguaggucucuuugucacccacacuggagugcagugacacgaccacagcucacugcagccucaaacuccugggcucaagccaucuuccugccucagucucccgagcagcuaggacuauaggugcacaccaccaugccuagcuaauguuuuuauuuuuguagaggugggaucucacuguguugcccaggcugcucucaaacuucuggccucaagcgcugggauuacaggggugagcuaccgcaccuagcuuccacuuuguaauucuuguacuggaucucagugcccucccacccucugggugucucuacugagcccugauguacagcggcgaagugcccaagacucugaaucucuuuugcuuuuuuuuuuuuuuuuuuuuuuuuugagacacagucuugcucugucgcccaggcuggaguacaauggugcaaucuuggcucacugcaaacuccaccuccuggguucaagcgauucuacugccucaggcucugaguagcugggauugcaggccccaccaccacucccggcuaauuuuugguauuuuuaguagagacggauuuucaccauguuggucaggcugaucucaaacuugugaccucaggugauccacccaccucggccucccaaagugcugggauuacagguaugagccaccucacccagccuggacuuuguuuuugauggagauagaauucauguacuguacuguauaguucacccguugaauguguacaauucagugguuuuagucuguuaauuuuuaauugugguaaaauauaaaauuugccauuucaaccauuuuuaaguguaaauucagugacauuaauuauauucauaaugcuguauagccaucaccguuaucuauuuucagaacuuuuccacuaccccaaccaaaaacuauaccauuaaucaguaacuucccacucuccucuccccuagcccccaaccucugguaaccucuaauguauuuucugucuguaugaauuugccuguucuagauauuucauauauguagacucaaacaaacuauuuguccuuuugugucugguuuauuucauuuaauauuuucgagguucauccauauuguagcauguaucagaacuuuuuuuuuuuggagacaggguuucacucugacacccaggcuggagugcaguggugugaucauagcucacugcagccucaaacuccugggcucccaccucagccucccaaacagcugggacuacaggcaugcaccaccauacuuugcuuauuuuuuuaauuguuuguagagauuggcucuuacuguguugcccaggcuggucuugaacccccagccucaagcaauccucccaccucagccucccaaagcaccgagauuacaggcaugagccaccccucccagcauucauucauuuucaugacugaauaguauuccacuguauggauacaccauauuuucuauucauucaccagcugauggacacucgggucguuucuaccucuugguauuuugaauagugcugcagugaacauuggcuuacauguaucugaguaccuguuuccaauccuuugagaauguacuuaggaauggaauugcuauaggguaacucuguguuuagcuuuuugaggaacaagcauauggacauuucacauuuaaacugucauaacugggaggugugggucuuuauuaauuaaaauuuaucuacuuuaaguuaacaugaagagccauaaauauaugcaaccaauucauuccucaccuucuucugaguucuuaacaauuaucaucuguacgauucaucugacaguuaaucacggaggcuuugugacauccauuauucucucuaacugguuauuuuaaagcuuuuacuauuuaacuugucauguuguuauacaguccuccacugagauuuuaaucuccucgagggcagagacacauauuucuuuguauagguauucccuguaguaccccgcguagaucuccgagauaucaugaguuuuaauuuucuuugauuucaaucuucugguuuauucauaaacuagaaaaaaggaaacuuuuccagcaaguccuuacccugauagaauucucuuugccuaaauaaguuuuuugcaaaccuguuuucacauguuaacuaagguaacacaacuuguaagaagaagaagaauagcagcuauuauggaauacuuaccauguguuguguaucauugaaagcacuuguauuuucucacuuaguucucaaaacaagccuaugauauagguacaauuauuaccuaccuuuuacugaugaggccacugaaucacugagagguuaaauagcugcccaccgcccugucaccagcacaugccgaaguuagacagcugacuccaagguucguguucucacccacgaacacgguuaggcacccugaaccagagaggacaguguccagccacuggaagaauuauccagccuagaugucaggagcgcugggcguuggggagcagggccagcgccuccuggggacugcaccccccagaucccccagccuucuguagcucagcagacaggcucugcuucugucccuccugccuggcugcugugggcucuggaauuugcccacuucccugcugccucuagggugguggagauccaucaugggaagagccuggccuggcuguguggccucaaacaagauacccgggagguggcugugacucuaugaggcuccguaaauaccagcugcuucucucauccaauuagcuggaaacugaccaguugccuaggcaauuuuuauuucuuaaaaauaaaugaucaauauauaaaaauagaugcacauucauuuuaaagucuuaaauaagcacacaauaaacaauaaauuucacauccaucaugccagcagccucucacugaguuugaagacaaacagaaguaguucccaaaguaaccacacuaacuuaaauaucucugaacaaacaugccggccaagagcuauccaaagccagugccucccuauuguaugaaguuccacauauaagaugaaggccagggcuucagaguggcuuucacacagcaucaaccuggcaggggccuucccaccaggccccggugcaauaccaucucccccgaucccuuggcccaggcaguggaaaagcugcaggugagccuggcuccugaaaaggggacugcagaggucguaguggccugcacacagcccacagagcacacucaaaguaaggagaggcagagggugucaacucuagcucugcguucucugcagcaugucugcacugugcugugugcaugcagcccccucagagccucacgcugcaucccauuggacauucugcucccuccugcauaagcuuugccaggccgcaggcaccaaaccuaagcuuaugacauucuucucccagcgagguuuacuccuaacccagguccccagguugcuggguucuugcugguucucuccuugcucagaugucccauucuggcaggcccacggggguuguacccagcucugggcugcaggugccuccccugcagcucugcugagcucugcugcacaggaagagcccaggccagcccggaagcaucucacucccuaguuuccagaagccccuguggguccagcaccagccccuucuccaugucuucacaugucccccugcugccggcuacacaggggacuuuugcaugcccagucucccuauggggguuagggagggcaaaagcccuguuccugcccucuccccucugccucccuccccugccccagggcaugaagugcuaguugggugucucaccucacggccuucucccaccucugacuucucccuuugcauuuucagcacugucuccaagcaaagaaaaaacgucaucagcugugucacaguccacgacucccccuacuccgacuccuccagcaacaccagccccuacuccgugcagcagcgugcugggcacaacaaugccaaugccuuugacaccaaggggagccuggagaaucacugcacggggaacccccgaaccaucaucgugccaccccugaaaacccaggccagcgaaguauugguggagugugauagccuggugccagguaauuuggggccaggacagggcaggaaccucucccuggagagugguuuuccugcuuuucugcugcuagaaauguugcuguaugggagcuaguacaauagaaagugcccagugacugcaggcgacccuuaccgaggauuuuauucaaguauccaggggaggcuucugcugaacagcacauuguauaagcagcguuuuccuucuuuaauccuguaaucaauaccucucugccuuuacaauggcucugcuuccaacuagguugauuaauagaaaauaaaagccuccugguucuuuaugccugagccuggaagaauaccuggucuggggaguuccuggcugacaucuagcaccacucucugccaggaagcccugguggucagaugggcuucuuguguaggaagaaccuccuccgagucuugcuagggaagggugaaauuggccccucucagccccuccucggaaucagcugcugggcggcgagaccaagccauguguguuucucugcucaugcacugcuaucuucagaggacuccuccugucccgcgaaggcuugucuugaaaauugggcccuggaauaaaggcugagaacguaaccuucugaauaaacucaguggcucacuguagauuuuguagcaucuauuuagcguuucccuugcucaugcucacaguggaagaauguggggacuaaaccagaagaagucugcgcgucccgcuauuccgccacaaaccacacccaagccagccugcaccugcguggcggcauaacugaaaagggaaggaaagggaacgccaggaagcuuuugucuagaugugagaagcuguuacuucucaggaggaccucaugucugucaccugaggucgcuacaggaaacuggggacucuuccuggguggugaccacaugugagacccagugggcgcaggccccauucaggggcugccacugaggaugaagcguagaggcaggauggggucauuagggcuuuuccagcccagugccucaggccagccugcacggugagggucagagcccuggcacgcucucccaagagcucauggcauugccugggauggggccccuuuugcugagaggcucugccuaaaggggagauggugacagccacaggcuugcgcuccccgccaccuacuuccuaacccaaggcagcaucacccuuuccgacauuugcggcgaagcucuuuuucccugacuuuggaguuaccccagcuaccuuuccucugaagaaaugcuugugaaaugcagcuucucagcacccugcuaaaacgucuccuuuugcaaguccuggucuguccccaacaguaccgucaugacgaugcagccuccaagcagcuuugacaucagagccagcgcuccugugggccugggggcagggggucguggugccuacagcgagaaagacacacaagcagcacgcagcucgcgcugugcucucucggaagaaggagaccuuaccuucaggaaaaauagagccacagcagugccacaugccagggcgagcauucugguugacaggggccaggcuguacuugcugcuagggucuggugaccuggggccagagaagcaggcuggagcccucccaaaauuaggcaucucugugaggaaaagaaaaugaagcugucccuuccacaaggcuacaaggacaucucucuccaaaaaccaucuuuuuccacccgggcaaauguuuugguggaaacccugccaggaagcaacauucucuagcaguaaccaaagggcccugggaggcacccgaagucauucccgggagccaggauuccuuaaagagagcugcauacuuuucagcucagcuauccuuuaaauauuguuuaaggguauaugcagcacacauuuuuaaguuuaaauauuugcaaaggauagaauuugucuuguaucauuauuuaaguuccuuaaauauauguuugugcaaaccucgaagcugcagacugaacucauaccauaugcgggagugcugccugugcccucacgagcaggggcauuccucgucuggugccugcccuuccccagccaguggcguucaauaccgauacacaccuuuagcuguagaacccaccuaggcuuggaaaagucgggaaagcagccuuccucagcucccuggagcccagugaugcauacaggccaagguacagccaguuaacagcucccccagcuacagcacccagagcaugggagaguucagcgcucccccagcccucuuaggccaggauaugcacugcuguuuccccgccauacucacccccuccuguggcucucagucuuucaguccuucucagguugggguuagugaaguuucuuuuggaagcaacagaaugaacucuacacuggcuuaagacaaacaacuuauuggaaggaugcagggcuaagggaaaguucaacaacuaagucccaggcagggcaggagccagaaccccggggaccugagcccugggggccagaugccugcucucugaagcugccuucacccgacucaccgacagcagcucccaggcuccuggugucccauuuccaggagaccagaauugauugucccagcuuggagagacacuugucguugcuuuuuuuuccggagaggagucucgcugugucacccaggcuggagugcaguggcgcgaucucggcuuacugcaaccucuacuucccggguucaagcaauucugcugucucagccucccaaauagcugggacuaccggcaugcaccaccacgcccggcuaacuuuuuguauuucgguagagaugggguuucaccgcguuagccaggcuggucucgaacuccugaguucaggcaauccacccgccucagccucccaaagugcugggauuacaggcauaagccaccaugcccggccaagacaccuuuuuuugagccucagcuuuaaccaggagacagaguucaauaaugacaccaacaauagcuaacacuaaguacguaaaugccagauacucaauacuuaagcccuuagaugccagauacuaagcauucuacacuuguuaacucauuuaauccucaucacagcccuacauggagcugccaugaucuucccaguuucccagguuaaaaauggaggcacagagggguugaccagccuucccagagccauguggcugggccucccagaggucuggcccuggagcuuaucugugcuguaagcaccccugccaacucaccuaguguagacagggccacuguggcuguucucaggacaggagaucacggagaguagcuggacaaggcaugacuggaaaacucuagaauguuuccucacuguuccaaaguauacauuaggagguugaccagcauuagcccauugucgcuuuguccaucgccacaggaggaguuacuguuauacuuuaaucucuugguccccuucaggacguccucccuuacucggggcucucguccucugagagcuuggcaagcucugacucaacccccaucuccuguccccaugaugaugguagcaucagggcugcauuacgcccauuucaucuaacauucccuaaccccuucacugaucccucgagcucaguguuucucccucaaauaucauuaccacaaaaugcccaggaaguuggaauagaagaaguaggugacaugcacagcggggcccagcacagucugugacccgccgcagagcaagaaggaggcuucccccaacacagccacauuguggcugcagaaggcaagaagcaggcucugcagagccaauguuugcagcuuucuauuuuucuuuucuacauugaguccacaaaaaucccuccaucccucagguuuugggggaccuuugagucuaauggguuuggcuugggcacaguguugggucgcaaggcccugauucccaaaugcaggucuguucagccagggccaggaggcucugguguccugggaagcuugcuaagaauacugauuccggaucucccguaccuacucgagggauuccgauucaguggauggggugggaggggccccaggcgcaaaugcacgguuggauuugcggccucugaauagcacccacugcccccauccccacugcggcagcucacccuucacuuagggcagggggcucugaguuuuggggucaggaaggcccccuuccaccuguagugagcaccagaaacuucuguccccagguuuccgguuuuccuuugaccuucuugagaggcugagaccucuagaggcacauuucucucuucaucaacaauuaaucagcauucuuucuugcuggcuccagccucaggcgucuccucuuugacuuugauuucaucgcccugggauuuguaauagaauugauccaaccgaauucaaucaagggccuggucguuuccaugcauggcucauuaauauuuagcaccucugccccaagaaugaccagauucucuccuuuuacacuaaccacccauaggauacuucauugagacaguaugagccuuccaguucaccuaagaugcucaggccccaaaaugaaugcuccgaauucuugcuucugaacgugagguguagaucugucuuuggacaucuugcaauauguucuugcugccucucccuucauaugaaacauuuuaccugauucguccuuugaacaccccuacuuugggcaccuuccucaaauguggacugcuuuagaguuggggcucuguggaacaauagcaccgcauuuuggcgaaugacuggauucccuggccaaagcucuuucccauacucaguuauuucaucuuuccucuccuagggcuuccuuacgcuuuucagugucaccaggcaguaauccuaaaguccagcaagguuuccaaaaaauauaaaucacagaaauauagcuguccggcacgguggcucacgccuauaaucccagcacuuugggaggccaaggguggggcagaucaccugagaucaggaguucgagaccagccuggccaacauggcaaaaccccaucucuacuaaaaaauacaaaaaauagccagguuugguggcacacaccuguaaucccagcuacucggaaggcugaggcuggaggaucacuugaaccugggaggcagagguugcagugagucgagauugcaccacugcacuccaaccugagcgacagagcaagacuccaccucaaaauaaaaaaaggaauuuagcuguccuccauagaaagucaaggugauaaaaauauuucaagcacauuccagaaacuuaaugaagaaaaauaacugaguacaagauacaacacaugaagugcucaaaucaacaaaggauggcggaaaggagguuacucauuaccuuucucucuuaaaaugcgcucccuuuuuccugggcaaagucuuccucagucugguucuuagacuaagaaucaguaccauggcugggcacaguggcucacgccuguaaucccaacacuuugggaggcugaggcaggcaaaucacuugaggucaggaguucacgaccagccuggcuaacauggucaaacucugucucuaccaaaaauacaaaaauuagcagcugggcgcgguggcucaugccuauaaucccagcaguuugggaggccaaggcagguggaucacaaggucaggaauucgagaccagccuggccaauauggugaaaccccgucucuacuaaaaauacaaaaauuagcuggguguggcagugggcgccuguagucccagcuacucgggaggcugaggcaggagaaucacuugaacccgggaggcggaggcugcagugagcugagaucacgccaccguacuccagccugggcgacagagcgagacucugucucaaaaaaaaaauuagcugggcgugguggugcaugccuguaaucccagcuacuugggagguugaggcacgagaaucacuuaaaccugggaggcagagguugcagugagccaagaucacaccacugcgcuccagccugggagacagagcaagacuccaucucaaaaaaaaaaaucaguauuguuucugugcacaucucaccccagcaggacugguugcccaaggaggcaggacagcccccagccccagcgccaggcucuuguucauucccuggucugcccugcccuucuuggugggggaccaucugccugucuuuccaccuggaagauguuuucuucuccauuaacucuacuguucuuuagcguuuaaggaacagaagcaaugcuuguuguaacuaugguuucuaacuauacaacacaaaccacacagucuucaggcugcuuugucguagccuucacuuacuaaaccccucuuuuucugcuuccguugucauugaaguuagagaaagguaucuggaauuuucugccucccacacuuuccuaggccauuaugcaguuugcuccuaaagaagcccaguguuggcccagcgcgguggcucacgccuguaaucccagcacuuugggaggccaagggcagguggaucaccugaggucaggaguuugagaccagccuggccaacauggugaaacccugucucuacuaaaaauacaaaaaaguuagccaggcguggugccgggugccuguaaucccagcuacuugggaggcugaggcaggagaaucacuugaaccugagaggcagagguugcagugagccgagaucgcaccauugcacuccagccugggcaacaagagugaaacuccaucucaaaaaaaaaaaaaaaaaaaaaaaaaggaagcccaguaucuucucacuagucugggucuguuuguugcuuuugccauuacaaaagugcuugcauuuaaugaauggcuaugacuggugcaucugggugcauuugauuggaaauuucauuuagguguguauuaauacugcacuguguguuaggcagcccucuccuggaggagagcugaggcacagggacauggggggcuaguaaagcaucucuucugcuuuuaucaaggggugaugguccugucugcagaacuccccaagcugggguggggagauggcccccacucggcagcagagcucccgcccucuggggcucuugccccugcugggcuggacacucaugcccuguccugcccuguccuguuccaucagccuucuuggacuugggcugucccugacugucagcgucuucaucugguuuauccucuggccucgccaccucaucugcgugaucugugaugccuccuccuuauucacgcucucagccuucucccugccacccccgucccuggugguacacagucaccguccuuagcacagggcaggagcucagaaaauacuuggaugaguuaaaaccacugggcucugaagaggcuccuggcuccccuggcucucuggcuggguaacauggaagccauccagcucaggguuuaacccaccucucucagagccccuggcuacucagagcguggucccccaagcagcagcacuggcacccccugggagcuugucagaaaugcaggugcucgggccccccagagcugcuggccagagucugcacugaacaagaugcaggaauuacauuugagaacuguugauggagccaccugcugaccaugaggucaccucuggaggguugcaguguuuuuuccacucuucagcccccuuggcaauaacauggaggcaguuuugugcuuggccauguuuggcucacagggccauuccccggaugauuuagucucauccugccuagaggcagguaacuggaccaggugacucugaggguuauuuuagcuucuaguaguuuauuaggucccaccacagacacugucuccucugauacucauagucacccaugguggggaccaagcagggauccugucuuagucuauuuuguguugcuguaacagaguaccugagacuggguaauuuauaaucaauagaaguuuauuuggcucacgauucugaagacuggaaguccaagaacaggaugccagcaucuggcaaggaccuuugugcugcaucuuccuagcacaggaggcagaaggacaaaagagcaugagggugagggggccagacuuguuuucaucaaaaaagccaaucucucaauagcuaacccacucccgagauaauauuaaugcacugaugaacucauacacucaugagggcucugcccucaggaccuaacaucccuuacuggccccacccuaaacacuugcacuggggacuaaguuucuaacacaagaacuuuggggaacacauucaaauuauagcagaucucuccuacccauuuuccagaugcugaaaguaacaccucccagaggaacggcacugggccuggccuuaggccaccagcccaccuugccucuccugauucuuuuccgcuuucccuugcuucauucccucaugcagccccgaccacccucccagccgagggagugagccagagccccacugcauccagagucaaggcaaaguccuaguggguccgggggagaugaggcugauuuguuacugcccggccucaggcacauguuucuuccuggaagaccacuguucucuggugggguagcaucuucugggcagcugggacccugccacugaucugaccucuuucuccucccgccacagucaacaccagucaccacucguccuccuacaaguccaaguccuccagcaacgugaccuccaccagcggucacucuucagggagcucaucuggagccaucaccuaccggcagcagcggccgggcccccacuuccagcagcagcagccacucaaucucagccagguaagccccacagcuggcgccccaggccaggcagggcccccauccccucauccuuccgcuucagagaggauugcuguggcggccccucacccaccucacagggcugcaguccuggccacggguggcagcacaugcccuuggugaccucugguggcuuuuucuaccacaggucacccuuggggaaguugauaucaccagugcacagagugcuggcccaaagcaaagcgacuugucuaauguuacaaagcccuuagugacauggugccagagcuuaaaaauaggauggcccacauacugcuguuucaacccagcaaaggguagagcacugugucccggcccugucggccugggacaucagggacagaccugcauccgacucauugcagggagggcccgcacaccacagcccccaagucaaggguaagauuugucccaggaccuggaggaagggggguggguugaggugaaaugugagugaccugaguuucugugggugcagggcugucugugucaagggcucggcaucaggccugacucacgugguggacucagggcccuguuucucuagaaacaaagugagauaaaugggguguuuguguucagagccccucaucugaagugcugccccaggucaucaguggagcccgugucucugucacgugacuuagguucaccagguagaagagggcuauuuuauuuggacugacagaacuucaaacagcaacgcuucugagagccaacuuuuuuuuuuuaagacagggucuuguucugucacccaggcucaagugcaguggcacugucauggcucucacugcagccucugccuccuggacucaaguaauccuccaccuuagccucccgaguagcugagacuacaggcaugagccaccacacccagcuaauuuucaaaauuuuuuguagagauguugugagagccaauaauuuugagaacaagauuuuacagugaguaagaaagcaacugcugcucaaagagaguguccuggccgggugcgguggcucacgccuguagucccagcuucucgggagcccaaggcggggggaucauucuaggccaggaguucaaggcuacagugagcuagguucaugccacugcacuccagccuggggcauccugauacuucacagcuucuguacguccuugggagaaauauguucuccuauaacuuugcagcuggcuuuauccguguaucaucccagcccagugaguggcaggccaagucgggauuuucucaguccaaguaaauuuuuuuuuuuuuuuugagacagaguuucacucugucacccaggcuggagugcacucgcgugaucucagcucacugcaaccucuaccucccagguucaagugauucuugugccucagcccaccgaauagcugggacuacagacaaggcacgugccaccaugcccggcuaauuuuuuuguauuuuaguagagacgggguuucaccauauuggccaggcuggucucgaacucuagaccucaggugauccgcccaccucugccucccaaagugcugagauuacaggcgugagccacugcgccaggucccaaguaaauuuuuacuuucucaacacacagagggaagccccuucuauuacuucuggagucuuucccuucucuuccuccucccugcccuccugccccuccucccauuccuuccuccccaugugucggccccugacgucucucuuggugccucuccuccccaggcucagcagcacaucaccacggaccgcacugggagccaccgaaggcagcaggccuacaucacucccaccauggcccaggcuccguacuccuucccgcacaacagccccagccacggcacugugcacccgcaucuggcugcagccgcugccgcugcccaccuccccacccagccccaccucuacaccuacacugcgccggcggcccugggcuccaccggcaccguggcccaccugguggccucgcaaggcucugcgcgccacaccgugcagcacacugccuacccagccagcaucguccaccagguccccgugagcaugggcccccggguccugcccucgcccaccauccacccgagucaguauccagcccaauuugcccaccagaccuacaucagcgccucgccagccuccaccgucuacacuggauacccacugagccccgccaaggucaaccaguacccuuacauauaaacacuggaggggagggagggagggagggagggagagaauggcccgagggaggagggagagaaggagggaggcgcuccugggaccgugggcgcuggccuuuuauacugaagaugccgcacacaaacaaugcaaacggggcaggggcgggggggggggggggggcagagggcagggggacgggucgggacaccagugaaacuugaaccgggaagugggaggacguagagcagagaagagaacauuuuuaaaaggaagggauuaaagagggugggaaaucuaugguuuuuauuuuaaaaaagaaaaaggaaaaaaaaaaagucaauaacaaaaaacccag

SEQ ID NO: 21405 - RNA, 2836 nt, Homo sapiens
cgccgcagggccaggaagcgcggaaggaaccgccgggggccauggacggagcagugauggaagggccgcuuuuuuugcagagucagcgcuuugggaccaagguagucuggcgcauggaugccgaaccuuauccgggcuaguagugggugagagagcccagaaacagggagaggugggcagcgggcuggagagcggcgccgggaguuggagagccugugacuuucccgugaaguugcuuugcacacucccgggaagcgucuguagucuagggguucugguccuggggagacggaguggcaucguccuugggaaacuucgcccccaaccccguuuggaagccccagaucccaaaucgacuugcgccgcaaccuccuuccccgucgggacccgggccgccugcgcacgccacucccucucgagcacucucucucucucccuagagguggaggaagaccugggccgugcucuacccggccaguccccacggcguagcgcggcucgaguucuuugaccauaaggggucgagcucuggggguggccgagggagcucgcgccgccuggacugcaaagugauccgucuggcugagugugugaguguggcccccgucaccguggagacccccccugagcccggcgccacugccuuccgccuggacacugcucagcgcucgcaccugcuggcggccgacgcgccguccagugcagccugggugcagacgcugugccgaaacgccuuuccggugaggagcugcggcgaugcggggugggggcaguuacagaggcagagaaauggggcugccucagaccgacccccgcuccccgcugaggaaauuacggguuucucgaugcucucuacuacagaaaggcagcuggacucuggcgccuaccgauaacccaccuaagcuuucugcccuggagaugcuggagaacuccuuguacagcccuaccugggaagguagacgccucagaagcccgggcagggauggagugaagaggaggagggccgagggccuuugggaaguggguggauacccaggggcccauggggaaguaagaaguaggaaggcccugagaucuggcuuccgagugagugcuuggacacuaugcucaugaguccucuggguccccacugcugcccccgucccucccccgcagcugucuaaucguguaugccuuccaggaucccaauucuggguaacggugcagaggacugaggccgccgagcgcuguggccugcauggcuccuacgugcugaggguggaggcugaaaggcugacucuccugaccgugggggcccagagucagauacuggagccacuccuguccuggcccuacacucuguugcgucgcuauggccgggacaaggugcaggggcuguccgggagggcuuccuggguugggcagcugugggagggguggggcaggacagaaagugggaagcucugaccuuuggaucccccuuucuugccuacccggugaccccgcgucuguucgcagguggucucuucuuuguagauacccuaacuagugcaggcgugugacucacuuccucugauggcuccugguaauguguuucccccucuacccuccuuaggucauguucucuuucgaggccggccgccgcugccccucaggcccuggaaccuucaccuuccagacggcacagggaaaugacaucuuccaggcaguugagacugccauccaccggcagaaggcccagggaaaggccggacaggggcacgauguucucagagcugacucccaugaaggggagguggcagaggggaaguugccuuccccaccuggcccccaagagcuccucgacagucccccagcccuguaugcugagcccuuagacucccugcgcauugcuccaugcccuucccaggacucccuauacucagaccccuuggacagcacgucugcucaggcaggagagggaguacaacggaagaaaccucucuauugggacuuguaugagcaugcgcagcagcaguugcugaaggccaagcugacagaccccaaagaggaucccaucuaugaugaaccugagggccuggccccagucccuccccagggccuuuaugaucugccucgggagcccaaggaugcaugguggugccaagcucgggugaaggaggagggcuaugagcuccccuacaacccugccacugaugacuacgcugugccacccccucggagcacaaagccccuccuugcucccaagccccagggcccagccuucccugaaccugguacugcaacuggcaguggcaucaaaagccacaacucagcccuguacagccagguccagaagagcggggccucagggagcugggacugugggcucucuagaguagggacugacaagacuggggucaagucagagggcucuaccugagaaggacggcaaggcugagguggcuaagggggaccauggggagguggcacuagggaucaaagaagaugguuagaaccagcagaagccagagggugggaggggccaugcugugugagaccaggggaccagagggaugggagagucaagggaaggacaaucccaggaaguccuaagaaguggggcagauggcagggcugaggaugggcucugcaucccccaaagccaucccuucccuacuuccccaaaugaagggacggcugugggaccaggucuguggaaaguggugcauggucagaaugggugcaguuugaggggccuguguggaggccucagggagauguuggacugugccuggauccuuacuccugcauuguucuuugccagagaccuauuuaaaaauuuuaaaauucucauuaaagucagcuuggguuuaag

SEQ ID NO: 21406 - RNA, 3324 nt, Homo sapiens
guugcuagguauaauuuuauuuuauauaaaaaguguuucugugauucuucagagcccaggagucagugcuggugguuggagggaccugcccccacugguucauuuaacccucugucucggugcccucagaaccucagccagaaaggcaaggaggaaaucagagcaggagccucauacucuuggugaucuauucauucugugaccucaggggucacauauaaggucaguguuucucguccccgccggaucugcacugccaacugggauuggguucgaacagcuucauaaacaucuucagcauuuuguaccaucugcuccccaauggccaaaaucacaucaccaggccgcagaccagcccuauagagaaaaauggacagagagaaaggaaggaguacaaagccuaguucaaggacacaugcacaccuugcccauccccauaucacacugcagccucucccucaccggugugcaggggagcccaggaugacuuuauggaugaguacaccaugcugaacaucgggaaagcuugguucucgaagcuguaguucagcaaggaugcugaaaguacacagaucacccuauuagccaaacccaggcauucuccccauccugaguuccaccucaagucucucaucaacacauugauaaauauauggacaggacaugggcuagguacuacaaaauacaauggcaacucacuuucugucuucuagcaauaaagugcaacauguacauaaaagauguacaccacaugagggcaccaaaugacaaacaguguuaaaucaauagcacuaaugucauucuagaauacuaagagaagcuuuaaggggaaagaacuuaaguugagccuaaaaggauggaucugauauuaaccauauaaaacaagaacagcauaaauaaaaaacaugggaguaggaaaucagguuggcugaguauucauauaggaagguauuacagccaggucuagaaaguugauuuacagacagauggaaaauggcccuuaaaugccaaguuaauggauugaaggcuugaaaucaaagcaguaacaggaugaaaucaaucuggugacagguguacaaaguggagugggauaagaaagucaagaugaugaagggagacagcucuugugauuauuucaagugugacacaguucaucuuagauaaagacagaaaugagaacaaagcucaauagaggugccccccucugauuacacuggucacauuacaugucacugucccuaaagcucauaccugggacucagggucagcaucaucaccccaauguagcgccgcugggacccacugauuccggaggaggaaucugugacagagggacaaaugagccccacccagcuacauccuuccuucccugcccucuucucccaguagaccacccuccaggaagucccacugaaugcccuuccccuauuuccaccacauuaaaggaacccguuuccccauaaggcaggcucacucuucuuuuccccacgaugcagaaacucucgaagacgaucagaagggauggcaaaggagauuccagcugugaccuucaugguguucacuccaaucaccuccccauccugcagggauacagcccccaguucccuagccuaaacaaauaguaggggaugggggcacccgaacaaaaguaccagcaaguguuggggagaucugguuggauauugagagauagccaacaaagaacugcucagaaacuugaccaaacauccuugaauuaggggaaaccuacccuucccacacugaccuggggcagggauucuuggaaggaaggaugucucacucaccagguuaaccaggggaccuccagaguuuccaaacuguaggacaaggagaaaacaugaaagagaucuggggauucuaagucugggggcauaccaggauguagguacuuucuccaaauucucuucuuucucagcccaugaauaaguggccacauuuuugcagccuaagcucuauauaggcucauccaccauauaucaguuggugcuuguaccacacagccucuccccccucccccaucauuugucauuucucuccuaucaggacgcacaucaauagcugcaucaguuugaauguauuccacauugguuugggggagucccaggucucuggcuggacgcugagcagagcuaacaaugccggaugugaucguguucugcagugcaaagggacuucccauggcaacaacaaacuccccuugccggacaucagcugagcgucccagaggcagcguggggagaggcuccuaagggagaauggguaaaagagaccugucaucugaagaugcgagcaaauaagcagcuccaaccagaccuggccuaccccagcccccaccuuagucugaauccucagcguugcgaugucugccacgggauccacagcugugaccacggccucauacgugucgccgcuuagcagucucacacggacucugcgccgaucagccaccacaugggcguuggugacaaugagcccaucggcagccaccacgaauccugagccguucgagauagggaccucgcggcccaagaaagggugccugaaauggagggaaagcacagauaagaggaggcucugaccccuccuacccgcccgcccuccagccuguggcuucagugccucccggucuacccccaccauuaccgguccaggaucucgauauagaccacggcaggugcugucuucuccaccacaucugcgaugaaguuguacugacuccggggagaagcgggcggcgggcuagggacggcggcgaggacggccggaggaccccgacccccgccccacaacaacaacagcacugcccccccagcgcccagcgccaccgccagccacgcgcgcgaacggguuccagaguucucugaggccucccggguccugguaucuggggucaccgcagucaguugugcccggggacccggggucccagacgucaggcaugcucgggguucagugaccccaacagacaaccgggcccagagacugggggucccauaagucacucgggcccgggggucagaaguuccugacgucagcagggcccggaggucaggggucaaacggggucuccucccccagcgaaugccccccaaagcccgccaugcccgaaggcuccagccugcaccccgccccgcccucggcgcagccaucagcuccgccuuggcugccuccucgcccgcccuacucagaggcggcacccaggacgcgagcaggcggacaguaggacgcggggcacgccgguaccugaaguccuucagaagugcacgccgggaccaggauuccgggaggccgacuccucccugc

SEQ ID NO: 21407 - RNA, 3324 nt, Homo sapiens
gcagggaggagucggccucccggaauccuggucccggcgugcacuucugaaggacuucagguaccggcgugccccgcguccuacuguccgccugcucgcguccugggugccgccucugaguagggcgggcgaggaggcagccaaggcggagcugauggcugcgccgagggcggggcggggugcaggcuggagccuucgggcauggcgggcuuuggggggcauucgcugggggaggagaccccguuugaccccugaccuccgggcccugcugacgucaggaacuucugacccccgggcccgagugacuuaugggacccccagucucugggcccgguugucuguuggggucacugaaccccgagcaugccugacgucugggaccccggguccccgggcacaacugacugcggugaccccagauaccaggacccgggaggccucagagaacucuggaacccguucgcgcgcguggcuggcgguggcgcugggcgcugggggggcagugcuguuguuguuguggggcgggggucgggguccuccggccguccucgccgccgucccuagcccgccgcccgcuucuccccggagucaguacaacuucaucgcagaugugguggagaagacagcaccugccguggucuauaucgagauccuggaccgguaaugguggggguagaccgggaggcacugaagccacaggcuggagggcgggcggguaggaggggucagagccuccucuuaucugugcuuucccuccauuucaggcacccuuucuugggccgcgaggucccuaucucgaacggcucaggauucgugguggcugccgaugggcucauugucaccaacgcccaugugguggcugaucggcgcagaguccgugugagacugcuaagcggcgacacguaugaggccguggucacagcuguggaucccguggcagacaucgcaacgcugaggauucagacuaaggugggggcugggguaggccaggucugguuggagcugcuuauuugcucgcaucuucagaugacaggucucuuuuacccauucucccuuaggagccucuccccacgcugccucugggacgcucagcugauguccggcaaggggaguuuguuguugccaugggaagucccuuugcacugcagaacacgaucacauccggcauuguuagcucugcucagcguccagccagagaccugggacucccccaaaccaauguggaauacauucaaacugaugcagcuauugaugugcguccugauaggagagaaaugacaaaugaugggggaggggggagaggcugugugguacaagcaccaacugauauaugguggaugagccuauauagagcuuaggcugcaaaaauguggccacuuauucaugggcugagaaagaagagaauuuggagaaaguaccuacauccugguaugcccccagacuuagaauccccagaucucuuucauguuuucuccuuguccuacaguuuggaaacucuggagguccccugguuaaccuggugagugagacauccuuccuuccaagaaucccugccccaggucagugugggaaggguagguuuccccuaauucaaggauguuuggucaaguuucugagcaguucuuuguuggcuaucucucaauauccaaccagaucuccccaacacuugcugguacuuuuguucgggugcccccauccccuacuauuuguuuaggcuagggaacugggggcuguaucccugcaggauggggaggugauuggagugaacaccaugaaggucacagcuggaaucuccuuugccaucccuucugaucgucuucgagaguuucugcaucguggggaaaagaagagugagccugccuuauggggaaacggguuccuuuaaugugguggaaauaggggaagggcauucagugggacuuccuggaggguggucuacugggagaagagggcagggaaggaaggauguagcuggguggggcucauuugucccucugucacagauuccuccuccggaaucagugggucccagcggcgcuacauuggggugaugaugcugacccugagucccagguaugagcuuuagggacagugacauguaaugugaccaguguaaucagaggggggcaccucuauugagcuuuguucucauuucugucuuuaucuaagaugaacugugucacacuugaaauaaucacaagagcugucucccuucaucaucuugacuuucuuaucccacuccacuuuguacaccugucaccagauugauuucauccuguuacugcuuugauuucaagccuucaauccauuaacuuggcauuuaagggccauuuuccaucugucuguaaaucaacuuucuagaccuggcuguaauaccuuccuauaugaauacucagccaaccugauuuccuacucccauguuuuuuauuuaugcuguucuuguuuuauaugguuaauaucagauccauccuuuuaggcucaacuuaaguucuuuccccuuaaagcuucucuuaguauucuagaaugacauuagugcuauugauuuaacacuguuugucauuuggugcccucaugugguguacaucuuuuauguacauguugcacuuuauugcuagaagacagaaagugaguugccauuguauuuuguaguaccuagcccauguccuguccauauauuuaucaauguguugaugagagacuugagguggaacucaggauggggagaaugccuggguuuggcuaauagggugaucuguguacuuucagcauccuugcugaacuacagcuucgagaaccaagcuuucccgauguucagcaugguguacucauccauaaagucauccugggcuccccugcacaccggugagggagaggcugcagugugauauggggaugggcaaggugugcauguguccuugaacuaggcuuuguacuccuuccuuucucucuguccauuuuucucuauagggcuggucugcggccuggugaugugauuuuggccauuggggagcagaugguacaaaaugcugaagauguuuaugaagcuguucgaacccaaucccaguuggcagugcagauccggcggggacgagaaacacugaccuuauaugugaccccugaggucacagaaugaauagaucaccaagaguaugaggcuccugcucugauuuccuccuugccuuucuggcugagguucugagggcaccgagacagaggguuaaaugaaccagugggggcaggucccuccaaccaccagcacugacuccugggcucugaagaaucacagaaacacuuuuuauauaaaauaaaauuauaccuagcaac

SEQ ID NO: 21408 - RNA, 7988 nt, Homo sapiens
gcucccacggugccuucaagcuuuauugccacacacacucccccagcccuuccugaauggcccugugcaugggaacaccagcuuagagaagcaauucagggcuaggcaagggccagaggacuggauuugggacugggguggguaggggggaucuggagaaggaaagugcuaagaccaaagcccacccccaccccagguuucccugagugguguccacccccagggucuugggggcuggcuugugcauuggggggagggggcucaucccaaauggauccuccccuggggucuccaggcucauggagggaagagaagccccacugagccccucgcaccccccaugaagcccucaaugugcagggagcaggaagaagagcugcacacaaacgcauacacaugcuugucuccaagagagcuccuggccccuggggcugcccagccaggggcucaacaguccagaccgauggacacgagcagguccucgagugcccgcagacgcugcugcgccuccucuauggcgcuguaggucugcaccgugcuggccacguggaagcggaugucguccaccagcgggauagaguccgucuccugccgggcugccacagccgcugccuccuccuucaccgccuccacgaaguccucccgcuccaccagcuaugagcgggaagggccagcucaguggaggggugccugcccucucaccccuccuucccacccacugcagaccacuggcccaccuucucaaugaccuuggccauguacucagugcacugguccucaagccgcgccaggcggaagagcuuggccacgcgccacacacccaccacaguguccucgucuagcaucugagccaggcugcggccgcacagccucuucaggccuggcagcagguacaugucggcgacgcucagcacaucauaggcugccucgggggacagcugcagugaagacagggaugaaggugccccccgaggucaccaagggcucccagggcacaacagccaaggcuagggccuguggugguuggggggcacuggcgggaaggcuuccagugggaguaggagcucccugcgcauguaugggguugggggucggggggcuggcccagauucccacagggaucugcaggaccgcuagggggcagaagacugggggguucucccaugcccugagcaggcuggcagggcaggcgggaggcagggcccucgcaggagccagggucugagcuccgaguuauacagaccugggucugacacuucuagcuguggggcccugggcaagucacugcaccucccugugccucuaguucccaguccaugagguauagauaaccaugccuaccugcgggggcugucagaauggugggacagaggcagcuagucaagaccuaugcagggacucugccaggggugggagacuaucuaccagcucccucccucucaagaggcuguggggacacagagcccaccuacagauacauccugugcuggauaagacugaagcccucagauucaggccagagccuggguggcacagggagcaagcugcagacagagacaaggggagcucugcgaccacauuacaagccaugugccaugugccaugccaccuccuuuaccuggguaacccaugcaucugcacaaggccuuaggaagugacgacgagagcuauccccauguucuagaggcacagagcaguuaaguaacuggcccaagaucacaaagcucacccagugucacacagcucaaccaguaucaacccagguuaagagcccaagccacacucugagacaaggugcccuuuggguggcgaggcuccuugaagagggagcuucuccagggugggcaaagguaaccccugcuacaggggccagagagcugggcugagcugcaggagaugcccaguagagggggugggaaagauggaggcugaggggcugucaggccgcgcggagggauggacaagggagcugccacuggagauagagcagcaguagggacugcccucugucucccagcaugcuuccuccccuucccccacaaaacagggcccuggccacagaaugacuuuccaagccucccuuguuggcagguaggcacgaaguucucuccaggggaacaugagaaguggugcaauuuccgguggcuucuacaaaaacagcauugcuugcccugccuuccucuuccuccuagagcaugaguuugccuaggacccaaucuccauggccaaacgcgaugccccaggcaggauggguaagcuacggccuguggaccaaauccagccuguuugugcaaguaaaguuuuauuggaaugcagccucacccacucaucucuguacugucucuggcuaccuuugcgcuacagaguugaguagcuacaacagggccauauggcccacagaaccugaaacacucaccuucagagaaaagguuuuugaccuucacccuuaggcauacaggggcaagauggagggaugaccugaucuuccgcaagccacuugcccuggggcacccaccucagucagaagugaaggagaaacaaacuccccucuucuuuaagccaccagauauggggauugcuuuauagugcgcgcgcacgcgcacgcacacacacacucucucucucucucacacacccuggcagagcaaaccuucagcacucugcugcugcccugcagccuuggcuuacggacaccuuggggcagcuggagacagaggcaggcagcaagggaagaggagacugggaacccagaaccccagggaucugcagcaccacagagaggaggcuguccccacccacccuccacccuccugcuagagaagcugaggaucccaaguggcugacaaguguggagugucugugacacaggcucaucacucauccucucucuggagcccaacaaggcuuccucuaccugaaagaaaaauccaaagucccacagccuuccccuccagccuucucaaaacgucaaccauggggccagcugggcccuuccacagacccccagggcccuggcgcucccucucagcccacggcagcacagguugugugccauccccagcucugccugagcccccaccucaguguggucgcuguacauguaguagagcacgugagugaagacgucgggugagaugccaugcagggugacggcuggggggcccccugaggucgcuggcuccucgcucucucggaaguggucauccagcagggcucggaaguagucacugcggccacagaaaaaggccugggggaggccgggcucaggaagugugagggccagggucugucuccugaggagcuagacgggggcucagggcaacgggcuggggccaggggcaacaggagggcacaggcaccuuguggcagaggaagcugcagccagccacucggaagcagaugucagggcagcuguugaagccgucaggacaagggaagggcagcucccaaagaucacccugggguacagaagaggugaccccaucagagcaguuguucacagaagugaacgacuagguucagaaaagggaaguaacugguccaggaccacacaaggaauugagcccaaguaucugggcugccugucacggccugccaucccaaaacgcccuuccugcccaccagccccgcacuuacucggagcucggggggcagggcacaaucggccagcagcgccauguccucccggaggcgggggucugcaggugggggcucgauggucagcaccuucacacacgugccuggcuuagacgccacuacaggggaagaacaacuucagggagccaggccagcccugccaggccgcacccauggccccgggccccaaacccugcucgcaccaaacucagacaccuucucgcacuuggccuccaggucgcugagcaggucccacagcuggcauugcuuggccaggcgcucacagucacucacaugcucuacgccaauguccaggcggccugggggcaguggggaggaugagggccugcgggaccucagcugucaucaggcccacagaaaaagggugauccccucccaccuggccaccuggcugcaggacuaggacuccugggcccacuugccaccaugguuuccccaucaaaagcuguucuacaggccccagggaacagaugggagggccucagcaugugggugggacaagcucuuccugagcaggcacacuaguccucucucuugcaacccaacccgagaggcagcuggaaccaccccggggggaccaugaagugucuagaggugaaaggucagcccagccacaccuagguguacugcuguccagaaggacggcccacucccucuccuccuacccuggacccagggggucaccuguguacagguacugcagcagggccccaaaggccacgggguugaucugugggcagaaaaccagaaaguaaugucagaggcagccacccagcacaaccuccugcuguuccuggacaguucaugccccucugccacccugaagggacauaccagugggugccugagaaccacgacacucuugcccuuccauuugguguccagcauguuggcaaaguaggcacuacgugcacccaggacgcagcgaugcacccggaauggcuucccguguacuacaaagaccacgucacuguggaugcccugcucuagaagccuggggagggacaagccaggagggaggauacuuggcacagccccaccccauuccucggagcacucagaacccagugcaggccacagucagagcagacucgccacacccaccagggccaccgcaccccaugcugcaccccucgugugcccuggcucaccgcugcaagaagucgucauaguaaucccgccuccugcaggaagccgugaccugcuuguaaucgcguagagcccggcggauggggucacucagugccccauagaggcagcgcucaccaucgaagguguuggccucgcagcgggcuccugggggaggcagggcucaccaguuagcagggaaggggccugggggaaauucuaaucucccugucccuccuccccaccuucccacacauggggcuccgaaucucuggcgaugccuucccaaauuacccugggcccacucugaccccaacacccucccagucaagggcuaggcgaaugggcacgucugugugcacucacacaggcacauacucacucacacggaagacagacaacacagaacggagagcugacuugguggcugggcuugucccacacacuggagcacagcagugaacgagacacaggucccuguccugcugaacuuauacucuagugaggcaggacaaucaacccacuaccuaacgauggcagggacuauuaagaaaaacaagccugggcguggcagcucacaccuauaauccaggcacuuugcgagaccaagguagguggaucacuugggcucaggaguuugagaccaaccugggcaacauagugagacaccaucucugcaaaaaaaauacaaaaacuugccgggcgugguggugcacgccuguagucucagcuauuugaagauuugaaggggcugaggcaggaggaucacuugagccugggagguuaaggcugcagugaaccgagaucacacuacuacacuccagccugggugacagagcaagacucugucuccaaaaaaaaaaaaaaaaaaaagaaaaaaccaaaauaggaagaagaauggcacugaaugaagggaagucaugaaaggucacucuguaaugguggcagcaugcagagaccugaaugaagggggagugggccaugugaacguuugcagaacggcaguccaugcaggaggaacugcaggugcaaaggcccuggggcaggaacaggggcaugcauagcacaguggagccccagcgaggccaguguagcagcaagcaagcagcaagcaagcagggagagccgaaggaaugaggccagugggagggcagacccuguggagccuugggcauggccaggcaggcucacuguauccuagaggcaaugggaacuugcuggaggauuuuuagccgaucagauucauugugaaaagaucaacuuggcugcaauggcaagagagaggcaggcaccguguccggggagaaaugcugaugacugggcccaggucguagaaguagagaugggcaagguggacagagaaaagguuuuaaaguagcaauaauaguacuugcugauucgacugggugguaagagaggaaucguggugcuuugcaaauguguaucaaggccuuugaaugcacgcacgcaugcaugcacccacacgcacacaugcaugcacccacgcacacccgugagccgggcucccugcucucaccauuggccagaagguagaguaccagcuccucgugcccacacaagcaggcauaguaccugaagggaggaaggaaguacaggaggcaguccucagugcugaaggggugcaccaacccccacccuccccaccccucucuccagcacucacaagggggugcugucccacuugucccgcacauucaccuccacgucucgcugcuccagcagguaccugggcaggaaggaggucagagccugggucaggacggguucauggucugagaaagaaggcccguggaaaggaacggagagaaaacaucccuuuugguauggggaagccucccccaggugagggcaggugacaggcagaccagagcaggagaggcacucaaggcaaagugcaggcaaggauguggagguggggucgaacaggcagacacugugugcuaucagugcugggggacgaugggcuacagggacagaagccagagccagugccgaggcuggaccuuuggccuuucagcguuugggagaggaggugauggagccuucacucccaccagagcucucuacugcaggaagaagcuggcccuguuagaagcagggagcccgggaaaaagcugcugcaggccuccugaugguguggagggcacacaauucuaggaggcaggagucgcgggauacagcaacugaugggaugcggaaggugagcgaggggagucgccaaugcuaaugcagccccacugaggcgggggcagcccaaaggaggccuccaggcugcaccuggaagugcugugaacccacucagcguugacacuaugcacuaacucuugaguggcacgggaugucagggagcggcccagggaggcuacgggaguacagcagcccggcgccagcccaggggagguggaagcagucagucagcaccaggucaagggggaggaagggccaagaaaaaaggaggucaaacgggauaguggaagcccaaggaggggaagggccccagaacccaacugggcaccccuucccuccgcguccggcccauggagggggcaucucagcgccagauucacuuuagcugcgucaggaguuuccgaauccucagggaccggaggccgauuaugggcucuagguguuccccgcgccagguccagagagcacgagagaaaggggccacgucuggagucccaggccuauacccgcgcccugcgcccggggggucugacguccgggcccuaccagggcgaacaguggcccgccuucucuccgcccacuucugcgccuucgggccuccgcugagcagucccuucuuacaggaagcccuccgggggucaauggccaucaguguccccgccccagcgcgcuuccgcuggggggcugcggcggggguccggguggucugccccgcgggggcgcuccgagggcugugacccggcagaggcgcccgccucuccgcggccgcccagccgcccgucccagggcccgaggcguuccgagggcggccaccucccgcacccuccccgggacugcgagguccucaccgcacucggcccacaucccccuuccugcagcuggcgaacaggucgcugguguccauggcgcggaggaugguacccgagccgaacgaccucgggcggcgaagccgcgcacccggcggauguaaacacgcucagccccgccccgccccg

SEQ ID NO: 21409 - RNA, 7988 nt, Homo sapiens
cggggcggggcggggcugagcguguuuacauccgccgggugcgcggcuucgccgcccgaggucguucggcucggguaccauccuccgcgccauggacaccagcgaccuguucgccagcugcaggaagggggaugugggccgagugcggugaggaccucgcagucccggggagggugcgggagguggccgcccucggaacgccucgggcccugggacgggcggcugggcggccgcggagaggcgggcgccucugccgggucacagcccucggagcgcccccgcggggcagaccacccggacccccgccgcagccccccagcggaagcgcgcuggggcggggacacugauggccauugacccccggagggcuuccuguaagaagggacugcucagcggaggcccgaaggcgcagaagugggcggagagaaggcgggccacuguucgcccugguagggcccggacgucagaccccccgggcgcagggcgcggguauaggccugggacuccagacguggccccuuucucucgugcucucuggaccuggcgcggggaacaccuagagcccauaaucggccuccggucccugaggauucggaaacuccugacgcagcuaaagugaaucuggcgcugagaugcccccuccaugggccggacgcggagggaaggggugcccaguuggguucuggggcccuuccccuccuugggcuuccacuaucccguuugaccuccuuuuuucuuggcccuuccucccccuugaccuggugcugacugacugcuuccaccuccccugggcuggcgccgggcugcuguacucccguagccucccugggccgcucccugacaucccgugccacucaagaguuagugcauagugucaacgcugaguggguucacagcacuuccaggugcagccuggaggccuccuuugggcugcccccgccucaguggggcugcauuagcauuggcgacuccccucgcucaccuuccgcaucccaucaguugcuguaucccgcgacuccugccuccuagaauugugugcccuccacaccaucaggaggccugcagcagcuuuuucccgggcucccugcuucuaacagggccagcuucuuccugcaguagagagcucuggugggagugaaggcuccaucaccuccucucccaaacgcugaaaggccaaagguccagccucggcacuggcucuggcuucugucccuguagcccaucgucccccagcacugauagcacacagugucugccuguucgaccccaccuccacauccuugccugcacuuugccuugagugccucuccugcucuggucugccugucaccugcccucaccugggggaggcuuccccauaccaaaagggauguuuucucuccguuccuuuccacgggccuucuuucucagaccaugaacccguccugacccaggcucugaccuccuuccugcccagguaccugcuggagcagcgagacguggaggugaaugugcgggacaagugggacagcacccccuugugagugcuggagagagggguggggaggguggggguuggugcaccccuucagcacugaggacugccuccuguacuuccuuccucccuucagguacuaugccugcuugugugggcacgaggagcugguacucuaccuucuggccaauggugagagcagggagcccggcucacgggugugcgugggugcaugcaugugugcgugugggugcaugcaugcgugcgugcauucaaaggccuugauacacauuugcaaagcaccacgauuccucucuuaccacccagucgaaucagcaaguacuauuauugcuacuuuaaaaccuuuucucuguccaccuugcccaucucuacuucuacgaccugggcccagucaucagcauuucuccccggacacggugccugccucucucuugccauugcagccaaguugaucuuuucacaaugaaucugaucggcuaaaaauccuccagcaaguucccauugccucuaggauacagugagccugccuggccaugcccaaggcuccacagggucugcccucccacuggccucauuccuucggcucucccugcuugcuugcugcuugcuugcugcuacacuggccucgcuggggcuccacugugcuaugcaugccccuguuccugccccagggccuuugcaccugcaguuccuccugcauggacugccguucugcaaacguucacauggcccacucccccuucauucaggucucugcaugcugccaccauuacagagugaccuuucaugacuucccuucauucagugccauucuucuuccuauuuugguuuuuucuuuuuuuuuuuuuuuuuuuuggagacagagucuugcucugucacccaggcuggaguguaguagugugaucucgguucacugcagccuuaaccucccaggcucaagugauccuccugccucagccccuucaaaucuucaaauagcugagacuacaggcgugcaccaccacgcccggcaaguuuuuguauuuuuuuugcagagauggugucucacuauguugcccagguuggucucaaacuccugagcccaagugauccaccuaccuuggucucgcaaagugccuggauuauaggugugagcugccacgcccaggcuuguuuuucuuaauagucccugccaucguuagguaguggguugauuguccugccucacuagaguauaaguucagcaggacagggaccugugucucguucacugcugugcuccagugugugggacaagcccagccaccaagucagcucuccguucuguguugucugucuuccgugugagugaguaugugccugugugagugcacacagacgugcccauucgccuagcccuugacugggaggguguuggggucagagugggcccaggguaauuugggaaggcaucgccagagauucggagccccaugugugggaagguggggaggagggacagggagauuagaauuucccccaggccccuucccugcuaacuggugagcccugccucccccaggagcccgcugcgaggccaacaccuucgauggugagcgcugccucuauggggcacugagugaccccauccgccgggcucuacgcgauuacaagcaggucacggcuuccugcaggaggcgggauuacuaugacgacuucuugcagcggugagccagggcacacgaggggugcagcauggggugcgguggcccugguggguguggcgagucugcucugacuguggccugcacuggguucugagugcuccgaggaaugggguggggcugugccaaguauccucccuccuggcuugucccuccccaggcuucuagagcagggcauccacagugacguggucuuuguaguacacgggaagccauuccgggugcaucgcugcguccugggugcacguagugccuacuuugccaacaugcuggacaccaaauggaagggcaagagugucgugguucucaggcacccacugguaugucccuucaggguggcagaggggcaugaacuguccaggaacagcaggagguugugcuggguggcugccucugacauuacuuucugguuuucugcccacagaucaaccccguggccuuuggggcccugcugcaguaccuguacacaggugacccccuggguccaggguaggaggagagggagugggccguccuucuggacagcaguacaccuagguguggcugggcugaccuuucaccucuagacacuucaugguccccccggggugguuccagcugccucucggguuggguugcaagagagaggacuagugugccugcucaggaagagcuugucccacccacaugcugaggcccucccaucuguucccuggggccuguagaacagcuuuugauggggaaaccaugguggcaagugggcccaggaguccuaguccugcagccagguggccaggugggaggggaucacccuuuuucugugggccugaugacagcugaggucccgcaggcccucauccuccccacugcccccaggccgccuggacauuggcguagagcaugugagugacugugagcgccuggccaagcaaugccagcugugggaccugcucagcgaccuggaggccaagugcgagaaggugucugaguuuggugcgagcaggguuuggggcccggggccaugggugcggccuggcagggcuggccuggcucccugaaguuguucuuccccuguaguggcgucuaagccaggcacgugugugaaggugcugaccaucgagcccccaccugcagacccccgccuccgggaggacauggcgcugcuggccgauugugcccugccccccgagcuccgaguaagugcggggcuggugggcaggaagggcguuuugggauggcaggccgugacaggcagcccagauacuugggcucaauuccuugugugguccuggaccaguuacuucccuuuucugaaccuagucguucacuucugugaacaacugcucugauggggucaccucuucuguaccccagggugaucuuugggagcugcccuucccuuguccugacggcuucaacagcugcccugacaucugcuuccgaguggcuggcugcagcuuccucugccacaaggugccugugcccuccuguugccccuggccccagcccguugcccugagcccccgucuagcuccucaggagacagacccuggcccucacacuuccugagcccggccucccccaggccuuuuucuguggccgcagugacuacuuccgagcccugcuggaugaccacuuccgagagagcgaggagccagcgaccucagggggccccccagccgucacccugcauggcaucucacccgacgucuucacucacgugcucuacuacauguacagcgaccacacugaggugggggcucaggcagagcuggggauggcacacaaccugugcugccgugggcugagagggagcgccagggcccugggggucuguggaagggcccagcuggccccaugguugacguuuugagaaggcuggaggggaaggcugugggacuuuggauuuuucuuucagguagaggaagccuuguugggcuccagagagaggaugagugaugagccugugucacagacacuccacacuugucagccacuugggauccucagcuucucuagcaggaggguggaggguggguggggacagccuccucucuguggugcugcagaucccugggguucuggguucccagucuccucuucccuugcugccugccucugucuccagcugccccaagguguccguaagccaaggcugcagggcagcagcagagugcugaagguuugcucugccagggugugugagagagagagagagugugugugugcgugcgcgugcgcgcgcacuauaaagcaauccccauaucugguggcuuaaagaagaggggaguuuguuucuccuucacuucugacugaggugggugccccagggcaaguggcuugcggaagaucaggucaucccuccaucuugccccuguaugccuaagggugaaggucaaaaaccuuuucucugaaggugaguguuucagguucugugggccauauggcccuguuguagcuacucaacucuguagcgcaaagguagccagagacaguacagagaugagugggugaggcugcauuccaauaaaacuuuacuugcacaaacaggcuggauuugguccacaggccguagcuuacccauccugccuggggcaucgcguuuggccauggagauuggguccuaggcaaacucaugcucuaggaggaagaggaaggcagggcaagcaaugcuguuuuuguagaagccaccggaaauugcaccacuucucauguuccccuggagagaacuucgugccuaccugccaacaagggaggcuuggaaagucauucuguggccagggcccuguuuugugggggaaggggaggaagcaugcugggagacagagggcagucccuacugcugcucuaucuccaguggcagcucccuuguccaucccuccgcgcggccugacagccccucagccuccaucuuucccacccccucuacugggcaucuccugcagcucagcccagcucucuggccccuguagcagggguuaccuuugcccacccuggagaagcucccucuucaaggagccucgccacccaaagggcaccuugucucagaguguggcuugggcucuuaaccuggguugauacugguugagcugugugacacugggugagcuuugugaucuugggccaguuacuuaacugcucugugccucuagaacauggggauagcucucgucgucacuuccuaaggccuugugcagaugcauggguuacccagguaaaggagguggcauggcacauggcacauggcuuguaauguggucgcagagcuccccuugucucugucugcagcuugcucccugugccacccaggcucuggccugaaucugagggcuucagucuuauccagcacaggauguaucuguaggugggcucuguguccccacagccucuugagagggagggagcugguagauagucucccaccccuggcagagucccugcauaggucuugacuagcugccucugucccaccauucugacagcccccgcagguaggcaugguuaucuauaccucauggacugggaacuagaggcacagggaggugcagugacuugcccagggccccacagcuagaagugucagacccaggucuguauaacucggagcucagacccuggcuccugcgagggcccugccucccgccugcccugccagccugcucagggcaugggagaaccccccagucuucugcccccuagcgguccugcagaucccugugggaaucugggccagccccccgacccccaaccccauacaugcgcagggagcuccuacucccacuggaagccuucccgccagugccccccaaccaccacaggcccuagccuuggcuguugugcccugggagcccuuggugaccucggggggcaccuucaucccugucuucacugcagcugucccccgaggcagccuaugaugugcugagcgucgccgacauguaccugcugccaggccugaagaggcugugcggccgcagccuggcucagaugcuagacgaggacacugugguggguguguggcgcguggccaagcucuuccgccuggcgcggcuugaggaccagugcacugaguacauggccaaggucauugagaaggugggccaguggucugcagugggugggaaggaggggugagagggcaggcaccccuccacugagcuggcccuucccgcucauagcugguggagcgggaggacuucguggaggcggugaaggaggaggcagcggcuguggcagcccggcaggagacggacucuaucccgcugguggacgacauccgcuuccacguggccagcacggugcagaccuacagcgccauagaggaggcgcagcagcgucugcgggcacucgaggaccugcucguguccaucggucuggacuguugagccccuggcugggcagccccaggggccaggagcucucuuggagacaagcauguguaugcguuugugugcagcucuucuuccugcucccugcacauugagggcuucauggggggugcgaggggcucaguggggcuucucuucccuccaugagccuggagaccccaggggaggauccauuugggaugagcccccuccccccaaugcacaagccagcccccaagacccuggggguggacaccacucagggaaaccuggggugggggugggcuuuggucuuagcacuuuccuucuccagauccccccuacccaccccagucccaaauccaguccucuggcccuugccuagcccugaauugcuucucuaagcugguguucccaugcacagggccauucaggaagggcugggggaguguguguggcaauaaagcuugaaggcaccgugggagc

SEQ ID NO: 21410 - RNA, 12444 nt, Homo sapiens
ccccuggggccguaggaggccgcagcgaggagguagagggggcgggggucgcacuagggugucccuagagaacgaggacucugaaggcgggacauuugggcgacccccgggcggggccagccauuaaacagucccacuucugugccagacacugaacugggcucuugacgggcaucaucucuuaauccucagaacaucccagggagguagguacuauuguuauccccauuuuucagauucagacuuuuaauggggaaacagaccgagacuucuuuuguccccauuuuacagauggaaaaacugagacugaaaaaggucaaauaacauguucaggggcauauaaguagagaaugguaaagccugggcuugaacccaggucugucuggcuuaccagcccacguucuaaaccacuguuagugacuagagaagggagaaagguggaauaggguaagaaaagaggccaagagucccagagaacaugguaagaauggggugcuuggaacucaaagucuuagcagaacccaagagaaauagaagggaaggaaagagcaucagaaaggcgaggcaaggcauagcaguauagcauggugaucagggugcagacucaagacuagcgggguucaaauugcaucuuggaagcauaggcacauacccacccuuacagagucucaguuucuuucucuguaaaaacgagaucacaaugguccuuguucauggugcugagugagaaauucagugagauaaacugauaaagugcucugcaccuagcuugguacccaguuaagugcccugugaguaggaacugugccaucaauuuugucaguaagggacugaagcugggcuuccuugaggcugucccuggagguaagaagcccuugggcuuuucucagaccacuuugucucccaucaauggcccuguccucuccagcuccacaggauccccauauccugggccaugagugaguugaaagacugccccuugcaguuccacgacuucaagucuguggaucaccugaaggucuguccccgcuacacggcagugcuggcacgcucugaggaugauggcaucggcaucgaggagcuggacacccugcagcuggagcuggagacccugcugucuucugccagccggcgccugcgugugcuugaggccgaaacccaggugauaaccccagagaggggccagcaccagagauggacugcaacaaguuaugggaugggucauugaguuagccccauaugcugagacuugggguacagggguuuguggggagagggagagagacgcaaacuggguuugcaugacacaaaaaauacacaagaauaugcaugauccucuuaaauugcaagauuucuaauucaguaagcuuuuauuggcaccccacucaucccccauuguguucuggguccuaugcuagucauuagagaaagguaauuaggacaguuauggcugucagggagcuuggcaacuaggaaagugagaaagucaaguacauaccaggugaugugauguugugguuagcaguccuagggaacuggaauggggaaaccuggauuugaauccuggcauaagcgcuugcuagcauugcuguuuccuagcuaugugacuuugagaaaguugccucauaucucugagugucaguuucccuaucugcaaaguggggugaauaauaggaccuaccuuagugcuuuugugaggauuaaaagagaauuuuuugcaaaaacucagcccaaugccagacacuaaguaaguacuucagauguuauuuauuugcuacucugaugacuuuauucacugcauaaagaugccuugagccuugugugccaggcgcuaugcuguauucugcaaaauagagaugguuaaggugggcuuucugguccucaguagcuuauggucuaguugaagagacaaggugugauggucauuccagugugaccaaacaacacgauugggugcacguuggagcugugaagugccagagacuuguggaggaaggaggugccaacuggaccuaaaaggaugaauggaauuaacuugucccugggaauccauggacccuccuugaggaaggcuaugacucaaguuguauuuuagcaucuaagaaccuggguaacugauugagagaaggcaucucaguaguggugacaucgaagugaagguuugcugagaggacucuucuguuaaacaguaugugacuggcaugggugauacagaagugaaucaguauagaugaacaagugaaugagauuaugagaaguauaugaauaaaguucuaggaggccaggcacagaaaaugagcugaauuuugaaggaugaguaagaguuuacuagguaaaaagaggauggggaaagacccaggagccucuguagauucuagauccuaauuuauucacuagaggaaagagauauucuguguuuucccuucucccccucagugacacuuucuguaaauuucagauccucaccgacuggcaggauaagaaaggugacagacgauuccugaagcugggucgagaccaugaacuuggagcuccccccaaacaugggaagcccaagaagcagaaacuggaagggaaggcaggacaugggccgggcccuggcccaggacggcccaaauccaaaaaccuucagcccaagauccaggaauaugaauucacugaugacccuaucgacgugccacggauccccaaaaaugaugcccccaacagguucugggcuagagaacauagaagggggccucaagguucuggugguggaggcacugguggggcaggggcgcccacucaggaucugcuucucccugcagguucugggcuucaguggagcccuacugugcugacaucaccagcgaggagguccgcacacuugaggaguuacugaagcccccagaagaugaggcugagcauuacaagguagaaacucugggccuugauagacaugaugcggaacaagagaguucagaggugccugagaaguaaagcuaccaaagccaugcaucaucuuccuuccccaacccugcccagucugcugucugcuccaucagugccuccagacaccuaggcccaaacucagcuuucuccgugcacugccuccccucuaccccagccaaaugucaacacgcccucaagcaucuacuuaagugaagucugcccauguuccuuuauccccauccccucugcuuugguccaagccuucaucaacuucuauccaaacagccucuuaacucucuuccuguuucgaggccucuggaggaaccuuucuucuuucuuuaagauauaaaacuugggcugggagcaguggcuuaugccugcaauccuagcacuuugggaggccggggcgggcagauugcuugagcucaggaauuugagaccagccugggcaacauggugaaaccccaucucuaccaaaauacaaaaaauuagccaggcauggcggugugcgccuguagucccagcuacucgggaggcugagucaggaggaucucuuggacccgggagguggaaguugcagugagccgagaucacgccacugcacuccagccugggcaacagagcaagacuccgucuccaaaaaaaaaaaaaagauauaaaagucaccucacgccuguaaucccaacacuuugggaggcuguggcaggcagaucaucugaggucaggaguucaagaccagccugaccaacauggugaaacgccgucucuacuaaaaauacaaaaauuagccuggcacgguggcaugcaccuguaauccuggcuacucgggaggcugagccaggaaaaucaccugaacuggggaggcaucgguugcaaugagccaagaucgugccacuguauuccagccugggugacagaaggagauuccauccauuaaaaaaaaaaaagccgggugcgguggcucaagccuguaaucccagcccuuugggaggccgaggcgggcagaucacaaggucaggagauugagaccauccuggcuaacacggugaaaccccgucucuacuaaaaauagaaaaaauuagccgggcgugguggcgggcgccuguagucccagcugcucgggaggcuaaggcaggagaauggcgugaacccgggaggcggagcuugcagugagcugagauugugccacugcacuccagccugggugacagagcaagacucugucucaaaaaaaaaagaagauauaaaacuauguuuuaaugaugaaaauaaauaaaacaugcuccauuaaagaaaauuuagaaaauacagaaaaauguugagggagaauccucccauaggugagcugucaugaucagaugugcucaugacauggcgcugcauccaggccuuucuuccucccguuaucuacaggaucaaguccacgcaucccaguccuugcuggcacagcuccagugccccucuccauuuuccucggccauaucccucuucauugccguguugaccagucccaccaaguaucucgcccucauuccaggacaccacagccuccucgcuggucucugggccucuggcaagcucuucucucccucuugucuccuugacagacuugacucacccuucaaggcccugaucucauguuaccuccaccaaagcacucuuucagauuccccagcagaaaguuagucagucucuccuuugugcugccacaacacuuugaucucucucuuucacuucacuuaucugauuucuuaaaaauuuaucugaaaaagaguucauacagacagcaguaaauucaagcaauacaaaagguaauucccugucacccgugaccugaaggcuccuaauucucucgagaggcaauugcugugaccugagacaaucuguguacguauucugcaccuucuaucuugggaauuauuucagauuggcuucugugugugugucuuaguucuuuuuggaccugucucccuuacuagagugugaaguacagguuuuaucuucguuguacuuucuuaccuacaccugacacugggcuuggccuuggacuagggacuugagagagauauaagauagguaagugaaugaaugaaugaagcauggcuggccagugcuuacccacucaggguugggugccaucuuuuccacagaucccaccccuggggaagcacuacucccagcgcugggcccaggaggaccugcuggaggagcagaaggauggggcccgggcagcggcuguggcugacaagaagaaaggccucauggggccacugaccgaacuggacacuaaagguaggccucucaccucccugccaaccccaggucaggacuugaauuccagaacuucagcccaccuccccuccuuuccugugcccgcuuagauguggaugcccugcugaagaagucugaggcccagcaugaacagccggaagauggaugccccuuuggugcccugacgcagcgccuccugcaggcccugguggaggugagcagccuaacccaaaagaggaaccauauuuacuuuguguuuuaauguguuaugcuuauuuuuuaucggaauuuaucauacauuuauuagguuggugcaaaaauagguuggugcaaaaguaaaaaccuggacuaauauauagcaaaagauugggaauaauauauaacuugugcaccuaauagaaaagugcacagaucauaaauguacaguuuucacaaaugagcuuguauuaccagccuggagauuacaaaaugaaacauuacuauauccuagaagccccucucaugccccuguuuuucuccaacuuuccccaaagguagccuuacuccacaauuacuuuugcuaagcaucuguuggaggggcuuuauacacauccucccacuggaggccaggacagugguuaacgcuguguuacagauaagaagauugaggcucagaaaagggaacuguucacuugaggucucacacaccaggauucaaacccuagcuucaggggcccugucuuuauaccugcugguugaccuuagacacacccucacacucuuucaccucauugagacucaguuuucuauucuggcucaaacacaagaguuuaucucauggaacagucuggguacauguugcagguuaucuaagguaggggaaggggcaggucucuaucucauaucaucagacagggaccccagcugacgguggccuugcagucugcacaaggucacucugggcguaauugucacuccagucccacagaauaagagcaaggaggccgggcgcgguggcucacgccuguaaucccagcacuuugggaggcugaggcgggcggaucacaaggucaggagaucgagaccauccuggcuaacaugaugaaaccccgucucuacuaaaaauacaaaaaaauuagccgggcauaguggcaggcgccuguagucccaacuacuugggaggcugaggcaggagaauggcaugaacccaggaggcggagcuugcaguaagccgaaauugugccacugcacuccacagccugggugacaaagugagacuccaucucaaaaaaaaaaaacaaaacaaaacaaggaggagugugugaaggaaacuuuuuggcccaugccuagcuauggcucuuaucucuucugaucacuuuccccuggagagaacuugucacaugaccauacccgccugcaagagagccugggaaguacaacuggacaggcauugccuagcugccguggaggaaagaagaguauggcauucggacagcuagcaucuccgccacagcaggccuagcacacugccuggugcguugcagacgcuucacaaaccuuagcuguucauuaccaucauugaguguuaaucauuucucuucuguguuccuuuuucuucacaucaguacgaaaauaaaagggauuucuagaaugaucaaagcaauuugggauugguaugggaaggcuucccacgguaggugggaugggaaagauaaaaggauauuucugguguuugaagacugucaguguaggucagaaaggagcaggaaaguggaacagcuauuuuuccuuccacucauuuuuguggucuucuaggaaaauauuauuuccccuauggaggauucuccuauuccugacaugucugggaaagaaucaggggcugacggggcaagcaccuccccucgcaaucagaacaagcccuucaggugagugguguccuauccacaacccacagucuggcccccgcuucuguuggcuucucuccaucucaaccuggggaaguccucaucaguaagaggcugggggcaguuaggugaagccuaauagcagucucaagugugagugaugacccagcgugucugcaugcacagacugagugcaggguuguucagcacagaacuguucauaccauaaauaacccaaauguccugcugaaggggaaugguuggcuaaauuggcauaacuccauaugaugaaauaacuuggggcuauuaaucauauagcugcaaguauagagaaauauaguuaaaugacaugaaaagauguaaauuauagagugacaaguggagaaaauauuaguuguagcccaguauggaugguauaauacuauuuuuacuuaaaauauauuucuuuuuuucuuuuucuuuuuuuuuuuuugagauggagucucgcucuugucguuuagguuggagcgcaauggcgcaaucuuggcucacugcaaccuccgccucccagguucaagcgauucuccugccucagccaccaaguagcugugauuacaggcgccugccaccauguauggcucauuuuuguauuuuuaguagagacgggguuucaccaucuuggccgggcuggucuugaacuccugaccucaggugauccucccaccucggccuuccaaagugcugggauuacaggugugagccaccaugccuggcuuacuuacaauauauuuaaauaugugcacauaagggaaaaaaccuggacuaauauguagcaaaagauuaggaauaauauauaacaaaaucuggaauauauauaauaauauauaacaaaauaauaguaauucucucuggguuguuggcauuauggguuuuuccauauuuuuugaauaguagauacauacguugcuuguuuuaaaaaccagaccagaugugucugucccucccuuuguaucuggauagauacagagggggugcccaaagggaaaggcagguuuucacugaccuugggaagcccugggaaccuccaaggugggcccuucuccaagcuggcucuugagucugacgggccugccucccgcugcagugugccgcauacuaagucccuggagagccgcaucaaggaggagcuaauugcccagggccuuuuggagucugaggaccgccccgcagaggacuccgaggaugagguccuugcugagcuucgcaaacggcaggcugagcugaaggcacuuagugcccacaaccgcaccaagaagcacgaccugcugaggugagcguuagcaggaugcacagucccggggguggccuuggaggcuguggccacggcuagucaccuuucagggguuuuacaacaggcuuuccaauccuggcuggccucuaaaucaccuggagagccucgaaaaaaacagcaguggccaguccaccggguaugucccaaacaaauucugauuccacagaguggggcucaggcaucugugacugaccgauugauuugauuuguuuuuguuuuguuuuuuuuugagagggagucucgcacugucacccaggcuggagugcaguggcaugaucucggcucacugcaagcuccgccucccagguucaugccauucuccugccucagccuccugaguagcugauacuacaggcacccaccaccacgcccagcuaauuuuuuuguauuuuuaguagagacgggguuucaccguguuagccaggauggucucgaucuccugaccucgugauccacccgccucggccucccaaagugccgggauuacaggcgugagccacugcgccuggccuaguuugguuuuuuaauuaugguaaaggcauaauauaaaauguaucuccaugggaggcugaggcaggagaaucaguugaaccugggaggcggagguugcagugagcugagacugcaccauugcauuccagccugggcaacaagagugaaacugcaucucaaaaaaaaaaagaaaaaaaauuuacgcuucuuaaccauuuuuaaguguacaguuuaguaguguuacccauauucacauuguugugugauuuauuuuuugucuuuucaugcuucuuuucuuuuuauccccaaaguuuuguuauuaaaaauuugauacacacagaaaaucugaaagaaucauacaauaaacaucaguauauucuccaccuagacuaauuaacuguuaacauuuuguuggagaucugugauuuuuauuugcucaucacaagaaauugaccaguguuuuaggacauguucuuuugggaauccaucacagugccugccauucauuugaugucaacucccauccaucuuguucugcauugaucacgaggguauaggugacaucuugaggaagacuguggaauagcuacccuuuagguaaagagauagggaagcaacccgaacaagucucuuugcuucucacagacaagugcugugucuuaacuucauagagcccugacaggacagggcacauucauucauuuggccuuuuuuuuuuuuuuuugagacggugucucacucuguugcccaggcuggagugcagugccaugaucucggcucacugcaaccuccgccucccggguucaggcaguucuccugccucagccuccugaguaguugggauuacaggcaugcacuaccaugccaggcuaaucauuuggccauucuuacugucucuuagauauugugcugggggccagcaagagaggcagagcaagggacuugcagauuacuagcagaugaucaguaaagauaagugccauuaaaaggagagguaguugcugacaagcugccaggguauuuaaggauaagagugacuaauguaugcugagggccuacugugugucaggggcuuuauguacacucucucaagugucuugacaacaacccaggagggaggagcuauuuucguuguuuaccagaugaggaaauaaaggcccagugaagcgaaaugcucugcugaaggucacacagucaauaaacagcaagcugagacuugaaccugugguugaaucaaagccucuuucuauaauaguuuguuuucucugaaaggugagaagaagaaaacacagauggaagaggcacugagggaagcagagggagagagaggaagagagagaaaagcaggcaugugcaguuacagaaguagugggcccuagcugggccugguggcucaugccuguaaucccagcacuuugggagacugaggugggaggcuuguuugagcucaggaguucgaaacuagccugggcaauguagucagacccccuucucuacuaaaaauuuuuaaaaaucagcuaggcaugguggcacaugccuauaguccuacucaggaggcugaugugggaggauugcuugauccugggagguagaggcugcagugagcuugaucaggccacuguacuccagccugggugacagagugagaccugucucaaaaaaaaaaaaaaaaaaaaaaaaagaaguaaugggcaaugaagaaauggcuugcagcucucaggaaaccagagcacagcccuuacccugcugcagagcagcugcaaggccuuaagcagccccugaccugagcaucuccuuccccuucuggaaaacuggcaggcuggacucaaucacuaagugaccuuccagcuccaccaucgaugaaauguauaaaucagacccuguucagagagauugaucuggugucucacccaccuccugucagccucaggcugccuagaccuuagggggcucuggaaugcagaugccgacguaagcaggccuucugcuggcaccggaacaccugaaacaacaguguuuaaaaacaagaguuuggccccagccugcuccagaucucccccucacuaacugugggauccugggaucaucuuugagccucauuuuccucacggguaacauaugaauaauaguacauauuuugcaggguuguuaggauuaacugaaagacagagagagagagugggugugccuguguguguguguuuguguguguguauguauauauauauauauuuuagagacagggucuuacucuguugccgagguuggucucaacuccuggcuucaagugaucuuccugccuccaucucccaaagcgcugggauuacaggcaugagcuacuuugcccagccuacuguguauauuuuuaagaccuuuuuuuuuuugaagacacagucacgcucuguugcccagacuggaguguaguggcaugaucauaguucacuguaaccuugaacuccuggccucaagcaauccucagcucccuuggaguugggacuacaggugugcacuaccacacccagcuaauuuuuuaaauuuuuuguagagacagucucacuauguugcucagacuggucucgaacuccugggcucaagugauccuucugccuugggcucccaaagugcugggacugcagaugugaacccccaugugcagccaagacuuuauucuucuagagcaguuuuaaguucacaacaaaauugagagaaagguacagagaauucccguaucucccuguccccacaugugcacagccucccccgugaucaacaugaguuaauauuuuucaggagcuuaagauagugccauguaaguguaggucaguaacugcuuuuuggucacgacuguaugacacaauccacaggcaugccagccugggcugguggguaggcucggucuugaagagggagggguuguucucuggaggugggcugacccuggcaccuggcuggcugguccccacaggcuggcaaaggaggaggugagccggcaggagcugaggcagcgggugcgcauggcugacaacgaggucauggacgccuuucgcaagaucauggcugcccggcagaagaagcggacucccaccaagaaagaaaaggaccaggccuggaagacucugaaggagcgugagagcauccugaagcugcuggauggguagcccucaccccugccucaggcugauuaucuggccuaggggaggggaagggaggcccacuuccuucuuugggcacaggaaacauuggccuguggcugucccucaaauggcggcagucucuagagggccguggcccuuccccugaggucuuuuggccuagcucuguacaaccaggacacaggaagcccugcugggcuagccugaggccuagucucugcuugguccccgagaugggguuggaggggacuucguuucugggucuuccucuuccccucuuuaccaucccccacucccuaauccccuaccccugucuccccuucaaggacuucucccuugugguuuuguaaagugcaaacuuaagaauaaagugacugcugugguu

SEQ ID NO: 21411 - RNA, 14945 nt, Homo sapiens
gcgccucccaccgccgcacuuucacucuccgucagccgcauugcccgcucggcguccggcccccgacccgcgcucguccgcccgcccgcccgcccgcccgcgccaugaacgccaaggucguggucgugcugguccucgugcugaccgcgcucugccucagcgacgguaagugcgcucggcggggaggcccuggcgaggcucugggcuucggcucccgcccggcgcagagccgcggcuccucugccugcgcccgcaguuugcgccgcccgacacaguggggguggaggcagcucgcuuagcugggcgcucuggugcggugucgcguucaaagcccuacuuuugcgccgaggguuugugaccugcagagagcgaccgccugaccucaagcuggcugcagagcgaggucagccgggacaacugggcaggaacgccccaagagagcguucgggacuggcgcgggaaggcgcgaggguggggagccgcggaccccagaccccugccugcccacccuccacccacugccuucccgcugcgggcucgguuuccacaggcgaaugggcuccgagguccugcugcgcacagugcuggaggucgggcggugcauggcgagagcgcgcuuugcaaaguucgccucaugccgcgacuugaggcugugagguccgaugcagccgcgcagccuccgcucccugcgaagccgauccucuccccacacccucgcggggcucuuggccaggcgcgggcgggcugcgcggcgcagcugucgggcuugugccacccgccaggccgcgcuucugcacagcuccgcgguccgcagcgacgcggaccugggcgcgcguccagccgcugucuuccugucucuucucggguucaccugagagaggcccagggacccuccgagccucacacgcccccuccccagcuccccaaacacaccugcagacaggcucuuuugucaccagcuggccaagcgcuuugccccagaaugagagcugcagcaaaguucaaucuccaaggcccugggccacugggaaccguggugucccguuucacugggagagggcuuuuuucuuuucuuucgcugaagagaaacucgcugcgcugucacaggacaccgaugcaaaccaaaauaaacuguugccucugaacacacaaaacaaaacccuguggcucaggccgcugagcuuccuuggcugugaaguuuccugcaaagaguugaaggacacucugagugcucuugcagccgcgggcugugcaggcccagcgcgccucgagcccuuggcuggguuggugcagacguggccccggcguccuagcuggcuuggacugugcgcuggugugagcaggaccagcgcagcugagucgggcuggagaagcugggcagccuggggucguggcggacugccuaaguguuaaggacacagacugaaggcaauugggaauguucgucguugaugaaaagucccugaggcugugucugcacacugacccccccccccccccgcaagucauggggcauguuucuaguuuuuauugcuggauauucuucuguuccuguaaggucucugguuugggcaguuauugacugauuggugggaugagcgcggaggugucacagugcgccgcucugggaaauggugcugcccccuccccggagggcuggagagaggauuggaaugaggaaccucggucuuugaguuaugggugcaacugaccugggggaagcacagagacgugggguucaucccagacuccuccuggccugggaagggugacauggcccucagaguugccccauuggcagccaaguaaccagggcaggagccugggcuccaggcagaucugcuccuuacacacaucgccagaauguuuuguuuuguuuuguuuuccccucaccucacagugccuaugugcccccuauccccacacuuaguccucaagcugcacuacagagagagcuuggccagggguccugccccucccccauuggcugacuuccgucaggcagcugggcccuuggguuucccgggcuuaaacucagggugggcccccuucccaagccugcuuggaggggccagcugggcuccugucucugcauuagacuggagggcuuucugaaaacuccuggagccaagcucacccggucccaaauccgggguaccaucagagccagucaggacucuugccgguacacggauuuacauccagaacgguugggaaaguuagucuuacugacaaaaagcuggaggaaggagcacaugagguacacacgagaccauguucuuuugguaagcacaccugggggcucugucacuuuaaaaagaccuguugaaauucgcugcuugacaggcgggccuuagguccugggaguagaagcaagaauugcuuuugaaggaaauggauaaucccaggggguggagggggagaggagagagagccuguguguugagcucugaauaggcucugauuucuggccucaucaccacugcuugguuggggggccagaggagcuucucuccucugggcgcuggagagucacagccccacccaucccagcgggggcggcugcagcacuugcccuuggcugcauaucuucaagcucacuguugccgggagggggcuugugccucacuaccggccuccuauucuccugcuccacccccaacccacccccugccucagcuuggaagggcccaaaagaaauccagggaaaccuggaggcacaacacucaggagcguuuagcuccucaguuacccaggcugcaggccccggcccuggggguggcuuucccaggugaucugguuacagugcagugcugacuuccccugcagggucccagugcagcugcuggaagcuggccccagaggugccuuucuggaguuagaucagguguaacugugaaggcugccuuaggucucuccagugccaugagucaccagcacccugaugcuuggcuuuuuccugguuuucagggaguugcauuugguccuggggacaaggaaguggggggacaagugguccacuuuuccugcaacuugguggcugaauacacaaugcaauuccuaguccacaucaucccucaauugauugcagucuguagaaaaaauaaaauaaaaugagccccuuacucaagauuuccuccuacuuccccagcauucuuucccaaaggugcagaauuucagaaccacagaggucucucagaacuuuguaaacaggcaaacuuaaaaaaaaagaaaaaagaaaaaaaaucucuggaccaaauauucuuagacauauauuuaaucucugaugaaaggauccacaaguucaaauaauuugggguauuaaguggggcuuggauaaaaucuucaaggaaaaaagaaaaacaaaaagcacacacaaaucccagcccuccagggcuugcaauccuauauuuaaagggugagcaguggguucugcaggagccccuugcuaauuuacacuaaugagugucaauuauggcauuuuguaaauuggugauuuugcaaagaucuuaauacaauuccugaggcuacagcaucccugccuaggcaaugaaaaccacauuuaacuccagcuccacuaaucucuaagccuuggggaaagugcugggcagaagguggguccuuggccugcucucaggggacucacagguaggaagccagccaggauucuuuugugccuuccagagcuuuaggugaaugugaggaggggucucuggggugggggagggcagcauuccugaguacuacugugcuuccuggcuagaggccugugccagaggagagaggccagggagccuggagccucuugucccccuuucuuuucccugaguagggagaucuuucucaguugucccuugaggaauuuuuuuuacaaagaguaacuggaaauuucaguaccuuggacugaaaccguuaucuacuauaauuacuaccuuuaucuugagacacugagcagguggcuucuaauuuaaacucccgccucaucuaggcuccggcucuccccaggccuguugggcuccuugcccuguagaagcugagccugagcucagccagcacucacuguguugccugaggagauggccuuucccaacauacaccaguaaccuggaacuuaccccagugaugccgucucuugauccuuaaucgcugcaccaacugcugcagcccagacacacauuaccaaaaucuggcaggguaguaaagugccuuguuguccuuaccucuucuagggaagcccgucagccugagcuacagaugcccaugccgauucuucgaaagccauguugccagagccaacgucaagcaucucaaaauucucaacacuccaaacugugcccuucagauuguguaagucuugaaauugaacaucaucuaacgaacauaguugcaucuaacgaacauaguaacaucuaacccgagucuuauuaaagguguagaggugacaagccaaguguccaaccuugaacuuggcauaauuaguggcagcuauucuuaucaugaggaccuuuaguaugccaccaggcauuaauuuuaaaagccgcucuuggccugggcacccugcugugcucguaguaguucucucuucuuuccaaaccuguguucuucagcacagcacagcuggaugcuggagaaacuaugggcuucaccaagguuuuggcugaagccuaguaaauuagccagcccuuagcuaauaacagugauaacuggccugccaguuucggggaucugaugcccuacauuaacucacaagacccaaaugcaguuuaaguccucuuuaaccauugggugaaacuucaacauuuucagcucacuugccuguauuuucucaaguacaacauaugagguuuugguguuauuugguguggauggcagccacuaacauuugauuuuauucauuugggaaacaaagaccaaaaucacacauccacaagacaggaagaucucagcuggguacagaagaccgggagaaaugcgggaagaaagccaugugcuugaaagcccucucaugcucaagagguccugugucugaacacggggaagcgagggcucagggagucuccuggagaggauuugauugcucagaaguucuagugcuaaaaaugggguggggagacagcaguuggaaccaaagcuacaacuuucccaagacuuuuccacccaacaccaaauguuuuuacuuuugauuuuagaaaacuguuuuuaguuuugaguuaacccuuuacugccuugaauguguuuguuauuuacaguauguuuuagggcccuagaaaaugaauguuuuuucuguacuuugccuacaacaugauacuuuaucucuugugaagaguauuuuaaagaugcucaauuuagcuaccuuggaccugcuuuacagcacugaucaugcugguuuacuggccuggaaaugcaccuugaaguugaagaugccaaauacaauucucaggucugagcagacacuaaauuaacaaagaauaggccccagauuuggaccccaauguggguugcuccgagccacacccaucucugcaccccucuucaccuaauggacaggcugcuugaagacucccugggugccccugaaccacuguucuggggcuuagcuguccucaagacccuuaaguacuugggcugcaugagauuaccuggcaccaaagggcuuucuggcaagagauucagagagaugaaaucaggccuuccccaggaguuugcauguagggaagcuuuuaagagugugaacuuuuaaaaaacaaaugagaccaagaaacauucagugaacuuguaaaaucuuucuagaaacuauuuucugguaagccaccugcacugccccuccccucccuggcuggucacccucccggucagaccgcggugacuucuggcaggccuccuuccuccaggcuuccucaugcccauccuuaagucggcccuauaucuaucaagaugacccauccaaauaaaccucugcucuguugcucuccauucuccccuccccagguaccuagagcauccugucguccccuuccucaguuuccucuguaugcuuugaugaccccccuggcguauuugcuccugauuuucccuucccguuuauuuacucuccaagcuccuacuuauccuucaaaggcagcucaaaugcucccuuacaugaauuccccugcacugccccggaaagacuucuguucacauuuccaugucucugcaauggaacuuccugcacugccagcgcugagcuuuccccagcacaccgcgagcaccucuggagccugagcguaccaaguggagcacggggugccagcgagggcccuagauggguguugggggagcggaugcacacguugcagccgcgccuuccuccugugcagccgcacacuguugccauucuguuuucacagagcccggcugaagaacaacaacagacaagugugcauugacccgaagcuaaaguggauucaggaguaccuggagaaagcuuuaaacaaguaagcacaacagccaaaaaggacuuuccgcuagacccacucgaggaaaacuaaaaccuugugagagaugaaagggcaaagacgugggggagggggccuuaaccaugaggaccagguguguguguggggugggcacauugaucugggaucgggccugagguuugccagcauuuagacccugcauuuauagcauacgguaugauauugcagcuuauauucauccaugcccuguaccugugcacguuggaacuuuuauuacugggguuuuucuaagaaagaaauuguauuaucaacagcauuuucaagcaguuaguuccuucaugaucaucacaaucaucaucauucucauucucauuuuuuaaaucaacgaguacuucaagaucugaauuuggcuuguuuggagcaucuccucugcuccccuggggagucugggcacagucaggugguggcuuaacagggagcuggaaaaaguguccuuucuucagacacugaggcucccgcagcagcgccccucccaagaggaaggccucuguggcacucagauaccgacuggggcugggcgccgccacugccuucaccuccucuuucaaccucagugauuggcucugugggcuccauguagaagccacuauuacugggacugugcucagagaccccucucccagcuauuccuacucucuccccgacuccgagagcaugcuuaaucuugcuucugcuucucauuucuguagccugaucagcgccgcaccagccgggaagagggugauugcuggggcucgugcccugcaucccucuccucccagggccugccccacagcucgggcccucugugagauccgucuuuggccuccuccagaauggagcuggcccucuccuggggauguguaauggucccccugcuuacccgcaaaagacaagucuuuacagaaucaaaugcaauuuuaaaucugagagcucgcuuugagugacuggguuuugugauugccucugaagccuauguaugccauggaggcacuaacaaacucugagguuuccgaaaucagaagcgaaaaaaucagugaauaaaccaucaucuugccacuacccccuccugaagccacagcaggguuucagguuccaaucagaacuguuggcaaggugacauuuccaugcauaaaugcgauccacagaagguccuggugguauuuguaacuuuuugcaaggcauuuuuuuauauauauuuuugugcacauuuuuuuuuacguuucuuuagaaaacaaauguauuucaaaauauauuuauagucgaacaauucauauauuugaaguggagccauaugaaugucaguaguuuauacuucucuauuaucucaaacuacuggcaauuuguaaagaaauauauaugauauauaaaugugauugcagcuuuucaauguuagccacaguguauuuuuucacuuguacuaaaauuguaucaaaugugacauuauaugcacuagcaauaaaaugcuaauuguuucaugguauaaacguccuacuguaugugggaauuuauuuaccugaaauaaaauucauuaguuguuagugauggagcuuauagacguuucugguuuauauaguuaagccugccugcagucaggugucugagaccccuucucacagcccaugugugacaguguaugggcuuuucucacgagcagauuagaucugcagcucaaguuuuuggaucuuuuuuuuuuuuuuuuaacccgauugaaauagcagugcugguuuucugaagaauaauauuugacucacuaauucgucuucccucccuccuccuccuugguucuccuaacuuccccauguaauccccagagacucaacccuaguaauaucaaccuuuuacauuuucccauguaaaaaucccaugacuccaggccaugguuaauaugaagcuuucacagggacagguggccucaccccauaaaucauuaaauaccauucagcuugaaucauuuuaaugugacagucacgagccaguugcucuaauaaaauucugcuaaccagcucucucccuugcucuccagaacaaucgcauucauucccaggaguguucacaggcgucuagaaaggggaaggugggaccacugccuuuuuucuccucuucugaauggcagucugaaccuggggccugcagccuccaaaacguuauucaauuugaaaugcagacauuucuuagagaaagcuaagaguucagcccugcauugagaagaagaaaaagucccaugagaacagggcaggguggggugacaaggaccacgauggccagccuggcccuggguguacccugagauguggauuccuuguccccagugggaaucagguucagguuggcagauuggcagucgcuguaacccauucacaaagguguucuaggagcccauugaacauuuguuugaauggaaggaaauguccaauuuauuuuaaugaauuacugauaaacagugcuuugaccaggggccuccaggccugagacugaaggcacaguuuaaccaguacacgggccaguguuaaaucuuaugcagacugagacgaacuuuuguuuauuuccacauuauuaaugguucuacuaauuuuaucuaagggggcgcagagaagaaaaaguggggaaaaaagaaaagauaggaaaaaagaagcgacagaagaagagaaaggcugcccagaaaaggaaaaacuaguuaucugccaccucgagauggaccacaguucacuugcucucggcgcuuuguaaauuugcucgauccuccuccaggacagacccccaugcagacugggcaggggcucagacuuccgugggggagcagugcuuugcugcccugccagccacaccggcuucuguauuuaugugcuuuuuaaggcccuuguuggucugcuaaguuaugaagaaaguaguugugcagagacuggggcgggggucugugacgcggagccugugugcucaggacucuguccagaauagccugggagcuccaggaaugcccagguugcugagccccccagcccgcccuccacuuccucucuuagaaggccugcgcucacuggggagcucaccagcuccacacacuugcagucugcauuccuguggagaccaggcuguggccaccuggccagugugcagggcaaccugcuagcagagguggccucgccaggaagggggugugccaccccucuguggcccucaggaaaggugaaaacugacugacccuuaggaaugggcccuggcuuuuuccaaauacccauugccuuucccuccagcacucugccaccugggaaggggcuucuucagccccuccuuccuggguugugggaguggcuuuauccccaagcccggguggguuucugcaaacuguguggggugagcccgagggaaugcugcauucucagagagcagauguggaaacacuucucagggagcuccucuuugggcaauucucuuuagagucuuuaaacgggucccccacguggaggacagaugugcuauggaacuuugcaaggguccugaaucccuggggaucccagccuguccccucccgccuccugcgugauggcgugugcuccagcugcagggcacagcugccucuguccucauucaugggaaauaccuuaucugccuaaagcaaauaccacuuaagcucuaggaacuuuccugcacccuccuucccugcccauguagauguaugugugagauuuuuuggcaaguuucucuaaucuggaccgggaggauggaagagcaaggaccccauuucaguagugcucggaaaaaggaugcguugaauuucucagcccuucuccaccucacauaaacacccgcccacccugcacccggauccugggucauaauuuuaauaaaugcagaaagagaaagugguuggaggauggagcacauggaauucaggagaaaacccacaaagaccccugcaugucagacacacccugucccggagcgugguguccccuugagcuuuaaugagcucccugugaucacagccaugccuucuccucguuggggagguguccuaggaugcuucagccaaagaccuuuguuucccgcugcuaucucuuuuaccuggacaacucuccuggcccacguuccucuugccagcacugggggucacaggccugagcccuggguacaggggugcccuagucuucugcccuccccaccucuuaaggcacagagcuguugggugggcugccuggggcugccauccuucccguggaagccaguagccacucuaguccaugggacucuugacaaaagcgccccgagagggcaaaccugugcccccauacucgccugcauucuucggacuccacaugcagcagggcuuugugccuggggagggguggccagucuguccuggucaguaugaaaagcuguuggcccccuagggacagagggcccagcuaaggcugccugaggauacaaacugcuugcuaucccacuccuggggagcagggucugcagggacugagagugggucccaccuugagaacgcaugcaagguccguccugucuugaugucuugaugugacuguaugugcccugggggcucacugugguuuacaaguggcuugugaagcuccugggagcaggugguacacccagugcugaagacagggucgccguggaagagugaagagccugaccgggauuccugguggguugaaacuaggaagugcucacaccagucagagccaaaugaggggugcgcuauggucacugcucuguccagcaugcguuccuccugggagguccuggccaccugugcacccaccccugugccaccuccagcagucccaccuggggccaccuacgguggcauggccccuggcugagaggccccgagggcgaaggguuacuggaagccacgaaagugccucuugggacagccgaggccaggaugcagggcagcagcauccugagccucagccccacgccggugccggguaagcagugugcccuguccccgucguaugaccacucugaugggccucucugugccuucgugcgucugccacgcccagugcuugccacgugucuguccucugcuuucugccauccaugggucccuccgcuucagccuggcugcgucucgcacuccccucccgucuguugucgcagggccucugaagggagaugcauggccaagguggcaacuuggaaguagggauuggccccagggccuccgcgcaggccgcuguccuucuggagcuggcuggguguggggggaaccugccuuaaugguguuucccucuguucuugucaacaggagguucaagaugugagagggucagacgccugaggaacccuuacaguaggagcccagcucugaaaccaguguuagggaagggccugccacagccuccccugccagggcagggccccaggcauugccaagggcuuuguuuugcacacuuugccauauuuucaccauuugauuauguagcaaaauacaugacauuuauuuuucauuuaguuugauuauucagugucacuggcgacacguagcagcuuagacuaaggccauuauuguacuugccuuauuagagugucuuuccacggagccacuccucugacucagggcuccuggguuuuguauucucugagcugugcagguggggagacugggcugagggagccuggccccauggucagcccuaggguggagagccaccaagagggacgccugggggugccaggaccagucaaccugggcaaagccuagugaaggcuucucucugugggaugggaugguggagggccacaugggaggcucacccccuucuccauccacaugggagccgggucugccucuucugggagggcagcagggcuacccugagcugaggcagcagugugaggccagggcagagugagacccagcccucaucccgagcaccuccacauccuccacguucugcucaucauucucugucucauccaucaucauguguguccacgacugucuccauggcccugcaaaaggacucucaggaccaaagcuuucauguaaacugugcaccaagcaggaaaugaaaaugucuuguguuaccugaaaacacugugcacaucugugucuuguuuggaauauuguccauuguccaauccuauguuuuuguucaaagccagcguccuccucugugaccaaugucuugaugcaugcacuguucccccugugcagccgcugagcgaggagaugcuccuugggcccuuugagugcaguccugaucagagccgugguccuuuggggugaacuaccuugguucccccacugaucacaaaaacaugguggguccaugggcagagcccaagggaauucggugugcaccaggguugaccccagaggauugcugccccaucagugcucccucacaugucaguaccuucaaacuagggccaagcccagcacugcuugaggaaaacaagcauucacaacuuguuuuugguuuuuaaaacccaguccacaaaauaaccaauccuggacaugaagauucuuucccaauucacaucuaaccucaucuucuucaccauuuggcaaugccaucaucuccugccuuccuccugggcccucucugcucugcgugucaccugugcuucgggcccuucccacaggacauuucucuaagagaacaaugugcuaugugaagaguaagucaaccugccugacauuuggaguguuccccuuccacugagggcagucgauagagcuguauuaagccacuuaaaauguucacuuuugacaaaggcaagcacuuguggguuuuuguuuuguuuuucauucagucuuacgaauacuuuugcccuuugauuaaagacuccaguuaaaaaaaauuuuaaugaagaaaguggaaaacaaggaagucaaagcaaggaaacuauguaacauguaggaaguaggaaguaaauuauagugauguaaucuugaauuguaacuguucuugaauuuaauaaucuguaggguaauuaguaacauguguuaaguauuuucauaaguauuucaaauuggagcuucauggcagaaggcaaacccaucaacaaaaauugucccuuaaacaaaaauuaaaauccucaauccagcuauguuauauugaaaaaauagagccugagggaucuuuacuaguuauaaagauacagaacucuuucaaaaccuuuugaaauuaaccucucacuauaccaguauaauugaguuuucaguggggcagucauuauccagguaauccaagauauuuuaaaaucugucacguagaacuuggauguaccugcccccaauccaugaaccaagaccauugaauucuugguugaggaaacaaacaugacccuaaaucuugacuacagucaggaaaggaaucauuucuauuucuccuccaugggagaaaauagauaagaguagaaacugcagggaaaauuauuugcauaacaauuccucuacuaacaaucagcuccuuccuggagacugcccagcuaaagcaauaugcauuuaaauacagucuuccauuugcaagggaaaagucucuuguaauccgaaucucuuuuugcuuucgaacugcuagucaagugcguccacgagcuguuuacuagggaucccucaucugucccuccgggaccuggugcugccucuaccugacacucccuugggcucccuguaaccucuucagaggcccucgcugccagcucuguaucaggacccagaggaaggggccagaggcucguugacuggcuguguguugggauugagucugugccacguguuugugcuguggugugucccccucuguccaggcacugagauaccagcgaggaggcuccagagggcacucugcuuguuauuagagauuaccuccugagaaaaaagguuccgcuuggagcagaggggcugaauagcagaagguugcaccucccccaaccuuagauguucuaagucuuuccauuggaucucauuggacccuuccauggugugaucgucugacugguguuaucaccgugggcucccugacugggaguugaucgccuuucccaggugcuacacccuuuuccagcuggaugagaauuugagugcucugaucccucuacagagcuucccugacucauucugaaggagccccauuccugggaaauauucccuagaaacuuccaaauccccuaagcagaccacugauaaaaccauguagaaaauuuguuauuuugcaaccucgcuggacucucagucucugagcagugaaugauucaguguuaaaugugaugaauacuguauuuuguauuguuucaauugcaucucccagauaaugugaaaaugguccaggagaaggccaauuccuauacgcagcgugcuuuaaaaaauaaauaagaaacaacucuuugagaaacaacaauuucuacuuugaagucauaccaaugaaaaaauguauaugcacuuauaauuuuccuaauaaaguucuguacucaaaugua

SEQ ID NO: 21412 - RNA, 14945 nt, Homo sapiens
uacauuugaguacagaacuuuauuaggaaaauuauaagugcauauacauuuuuucauugguaugacuucaaaguagaaauuguuguuucucaaagaguuguuucuuauuuauuuuuuaaagcacgcugcguauaggaauuggccuucuccuggaccauuuucacauuaucugggagaugcaauugaaacaauacaaaauacaguauucaucacauuuaacacugaaucauucacugcucagagacugagaguccagcgagguugcaaaauaacaaauuuucuacaugguuuuaucaguggucugcuuaggggauuuggaaguuucuagggaauauuucccaggaauggggcuccuucagaaugagucagggaagcucuguagagggaucagagcacucaaauucucauccagcuggaaaaggguguagcaccugggaaaggcgaucaacucccagucagggagcccacggugauaacaccagucagacgaucacaccauggaaggguccaaugagauccaauggaaagacuuagaacaucuaagguugggggaggugcaaccuucugcuauucagccccucugcuccaagcggaaccuuuuuucucaggagguaaucucuaauaacaagcagagugcccucuggagccuccucgcugguaucucagugccuggacagagggggacacaccacagcacaaacacguggcacagacucaaucccaacacacagccagucaacgagccucuggccccuuccucuggguccugauacagagcuggcagcgagggccucugaagagguuacagggagcccaagggagugucagguagaggcagcaccaggucccggagggacagaugagggaucccuaguaaacagcucguggacgcacuugacuagcaguucgaaagcaaaaagagauucggauuacaagagacuuuucccuugcaaauggaagacuguauuuaaaugcauauugcuuuagcugggcagucuccaggaaggagcugauuguuaguagaggaauuguuaugcaaauaauuuucccugcaguuucuacucuuaucuauuuucucccauggaggagaaauagaaaugauuccuuuccugacuguagucaagauuuagggucauguuuguuuccucaaccaagaauucaauggucuugguucauggauugggggcagguacauccaaguucuacgugacagauuuuaaaauaucuuggauuaccuggauaaugacugccccacugaaaacucaauuauacugguauagugagagguuaauuucaaaagguuuugaaagaguucuguaucuuuauaacuaguaaagaucccucaggcucuauuuuuucaauauaacauagcuggauugaggauuuuaauuuuuguuuaagggacaauuuuuguugauggguuugccuucugccaugaagcuccaauuugaaauacuuaugaaaauacuuaacacauguuacuaauuacccuacagauuauuaaauucaagaacaguuacaauucaagauuacaucacuauaauuuacuuccuacuuccuacauguuacauaguuuccuugcuuugacuuccuuguuuuccacuuucuucauuaaaauuuuuuuuaacuggagucuuuaaucaaagggcaaaaguauucguaagacugaaugaaaaacaaaacaaaaacccacaagugcuugccuuugucaaaagugaacauuuuaaguggcuuaauacagcucuaucgacugcccucaguggaaggggaacacuccaaaugucaggcagguugacuuacucuucacauagcacauuguucucuuagagaaauguccugugggaagggcccgaagcacaggugacacgcagagcagagagggcccaggaggaaggcaggagaugauggcauugccaaauggugaagaagaugagguuagaugugaauugggaaagaaucuucauguccaggauugguuauuuuguggacuggguuuuaaaaaccaaaaacaaguugugaaugcuuguuuuccucaagcagugcugggcuuggcccuaguuugaagguacugacaugugagggagcacugauggggcagcaauccucuggggucaacccuggugcacaccgaauucccuugggcucugcccauggacccaccauguuuuugugaucagugggggaaccaagguaguucaccccaaaggaccacggcucugaucaggacugcacucaaagggcccaaggagcaucuccucgcucagcggcugcacagggggaacagugcaugcaucaagacauuggucacagaggaggacgcuggcuuugaacaaaaacauaggauuggacaauggacaauauuccaaacaagacacagaugugcacaguguuuucagguaacacaagacauuuucauuuccugcuuggugcacaguuuacaugaaagcuuugguccugagaguccuuuugcagggccauggagacagucguggacacacaugaugauggaugagacagagaaugaugagcagaacguggaggauguggaggugcucgggaugagggcugggucucacucugcccuggccucacacugcugccucagcucaggguagcccugcugcccucccagaagaggcagacccggcucccauguggauggagaagggggugagccucccauguggcccuccaccaucccaucccacagagagaagccuucacuaggcuuugcccagguugacugguccuggcacccccaggcgucccucuugguggcucuccacccuagggcugaccauggggccaggcucccucagcccagucuccccaccugcacagcucagagaauacaaaacccaggagcccugagucagaggaguggcuccguggaaagacacucuaauaaggcaaguacaauaauggccuuagucuaagcugcuacgugucgccagugacacugaauaaucaaacuaaaugaaaaauaaaugucauguauuuugcuacauaaucaaauggugaaaauauggcaaagugugcaaaacaaagcccuuggcaaugccuggggcccugcccuggcaggggaggcuguggcaggcccuucccuaacacugguuucagagcugggcuccuacuguaaggguuccucaggcgucugacccucucacaucuugaaccuccuguugacaagaacagagggaaacaccauuaaggcagguuccccccacacccagccagcuccagaaggacagcggccugcgcggaggcccuggggccaaucccuacuuccaaguugccaccuuggccaugcaucucccuucagaggcccugcgacaacagacgggaggggagugcgagacgcagccaggcugaagcggagggacccauggauggcagaaagcagaggacagacacguggcaagcacugggcguggcagacgcacgaaggcacagagaggcccaucagaguggucauacgacggggacagggcacacugcuuacccggcaccggcguggggcugaggcucaggaugcugcugcccugcauccuggccucggcugucccaagaggcacuuucguggcuuccaguaacccuucgcccucggggccucucagccaggggccaugccaccguagguggccccaggugggacugcuggagguggcacaggggugggugcacagguggccaggaccucccaggaggaacgcaugcuggacagagcagugaccauagcgcaccccucauuuggcucugacuggugugagcacuuccuaguuucaacccaccaggaaucccggucaggcucuucacucuuccacggcgacccugucuucagcacuggguguaccaccugcucccaggagcuucacaagccacuuguaaaccacagugagcccccagggcacauacagucacaucaagacaucaagacaggacggaccuugcaugcguucucaaggugggacccacucucagucccugcagacccugcuccccaggagugggauagcaagcaguuuguauccucaggcagccuuagcugggcccucugucccuagggggccaacagcuuuucauacugaccaggacagacuggccaccccuccccaggcacaaagcccugcugcauguggaguccgaagaaugcaggcgaguaugggggcacagguuugcccucucggggcgcuuuugucaagagucccauggacuagaguggcuacuggcuuccacgggaaggauggcagccccaggcagcccacccaacagcucugugccuuaagagguggggagggcagaagacuagggcaccccuguacccagggcucaggccugugacccccagugcuggcaagaggaacgugggccaggagaguuguccagguaaaagagauagcagcgggaaacaaaggucuuuggcugaagcauccuaggacaccuccccaacgaggagaaggcauggcugugaucacagggagcucauuaaagcucaaggggacaccacgcuccgggacagggugugucugacaugcaggggucuuuguggguuuucuccugaauuccaugugcuccauccuccaaccacuuucucuuucugcauuuauuaaaauuaugacccaggauccgggugcagggugggcggguguuuaugugagguggagaagggcugagaaauucaacgcauccuuuuuccgagcacuacugaaaugggguccuugcucuuccauccucccgguccagauuagagaaacuugccaaaaaaucucacacauacaucuacaugggcagggaaggagggugcaggaaaguuccuagagcuuaagugguauuugcuuuaggcagauaagguauuucccaugaaugaggacagaggcagcugugcccugcagcuggagcacacgccaucacgcaggaggcgggaggggacaggcugggauccccagggauucaggacccuugcaaaguuccauagcacaucuguccuccacgugggggacccguuuaaagacucuaaagagaauugcccaaagaggagcucccugagaaguguuuccacaucugcucucugagaaugcagcauucccucgggcucaccccacacaguuugcagaaacccacccgggcuuggggauaaagccacucccacaacccaggaaggaggggcugaagaagccccuucccagguggcagagugcuggagggaaaggcaauggguauuuggaaaaagccagggcccauuccuaagggucagucaguuuucaccuuuccugagggccacagagggguggcacacccccuuccuggcgaggccaccucugcuagcagguugcccugcacacuggccagguggccacagccuggucuccacaggaaugcagacugcaaguguguggagcuggugagcuccccagugagcgcaggccuucuaagagaggaaguggagggcgggcuggggggcucagcaaccugggcauuccuggagcucccaggcuauucuggacagaguccugagcacacaggcuccgcgucacagacccccgccccagucucugcacaacuacuuucuucauaacuuagcagaccaacaagggccuuaaaaagcacauaaauacagaagccgguguggcuggcagggcagcaaagcacugcucccccacggaagucugagccccugcccagucugcaugggggucuguccuggaggaggaucgagcaaauuuacaaagcgccgagagcaagugaacugugguccaucucgagguggcagauaacuaguuuuuccuuuucugggcagccuuucucuucuucugucgcuucuuuuuuccuaucuuuucuuuuuuccccacuuuuucuucucugcgcccccuuagauaaaauuaguagaaccauuaauaauguggaaauaaacaaaaguucgucucagucugcauaagauuuaacacuggcccguguacugguuaaacugugccuucagucucaggccuggaggccccuggucaaagcacuguuuaucaguaauucauuaaaauaaauuggacauuuccuuccauucaaacaaauguucaaugggcuccuagaacaccuuugugaauggguuacagcgacugccaaucugccaaccugaaccugauucccacuggggacaaggaauccacaucucaggguacacccagggccaggcuggccaucgugguccuugucaccccacccugcccuguucucaugggacuuuuucuucuucucaaugcagggcugaacucuuagcuuucucuaagaaaugucugcauuucaaauugaauaacguuuuggaggcugcaggccccagguucagacugccauucagaagaggagaaaaaaggcaguggucccaccuuccccuuucuagacgccugugaacacuccugggaaugaaugcgauuguucuggagagcaagggagagagcugguuagcagaauuuuauuagagcaacuggcucgugacugucacauuaaaaugauucaagcugaaugguauuuaaugauuuauggggugaggccaccugucccugugaaagcuucauauuaaccauggccuggagucaugggauuuuuacaugggaaaauguaaaagguugauauuacuaggguugagucucuggggauuacauggggaaguuaggagaaccaaggaggaggagggagggaagacgaauuagugagucaaauauuauucuucagaaaaccagcacugcuauuucaaucggguuaaaaaaaaaaaaaaaagauccaaaaacuugagcugcagaucuaaucugcucgugagaaaagcccauacacugucacacaugggcugugagaaggggucucagacaccugacugcaggcaggcuuaacuauauaaaccagaaacgucuauaagcuccaucacuaacaacuaaugaauuuuauuucagguaaauaaauucccacauacaguaggacguuuauaccaugaaacaauuagcauuuuauugcuagugcauauaaugucacauuugauacaauuuuaguacaagugaaaaaauacacuguggcuaacauugaaaagcugcaaucacauuuauauaucauauauauuucuuuacaaauugccaguaguuugagauaauagagaaguauaaacuacugacauucauauggcuccacuucaaauauaugaauuguucgacuauaaauauauuuugaaauacauuuguuuucuaaagaaacguaaaaaaaaaugugcacaaaaauauauauaaaaaaaugccuugcaaaaaguuacaaauaccaccaggaccuucuguggaucgcauuuaugcauggaaaugucaccuugccaacaguucugauuggaaccugaaacccugcuguggcuucaggaggggguaguggcaagaugaugguuuauucacugauuuuuucgcuucugauuucggaaaccucagaguuuguuagugccuccauggcauacauaggcuucagaggcaaucacaaaacccagucacucaaagcgagcucucagauuuaaaauugcauuugauucuguaaagacuugucuuuugcggguaagcagggggaccauuacacauccccaggagagggccagcuccauucuggaggaggccaaagacggaucucacagagggcccgagcuguggggcaggcccugggaggagagggaugcagggcacgagccccagcaaucacccucuucccggcuggugcggcgcugaucaggcuacagaaaugagaagcagaagcaagauuaagcaugcucucggagucggggagagaguaggaauagcugggagaggggucucugagcacagucccaguaauaguggcuucuacauggagcccacagagccaaucacugagguugaaagaggaggugaaggcaguggcggcgcccagccccagucgguaucugagugccacagaggccuuccucuugggaggggcgcugcugcgggagccucagugucugaagaaaggacacuuuuuccagcucccuguuaagccaccaccugacugugcccagacuccccaggggagcagaggagaugcuccaaacaagccaaauucagaucuugaaguacucguugauuuaaaaaaugagaaugagaaugaugaugauugugaugaucaugaaggaacuaacugcuugaaaaugcuguugauaauacaauuucuuucuuagaaaaaccccaguaauaaaaguuccaacgugcacagguacagggcauggaugaauauaagcugcaauaucauaccguaugcuauaaaugcagggucuaaaugcuggcaaaccucaggcccgaucccagaucaaugugcccaccccacacacacaccugguccucaugguuaaggcccccucccccacgucuuugcccuuucaucucucacaagguuuuaguuuuccucgagugggucuagcggaaaguccuuuuuggcuguugugcuuacuuguuuaaagcuuucuccagguacuccugaauccacuuuagcuucgggucaaugcacacuugucuguuguuguucuucagccgggcucugugaaaacagaauggcaacagugugcggcugcacaggaggaaggcgcggcugcaacgugugcauccgcucccccaacacccaucuagggcccucgcuggcaccccgugcuccacuugguacgcucaggcuccagaggugcucgcggugugcuggggaaagcucagcgcuggcagugcaggaaguuccauugcagagacauggaaaugugaacagaagucuuuccggggcagugcaggggaauucauguaagggagcauuugagcugccuuugaaggauaaguaggagcuuggagaguaaauaaacgggaagggaaaaucaggagcaaauacgccaggggggucaucaaagcauacagaggaaacugaggaaggggacgacaggaugcucuagguaccuggggaggggagaauggagagcaacagagcagagguuuauuuggaugggucaucuugauagauauagggccgacuuaaggaugggcaugaggaagccuggaggaaggaggccugccagaagucaccgcggucugaccgggagggugaccagccagggaggggaggggcagugcagguggcuuaccagaaaauaguuucuagaaagauuuuacaaguucacugaauguuucuuggucucauuuguuuuuuaaaaguucacacucuuaaaagcuucccuacaugcaaacuccuggggaaggccugauuucaucucucugaaucucuugccagaaagcccuuuggugccagguaaucucaugcagcccaaguacuuaagggucuugaggacagcuaagccccagaacagugguucaggggcacccagggagucuucaagcagccuguccauuaggugaagaggggugcagagauggguguggcucggagcaacccacauugggguccaaaucuggggccuauucuuuguuaauuuagugucugcucagaccugagaauuguauuuggcaucuucaacuucaaggugcauuuccaggccaguaaaccagcaugaucagugcuguaaagcagguccaagguagcuaaauugagcaucuuuaaaauacucuucacaagagauaaaguaucauguuguaggcaaaguacagaaaaaacauucauuuucuagggcccuaaaacauacuguaaauaacaaacacauucaaggcaguaaaggguuaacucaaaacuaaaaacaguuuucuaaaaucaaaaguaaaaacauuugguguuggguggaaaagucuugggaaaguuguagcuuugguuccaacugcugucuccccaccccauuuuuagcacuagaacuucugagcaaucaaauccucuccaggagacucccugagcccucgcuuccccguguucagacacaggaccucuugagcaugagagggcuuucaagcacauggcuuucuucccgcauuucucccggucuucuguacccagcugagaucuuccugucuuguggaugugugauuuuggucuuuguuucccaaaugaauaaaaucaaauguuaguggcugccauccacaccaaauaacaccaaaaccucauauguuguacuugagaaaauacaggcaagugagcugaaaauguugaaguuucacccaaugguuaaagaggacuuaaacugcauuugggucuugugaguuaauguagggcaucagauccccgaaacuggcaggccaguuaucacuguuauuagcuaagggcuggcuaauuuacuaggcuucagccaaaaccuuggugaagcccauaguuucuccagcauccagcugugcugugcugaagaacacagguuuggaaagaagagagaacuacuacgagcacagcagggugcccaggccaagagcggcuuuuaaaauuaaugccugguggcauacuaaagguccucaugauaagaauagcugccacuaauuaugccaaguucaagguuggacacuuggcuugucaccucuacaccuuuaauaagacucggguuagauguuacuauguucguuagaugcaacuauguucguuagaugauguucaauuucaagacuuacacaaucugaagggcacaguuuggaguguugagaauuuugagaugcuugacguuggcucuggcaacauggcuuucgaagaaucggcaugggcaucuguagcucaggcugacgggcuucccuagaagagguaaggacaacaaggcacuuuacuacccugccagauuuugguaaugugugucugggcugcagcaguuggugcagcgauuaaggaucaagagacggcaucacugggguaaguuccagguuacugguguauguugggaaaggccaucuccucaggcaacacagugagugcuggcugagcucaggcucagcuucuacagggcaaggagcccaacaggccuggggagagccggagccuagaugaggcgggaguuuaaauuagaagccaccugcucagugucucaagauaaagguaguaauuauaguagauaacgguuucaguccaagguacugaaauuuccaguuacucuuuguaaaaaaaauuccucaagggacaacugagaaagaucucccuacucagggaaaagaaagggggacaagaggcuccaggcucccuggccucucuccucuggcacaggccucuagccaggaagcacaguaguacucaggaaugcugcccucccccaccccagagaccccuccucacauucaccuaaagcucuggaaggcacaaaagaauccuggcuggcuuccuaccugugaguccccugagagcaggccaaggacccaccuucugcccagcacuuuccccaaggcuuagagauuaguggagcuggaguuaaaugugguuuucauugccuaggcagggaugcuguagccucaggaauuguauuaagaucuuugcaaaaucaccaauuuacaaaaugccauaauugacacucauuaguguaaauuagcaaggggcuccugcagaacccacugcucacccuuuaaauauaggauugcaagcccuggagggcugggauuugugugugcuuuuuguuuuucuuuuuuccuugaagauuuuauccaagccccacuuaauaccccaaauuauuugaacuuguggauccuuucaucagagauuaaauauaugucuaagaauauuugguccagagauuuuuuuucuuuuuucuuuuuuuuuaaguuugccuguuuacaaaguucugagagaccucugugguucugaaauucugcaccuuugggaaagaaugcuggggaaguaggaggaaaucuugaguaaggggcucauuuuauuuuauuuuuucuacagacugcaaucaauugagggaugauguggacuaggaauugcauuguguauucagccaccaaguugcaggaaaaguggaccacuuguccccccacuuccuuguccccaggaccaaaugcaacucccugaaaaccaggaaaaagccaagcaucagggugcuggugacucauggcacuggagagaccuaaggcagccuucacaguuacaccugaucuaacuccagaaaggcaccucuggggccagcuuccagcagcugcacugggacccugcaggggaagucagcacugcacuguaaccagaucaccugggaaagccacccccagggccggggccugcagccuggguaacugaggagcuaaacgcuccugaguguugugccuccagguuucccuggauuucuuuugggcccuuccaagcugaggcaggggguggguuggggguggagcaggagaauaggaggccgguagugaggcacaagcccccucccggcaacagugagcuugaagauaugcagccaagggcaagugcugcagccgcccccgcugggauggguggggcugugacucuccagcgcccagaggagagaagcuccucuggccccccaaccaagcaguggugaugaggccagaaaucagagccuauucagagcucaacacacaggcucucucuccucucccccuccacccccugggauuauccauuuccuucaaaagcaauucuugcuucuacucccaggaccuaaggcccgccugucaagcagcgaauuucaacaggucuuuuuaaagugacagagcccccaggugugcuuaccaaaagaacauggucucguguguaccucaugugcuccuuccuccagcuuuuugucaguaagacuaacuuucccaaccguucuggauguaaauccguguaccggcaagaguccugacuggcucugaugguaccccggauuugggaccgggugagcuuggcuccaggaguuuucagaaagcccuccagucuaaugcagagacaggagcccagcuggccccuccaagcaggcuugggaagggggcccacccugaguuuaagcccgggaaacccaagggcccagcugccugacggaagucagccaaugggggaggggcaggaccccuggccaagcucucucuguagugcagcuugaggacuaaguguggggauagggggcacauaggcacugugaggugaggggaaaacaaaacaaaacaaaacauucuggcgauguguguaaggagcagaucugccuggagcccaggcuccugcccugguuacuuggcugccaauggggcaacucugagggccaugucacccuucccaggccaggaggagucugggaugaaccccacgucucugugcuucccccaggucaguugcacccauaacucaaagaccgagguuccucauuccaauccucucuccagcccuccggggagggggcagcaccauuucccagagcggcgcacugugacaccuccgcgcucaucccaccaaucagucaauaacugcccaaaccagagaccuuacaggaacagaagaauauccagcaauaaaaacuagaaacaugccccaugacuugcgggggggggggggggucagugugcagacacagccucagggacuuuucaucaacgacgaacauucccaauugccuucagucuguguccuuaacacuuaggcaguccgccacgaccccaggcugcccagcuucuccagcccgacucagcugcgcugguccugcucacaccagcgcacaguccaagccagcuaggacgccggggccacgucugcaccaacccagccaagggcucgaggcgcgcugggccugcacagcccgcggcugcaagagcacucagaguguccuucaacucuuugcaggaaacuucacagccaaggaagcucagcggccugagccacaggguuuuguuuuguguguucagaggcaacaguuuauuuugguuugcaucgguguccugugacagcgcagcgaguuucucuucagcgaaagaaaagaaaaaagcccucucccagugaaacgggacaccacgguucccaguggcccagggccuuggagauugaacuuugcugcagcucucauucuggggcaaagcgcuuggccagcuggugacaaaagagccugucugcagguguguuuggggagcuggggagggggcgugugaggcucggagggucccugggccucucucaggugaacccgagaagagacaggaagacagcggcuggacgcgcgcccagguccgcgucgcugcggaccgcggagcugugcagaagcgcggccuggcggguggcacaagcccgacagcugcgccgcgcagcccgcccgcgccuggccaagagccccgcgaggguguggggagaggaucggcuucgcagggagcggaggcugcgcggcugcaucggaccucacagccucaagucgcggcaugaggcgaacuuugcaaagcgcgcucucgccaugcaccgcccgaccuccagcacugugcgcagcaggaccucggagcccauucgccuguggaaaccgagcccgcagcgggaaggcaguggguggagggugggcaggcaggggucugggguccgcggcuccccacccucgcgccuucccgcgccagucccgaacgcucucuuggggcguuccugcccaguugucccggcugaccucgcucugcagccagcuugaggucaggcggucgcucucugcaggucacaaacccucggcgcaaaaguagggcuuugaacgcgacaccgcaccagagcgcccagcuaagcgagcugccuccacccccacugugucgggcggcgcaaacugcgggcgcaggcagaggagccgcggcucugcgccgggcgggagccgaagcccagagccucgccagggccuccccgccgagcgcacuuaccgucgcugaggcagagcgcggucagcacgaggaccagcacgaccacgaccuuggcguucauggcgcgggcgggcgggcgggcgggcggacgagcgcgggucgggggccggacgccgagcgggcaaugcggcugacggagagugaaagugcggcggugggaggcgc

SEQ ID NO: 21413 - RNA, 5335 nt, Homo sapiens
gacuucagguuaaguaauaaaaauuuauugagaauuccuggguugguguuuaucuccucccagccuugagggagggaacaacacuguaggaaaucacugagaaaucacgcacuguccccaacagccccaguuaacacagggaggaggaaaguaauuccccagaaaaggggcuagucuucagucuuccuuaauccaagagggguucagggaaccggugugggggaccaucgcaugauacuggggcgggguagggcugugcuggaccccuggcuggcuccucaaaaacuggagaagcagauccacuuccucuggggguggaguucuuggugacuaggcucauuucuuacccuugaugaggcugucacuguaggaaaaaaaagauagauaaugacauuauuaggggacauaaaugugagaggcaggacacucuaggccauucccucuacgacccuccuacccugauugaggguuugucuucggggaggugggaaaggggguaggguaggaggcggguacuggagaagguggccugcaggaccccacagaagcaacaacagcuuaccuuccccuguggugccagaucgccagaugaacaagaaacagagaagagaaaugcacauguuaauugacagcuucaggccccacucagcuuugaacccuccuuugcucccaagagaaaagauaaacaggguugacagccaggaaucucaggcucaugaaaggaggaggcauguucucauggccacugcuauuucucaucuccuuuccuaacaucccuccauucaccagaggaguuugagggcucuugaguaagaaaacugaguaucaucuuucaucacuuuuugguuagaugaaaacuuuauaauuaaagugcuuuuuaugugaauaauccuauuugaucucauaaaaucaauccuaugagaugcaagauagaaacugucaaccacccccuuuucuaauuuugguucaaugucucugagccauaugaauagcuguagcaggcuccagagcccaaacaaccagacucaggucccacguucuuggugauaccccacaguguggccacaucucucaccuggugaaacuuucauccuguagguucagcacaagguugucagcugugagauagauacgauucugugauguggcgaucuacagggcaggaaauaagacagaugcuugcauuaagcaaagaccucaauuccgaccccugcaauucagcagcuacuuaacauggaacacaugcagauuagggcaggggugcagcaaugaguaacacaugguuucugcucgcacuuagggauccagagcgcugagcagcagcuaugauuagaacaaaaggucagggaacccagaggaaucauucuugacaggaggaguaucggagaagccaauuuuuuauuuauuuauuuuugagacggagucuugcucuguugcucaggcuggagugcaguggcaugaucucagcucacugcaacuuccgccuccuggguucaagugauucuccugccucagccuccugcguagcugggaauauagcuaaacgccaccacagcgggcucauuaucuuuuguauuuuuaguagagaugggguuucaccauguuggccaggcuggucucgaacuccugaccucaggugauccacccaccuuggccucccaaagugcggggauuacaugcgugagccaccgcgccggccagagaagccaaucugaguagaaaccggaacaagcaagguucgaauucccucaccucaaugugccuuaacugaaagcacuuucucaaggcagccccaucagagacgcugggcugacacacucaccgucuuggagauauucugggcugcucgaaucuugcgaaguuugauguagccaggguucuugcucagugcuucuccaaggugaggaggguuaagguacacgcaagggcaggucucaaucccuggcccuguccuuaccacacucccuugcuccaguccuccucugggcugucagauccaagguugcgcucagguggcuugugcccagcccuaccguggaccccaccugugggccucccugcaggcugcugccaggaacuaggggcagcaccagaaaugaaggcaaggccaccaaugcuauugaucuggccuuacaguggggagucauggcucagguacuaccacuaagauuucagaucucaucuguaguccccacccccaacaaggagccaagggccagagagcacggagucgcauucgccuuagucucaucagccugcccaugaaggagaauggggaacucaggugcccuaggggcugggcugagaucucuccagcagaaggauaucaucuuggcagccucggccucacccucggccugcacaauuuucugccgcuguuccugcuuugcuuuuucuaccaagaauugggcccgcugggccuccugcugggcuguggugggagagagucagggagacccuguccugggucaggagccccacccauggagucuuuccuccuccugcaucucagaagcccucaccccacggcucuugcgacucacccacuuguuuggcuucuacagcagcuguguacucucggcuaaagcucagcucugugauggccacaucauccaggaugaggcugaaguccuuggcccucucugucagcucccggcggaucaacagggauaccugagggcaggggugaagaggggaagggaggggugguuugaggggacuggggagcugaaaggaagguugcgaccccuaacccuucacucucaauacaacaugcacugccuuagcuuccugucaggcaaaccuguaacauaagccucucugcucgaagaggugcaggaaaagccaagacuuggccauuuuccucugugcuuccuaacaccgagugcuaucgaguucuaaugcuggcucuccuuauuucacaguggcaauuagcacagcuuuuagguggaaauggcacuagggugacaaugcuuuucuaauaagcugccuuuccuaauucccaauacucugggccuaggaaggaaaggcugacaccacgcagaugguggugggagucagaccugggcccgcugggugaucagcugugaggcauugaacuuggccaccacacucuugagcaccucguugacaauggacggcaacacucguuccucguaguccagcccuaggcgcugguacaugcuaggaagcuccugagcauugggucgagacaacacucgcagggagauauucaccaucuguaggucugagauugaggucagcaguggcuggucaaggccaaacacccuuucccaagcauuuucuccuucauguuccucccuguaugcccugugcaaugguguacagccuggcacuacccuggggggaggagaguuaaucaggcugacaaggaagacaagacgcagcacagcugaaaugcacccucacccacugugaagccuugaacugcaaaccccgucaccagcagagcugacuacucuuucccccucuguacucugugcaaccucuaacgugggcgcuuucgugcuguaccguaaucaugucuccuguaaggacuugggggacaagaauuguguuuaaugaaucuuuuauucccagggcccagucuaguaaaugaauaagcgaccugcacuagguauagcacaaagaaguacauuacagguuacaggugagcuaccugacccaggguguauaugugugcguggguggggaggaggaagaggucuggggaacucaaaggcacggcuuuuauguauggucuagaaggagagaacaggugaacuagucaagcuuagggacaaacuucuccagaacagaguguacuaguggauguaacuguagauauaguaagucaagcaguuagaaaaaaaaggcuuuaaaacaaagcuuugaucuaggcagugaacaagacgagggacaaacaauacucuuauugaauacacgucagggaggagacaguaaaaagcacgcaaacacaguguguucagaauuugcugcuuugaccccaggaggcagguauuuuuguuacagcucuugcagauguggaaagaggccuaaaggccugacacuaccauauuccccugggguuucuugccagcuaccuugaucaucccaccugccaugugauuaccaagugcucagaccuaccuuuggagccuguaggggaggagauuuuucgaggucuggcccgaaugucauagauaaugggguacuggaaccaagggauccuggagaggacagggauagguauuaagaggccacaguuucggccgggcgcgguggcucacgccuguaaucccagcacuuugggaggccgaggcgggcggaucauuugaggucaggaguucgagaccagcuugaucuacauagugaaaccccgucucuacuaaaauacaaaaauuagccgggcgugguggcgggcgccuguaaucccagcuacucgugaggcugaggcaggagaaucgcuugaaaucaggaggcggagguugcagugagccgagaucgcgccacugcacuccagccugggcgacagagcaagacucccucuccaaaaaaaaaaaaagaaaaggccgcaguuucacuagccuugcccgguuuccccucaccacgcguuuuuuggccugcuccucuccacgaccacagacaaggagagauucucuugucccucuggaaaacaacaguuuguaugcugcuggagguucucgcagcacccacuauccuaggggcagggaugaggagggugggaaaagagcagcguugaauccuguugcacguccgacuauagccacugcugggucggcgucaagggugaaaggucagggucagcaggcucugcccgccauuaccugaagugaaggcccucggccaggauaguguccugcugcacuccaccgauccgauugaagaagauggcucugugcccgccuuccacuguggggagauggguggugaucaggccaggccgcugcucagaggaaaugcuaggcccguggaggggcgcggggacagggcaagggguuugggggagggacuggaagcguccggcgagcaggcggagguugcucaccggugaacacagauucgcgcacaccguaggccacggcgccggcccccagcaacagcuucagggccgugcccaugccccggggcccggcgggcagccgucccgccaaguccuucaaguucugggccaugucugaucuugaggccggcggcacuggaggucagaagggggugccggcccgccucuaccccgcuccggcuuagguacugcacccuucacacgaggguucgggcccguaaggcuggcgaaagaaagggcagcggaagugcg

SEQ ID NO: 21414 - RNA, 12812 nt, Homo sapiens
uguuuugcuucgagauggcugcggggauguauuuggaacauuaucuggacaguaagagcaggcuggaggugggggucggggcugcagaguggugcggggaucagggaugagaggaucuguagcccuuaaguuccagugacgagaaggucacaauuaugaagcgguucuguggcaggaaauauuggagggugcggagaaagagggggcggggcagcaggaucgaggccccgcugauggguguagacgagggaggggugcgguguggggguuagagacgugucuugaagggcuagugugcauggccaggaagauaguugcugcccccauucuccagggucuccagccucgguagauuuuuuuccccauagucguucagaaucguuaucacacacugccauuuggagaagcgguaaagaccucuccuccacuccauucuuccucaaaaguggcuucucaugggguugagagugguggugaugagugaccacugucagaugaugaacuagaacgcuucucuucauggaguaaagaucuaauucccaucaaaugaaaaucugguguuuaugcgauuuauguaaaccaccccugcagaaagccuauugcucugugcgcuuacauuuguuuuagggcccggagucauuuauucaacaaauauuuauugagguccugcuaugggucagacauaauggcaggcacuagggauagaaaaaugaguaagacaaggcuccugcccucaagaagcucacgaucuaguaggaaacagauucugcaaauaauuauaaaacacugugacaagugagauaauggaaauacauuaaaaaggacacuugguaggcaacccuggagaaaagggggguaauuaccuggggauguaggaaaagcuuuacagcggaggugauguuugaauagggucuugaagguuauuugccagugaggagagaaaaaaggaauuccagguuggggaaagcauccgcaaagguacugugauggguuuguggcaaggucaaggguguuugauauuuaugacucagaggucagcguauuugauauuuaugaaucuaagguaagaaauugagaaaggagacuggagaaagaggcugaggcuagauuggacaaggucuuuuaagccaaacgaagaaguuugcauuuuaaaguagaguaugauuuuuauagaggaaaaugacuaauauaugguaaauuggagcaugauauuguugauaacagagaucaauuagugauaacauuccaggacagagauaagaaccugauuuuagggaguuacagaaguauuuaggaguuaaauaugaaaggacugacugaaugacugagugguugagagagaaggaagaaucuaagguggcuucuuccugcuuagaaagugagguagacaggcugggcacaguagcucaugccuguaaucucagcacuuugggaggccaaggcgggcagaucacuugaggucaggaguuugagaucacccuguccaacauggugaagcccagucucuacuuuaaaaaaaaaaaaaaauuagcugggcaugguggcaugugacuguaaucccagcuacuugggaggcugagucaggagaaucacuugaacccagcaggugaagauugcagugagcuaagaucauacauaccacugcacuccagccugggugacagagaaagacuccgugucccucucaaaaaaaaaaaaaaaaaaaaaaacaaaggcugguggccaggcacgguggcucaugccuguaaucccaacacuuugggaggcugaggcaggcggaucaugaggucaggagaucgagaccagccuggcuaacauggugaaaccccgucucuacuaaaaauaaaaaaaauagccaggugugguggugugccccuguagucccagcuacuuaggaggcuaaggcaggagaaucgcuugaaccugggagguggagguugcagugggccgagaucaugccacugcacuccagccugggcaacagagugagacuccgccucaaaaaaaaaacaaaaacaaaaaggcugggagcgguggcucacgccuauaauccuagcacauugggaggcugagauggguggaucgccuuaggucaggaguuccaagaccagccuggcuaacauagugaaaccccgucucuacuaaaaauacaaaaauuagcugggcgugguggcagacgccuguaaucccagcuacuugggaggcugaggcacaagaauuccuugaaccugagauugcgccauugcacuccagccugggcgacaagagcgacacuacaccucaaaagaaaagaaaagaaaguuacucagcggagaaaagaucaugccaacugcugcagagauauuuuuuaggauaggcuuaauaacaccauuagauuugguaaaucaccagugacucagucuugugaacuggugguagcagaccugaaguuguagguuuaaacaguagaggcauuuuauuuuuuuuuauuuauuuuauuuuaguuuuucuguuuguuuguuuguuuuugagacagagucucacucugucacccaggcuggagcgcaauggugcgaucuuggcccacugcaaccucugccucccggguucaagugauucuccugccucagccucuugaguagcuaggauuacagugcccgccaccauacccagcuaauuuuuguauuuuuaguagagaugagguuucacuguguuggccaggcuggucucaaacucccaaccucaggugauccacccaccuuggccucccagagugcugggauuacaggcaugagccaccguaccaggccuuuuauuuuuuauauauauauuuaauuuuuauagagacaggaucuggccauauugcccaggcuggucucagacuccugagaucaagcgaucuaccugccuuggccucccagaaugcugggauuacaggcgugagccacugugcccagcaaguagaggcauuuuuaaaguuuuagguggagucuuggcaagagauuucucuuguacuggggugacaaauauucaugcauuuauucaaguauuuacugaguaccugcucuuugcaagucauaauucuaaacacuauggaaacaggagagaauaugauagccauguucggccuggggagacagauaccaaauaacuaauuacacauuauuuuuuuuaauuuuuuuguuuuuugaaacagucuugcucuuuugcccgggcugcaaccucuaccucccugguucaagcaauuguccugccucagucucuugaguaacuggaacuacagccacaggccaccaugcccaucuauuuuuuuuuuuuuuuuuugagacagagucucgcucugucgcccaggcuggagugcaguggagcgaucucggcucacugaaagcuccaccuccuggaugcacgccacucuccugccucagccucccgaguagcugggacuacaggcgcccgccaccacggccagcuaauuuuuuuguauuuuuaguagagacgggguuucaccauguuagccaggauggucucaaucuccugaccucguaaucugcucuccucggccacccaaagugccgggauuacaggugugagccaccgcgccuggccuaauuuuuguuuuguuuuguuuuugagauggagucgcacucugucacccaggcugaagugcaguggugcgaucucagcucacugcaaccuccaccucccggauuuaagcaauucuugugccucagccucccaaguaucugggauuacagguuucaccauguuggccaggcuggucuugaacuccuggcuucaagugagccacccgccucggccucccaaagugcuagaauuacaggcaugagccaccgugccuggcccuaauuuuuguauuuuuaguagagaugggguuuugccaggcugccaaggcuggucuugaacuccuggccuugagugauccaccugccuuccagagugcuggauuacaggcaugggccaccgcacccagccaacuaauuacacauuuauuuaauuacaguuggauaagugcuuuaaaaagguggcuagaauaccuugacauagaucgagggcaguuaacagagucugggaaaguugaguuugagcugaacuuuggaagaacgaacaggaauuuaauaggccaagagggaugggguggaugggaugaggaaaagcgagcggugcauuccaacuagagagaacagcauguggaaagccaaauggcaggaggagcacaggccaguuugaggcagugcgaggaggccaguaugggcaaagcagagcacaaagggagacugacaugaguucaggcuggugugagguaagcaagggccagaaagcgcagaacaucuucagagcaguaggaagugaccagaagguuauaagcgggagagugacuugauuagguuugcauuuuuuauuuuuguguuuguuuuuguuuuuguuuuuuugagucagugucuugcucugucauccaggcuggagugcauuggcgugaucucggcucacugaaauguccaccucccagguucaagggauuuuugugccccagccucccaaguagcugggauuacaggcaugugcaccaagccuggcuaaguuuuuguauuuuugguagagacagaguuucaccauguugcccaggcuggucuugaacuccucagcucagcugaugcgcccaccugggccucccaaagugcugggauuacaggcaugagccaccgugccuggccagguuugcauuuuuuaaaaaggacauucuggcuacuauauggaaguagauuggaaguguuauguguauaauagaggauaccaggagacuauuuguaauuugaggacaaagagcuuggaggcagagauggaaaauaaaagaaaggggcccgucuuaguggcucaugccaguaaucccagcacuuugggagaucaaggcgggcggaucaccugaggccaggaguucaagaccagucuggccaaaauggugaaacccugugucuacuaaaaauacaaaaauuagucgggugugguggcgcgcgccuguggucccagcuacuccagaggcugaggcaggagaaucacuugaacccaggagguggaggcugcagugagccaagaucgugccacugcacuccagccugggcaacagagccagacuccgucucaaaaaacaaaaaaggaaaagaaagggaagagcuuuuuuuuuuuuuuuuggagacagagucucgcucugucaccaggcuggagugcaguagugcagucuuggcucacugcaaccucugccucccagguucaagugauucuccugccucagccuccugaauagcugggauuacagguacgugccaccacaccuggcuaauuuuuauauuuuuaguagaaacaggcuuucaccauguuggccaggcuggucucgaacuccugaccucgugauccacccgccucaaccucccaaagugcugggauuacaggcuugagccaccacaccugacgggaagagcuuauuuauaaaggaaggucacugaaggcgaaaagggugggauagccaugcagaaauggaaagguuuuguagagaaagaguuaagcauggccugucaugagagaacugauccauccugucacagauaaauccagagguucagaggaaggaaaacugagcugcacuuuauuuuuuguuuguuuguuuguuuguuugagauggagucucacugugucgcccaggcuggagugcaguggugcgaucucggcucacugcaaacuccgccucccagguucaugccauucuccugccucagccuccugaguagcugggaguacaggcgcccgccaucgcaccuggcuaauuuuuuguauuuuuaguagagacgggguuucaccauguuagccaggauggucucaaucuccugaccucgugaucugcucuccucggccucccaaagugcugggauuacaggugugagccaccaugccuggccauuuguuuguuuuugagacagggacuugcucuauugcccaggcuggagugcaguggcucaaucacggcucacugcaaccucugccuccuggauucaagugauucucaugccucagccucccaaguagcugggauuagagaugcccaccgucacacuaggcuaauuuucauauuuuuaauagagauggaggucucgccauguuggccaggcuggucuugaacuccuggccuugagugauccacccccuuggccucccaaagugcugggauugcaggcgugagccaccauguccggccugaacugcacuuuaaaaggagcuguaaggccuaugcauagucaguccugugauuguuucucucucuucccuagguauugaaaaccuucccuuugaauuacagagaaacuuucagcucaugagggaccuagaccaaagaacagaggguauguauagaguaaaaaguuuuuguaucuaaugaguguguguaaucauuuauuuuucuacuugauguuaccguaucaucugguaugaucuggagaacuguggcuucucucgcuccuuuuuuacgcucuuggaauucuuaaaacaggauaaugauccucauuucugugucagcuuuuucauaacaaauagaguauugugaaaacgccucaagaauucaaagaugcuguguucuuuaugucuuccuggagaauaauuagccaggcuggcucacaccuguaaucccagcacuuugggaggccuaggcgggcagguaacuugaggccaggaguuugagaucagccuggccacauggugaaaccccaucucuacuaaaaauacaaaaacuagccaggugugguggcacgcaccaguaaucccagcuacuugggaggcugagacgugagaaucguuugaaccugggagguggagguuguagugagcccaaaucaugccacaugucacugcacuccagccuaggcaacagagcaagacucugucucaaaaaaaaaaaaaaagaagaauuaaagaaagucaacucgagucauuucugcucuccacguuugauauauuuauaggaugacuagaauguuucuacuucucucauuguuaauguuacugucacaaauucccagugugacuuuagacugcaacauauguugguagaugggagguuugcuauaugagaaguccuuaaaaagagaaagaaaaaagaaagaggaaagaaaaaaaagcaguaauugacaaugggaucucuauaccguucacacuuacagaagcauuagauaccaucuccagccuggaacauugagcaaauuuggcugcauuggggcauucacuugguuucuucaaagaugucuguuggagcuauucccauacccacugaaggaucuguagucuugucuucauucuauguagccauguucaaggauguaacagacugguuuugagauacaugaagcugugucuuaaguuacucugaguuuacacaugaaaaggugaacaucaucaaaaacccuggacacaguucccugagaacugccugccgaauggugagaaccagauugcuuuuuuuguaauacaguuguaacucuugaguucaugcauggaaagacaguuggagauuauggaacuauaugcuuuuucagcuucuuccaagagccuggaaugaaguggaguauaaacagugucuucacagauccuccugguuaucuguugcugcacuauguuagagucagacuugucucuuacuacugacauauuuaugagcccuuccaaauauuaguaaacaucuauagucucaauguccugggacauuaccauucuuccaauauuaaaacauuuggggccgggugcgguggcuuacgccuguaaucccagcacuuugggaggcagaggcgggugagucuccugagauaaggaguuugagaucagccuggcccauauggugaaacccugucucugcuaaaaauacaaaaauuagucgggugugguggcgcaugccaguaaucccagcuacucaggaggcugaugcaggagaaucgcuugaaccugggagguggagguugcagugagcugaaaucacacuacugcacuccagccugggcaacacagugagacuuggucucaaaaaaaaauaaauaaaauaaaauaaaacaucugggagaccgggugccguggcucaugucuguaaucccaguacuuugggaggccgaggcgggcagaucacuugagaucagaacuucgagaccagccuggccaacauggugaaaccacaucucuacuaaaaaugcaaaaauuagccagaugugguggcgcacaccuguagucccagcuacuugggagacugaggcacgagaaucccuugaacccacgaggcagagguugaggugagccaagaucgugccacugcacaccagccugggcaacagagcgugacuccgucucaaaacaaaaaaacguguuuggagcaauaucuaggauggacaaacaggaaaaaaagaaguaauggaaaaugaaagaaguugcaaugaugagccaaauaggaugggcagccuggcugcaguggcucacaccuggaaucccaacacuuugggaggcugaggcagguggaucauuugaccaggaguucaagaccagccugggcaauauagugagaccucaucucuagaaauaauuuuuuuaaaaaaauuaucaggguguaguggcaugugccuguggucccagcuacuccagaggcugaaaugggagaucauuugagcucagagguugaggcugcagugugauccaugaucaugccacugcacuccauccaaccugggcaauagagugagacccugucucaaaaaaaaaaaaaaagaaaaauagagugagcaguaagauaagcagaauuguuacauggauguuggaguaaggucuaauuuuaaauugugugauauacucaacuacucaggaggcgaaaagauagaaucacuugaggacaggaguuggaggucagccuaggcaacaaacauaagagagaaccugcgccugccucuaaaaauaaauagauuaggccaggcaugguagcucacccccaauaaucccagcacuuugggaggcugaagcaggcagauugcuugacccaggaguucgagaccagccuggguaacguggaaaaagccugucucuacaaaaaaauagaaaaaauuagccaggcgugguggugccugagaugggaggaucaccagagcucaggaaguugaggcugcagugagccaugauugugccacugcacuccagccugggcgacaaagugagacccugugucaaaaagaaaaaauacuaauaauuuugaaauguaugauauugauguacagacuuggaaaccagcaacagcagaugacucagccugauuugcggcagacaacugcugugggauguuuuugagaaggaaacaauggcuuuugagacaaaauucaagaagcagcaagcccuucaaagaagcaucuucaaacauggacaaaaauacacuucauauuaauguggugugcaaaggaucccuugcuguguuucaguaauuuaaauuccaacuaugauagcaauguuuucagcaccuugaaaggaccuuuaaagcaaauauugucaguauguuccauuacuugagugcauggcacaguaccucugaacauucaguacuuuuuaguuggaagguuaugcuaaucaauggaaaagguccaaagaacaaaaggaagaaauguguuucaccuagccacucaggggccauugugaccaggccucugucucuguuguagaccugaaggcugaaauugacaaguuggccacugaguauaugaguagugcccgcagccugagcuccgaggaaaaauuggcccuucucaaacagauccaggaagccuauggcaagugcaaggaauuuggugacgacaaggugcagcuugccaugcagaccuaugagaugguauggcccuguucauggcuccccaccuacuucccaucuaauccucagggucuuagaccccuccuucaacuguguugggaucuguuuggggucugugagauccauaaacucugccuuaaccuauuuucuuuaauuggagauaguuuuguaccucuccuuucuccuuccuuuccacccagguggacaaacacauucggcggcuggacacagaccuggcccguuuugaggcugaucucaaggagaaacagauugagucaagugacuaugacagcucuuccagcaaaggcaaaaagagugaggagggggcggggcugugagagguggggcgaggacugaaagggagaagaagucagcucuucaucuggugggaaguuuggcaccagguuggaaagggggagagaagaggacuuaacccaucuuucugucucccugccuucuggcuuucucccucuucccuagaaggccggacucaaaaggagaagaaagcugcucgugcucguuccaaagggaaaaacucggaugaagaagcccccaagacugcccagaagaaguuaaagcucgugcgcacgugagugauucagggagcccuuugccggaugacauccucuucucucccggugccccacucccagccugcaccgcccccugccgcuuucuauaugucugcgccaagaacucuucuuaucauuuugguaucugcuggagaagccacaaaucauuugcccuaccaggaucuccugccaccucugaaagccucaggcuuuagcuucccuuccuguagaugacacuuucucuuccucuuggcaugcagaaguccugaguaugggaugcccucagugaccuuuggcaguguccaccccucugauguguuggauaugccuguggaucccaacgaacccaccuauugccuuugucaccaggucuccuauggagagaugauuggcugugacaacccugaugugagaaacauuuugccuuaggaugggggguugugaggggcaugaagggaguggguacaagagggaaaaucccacaguugaguacugggacuucagaauagaagaaagaugggcuggacguaguagcucuugccugaaaucccagcacuuugggaggcugaggcgggcagaucacgugaggucaggaguuugagaccagccuggccaacauaguguaaccccuucucuacuaaaaauacaaaaauuagcugagcauaguggcacacgacugucaucccagcuacucgggaggcugaggcgagaggcaggagaauugcuugaaccuaggaggcagagguugcagugagcugagaucacgccaccacacucuaaccugggcgacaagagcaagacucugucucaaaaaaaaaaaaaaaaaaaaagccugaaagccuggcgcuguggcucacgccuguaaucccagcacuuugggaggccaaggugagcagaucacuugagaucaggaguucgagacuggccuggccaacacggugaaaccccgucuccacuaaaaauacaaaaauuagccaggcaugauagccugugccuguaaucucagcugcuugggaggcugaggcaggagaauagcuugaacucgggaggcggggguugcagugagcugagaucaugucauugcauuccagccugggcaacagagugagacucugccucaaaaagaaaaaaagaauagaaggaagauggugggaacugguuggccuugggacuuccaagaauucuccaaaaggauggaguaaaggacaggauguuccuaaggaaucuggaggggcuuucucuccuuccucuggcccuuccuggccccugacuacuucuuucuuccucuuccaguguuccauugagugguuccauuuugccuguguggggcugacaaccaagccucgggggaaaugguaaguggcaggaguuggagggucccuaaguugaguggucaagggcauucucccuuucacucacuuuucucuccccuucucuguuucagguuuugcccacgcugcucccaagaacggaagaagaaauagauaagggccuuggauuccaacacaguuucuuccacauccccugacuugggcuagugggcagaggaaugccugugcuggggccagggguucagggaggaguggauggcacagugcugucaucccuucuccuccccucuccccacucccggugcugaggcugcaucagacccugguagggaggggugccgcagccacuaacgguaugugcucuccuucagcccucucccuucggagggacguggucuugcccacuguccuuuugccuccaugcugaggucggugcuguauuucagagggaggguccuuuucauucuccuugcuuuguauuuaaggacuggggcauagcaugggggcagucccccagaccucuucauucccccuccuguggugagggcuaggugugaucaacacuuuucuucuccauucccuuccugcuuuuuucauggugggggauccaccaggucaucuaggcucuggcccuaguugaaggggcaccccuuccucugugccaagaggauucauccugggagagggggcaagguggaaugcagauaacucacauguaaaaggaacuuggguagguaaauaaaagcuauacauguuggccugcuguguuuauuguagagacacuguuuuaguaaacaugcugagcauucauuuugcguccucuggguuggaugcaaugugagaggauggcaugccagaauuaggacacgacaugaaaccagaguggugccucuguccgagaacuuguaaguucucaacuugggaaagacagaggugcuggaggguaggccucagaccagggggucuccaaaacuuuguaaaucaugcaucuuuucuccauaaaacaucuuucacuuaauuuccaauaaaugauguauuugugcu

SEQ ID NO: 21415 - RNA, 5030 nt, Homo sapiens
ccgugucaaucauuuucuucuucgucagccucccuuccaccgccauauugggccacuaaaaaaagggggcucgucuuuucgggguguuuuucucccccuccccuguccccgcuugcucacggcucugcgacuccgacgccggcaagguuuggagagcggcuggguucgcgggacccgcgggcuugcacccgcccagacucggacgggcuuugccacccucuccgcuugccugguccccucuccucuccgcccucccgcucgccaguccauuugaucagcggagacucggcggccgggccggggcuuccccgcagccccugcgcgcuccuagagcucgggccguggcucgucggggucugugucuuuuggcuccgagggcagucgcugggcuuccgagagggguucgggcugcguaggggcgcuuuguuuuguucgguuuuguuuuuuugagagugcgagagaggcggucgugcagacccgggagaaagaugucaaacgugcgagugucuaacgggagcccuagccuggagcggauggacgccaggcaggcggagcaccccaagcccucggccugcaggaaccucuucggcccgguggaccacgaagaguuaacccgggacuuggagaagcacugcagagacauggaagaggcgagccagcgcaaguggaauuucgauuuucagaaucacaaaccccuagagggcaaguacgaguggcaagagguggagaagggcagcuugcccgaguucuacuacagacccccgcggccccccaaaggugccugcaaggugccggcgcaggagagccaggaugucagcgggagccgcccggcggcgccuuuaauuggggcuccggcuaacucugaggacacgcauuugguggacccaaagacugauccgucggacagccagacgggguuagcggagcaaugcgcaggaauaaggaagcgaccugcaaccgacgguaaugacccuuucccaaccauagaauguguuuggggccccgcuuugccugcuggaggguguuaaccuuagcuugcuuuucggcguauucugauuuagcuuugggagagcuaacuuuauuggucuuagguguucagugcuaccuggcccacugcuugucuguuugugacuuuuaagucagaaacuggagaugguaagauccgauaauuucccuaacuuaauacaucgcggucccucucacuagcaacuccuagguaugugacaaaguugggauguuuaucaacgguccgccuccuggcuagggaaagagcucuggggcggagaaugcacuuucuguuuuuugaaaacaaccucauuuugugcccuuaaaagccacuggggaugacggauccaggauuguggguggagguaguggguuuuucauccccugacuauggggccaacuucugccagccauuguuuuuucuaauaaagauuguguguucuuuuuaaaaauuuccccugcgcuuagauucuucuacucaaaacaaaagagccaacagaacagaagaaaauguuucagacgguuccccaaaugccgguucuguggagcagacgcccaagaagccuggccucagaagacgucaaacguaaacagcucgguggguugaucacuaaaggagcacgcacuggaacccggggccuucagaccucacgauaccugaucuuacugguugcuggcaaauuaaaagcuuaugggguuuuguuuuguuuauacuucgugaggucaaaaaaguagcaauggggaaggcuggggauacgguaauuccucagaguuucuaugcccagagauacuuucucuucaaacuguugaccagagcagcuacuuguaacccaggccccaucggguaggaaggucguuucccugugagucccacuaaaacguguugggagcaauagguucuuugcccauccgaacaagaacuaggguacucccucaguccgaauuaaugagaauuaauuuccuagagguucagcuugagucgguaacagauuuugagccauacauggaaaaauggcaaauacaugauuaaguuucaauuuugagggggaauguuugguagaaauugcucaucuuugguuaugcaagggauuagagaugugaauaggaugguauguuguguucuuugacauuuuaauaaacugucacuuucccuguugucuccuaaguuuggagagagaaggaaccaguauuugcaaaaaccaaauggaaagauaaaaaaguuacuaaaguuucuacagaauuucugguaacacugaaguugcaaagcagaaguuaaauuaacucuugucaguaagcaauccaggaacacgucagccaguguaugcuaauugugccguaacagggugauuuggauauuuguaggggaaauggguaguaaauaucaagacuggugaccguaggucagcccagcacaaaggaaguggagauuuuuccaugcacaagaaucugaucacuguaaauagcuaauuugaauaauucaguccccagauaaccaacauggguugguuauucauaauaaacuacauauuuuaauaguuuauuagcuuccuuuagaccaagacugugaccucuuuauuuucuaaagcacacacguaguuuagcauaugaggcgauaaaauauugauguuaacuuuuuaaauccccaguuauaaaaauuuuaaaauaacagggauuaaggugagauucagguuuguugugucuuuaaauuguauaugugacuucacauaucuuuuucagcgcuuauacaaaacggcacuauagaaccuccauuuuacagcaccauaugaagugggaaaauuaggugaaaauuuuccugaagcaaccuuaacaugcgcagcccuuguugguuugugacuuguggccuagcucaucagaugagccacgagaaucagaccuggauuuugaucuggcccuguucugacaugcaaugaggcauuuguaggauuuaguaauauugcuaguucaaagaauacuagaaauauuaguaagaaccuauucaaaaguauucaugaguauuuucugcauaugaaucaggaauuagaauauuuugaaaaugauguuaauaaaauuuuccucuggaaggccuuuauaauuuuuauucccaaucauuuuucaaauuuagaaaguuuaaucugucacaggagaaaaaaaauuaaaaauuuucaaaaauuuagaaaauuuuuacccguaaguauuacaguuuccuaauuauccuauuuauuucccacuugccuuugaccuagauuauuuagaguaggguuucucagccucugcacuaaugacauuuugggccgaauaauucuguuguaggaggcuguccuguguguuuuagauuguuuggaauuaucccuggccucucacacuagaugccagcaguauccuccucccccagugugacaaccuaaaaugucuccagacauugccaaauguucccuguggggcgggggcaacauugccuacuguuaagaacuacugcucuagaccaaagaacacagcacagaggaaaggaaaaaaaaauccaguuaagagaauguuagguggagaugacuauagucaucaaacuuuuuuccccaucaaguauuuccaagcuaacauagugacaaaauaauuccuguacucuacugguaacguuaaucuagugcucuuccuuuaauucuuccguuuuguuuucuuuugcagaauuaagaauauguuuccuuguuuaucagauacaucacugcuugaugaagcaaggaagauauacaugaaaauuuuaaaaauacauaucgcugacuucauggaauggacauccuguauaagcacugaaaaacaacaacacaauaacacuaaaauuuuaggcacucuuaaaugaucugccucuaaaagcguuggauguagcauuaugcaauuagguuuuuccuuauuugcuucauuguacuaccuguguauauaguuuuuaccuuuuauguagcacauaaacuuuggggaagggagggcaggguggggcugaggaacugacguggagcgggguaugaagagcuugcuuugauuuacagcaaguagauaaauauuugacuugcaugaagagaagcaauuuuggggaaggguuugaauuguuuucuuuaaagauguaaugucccuuucagagacagcugauacuucauuuaaaaaaaucacaaaaauuugaacacuggcuaaagauaauugcuauuuauuuuuacaagaaguuuauucucauuugggagaucuggugaucucccaagcuaucuaaaguuuguuagauagcugcauguggcuuuuuuaaaaaagcaacagaaaccuauccucacugcccuccccagucucucuuaaaguuggaauuuaccaguuaauuacucagcagaauggugaucacuccagguaguuuggggcaaaaauccgaggugcuugggaguuuugaauguuaagaauugaccaucugcuuuuauuaaauuuguugacaaaauuuucucauuuucuuuucacuucgggcuguguaaacacagucaaaauaauucuaaaucccucgauauuuuuaaagaucuguaaguaacuucacauuaaaaaaugaaauauuuuuuaauuuaaagcuuacucuguccauuuauccacaggaaaguguuauuuuucaaggaagguucauguagagaaaagcacacuuguaggauaagugaaauggauacuacaucuuuaaacaguauuucauugccuguguauggaaaaaccauuugaaguguaccuguguacauaacucuguaaaaacacugaaaaauuauacuaacuuauuuauguuaaaagauuuuuuuuaaucuagacaauauacaagccaaaguggcauguuuugugcauuuguaaaugcuguguuggguagaauagguuuuccccucuuuuguuaaauaauauggcuaugcuuaaaagguugcauacugagccaaguauaauuuuuuguaaugugugaaaaagaugccaauuauuguuacacauuaaguaaucaauaaagaaaacuuccauagcuauucauugaguca

SEQ ID NO: 21416 - RNA, 2933 nt, Homo sapiens
aaggucucccaagccuaccgucccacagauuauuguacagagccccaaaaaucgaaacagaggaaacgaacagcaguugaacauggacgaaggaauuccucauuugcaagagagacaguuacuggaacauagagauuuuauaggguaaggugcacgcacccuugcgaauaucugucuaggcuuugguuugauuuuuuucuucuccagaaagugguauggagcuggcgagggcagagccccuccccgaaugggugccugaugcugauuucuguuuugcagacuggacuauuccucuuuguauauguguaaacccaaaaggagcaugaaacgagacgacaccaagguaaguguaaguucccgauauuccucauaaccugcauggguaguuaauuagagccauugauuucacagugaagcucugcccgcaaauauauuccagccccugagcuuccccaacugugaauuuuaaguggcuugcuggguacucucagggggauauuaaacaucauaccugaauuuaaauugcauugcagaacaguccagaggaaagagguuucuuggguguaguuuaucacauaguauguuuuauggugggggggcggggggggcagacgaggguaauauccaauaagugaauguuucgcuuacuguuuucucuuuuccaugacucucauauauuaaggauaccuacaaauuaccgcacagauuaauagaaaagaaaagaagagaccgaauuaaugaaugcauugcucagcugaaagauuuacugccugaacaucugaaauugacaguaagaugcacauuuucauucuuugcugcucuccaagggcguguuaauagucuggugcgacucccagaaaauauaagaauaaauguaaauauaaguuccugacuuaaaacuugugcuauaccguacagaguuucccgcaaacuggaguaggugcucccagcugaaggcaagaaaucauuuauaaccugucuuguggaaagcucaagaaguaaaagaacaguacuucuuucaaaguguuugcuuaaauugcugugcugaauggacagccaauuaagccaaauguguguuuuuaaguaaccaagugcccguuucuuuuuugcaccacugcagacucugggacaucuggagaaagcuguagucuuggaauuaacuuugaaacacuuaaaagcuuuaaccgccuuaaccgagcaacagcaucagaagauaauugcuuuacagaaugguaagucaguucagggaggccagccuacccugaugaagcggggcagcccacaggggagcagugucaggacucccucacccgcaccccaucucuuuccgugggcucauggguucccucucauuuguuaaauugcuuauacuuucccuucauuggaacgagcccauuucccgaagcauccuagaggcuuucagcagaacucggaggaaucaggauuuaaaguggcgguugcacccgcuccacuuugguuuucagcugggaggagagcgcccucuccccgcuccgcaccuccgccaccccgcuucucucgucaacugguggauuauaucacuugaauacuggggaaaaaccgagaucacuuuagucgaugcagggcccacgugauaagcagauguuuuaacguggguauguuucuucuugccuccacuccuccgucccccacccccaucccuuccucauccuaggggagcgaucucugaaaucgcccauucaguccgacuuggaugcguuccacucgggauuucaaacaugcgccaaagaagucuugcaauaccucucccgguuugagagcuggacacccagggagccgcgguguguccagcugaucaaccacuugcacgccguggccacccaguucuugcccaccccgcagcuguugacucaacaggucccucugagcaaaggcaccggcgcucccucggccgccggguccgcggccgcccccugccuggagcgcgcggggcagaagcuggagccccucgccuacugcgugcccgucauccagcggacucagcccagcgccgagcucgccgccgagaacgacacggacaccgacagcggcuacggcggcgaagccgaggcccggccggaccgcgagaaaggcaaaggcgcgggggcgagccgcgucaccaucaagcaggagccucccggggaggacucgccggcgcccaagaggaugaagcuggauucccgcggcggcggcagcggcggcggcccggggggcggcgcggcggcggcggcagccgcgcuucuggggcccgacccugccgccgcggccgcgcugcugagacccgacgccgcccugcucagcucgcugguggcguucggcggaggcggaggcgcgcccuucccgcagcccgcggccgccgcggcccccuucugccugcccuucugcuuccucucgccuucugcagcugccgccuacgugcagcccuuccuggacaagagcggccuggagaaguaucuguacccggcggcggcugccgccccguucccgcugcuauaccccggcauccccgccccggcggcagccgcggcagccgccgccgccgcugccgccgccgccgccgcguuccccugccuguccucgguguugucgcccccucccgagaaggcgggcgccgccgccgcgacccuccugccgcacgagguggcgccccuuggggcgccgcacccccagcacccgcacggccgcacccaccugcccuucgccgggccccgcgagccggggaacccggagagcucugcucaggaagaucccucgcagccaggaaaggaagcucccugaauccuugcgucccgaaggacggagguucaagcagagugagaaguuaaaauacccuuaaggagguucaagcagagugagaaguuaaaauacccuuaaggucuuuaagggaggaaguguaauagaugcacgacaggcau

SEQ ID NO: 21417 - RNA, 11487 nt, Homo sapiens
uuuauugaagggcgagucuccggcaucugauggcagcuacaaccuggggacagaggaaaggagcugagggugggugagagggugccccauacccccugccgaccugacacccccugccuuucaguuucccuuuggggacccucccaaccccgcucugguuucagggccucuucugggcauggccaaggggguguggcucagccacuagccacacucuggaaggggcccugggacucggugggcaccacggggugggagaagggcucccuuccuugcgccgaagccggguggacucacuggaucucacggaacgcccgcuucuccaccagcuucaccuuguacuugcguuugaaccuggagcagggacaauggagcaaucagugcccggggccaaucccagaugcccucgccccacagcagccccggccgccccuuacuuggcucucucucgaggcucgaucauauuccuccucuggaagcucuugaaccggucucgaaggauguugcccucgggcuacaggacagagagggaggccucagcagggccuggcagaagcccaagggccuggaccucuccucgggguccuggcagggcucagccccaugcagucuccccccagggcagccugugggcaccagggacucagccuggcccucagcugcuggggcucaguguugggaugacagccaccaaccuauggccaucucuaagcugggcuuagaggagucacgggaagugggcuggugacgacacagaaaaggggacagcgagggcaaaggcuggaucagagggagaaggcacaguccgcucaugagcacaacuggcuggagccccacggccgggucggcccaggcguguggcugacagaggagcugggcuuccucaggggcacuggggagccacagcagguuccgagcaggggagggacaggguugguucugagcuucaggaaggucccucuaguccuaaaggugaccgggacugcaacagggaccagcuggaaggaaaggccuucuuagggucccggacucaaaccuuagccuggccccucacccugggaucucaucccagcaucccgugcccucagccccugggcauuggccccacuggcccagcccaggggcagccauggugucgcccauagccccuggggggcacggggagcaaggauggugucaucacugggcacggggcuccacggcaggacacagugagcaccuucaggguccugagcgagucugucagcuccgagcucagcugcacgucgaugucaggugccugguaccugcagaacagggcggguguucagaaauaucacccccgcggggcccaggacacccaguccaaagcccccuccuggagaagaaggggccucugagaaugugggguuuugugggggaagagguggucucccgauggggggggugggcaguuccugaacaaaggcaggaaggugucaggaccugggacccggcccccuccccagccucucccagaacccccggccugguucucacuugagccgccccagccuucggggcuugucagccucagccucccgccgcgccugccgccgccucugccgccgcgccagcuccgccagccucagggccaccugggccuugaucccgcgcagccggaacagcuccuggugccggagccgggcggcccgcaacgcggccugcuguacccgcuguggagacgggggagggucagggcucaggccggugcugcccacacagggagaccuucucucuacacagggagccuucccugcacaaaccugccuguccccggaggcccuuccuaaccccgucacaucagcggccccuccagugccuucccagcagcuguuugcugaagccccuuuugucauccaucuccccuggucugcggugcagaaaccuccccccaccccgccccucaaacagaagcgccagggacccugucccaccccagcccgagcccugccuggaagaggcugggaaaugagucucagcugugaggaucccaaacagcccaaaccacaggccacaugcggggcuuggggugugcaggcugcccgcagcacccagggcagcccauggugggaggaaggaaggaagggggcgaggcaucagaggcaggccccgcuggcccaggcgcucaccagccugugcacagccuucucccgccgccgcugcugcuccgucuucuucucugugguggccaggcgggcgggcgugggacagaccucggcauccccagccuccggccccucgcccuggccuggcucccccucaccauccgacuccuccagcagccccucgcacagcuccuggaauguggacuccuggggaggcggggugcagugucagggguggguaggaggcccggggaggggagggagugggcaggugcggggcucaccuggguggcggccugcuccguggcgggcagggccagcugccgcuccagcuucuccgccuccuucugccgcugcaacuccaccucgugggccgcugagagcagggucugaggggcgggagugaggaugggucccugaaccccuccugggacacugagacuagacccucuuaccucccaucugucccucauccagugcccguggaucccgccccggcccaggcuuuccuccccacaccccgucuaccagcacacccacccugcacagagccagagggcaccucaaacccucgcccucacaccugcucugcacgucugugaaggcagucugaccugcacgcuucacauuuuuuuuuugagauagaguuucugucuuguugcccagacuggagugcaauggugugaucucagcucaccacaacccccgccuccuggguucaagcgauucuccugccucagccucccgaguagcuacuauuacaggcaugugccaccauacccggcuaauucuguaacuuuaguagagaugggguuucuccauguuggucaggcuggucuugaacuccugaccucaggugguccaccuaccucggccucccaaagugcugggauuacaggugugagccaccaugcccggcccacaguuucaucuaugugaauuggucagggugggcuggucccugagacaggaagccuggcagcccaagaccacacgagacagggaauugcgggggugauggcugacaugugugagguuuccuuuacggacagugaaaauguucuaaaauugacugcggggaugguuacacaauggucacuaaaagccacugaaucacauacucuaacuaggcugaccguaugguuaagugaauuuuaucucuacgaaguaguucuguacaaaucuaaaagugaaugucugaucuccacgcccccucccacaucugguccaggaacagauggcagugagcggcacccucacgcuuucaaccaugagcacacuguugcuuuuuuccgcagacacuuuucucuaccagaugaggaagcugccucuguuccuggcuagcuaucuccuucuuaugaaugcugaaaacgauucggacaagcgguccugcaucuaccgcaaacaucucagcaucucuccagucacgugaccccaugagaagggcuguuccuugagggaggguugugcuuguuuuuugagucucgcucuguuacacaggcugcagugccguggugcgaucauagcucacugcagccuggaccuccugggcucaagcaauccucccaccucagccucccaagcaguugggaccacagaugcgugcugccaugcccugcuaauuuucuguauuuaguagagacaggguuucaccauguuggucaggcuggucuccaacuccugaccuccaaugaucugcccgccucagccucccaaagugcugggauuacaggugugaggcaccgcacccggccaagggagggguuuuuguccccuuuguccacagcaucugugcucaacagaugcccgcuaaaugcacaguggcuccagcuagacuuucccaucgcugagcuagccucgcccauauauaacugucacuuggcugccagugugccaccgugucaccacagccuuuuucaucucugccccacaggcuuccuggaaggcgccacggucucucucaacucugugccuuugcagugcuguucccaccaccuggaaaacccacuccccuccucccacugcaaaccccucccucagccucugccucggcucaggcgaccccuccucccgggagcccuuccugaccccccaggcugggccaggugccccgucugggcucccagccccaaccacucugcccaucacugucugggaacaggucucuugcacuggaccgugagccccguugcggacaggcccagggcugucugggucauuggaguucccagcacagggaggaagcuagugaaggccugaccaagaggcagagcccacugaggagggaggccuggacggggcaguguaccugguggucuucaaaggauggauuguaggaagcuccggcaggcgccaccuccacggcgggugccugggacggcuuggugugcaggcgugcuggccgcuguggagaaaaggccgaggcaggguaaggccgugcguuggggcugcgggugacccaggacacagccauggggcagaugcuccaggccuugccagugguugggugugggaagagcucaaggggcauucaggugacuccagagcaagacuccaucucagaaaaaggauagcagccuauccucugcuacccacgaggcugagccccggagauuguaagcaccugggcucuaacacuugggguccagcagcucaagaaggaggcugcaaauccaaacucaaacccgugacacuucugccacuugccagcacgggcuccaccuucucaugugcuaccucuuuacauucuccccaccgacccaugaucuaaguacaauuucaucuguauuuuauuuuauuuuuuuuuuugagacagaguuucgcucuuguugcccaggcuggagugcaguggcaugaucucggcucacugccaccuccaccucccugguccaagcgauucuccugccucagccucccuaauagcugggacuacaggcacgugccaccaagcccagcuaauuuuuuuuuuguauuuuuaguagagacaggguuucaccacguuggucaggcuggucucaaacucccgaccucaggugauccaccugucucggccucccgaagugcugggauuacaggcgugagccaccaugcccggcccucaucugcauuuuagaggaagauauagguugcagaaaggugagaccaccuucccaggaucagucagcacuggagcugggacaggaaucccagccaccuggcuccagcacagaguucucggccacugggauggaagggcucugagacagacucuacugcaggaacacagagcagcucccggcccuccucacccucccaucacccaggaugcccuucccacacaucucaccuucacuccuuucuucuuggucugcuccaggaaaaacucauccuggccaaccaacggccuguccagggggucuguggauacagcgaggggagcugcugggacagucccagcauggaagaggcaccaaaggcucccccccaaucccuccacauuucaaaaaggugacccugaagcucaggcaagggaaggacugauucuagaccccaagggccuugaucaccaggacaaaacugugucuggacggguucagaaaguggaagagaccaaagcugaaggcuuccuuuccugaagccucacaacucaggaaaggaaaagcacgagugggaaacggccgccccuucaggacgcacgacucugcugggaggucaccaaagcacccacaaagcacucccuuucacacuguacucucgugcagugcacaacacacacaaacugcacauggccguccuguccccauucauaggugacagcaggaucacucacugucugaggcccagaggucguagaagggccgcucuacgguguccuggggcccgggcuuggcccuuguugcagaaggguugaggagccgggccugggcccugcgcaccucccggggcagcucgcccugcuuggccagcuucucccauagcugcuccuuccgccugagcuucuuggcguuggggaccuggugggcgaggacgcuggucggggagagggggcacaagugcagcaggugagguggcagccugaacggcagcagggccuccuccccgucgggcuuccuccaccauuaaggcagcuucagcacccccucuccaaaagguggcacuccgcccccucuucagagaacuccucuccccacgucugucuccagccuaggccuccccucugagccccagacucaacgaagcaacagccccguccuggacauaccccaggcaccucacaccaccacgucaaaaccaaccucagcaucacccgaaaucccacuccuccacauccccaucucaggggaaggccagcuguccacccucucacccgcucaugccccaagacccaccugaugugccuccugaacacgccucccacucagccccuccucuccaaccccgaagcccccagcuggguccaggccccuccucaccugccucggcccagcaccagggcacccagacucccucccucuaaucugcacuccgaagcccaaaccugagccugcccuacccuucaaaugacccucaccuaccagcccccagccccggaaacccuuuaggaccagagucuggugggaaagaagggcccagggaugcugggacacucacucuuugggggcagggacuuuggauguguucucgaggaugaggucaacccgaagggguuucuugagaagcagugacuucuucuggacuuugguucucuucuuugucagcccuaagaaugggaaagagaacaagucaaggccucagcccuacccacugccaaagaccacccacccuauucaccuccaugggagccaucagaccugaaucccaagucaccccaggagacuuggagguccccaggcuccuaccuggagguagaggccccuaaggauggggcccaaggugcccaagcucugacccuccacaaccaagugcugggccagcaggaggcaggccccaugcuggggacacgaagagucacgcccacagccacauaggagggucuuccagacaaacagggaaccucuucccugcaugguggcucacgccuguaaucccagcacucugggaggcugaggugggaggaucgcuugagcccaggaguuugaugccagccugagcaacauagugagaucucaucucagggggaaaaaaaaaaggaagaaagcaagucaucaguugacacugaagcccagggagggccacagaaguggacuugggacccaggauggccacuucucagcauaacuucuaguucucugguuuuuacugucuuuuuccucccacaaagauaccugugguuuuuacuucaaaagccuaacaguuaaaagcaguaacucuacagcaaaacacucuagaauggaauaacacccuugcauggacugugggaccucacacaagaggcuuagcuccuccgugcccccaaaaugaggauguggauaccucccucacuaggccguuaugaagauguaaucauuuaaggcccacaaagcacaggggcugaccugguugacugcucacaaccacuaugaucuuuguccguguuuccuuacuaaaguggaacccauaaacugccucuuuccugccccccaaagaggcuucccacucgccaaagcacgccgguaacuacuuucccaucuguucauuacgggcaggucacugacuuacccuuuacacucacacaccagaucaacucacuucggucaaggcugacuucucuaauaaccccccacuuuuuuuuuuuuuugagacagagucuuguaacccaggcuggagcggagugcaaugaugcgcucuuggcucacugcaaccucugccucccagguucaagcaacaauccugccucagccuccugaguagcuggaauuacaggcaugcgccaccacgcucggcuaauuuuguacucuuaguaaagacgggguuucuccauguuggucaggcuggucucaaacucccgaccucaggugauccacccgcaucagccucccaaagugcugggauuacaggcgugagccaccacgcccagcuugagacagagucuugcucugucgcccaggcuggagugcagugguaugaucuuggcucacugcaaccucugccucccggguucaagcgcuucucaguagcugggauuacaugcguguaccaugacguccggcuaguuuuuguauuuuuaguagagacgggguuucgccaugcugcccaggcuggucuccaaccccugaccucaagugauccgccccaccucggccucccaaagcgcugggcuuacagguguaggccacugcacccagacucuaauaaccacuuuuuaccugccuauuggaagucuccuguaccucagggcagcuccuuccacucuaucuggucacugaaccagguccgcucauuuucauuaaaacauacccuuugacugaucucacacaagcucacucucuugcucauuaaagcagaccccuucgcuugcuuccaggcuguucauuagagcagaucaucuguucuuaguuuguuuuucuacauauugaaguaaacacuauuacucaccagagcaaucccucccucacgccucaucuuguuucagcagauccccacccuacauucuagcaacuuaaggcaagcaaguuaagacguguguuacccgcucacuaaagcaaguccucuuauuccuauuaaagcucaucuuggccaggcgcagcggcucacgccuauaaccccagcacuuugggaggccaaggcggguggaucaccugaggucaggaguuugagaccagccuagcugacaugaugaagacccaucucuacuaaaaauacagaaauuagccaggcuugaccaggcgugguggcucaugccuguaaucccagcacuuugggaggccgaggcgggcggaucaccugaggucaggaguucgagaccagccugaccaacauagagaaaccccaucucuacuaaaaauacaaaauuagccgggcaugguggcacaugccuguaaccccagcuacucaggaggcugaggcaggagaaucgcuugaaccugggagguggagguugcggugagcugagaucacgccauugcacuccagccugggcuugaaacuccaucucaaaaaaaaaaaaaaaaaaaaaaaaagagagagagaaaagaaaagaaauuagccaggcuugauggugcagccugcagucccagcuacuugggaggcugaggcaggagaaucgcuugaacugagaucacaccacuguacuccagccuggaugacagcgcaacacugucucaaaaaaauaauaguaaucccaggcuggaguucagcggcgcgaucucggcucacugcaaccuccaccucccagguucaagugauucuccugccucagccucccaaguagcugggauuacaggugcccgccaccacaacuggcuaauuuuuguauuuuuagcagagacgggguuucaccaucuuggccaggcuggucucgaacuccugaccucaggugaucugccugccugagccucccaaaguacugggaauacaggcgugacucaccgcaaccggcaggacugaguuaagcagguccuugacuugcuuuucugcaagcuaaaaagagauccuuuaauguguuucuaacuuauucaucaaggcagacucccagcagcuuaucugugcauggagaucacugacaucucaaaagaaaaaccugccuucucuaaguucgucuccagcuugcuuucugcccauuugagguccccuuguuuauauuaagguugaccuguuuccgcagauauuugccuuccaagccacaucauuaacacagaucucagaggcuaccguaagcugacuaacaaugaauaaccgccauuccacaccacaaaagccucuccucaccuuuuuccuuggagccaguguccacgaagaagaguuuuucauuuggggccucugacaacaagccacugggggacagaaaugcagaacaucagccagagauguuggagaggaaagagauuuaaccuggcagguccagccuucaucuuccgcuuagucaagucccgccaccggacucuuccaggcuaaggcuucgcccagcaguuuacagaacuuaguauuuaggaaggacugccaggcgcaguggcucacgccuguaaucccagcacuuugggaggcccaggcggguggcucaccugaggucaggaguucaagagcagccuggccaacauggugaaacccugccuuuacuaaaaauacaaaaauuaggcugggugugguggcucacaccuguaaucuuagcaccuuagggggccggggcggguggaucaccuaaggucaggaguucaagaccagccuggccuguaacauggcaaaacccugucucuacuaaaaauacaaaaauuagccggacgugguggugcaugccuguaaucccagcuacuugggaggcugaagcaggagaaucacuugaacccaggaggcagagguugcagugagccgagaucgugccauugcacuccagccuggacuacagagaaagacuccgucucaaaaaaaaaagaaaaaagaaaagaaaagaaaaauagccgagcgugguggcgcccgccuguaaucccagcuacuaaggagcugaggcaggagaaucgcuugagccugggaggcggagguugcggugagcugagaucgcgccuacuccagccugggcgauagagcgagacuccgucugaaaaacauauauauauacauauauauacacacacacauauacacauauauauauacacacauauacacauauauauacacacacauauauacauacacacacacacauauuuagaaaacagcaagcuaagguggaugcauggaacguauuuaugcuaaaaauuauucauuguuuaccuaaaauccaaauuuaauugagcguccuguauauuuaucugcuaaaucugguaacucuaucaagcucuccagcuucccaugcugaguccccugcccaugcucuccauuuccucggcgguccccgggacaggagcccccaacccccgacccccgacccccgacccccgacgaguccacgcaagcacgccuggccuugcaccugggcgcaggaaccgucccaccucccggaagucccgcccaacguacccgcucgugcgcuccuguagccgcacgucuuccaggaacuggucaaccuccagccccagcggcuccugagcaagccgccgccagccccgcuucuuauuucuugggccucgccgccgccgccucagcgcuggguccaccgaagugggccgcagccccaggaaaccagaaucggcaucgcuuuucgagcugcgcuucccaccaacgccacugccuccugccgccaucuugu

SEQ ID NO: 21418 - RNA, 11487 nt, Homo sapiens
acaagauggcggcaggaggcaguggcguuggugggaagcgcagcucgaaaagcgaugccgauucugguuuccuggggcugcggcccacuucgguggacccagcgcugaggcggcggcggcgaggcccaagaaauaagaagcggggcuggcggcggcuugcucaggagccgcuggggcuggagguugaccaguuccuggaagacgugcggcuacaggagcgcacgagcggguacguugggcgggacuuccgggaggugggacgguuccugcgcccaggugcaaggccaggcgugcuugcguggacucgucgggggucgggggucgggggucggggguugggggcuccugucccggggaccgccgaggaaauggagagcaugggcaggggacucagcaugggaagcuggagagcuugauagaguuaccagauuuagcagauaaauauacaggacgcucaauuaaauuuggauuuuagguaaacaaugaauaauuuuuagcauaaauacguuccaugcauccaccuuagcuugcuguuuucuaaauauguguguguguguauguauauauguguguguauauauauguguauauguguguauauauauauguguauauguguguguguauauauauguauauauauauguuuuucagacggagucucgcucuaucgcccaggcuggaguaggcgcgaucucagcucaccgcaaccuccgccucccaggcucaagcgauucuccugccucagcuccuuaguagcugggauuacaggcgggcgccaccacgcucggcuauuuuucuuuucuuuucuuuuuucuuuuuuuuuugagacggagucuuucucuguaguccaggcuggagugcaauggcacgaucucggcucacugcaaccucugccuccuggguucaagugauucuccugcuucagccucccaaguagcugggauuacaggcaugcaccaccacguccggcuaauuuuuguauuuuuaguagagacaggguuuugccauguuacaggccaggcuggucuugaacuccugaccuuaggugauccacccgccccggcccccuaaggugcuaagauuacaggugugagccaccacacccagccuaauuuuuguauuuuuaguaaaggcaggguuucaccauguuggccaggcugcucuugaacuccugaccucaggugagccacccgccugggccucccaaagugcugggauuacaggcgugagccacugcgccuggcaguccuuccuaaauacuaaguucuguaaacugcugggcgaagccuuagccuggaagaguccgguggcgggacuugacuaagcggaagaugaaggcuggaccugccagguuaaaucucuuuccucuccaacaucucuggcugauguucugcauuucugucccccaguggcuuguugucagaggccccaaaugaaaaacucuucuucguggacacuggcuccaaggaaaaaggugaggagaggcuuuugugguguggaauggcgguuauucauuguuagucagcuuacgguagccucugagaucuguguuaaugauguggcuuggaaggcaaauaucugcggaaacaggucaaccuuaauauaaacaaggggaccucaaaugggcagaaagcaagcuggagacgaacuuagagaaggcagguuuuucuuuugagaugucagugaucuccaugcacagauaagcugcugggagucugccuugaugaauaaguuagaaacacauuaaaggaucucuuuuuagcuugcagaaaagcaagucaaggaccugcuuaacucaguccugccgguugcggugagucacgccuguauucccaguacuuugggaggcucaggcaggcagaucaccugaggucaggaguucgagaccagccuggccaagauggugaaaccccgucucugcuaaaaauacaaaaauuagccaguugugguggcgggcaccuguaaucccagcuacuugggaggcugaggcaggagaaucacuugaaccugggagguggagguugcagugagccgagaucgcgccgcugaacuccagccugggauuacuauuauuuuuuugagacaguguugcgcugucauccaggcuggaguacaguggugugaucucaguucaagcgauucuccugccucagccucccaaguagcugggacugcaggcugcaccaucaagccuggcuaauuucuuuucuuuucucucucucuuuuuuuuuuuuuuuuuuuuuuuuugagauggaguuucaagcccaggcuggagugcaauggcgugaucucagcucaccgcaaccuccaccucccagguucaagcgauucuccugccucagccuccugaguagcugggguuacaggcaugugccaccaugcccggcuaauuuuguauuuuuaguagagaugggguuucucuauguuggucaggcuggucucgaacuccugaccucaggugauccgcccgccucggccucccaaagugcugggauuacaggcaugagccaccacgccuggucaagccuggcuaauuucuguauuuuuaguagagaugggucuucaucaugucagcuaggcuggucucaaacuccugaccucaggugauccacccgccuuggccucccaaagugcugggguuauaggcgugagccgcugcgccuggccaagaugagcuuuaauaggaauaagaggacuugcuuuagugagcggguaacacacgucuuaacuugcuugccuuaaguugcuagaauguaggguggggaucugcugaaacaagaugaggcgugagggagggauugcucuggugaguaauaguguuuacuucaauauguagaaaaacaaacuaagaacagaugaucugcucuaaugaacagccuggaagcaagcgaaggggucugcuuuaaugagcaagagagugagcuugugugagaucagucaaaggguauguuuuaaugaaaaugagcggaccugguucagugaccagauagaguggaaggagcugcccugagguacaggagacuuccaauaggcagguaaaaagugguuauuagagucugggugcaguggccuacaccuguaagcccagcgcuuugggaggccgagguggggcggaucacuugaggucagggguuggagaccagccugggcagcauggcgaaaccccgucucuacuaaaaauacaaaaacuagccggacgucaugguacacgcauguaaucccagcuacugagaagcgcuugaacccgggaggcagagguugcagugagccaagaucauaccacugcacuccagccugggcgacagagcaagacucugucucaagcugggcgugguggcucacgccuguaaucccagcacuuugggaggcugaugcggguggaucaccugaggucgggaguuugagaccagccugaccaacauggagaaaccccgucuuuacuaagaguacaaaauuagccgagcgugguggcgcaugccuguaauuccagcuacucaggaggcugaggcaggauuguugcuugaaccugggaggcagagguugcagugagccaagagcgcaucauugcacuccgcuccagccuggguuacaagacucugucucaaaaaaaaaaaaaagugggggguuauuagagaagucagccuugaccgaagugaguugaucuggugugugaguguaaaggguaagucagugaccugcccguaaugaacagaugggaaaguaguuaccggcgugcuuuggcgagugggaagccucuuuggggggcaggaaagaggcaguuuauggguuccacuuuaguaaggaaacacggacaaagaucauagugguugugagcagucaaccaggucagccccugugcuuugugggccuuaaaugauuacaucuucauaacggccuagugagggagguauccacauccucauuuugggggcacggaggagcuaagccucuugugugaggucccacaguccaugcaaggguguuauuccauucuagaguguuuugcuguagaguuacugcuuuuaacuguuaggcuuuugaaguaaaaaccacagguaucuuugugggaggaaaaagacaguaaaaaccagagaacuagaaguuaugcugagaaguggccauccugggucccaaguccacuucuguggcccucccugggcuucagugucaacugaugacuugcuuucuuccuuuuuuuuuucccccugagaugagaucucacuauguugcucaggcuggcaucaaacuccugggcucaagcgauccucccaccucagccucccagagugcugggauuacaggcgugagccaccaugcagggaagagguucccuguuugucuggaagacccuccuauguggcugugggcgugacucuucguguccccagcauggggccugccuccugcuggcccagcacuugguuguggagggucagagcuugggcaccuugggccccauccuuaggggccucuaccuccagguaggagccuggggaccuccaagucuccuggggugacuugggauucaggucugauggcucccauggaggugaauaggguggguggucuuuggcaguggguagggcugaggccuugacuuguucucuuucccauucuuagggcugacaaagaagagaaccaaaguccagaagaagucacugcuucucaagaaaccccuucggguugaccucauccucgagaacacauccaaagucccugcccccaaagagugagugucccagcaucccugggcccuucuuucccaccagacucugguccuaaaggguuuccggggcugggggcugguaggugagggucauuugaaggguagggcaggcucagguuugggcuucggagugcagauuagagggagggagucugggugcccuggugcugggccgaggcaggugaggaggggccuggacccagcugggggcuucgggguuggagaggaggggcugagugggaggcguguucaggaggcacaucaggugggucuuggggcaugagcgggugagaggguggacagcuggccuuccccugagauggggauguggaggagugggauuucgggugaugcugagguugguuuugacgugguggugugaggugccugggguauguccaggacggggcuguugcuucguugagucuggggcucagaggggaggccuaggcuggagacagacguggggagaggaguucucugaagagggggcggagugccaccuuuuggagagggggugcugaagcugccuuaaugguggaggaagcccgacggggaggaggcccugcugccguucaggcugccaccucaccugcugcacuugugcccccucuccccgaccagcguccucgcccaccagguccccaacgccaagaagcucaggcggaaggagcagcuaugggagaagcuggccaagcagggcgagcugccccgggaggugcgcagggcccaggcccggcuccucaacccuucugcaacaagggccaagcccgggccccaggacaccguagagcggcccuucuacgaccucugggccucagacagugagugauccugcugucaccuaugaauggggacaggacggccaugugcaguuuguguguguugugcacugcacgagaguacagugugaaagggagugcuuugugggugcuuuggugaccucccagcagagucgugcguccugaaggggcggccguuucccacucgugcuuuuccuuuccugaguugugaggcuucaggaaaggaagccuucagcuuuggucucuuccacuuucugaacccguccagacacaguuuuguccuggugaucaaggcccuuggggucuagaaucaguccuucccuugccugagcuucagggucaccuuuuugaaauguggagggauugggggggagccuuuggugccucuuccaugcugggacugucccagcagcuccccucgcuguauccacagacccccuggacaggccguugguuggccaggaugaguuuuuccuggagcagaccaagaagaaaggagugaaggugagaugugugggaagggcauccugggugaugggagggugaggagggccgggagcugcucuguguuccugcaguagagucugucucagagcccuuccaucccaguggccgagaacucugugcuggagccagguggcugggauuccugucccagcuccagugcugacugauccugggaagguggucucaccuuucugcaaccuauaucuuccucuaaaaugcagaugagggccgggcaugguggcucacgccuguaaucccagcacuucgggaggccgagacagguggaucaccugaggucgggaguuugagaccagccugaccaacguggugaaacccugucucuacuaaaaauacaaaaaaaaaauuagcugggcuugguggcacgugccuguagucccagcuauuagggaggcugaggcaggagaaucgcuuggaccagggagguggagguggcagugagccgagaucaugccacugcacuccagccugggcaacaagagcgaaacucugucucaaaaaaaaaaauaaaauaaaauacagaugaaauuguacuuagaucaugggucgguggggagaauguaaagagguagcacaugagaagguggagcccgugcuggcaaguggcagaagugucacggguuugaguuuggauuugcagccuccuucuugagcugcuggaccccaaguguuagagcccaggugcuuacaaucuccggggcucagccucguggguagcagaggauaggcugcuauccuuuuucugagauggagucuugcucuggagucaccugaaugccccuugagcucuucccacacccaaccacuggcaaggccuggagcaucugccccauggcuguguccugggucacccgcagccccaacgcacggccuuacccugccucggccuuuucuccacagcggccagcacgccugcacaccaagccgucccaggcacccgccguggagguggcgccugccggagcuuccuacaauccauccuuugaagaccaccagguacacugccccguccaggccucccuccucagugggcucugccucuuggucaggccuucacuagcuuccucccugugcugggaacuccaaugacccagacagcccugggccuguccgcaacggggcucacgguccagugcaagagaccuguucccagacagugaugggcagagugguuggggcugggagcccagacggggcaccuggcccagccuggggggucaggaagggcucccgggaggaggggucgccugagccgaggcagaggcugagggagggguuugcagugggaggaggggaguggguuuuccagguggugggaacagcacugcaaaggcacagaguugagagagaccguggcgccuuccaggaagccuguggggcagagaugaaaaaggcuguggugacacgguggcacacuggcagccaagugacaguuauauaugggcgaggcuagcucagcgaugggaaagucuagcuggagccacugugcauuuagcgggcaucuguugagcacagaugcuguggacaaaggggacaaaaaccccucccuuggccgggugcggugccucacaccuguaaucccagcacuuugggaggcugaggcgggcagaucauuggaggucaggaguuggagaccagccugaccaacauggugaaacccugucucuacuaaauacagaaaauuagcagggcauggcagcacgcaucuguggucccaacugcuugggaggcugaggugggaggauugcuugagcccaggagguccaggcugcagugagcuaugaucgcaccacggcacugcagccuguguaacagagcgagacucaaaaaacaagcacaacccucccucaaggaacagcccuucucauggggucacgugacuggagagaugcugagauguuugcgguagaugcaggaccgcuuguccgaaucguuuucagcauucauaagaaggagauagcuagccaggaacagaggcagcuuccucaucugguagagaaaagugucugcggaaaaaagcaacagugugcucaugguugaaagcgugagggugccgcucacugccaucuguuccuggaccagaugugggagggggcguggagaucagacauucacuuuuagauuuguacagaacuacuucguagagauaaaauucacuuaaccauacggucagccuaguuagaguaugugauucaguggcuuuuagugaccauuguguaaccauccccgcagucaauuuuagaacauuuucacuguccguaaaggaaaccucacacaugucagccaucacccccgcaauucccugucucguguggucuugggcugccaggcuuccugucucagggaccagcccacccugaccaauucacauagaugaaacugugggccgggcaugguggcucacaccuguaaucccagcacuuugggaggccgagguagguggaccaccugaggucaggaguucaagaccagccugaccaacauggagaaaccccaucucuacuaaaguuacagaauuagccggguaugguggcacaugccuguaauaguagcuacucgggaggcugaggcaggagaaucgcuugaacccaggaggcggggguuguggugagcugagaucacaccauugcacuccagucugggcaacaagacagaaacucuaucucaaaaaaaaaaugugaagcgugcaggucagacugccuucacagacgugcagagcaggugugagggcgaggguuugaggugcccucuggcucugugcagggugggugugcugguagacgggguguggggaggaaagccugggccggggcgggauccacgggcacuggaugagggacagaugggagguaagagggucuagucucagugucccaggagggguucagggacccauccucacucccgccccucagacccugcucucagcggcccacgagguggaguugcagcggcagaaggaggcggagaagcuggagcggcagcuggcccugcccgccacggagcaggccgccacccaggugagccccgcaccugcccacucccuccccuccccgggccuccuacccaccccugacacugcaccccgccuccccaggaguccacauuccaggagcugugcgaggggcugcuggaggagucggauggugagggggagccaggccagggcgaggggccggaggcuggggaugccgaggucugucccacgcccgcccgccuggccaccacagagaagaagacggagcagcagcggcggcgggagaaggcugugcacaggcuggugagcgccugggccagcggggccugccucugaugccucgcccccuuccuuccuuccucccaccaugggcugcccugggugcugcgggcagccugcacaccccaagccccgcauguggccugugguuugggcuguuugggauccucacagcugagacucauuucccagccucuuccaggcagggcucgggcuggggugggacagggucccuggcgcuucuguuugaggggcgggguggggggagguuucugcaccgcagaccaggggagauggaugacaaaaggggcuucagcaaacagcugcugggaaggcacuggaggggccgcugaugugacgggguuaggaagggccuccggggacaggcagguuugugcagggaaggcucccuguguagagagaaggucucccugugugggcagcaccggccugagcccugacccucccccgucuccacagcggguacagcaggccgcguugcgggccgcccggcuccggcaccaggagcuguuccggcugcgcgggaucaaggcccagguggcccugaggcuggcggagcuggcgcggcggcagaggcggcggcaggcgcggcgggaggcugaggcugacaagccccgaaggcuggggcggcucaagugagaaccaggccggggguucugggagaggcuggggagggggccgggucccagguccugacaccuuccugccuuuguucaggaacugcccaccccccccaucgggagaccaccucuucccccacaaaaccccacauucucagaggccccuucuucuccaggagggggcuuuggacuggguguccugggccccgcgggggugauauuucugaacacccgcccuguucugcagguaccaggcaccugacaucgacgugcagcugagcucggagcugacagacucgcucaggacccugaaggugcucacuguguccugccguggagccccgugcccagugaugacaccauccuugcuccccgugccccccaggggcuaugggcgacaccauggcugccccugggcugggccaguggggccaaugcccaggggcugagggcacgggaugcugggaugagaucccagggugaggggccaggcuaagguuugaguccgggacccuaagaaggccuuuccuuccagcuggucccuguugcagucccggucaccuuuaggacuagagggaccuuccugaagcucagaaccaacccugucccuccccugcucggaaccugcuguggcuccccagugccccugaggaagcccagcuccucugucagccacacgccugggccgacccggccguggggcuccagccaguugugcucaugagcggacugugccuucucccucugauccagccuuugcccucgcuguccccuuuucugugucgucaccagcccacuucccgugacuccucuaagcccagcuuagagauggccauagguugguggcugucaucccaacacugagccccagcagcugagggccaggcugagucccuggugcccacaggcugcccuggggggagacugcauggggcugagcccugccaggaccccgaggagagguccaggcccuugggcuucugccaggcccugcugaggccucccucucuguccuguagcccgagggcaacauccuucgagaccgguucaagagcuuccagaggaggaauaugaucgagccucgagagagagccaaguaaggggcggccggggcugcuguggggcgagggcaucugggauuggccccgggcacugauugcuccauugucccugcuccagguucaaacgcaaguacaaggugaagcugguggagaagcgggcguuccgugagauccagugaguccacccggcuucggcgcaaggaagggagcccuucucccaccccguggugcccaccgagucccagggccccuuccagaguguggcuaguggcugagccacacccccuuggccaugcccagaagaggcccugaaaccagagcgggguugggaggguccccaaagggaaacugaaaggcagggggugucaggucggcaggggguauggggcacccucucacccacccucagcuccuuuccucuguccccagguuguagcugccaucagaugccggagacucgcccuucaauaaa

SEQ ID NO: 21419 - RNA, 2606 nt, Homo sapiens
cauucgcgacccggaggugcgcgggcgcgggcgagcagggucuccgggugggcggcggcgacgccccgcgcaggcuggaggccgccgaggcucgccaugccgggagaacucuaacucccccauggagucggccgacuucuacgaggcggagccgcggcccccgaugagcagccaccugcagagccccccgcacgcgcccagcagcgccgccuucggcuuuccccggggcgcgggccccgcgcagccucccgccccaccugccgccccggagccgcugggcggcaucugcgagcacgagacguccaucgacaucagcgccuacaucgacccggccgccuucaacgacgaguuccuggccgaccuguuccagcacagccggcagcaggagaaggccaaggcggccgugggccccacgggcggcggcggcggcggcgacuuugacuacccgggcgcgcccgcgggccccggcggcgccgucaugcccgggggagcgcacgggcccccgcccggcuacggcugcgcggccgccggcuaccuggacggcaggcuggagccccuguacgagcgcgucggggcgccggcgcugcggccgcuggugaucaagcaggagccccgcgaggaggaugaagccaagcagcuggcgcuggccggccucuucccuuaccagccgccgccgccgccgccgcccucgcacccgcacccgcacccgccgcccgcgcaccuggccgccccgcaccugcaguuccagaucgcgcacugcggccagaccaccaugcaccugcagcccggucaccccacgccgccgcccacgcccgugcccagcccgcaccccgcgcccgcgcucggugccgccggccugccgggcccuggcagcgcgcucaaggggcugggcgccgcgcaccccgaccuccgcgcgaguggcggcagcggcgcgggcaaggccaagaagucgguggacaagaacagcaacgaguaccgggugcggcgcgagcgcaacaacaucgcggugcgcaagagccgcgacaaggccaagcagcgcaacguggagacgcagcagaaggugcuggagcugaccagugacaaugaccgccugcgcaagcggguggaacagcugagccgcgaacuggacacgcugcggggcaucuuccgccagcugccagagagcuccuuggucaaggccaugggcaacugcgcgugaggcgcgcggcugugggaccgcccugggccagccuccggcggggacccagggagugguuuggggucgccggaucucgaggcuugcccgagccgugcgagccaggacuaggagauuccggugccuccugaaagccuggccugcuccgcguguccccucccuuccucugcgccggacuuggugcgucuaagaugagggggccaggcgguggcuucucccugcgaggaggggagaauucuuggggcugagcugggagcccggcaacucuaguauuuaggauaaccuugugccuuggaaaugcaaacucaccgcuccaaugccuacugaguagggggagcaaaucgugccuugucauuuuauuuggagguuuccugccuccuucccgaggcuacagcagacccccaugagagaaggaggggagcaggcccguggcaggaggagggcucagggagcugagaucccgacaagcccgccagccccagccgcuccuccacgccuguccuuagaaagggguggaaacauagggacuuggggcuuggaaccuaagguuguuccccuaguucuacaugaagguggagggucucuaguuccacgccucucccaccucccuccgcacacaccccaccccagccugcuauaggcugggcuuccccuuggggcggaacucacugcgaugggggucaccaggugaccagugggagcccccaccccgagucacaccagaaagcuaggucgugggucagcucugaggauguauaccccuggugggagagggagaccuagagaucuggcuguggggcgggcauggggggugaagggccacugggacccucagccuuguuuguacuguaugccuucagcauugccuaggaacacgaagcacgaucaguccaucccagagggaccggaguuaugacaagcuuuccaaauauuuugcuuuaucagccgauaucaacacuuguaucuggccucugugccccagcagugccuugugcaaugugaaugugcgcgucucugcuaaaccaccauuuuauuugguuuuuguuuuguuuugguuuugcucggauacuugccaaaaugagacucuccgucggcagcugggggaagggucugagacucccuuuccuuuugguuuugggauuacuuuugauccugggggaccaaugaggugagggggguucuccuuugcccucagcuuuccccagccccuccggccugggcugcccacaaggcuugucccccagaggcccuggcuccuggucgggaagggagguggccucccgccaacgcaucacuggggcugggagcagggaaggacggcuugguucucuucuuuuggggagaacguagagucucacucuagauguuuuauguauuauaucuauaauauaaacauaucaaagucaauguc

SEQ ID NO: 21420 - RNA, 2606 nt, Homo sapiens
gacauugacuuugauauguuuauauuauagauauaauacauaaaacaucuagagugagacucuacguucuccccaaaagaagagaaccaagccguccuucccugcucccagccccagugaugcguuggcgggaggccaccucccuucccgaccaggagccagggccucugggggacaagccuugugggcagcccaggccggaggggcuggggaaagcugagggcaaaggagaaccccccucaccucauuggucccccaggaucaaaaguaaucccaaaaccaaaaggaaagggagucucagacccuucccccagcugccgacggagagucucauuuuggcaaguauccgagcaaaaccaaaacaaaacaaaaaccaaauaaaauggugguuuagcagagacgcgcacauucacauugcacaaggcacugcuggggcacagaggccagauacaaguguugauaucggcugauaaagcaaaauauuuggaaagcuugucauaacuccggucccucugggauggacugaucgugcuucguguuccuaggcaaugcugaaggcauacaguacaaacaaggcugagggucccaguggcccuucaccccccaugcccgccccacagccagaucucuaggucucccucucccaccagggguauacauccucagagcugacccacgaccuagcuuucuggugugacucggggugggggcucccacuggucaccuggugacccccaucgcagugaguuccgccccaaggggaagcccagccuauagcaggcugggguggggugugugcggagggaggugggagaggcguggaacuagagacccuccaccuucauguagaacuaggggaacaaccuuagguuccaagccccaagucccuauguuuccaccccuuucuaaggacaggcguggaggagcggcuggggcuggcgggcuugucgggaucucagcucccugagcccuccuccugccacgggccugcuccccuccuucucucaugggggucugcuguagccucgggaaggaggcaggaaaccuccaaauaaaaugacaaggcacgauuugcucccccuacucaguaggcauuggagcggugaguuugcauuuccaaggcacaagguuauccuaaauacuagaguugccgggcucccagcucagccccaagaauucuccccuccucgcagggagaagccaccgccuggcccccucaucuuagacgcaccaaguccggcgcagaggaagggaggggacacgcggagcaggccaggcuuucaggaggcaccggaaucuccuaguccuggcucgcacggcucgggcaagccucgagauccggcgaccccaaaccacucccuggguccccgccggaggcuggcccagggcggucccacagccgcgcgccucacgcgcaguugcccauggccuugaccaaggagcucucuggcagcuggcggaagaugccccgcagcguguccaguucgcggcucagcuguuccacccgcuugcgcaggcggucauugucacuggucagcuccagcaccuucugcugcgucuccacguugcgcugcuuggccuugucgcggcucuugcgcaccgcgauguuguugcgcucgcgccgcacccgguacucguugcuguucuuguccaccgacuucuuggccuugcccgcgccgcugccgccacucgcgcggaggucggggugcgcggcgcccagccccuugagcgcgcugccagggcccggcaggccggcggcaccgagcgcgggcgcggggugcgggcugggcacgggcgugggcggcggcguggggugaccgggcugcaggugcaugguggucuggccgcagugcgcgaucuggaacugcaggugcggggcggccaggugcgcgggcggcgggugcgggugcgggugcgagggcggcggcggcggcggcggcugguaagggaagaggccggccagcgccagcugcuuggcuucauccuccucgcggggcuccugcuugaucaccagcggccgcagcgccggcgccccgacgcgcucguacaggggcuccagccugccguccagguagccggcggccgcgcagccguagccgggcgggggcccgugcgcucccccgggcaugacggcgccgccggggcccgcgggcgcgcccggguagucaaagucgccgccgccgccgccgcccguggggcccacggccgccuuggccuucuccugcugccggcugugcuggaacaggucggccaggaacucgucguugaaggcggccgggucgauguaggcgcugaugucgauggacgucucgugcucgcagaugccgcccagcggcuccggggcggcagguggggcgggaggcugcgcggggcccgcgccccggggaaagccgaaggcggcgcugcugggcgcgugcggggggcucugcagguggcugcucaucgggggccgcggcuccgccucguagaagucggccgacuccaugggggaguuagaguucucccggcauggcgagccucggcggccuccagccugcgcggggcgucgccgccgcccacccggagacccugcucgcccgcgcccgcgcaccuccgggucgcgaaug

SEQ ID NO: 21421 - RNA, 5459 nt, Homo sapiens
ucagaucacgacaacagguaaccuuuagucagaacucaccacccacuguguuaagccuuacaugacaaucaccaugaagauuuacauacacauguuauaucauagucuccucacaacaugucuaagagguaggcacgucauuguucccauuuugcagaugaggaaacugagguucagagagggcacuuggcuugcccaaagucacacagcagggaguggcagaggaagucagguugggugaccccaguaacugcucucagaggcugggugaugaccggcuuccuggcuucucuggaauaaaccuuugccaccacuuccugcauuucagcuucaguacaggcagagaauggggauaggugggggaaugaggugagaggggagauguuuagagguguggagggcggcagagguuugaacagugcagacaaggggagaguucagccgacuggggaggaagaggauggacgauggagccucugggcaucuggaucagcaggagcauaacaucuggaucagcuggagcguagcaucuggaucaguuggagcguaugacuuuauugauccaggacauguauuugcagaucuggguguagacagcuggaugcugggcagagccacagggguaaacaccccacgagaggaugccuuggagggucucgucacagaccagggggccuccagagucacucuggggguggcaggaaggagagaucaaauaaaugugccaacgugagagcugucacuuugggaucuggggcagugguggggaaggaaggaguuggguugggauaaagacgaggaugggaugggguuggaauuagguaugagcuggaagguaggaauggagguggacuucagguuaugggagguugggcugggggaugagaaugaaggcacagugagacugggguugggauuguaguucauggaaggugaggggaugaaaaugggcuuggagaugggaauggggugggguugggauggaaaugggauugaggauagggaugaggaggggguuaggucuggguaagaguuggggucaaggauggguuugggaauggaguuggggaucgggcacagggucugcucuuuucccauaaccucccuguccucccucccaggagucagagacucucccuguucagacccuaccuggcaaggguccuggccccgguccaguccagcacauaucauguuguuggugaccacgccaggguagaagaccucacacucuuuagggcucaggauagugaugcuggagcaggucaggcccuuguuguacuucacugaagggagaauaugccaguaaucccuggguccagcccccaauccuuggggagccaggaguccagauacaagaccguuucuauccuaagccccagccccuccuccuucagacucaagaauccuggccccagccccuccccacuuagacccaggaguccaggcccccagccccuccuccccucagacucacagacccaggcaucuaggaccccagcccguccucccucagauccaggaauccaguccccagcccauccuuccucagacccagggguucaggcccucagcccccuccuccugagguuccggccucagagccccagcucuugccucuccgggcggccguggugccccagccagcaaccuggcacuggucuccgggcugagcacagcgguagggaagcugcagggcccggacgcggggccccagcacuacgggccuggccagcuucagcaacaugagaucgugcucauccguucgccuuggcaggauggggccugagcccuggugguacuugggauggacaacagagcgagugguccggcggagcugcucucccugaagaagcagcagguggucauccccuacucgagcccacaguggccugggggaaggaagaggcaugugaaggcaaacccuucauagggacugggaaagcaggugggcagugacgcagggccuggagauaggaagagucugagggaagagggccuugugggagaaggggaccucaguggacauggggaggaggaaucaguuguuugagcucugaggaucuguaggaauugaggagggcugggggccuggacaccuagguaagccuuccacauuuucuuuucucuuuuucuuuucuuuguugaaacagaguuucgcucuugucacccaggcuagaaugcaauggcgcaaucucggcucacugcaaccuccaccucccagguucaagcaguucuccugccucagccuccuuccugaguagcugggauuacaggcacccaccaccacacccagccuuuuuuuuuuuuuaauuuuuuuaaaauuuuuuauuuuuuauuuuauuuuauuuuuaguugagaagugguuucaccauguuggccaggcuggucuugaacuccugaccucaggugauccacccgccuuggccucccaaagugcugggauuacaggcgugagccaccgagcccagcccaacuccacauuuucucugugguaauacccaacccuuccuccuucaacggggacucacgaagugaaccuuuuccuuuaguucuaaauuccugaccacaccggacccuggcuucuauccguugcaggcaaccaccuccuccuagagcucaaggagaaucagcgggagaggagugacgggcccagaaaugcggaaaaggaccacaccgcccccuggcggccacagcgcaagcccggucucuccuccugcuggaaggacaccggggaccgcaccuccagcugugggaguuccgagagaccccgcccugcccgcuccucccuggaggccgccuccacagccccccguggcguccucggggauggaucuccuccuacuuguuuccgcagugcgcggccgucagcacccaacucugguccaccaggacacccgcgcaguggaacgagaggccguugaagagcgagaccugccagggcugcgagccgcgcgcgcacggggagccauaggcuucgggguccaagcgcgugucguuuugggggagcagcgccgccucugcggcuggagaaagaaaggggacggaaucaaagcacggagggcagggucuggguuugggguuggagcugggcuguggcacuggacugcguucggggacgggggacgcagccagaacgcgagggugguagggaaauauuggggguuucgcgugcaccgaagggaaugggaggagaagaagcgcgugaaaguggaaggaagcugggauaggguagcguggaguaaugagacagaauagggugggucuggagggcagggacugaacgcagcgcgccuggagagcuggcuagaacgucgcuggucgauagaggggcggggauugaacgcggcggggagguaagggugcggggauagaacucggggaucggggagaggaaggggugugaauaacaaaacgggauugaaaaccaggagagggguggggcgcagugguuuacgccuguaaucccagcacuuugggaagccgaggcgguuggaccgcuugagcucgggaauucaagaccagcccgggcaacacagcaagacccagucucuacaaaaacaaacaaacaacaacaacaacaacaaaaaaguagucgcggaggcaugcgccuguagucacagcuaccugggaggcugaggugggaggaucgcuugagcccaggagguggagguugcaaugagccgagauugggccacugcacuccagucugggcgacagagugagacccugucucaaaaaaaaaaaaaaaaaaaaaaaaagccggaugugguggugcaugccugugguaccagcuacucuggaggcugaguaucgcuugagcccaggaggucgaggcugcagugagcucugauugggccacuguacuccagccacggagacagagcacugcccugucucaaaaaaaaaaaaaaaaaaaaaagaaggaaagaaaaagagagagaaagaaaaaaacaagaaagaaagaagaaaaaauaagagagaaaguaaaacaagaaagaagaaacaaacgaaaggaaggaaggaaaggaaggaaggaaaagaagaacgaaagaaagaaaagaaagaaagaaaaagaaaaaagagagagaaagggaaagaggaagaaaaaaagugaggggagagggcaaaaagcgguaaggcaagacucaggauaaaacacggugguguggccgggagcgguggcucacgcuuguaaucccagcacuuugggaggccgaggcaggcggaucacgaggccaggagaucgagaccacggugaaaucccaucucuacuaaaaauacaaaaaacuagccgggcuugguggcgggcgccuguagucccagcuacucgggaggcugaggcaggagaauggugugaacccgggaggcggagcuugcagugagccgagaucgcgucacugcacuccagccugggcgacagagcgagacuccgucucaaacaaacaaacaaacaaaacaaaacacgguaguguaaaauggagcggggccgggauggggcggcguaagaggaggagaaagaacgcggcgaagaguccacggaagagcgaggauccggguggcagaaaucggacagggccugaguggggcgggucacccaggggccgagccagaagaagggcccagcugacuugggggcgggccgugcuccggagcgcugggugggugcuggggucucgggggaggagaggugcgcggggcuuggugacgggaacacauucuccucccgcccgugccucccaccggcgccucuccccgcccccugcccccgaccuuaccccagaguugcgccaucagcagcggcagcagcuucgccagagcccgggcgccagaggcggcggagagguggaggugcggagcucucauggccaggaucugcuggggugugugcaggggcggguuaaaacagaugcuccguuagagacccccaccucgccgcgcucauccgcccagccugggccaccccagcccgcaagcacccuuuugaccugcagccgauaaccccaggggcuggcagacgggagauucgggcuggaacagcgguaaugggcacaauuacccuaaugacgccccucgcggcaucuucccguccucccugugcccgaguggagcgcucuccgcgccccagcuacccuggcugcagccacgccgcgcccgagguuucccccuccuucacgcgcgggguggggauccgaggcucggagccagugggagccucuuucucaaccucacagcggggggacuuccgcgucccgcagguggagaaaccgaggcucuaagccggcuccugccuguggcccggggguccccacccauccucucgcaauccaccccaacccggguggggugcagguagcuucaccugggagucgccgauaggaaggagggaggggacccagacgugccucugcccugccuguggucugccgcugguauccucugcccagggaccccuggcg

SEQ ID NO: 21422 - RNA, 7216 nt, Homo sapiens
caaaaaagggcauaggggcgggaacagcccagcgggccgucccaucggcuuuugggucuguuacccaaagaaugauaaaguugguuuuauuucaagaagucgaucaaaaagaaagccccagcgcucuagagcucagcugacgggaaagggggugcgcagccucgaguuugagagcuacccggagcuccaagacagggguggguuccagcugcccgcacgccccgaccuuccaucguagguaacgcggaagagcccgggagagcguugguggcguccgagagcgaggagcgggaaagaggaugggucugcacggagaguggaaaggcaggcuguguacucuggggaaaguggagcaaggaaggagcuacaguggccgacgcuggaggucggcugcagaaaaacuagaaaaaguagggaggaaagaggaaaagaggaggcgucuacacugaggggguucuagagagggagggguggacuccguagauggggguaguucagucucgaaaccuggggcgugcucuguccuggaggagggaggcgggcagucggaggggaauugaauggaaguucuguguuggaaauguuuugggagaucuucuguagggggacuguggaagggggucuacauugggguaagugcaggagguagaggcuuacacgugaaucgauucugcacugaaauaacuagggaaagaggaugcuacccugaaaguggggauacuuacuuucgaugaugugggggagggaggaggucuauacuggcggaauugagggaguggagggucugcacugaagacgcuggggaaggaugugccauggauaugggaaggaacccuagcugauuagagagccucucgggaggaugggaggaugggaagaggagguuuccuguuuguacccccgaaaauaugggugaaggaccugugccguggcccgugagaaggaggucugggugcggaaacuccaggccagguggguccgggggaggccggucgcgcccaggaaaugcccuauacgcgcaggccggaccaugggaaccccaaagccacggauccugcccuggcuggugucgcagcuggaccuggggcaacuggagggcguggccugggugaacaagagccgcacgcgcuuccgcaucccuuggaagcacggccuacggcaggaugcacagcaggaggauuucggaaucuuccaggugcgugcgacgaccugggacgcuggaaacccggagcugcgcgcugggcggaaaggacuccuagugggcccggcugagaaggcggagguggcgcgcgaggggcgggcucgugccaacgcugguggguggggcuagaacgggaggggcggggcuagccggauccgcugacugaugguggggcgcaagcaggguuggagcugcaggguuacgggaauaaaaccgggaaagccgguuaguacgcaaaggaaaugcauccuggggguuuggggcuuucuagaggccggggcucuugguuguaggauagauacugggggaugguucuugaaacaucagaggugaggccuggagccccaaaucugagguuccuaacuaccgaauuaguauaugccagaggugguaaacagugugaggggcgggguuaucacagagggugucgcggggcagguggugcacgggauuagacaccaaguuggacuuggaagccuggcuuagaaagaaaagguuuuugggccgggggcggugguucacaccuguaauccuagcacuuugcaaggccaaggcgggaggaucgcuugagcccaggaguuugaggccagcuugggcaacauaggcuccaucucuuuaaaaacaaaagcgaaacaaaacaaaaaccaaagagguuucaaaggcuuuugaagaggccgagcacaguagcucaugccuguaaucccagcacuuugggaggccgaggaggacggaucaccugaggucaggaguucaagaccagccuggccaacauggugaaaccccaucucuacuaaaaauacaaaaauuagccagguguaguggugcccaccuguaaucccagcuacucaggaggcugagacaggagaaucgcuugaaccggggaggcggaaguugcagugagcugagauugcaccauugcauuccagccugggugacaggagugaaacuccaucucaaaaagaaaaaaagccuuuugaaaacuagaggugggggauggagguaggugggacggggggauuuggggauggaccuugcagaguuagaacuugccagggaaagagggugguguuaggacucgggagacaggguuagggccccaggagcaggaucuaagucguccucccccaccauccugacaccacuguugccccaggccugggccgaggccacuggugcauauguucccgggagggauaagccagaccugccaaccuggaagaggaauuuccgcucugcccucaaccgcaaagaaggguugcguuuagcagaggaccggagcaaggacccucacgacccacauaaaaucuacgaguuugugaacucaggucugccagcuugggguucgugugggaggcuggggccccaaggguuccuggcacuccuacuccccucaccacuuuucucaacaggaguuggggacuuuucccagccagacaccucuccggacaccaaugguggaggcaguacuucugauacccaggugagaaugugcccaacuuucaugccccucagucuccgaccugucuccaugggccuuguccucucccucuagacgauccccccacuccccugccuccagccugccccucaccugagccagugcugacccugucugucccugccccggucuccucaggagaaaauuccaagucuucacccagcauucaaggcccgagcacaccuucccgggauuucauggauuucgauucgcagggggcugucagccucuugggaacugaaaaacucccucaccuugauccugcugaggcccaagcugggggagcauccccucugaaauucuacccagccugcuuugcccaggucuuaccugcauagagccagauccuuggguuggaaugguagcaccuggcguucauuaguguuuguuuggcuguugaugccauggcuggcucuguccccaggcuggaagccccuugaaggcagagcucaagccugaccucccugcguugcugagaacagaccugguccauaugaagucuccagaaaaggauauggaaaugccugauucucuuuuuuuguuucccuccaggaagacauucuggaugaguuacuggguaacaugguguuggccccacucccagauccgggacccccaagccuggcuguagccccugagcccugcccucagccccugcggagccccagcuuggacaaucccacucccuucccaaaccuggggcccucugagaacccacugaagcggcuguuggugccgggggaaggugagugucagcugcaggcugggagggcugaggucugggcggcagccccugauucucaaccccucuccccuucaugccgcugcugccgcugcucagagugggaguucgaggugacagccuucuaccggggccgccaagucuuccagcagaccaucuccugcccggagggccugcggcuggugggguccgaagugggagacaggacgcugccuggauggccagucacacugccagacccuggcaugucccugacagacaggggagugaugagcuacgugaggcaugugcugagcugccugggugggggacuggcucucuggcgggccgggcaguggcucugggcccagcggcuggggcacugccacacauacugggcagugagcgaggagcugcuccccaacagcgggcaugggccugauggcgagguccccaaggacaaggaaggaggcguguuugaccuggggcccuucauuguaggugagugagacaggggcuucgaccuggccaguacaaagcagccugcacagugguuaacaacucaggauuggccgggcacgguggcucacgccuguagucccagcacuuugggaggcugaggugggcagaugacaaguucaggaguucgagaccagccuggucaacauagugaaaccccaucucuacuaaagauacaaaaaaauagucgggcgugguggcacgugccuguaaucccagcuacucgggaggcugaggcaggagaauugcuugaacccaggaggcggagauugcagugagcugagaucgcaccacugcacucuagccuggugacagaguaagacuccaucucgaacaacaaaaaaaaaagaacucaugauuaggacugaauucagacgcuggcugcccuuggcccgcuguauaaccgaggcaaaggacuuugcccugagcccguggaauccaaggauggucuccucucucuaccugccugccagcgcuggggugagacacaggcccaguacacagagccugcucagggaauuagcugccacugucaucaucaucguaacuaaugauggugaacagaccaauagcaggaaagcuacaucccuuaggguuucgcugugcaguggcacuuucugccaugauggaaaugacagucaccugcacuguccggugcagcagccacuagccacaggggccaagcacucaggugaggcgagugcaaccaggacgugauucguuuuaauugguuacaauuuaaacugaaauaaccuuacaugacuaauggcugcaauuggacaaugcagccucagacaggacugaaugccaaccagcuucuccagauucacugagcauccuugggagcaugggcccccuacucugggccuguuaugaaugcugaggcuugggggcuuggggguguggccuuccaacaaccccacccugaugggagggagggagggagggaaggaggggacuuuccccaaacaagcaguccccuggucgaggcagcagagggccuuaggucaggggaggugguggggguuaucauucaaguuuacggggaaggguggguagaggguccucuucucaucccugacuaggcuccugggcccccagaucugauuaccuucacggaaggaagcggacgcucaccacgcuaugcccucugguucugugugggggagucauggccccaggaccagccguggaccaagaggcucgugauggucaaggugccugcagaccugagucccuggggcugaaagggguggccuuacagagggaagagguugcucccaggaacuccaacucccagagggcccucuaaaaaacugcaacuuccaagaucucugcaauaaccaguuuuucauccccgggagcuccuucccauggccucaccugcagaaccuguuuugaacucucuaaaccaguggcccccaaacuauuuggcaccagggaccagucucauggaagauaauauuuccacggacagggaggugugguuucgggaugaaacugcuccacugcagaucaucaggcauuagauucucuuaaggagcagccgaucccucacgugcgcaguucgauagaguuugugcuccucugagaaucuaaugcugccgcugaucucacagaaggcagagcucaggcaguaauauucccccacccgcugcucacauccugcugugcaaccuggucccuaacaagccguagggggguuggggaccccugcucuaaaccauguagaagcugguggacucaaguuuuagcugccauugugaggccauggcuguggcucccaggagucaagaucacagacugcucagcccugacguguguguguguguguguuuguguguguguguaaaacuacaacucccagcagcccuaggccuaugguucaguuacagcaggggguguguguguguguguguguguguguguguguguguguguguguaaaacuacaacucccagcagcccuaggccuaugguucauccuagguuacagcaggggcugcagggaguuguaguccuccaagcccugacuccuaccuugguggacaguggcuggguguuuucccugacuccuguccccacuuccccugcagguugugcccacgugccucagggccuugguagaaauggcccggguagggggugccuccucccuggagaauacuguggaccugcacauuuccaacagccacccacucucccucaccuccgaccaguacaaggccuaccugcaggacuugguggagggcauggauuuccagggcccuggggagagcugagcccucgcuccucauggugugccuccaaccccccuguuccccaccaccucaaccaauaaacugguuccugcuaugaucacuugugcgugucugguguugggugcccucugacccaauaugguuguuauucccgcucagggucucaguuuacccaucugugcagcuauauacaacucaggugcucaaugcaugaagaccaagcacugcagggggcagcugacaccuccucacuucugcccagggaccuggugggugauggcuguccccguguuguagaccaagacacaggcugggagaggcgcaaaggucacagaguaggaaacacaaagacuagccagaacccaggcccccugccuugccuaugaacaguuugggcaagugguccuucuccuuccaggccucaggcuccccuccacguggggcuggaggggucuugguaaaggggcucugcggccacccuggagccugcaaagccugccugccuggugacccugggcacugucaccucuccugguugggccgcaguucugggugaugaaacuggcagaagccagcgcagcccugacucacccuucggcccuugcugcucugugccucaguuucccucucaggacaguugaugagaucaccccagcuucacggggcugcugaaaagagaagccaacucaauggggaacacagauccugcucugggagcaauuccaaggcaggcacauggcacccaggagccgagcugggaagaugcugaucaggugggguccggccccugccucccugugagcagcucgcucccagccagagacugugcuaagugcuccaccugugucuuguucaaucaucacaacacccacuacacagauaagaaaacugaggcccaggggaggcagcugccccaagucacagucuggucucugucucccauccucagccuccugggggucccuccccaacccucuggcaaauuugucuccgaaaacaaaggguuagaaccaugg

SEQ ID NO: 21423 - RNA, 1652 nt, Homo sapiens
ccccgcccugcccgucgcugcggaaggcgccgcgcgcagcaacgcgcacuuccucuccaggaauccgcggagggagcgcaggcucgaagagcuccuggacgcagaggcccugcccuugccagacggcgcagacaugucagaacaaaguaaggaucugagcgacccuaacuuugcagccgaggcccccaacuccgaggugcacagcagcccugggguuucggaggggguuccuccguccgcgacccuggcagagccgcagagcccuccucuaggcccgacggccgcuccgcaggccgcgccgccuccccaggccccgaacgacgagggcgacccgaaggcccugcagcaggcugcggaggagggccgcgcccaccaggccccgagcgcggcccagccgggcccggcaccgccagccccggcgcagcuggugcagaaggcgcacgagcucaugugguacgugcuggucaaggaccagaagaagaugaucaucugguuuccagacauggugaaagaugucaucggcagcuacaagaaguggugcaggagcauccuccggcgcaccagccucauccucgcccggguguucgggcugcaccugaggcuaaccagccugcacaccauggaguuugcgcuggucaaagcgcuggagcccgaggagcuggacaggguggcgcugagcaaccgcaugcccaugacaggccuccugcucaugauccugagccucaucuacgugaagggccgcggcgccagagagagcgccgucuggaacgugcugcgcauccuggggcugcggcccuggaagaagcacuccaccuucggggacgugcggaagcucaucacugaggaguucguccaaaugaauuaccugaaguaccagcgcgucccauacguggagccgcccgaauacgaguucuuuuggggcucccgggccagccgcgaaaucaccaagaugcaaaucauggaguuccuggccagggucuuuaagaaagacccccaggccuggcccucccgauacagagaagcucuggaggaggccagagcucugcgggaggcuaaucccacugcccacuacccucgcagcagugucucugaggacuagcaaagucuggaggcagaugaaugguuucugacccucaccagggcuguggaagggugggggugggucauuauaguauucaggauuuacagugcaguauucacguguaacuuuuaaguuuucaguacagugcuuuuauaccuuuaaugcaauguuguauucauuuggguacuauuguguaguauuuaggauguaugcauguuuguuuauauguaagcuugguuggugcuuucgcuuuugugcuaccuuucuuggauuuuuguaccagagaugugcuaaacugaugaaauacauugagaaaguuuccaucuuauucuuuuauaugggacugaugauguguguugggguagacugcuccugcagaguuuggaagaagucaccagcaaagccggccuaaccaagaaaagucaaggcccuucaugaccuugcugggcacagaaaacacccucguggaguacacuaauuugaacuggacuggucucagugugagcacuuggcacacuuuacuaaacacauauacaaccccaccgugagucaacuuuaaaguaaacauuaa

SEQ ID NO: 21424 - RNA, 315595 nt, Homo sapiens
gcggccggcccgccgcuuuguguguguccuggauuugggaaggagcucgccgcggcggcggcggcgcugagggaggaggcggcggcgagcggagccaggaggaggaggaggagggggagccgcucauucauuuugacuccgcguuucugccccucgccggccucgccugugacccggacuucggggcgaucuugcgaacugcgucgcgcccucccgcggcggaagcucgggcguccggccgccucccgcgcggccagggccgggcuuguuuuuccucgccuaggcagauuugggcuuugcccccuuucuuugcaguuuuccccccuuccugccucuccggguuugaaaauggaggccgacgacgccgacagcccgccccggcgcgccucggguucccgacuccgccgagcccugggccgcugcugccggcgcugaggggccgccccgcgccgcccgccccguccgcgcacccggagggccccggcggcgccgccuucggaguauuguuuccuucgcccuuguuuuuggagggggagcgaagacugaguuugagacuuguuuccuuucauuuccuuuuuuucuuuucuuuucuuuuuuuuuuuuuuuuuuuuuuuugagaaaggggaauuucaucccaaauaaaaggaaugaagucuggcuccggaggaggguccccgaccucgcugugggggcuccuguuucucuccgccgcgcucucgcucuggccgacgaguggagaaagugaguaugugcccgccgcccgcggccacugcgggaacuuuuccuccgaggggcugcgcccuguuugcgaaacccgaguugccaccgucgcagcugucgggcccccgggcucgggagcggcgggguggggcgcagggcggcucugccgggagggaggcugcagcggacccgggacccgggcucguucgucuggagccccgcgggcccuggcuccgcgcauccccgcgcgggaagggcuuuucucuuucuccguccugacagcccagccguguuucccggcuaggcgcgaggacucgguagggaaguuggugccggggcgggcuccgcgguucccgggccccgcgacccgcaccucgccccuuccaugcgcaagagccucuccgcacacagcgcugauccccugcggcgcgcaggcagcagcgacagcacccugggccgcaccgcgucuccgcugcuggggcugaccgggcaguggggagcgggcagccgcccggcccgcggggugcgaguugcccucgaggggggaggugcccugcggagaggccccgaagccccaggacacgucuccaagcgcccgucgcugccucccgucgcccaacgugcuuuugccccucgggcuccucggguuccuggccuugcccgucacuuuggcccgcuccucguuggguuaccugcccccggcgucccggggcugggcgguggggugaggggaagcgcucucugggcagccccccgggaagugcgaggccgggagucuuccucagcuugucucuuccggggagcgccacuggguccccaguucagagggcucugggauggucucccaguuucucccgggccgggggauggagggguacuagggccgcauccgagugugcguugguggguguguggucggagccgacgugcauuccgacacacgugcucgcagcgcgggguguagucgccgccucacggggacaccuagacgcccgucccuggcgagaggugucguacgcugugguuucagcgccagggucugcggcggcgcggggaggguguuguguuuugcgagcgcggagcccuggccuugguuuuguuguggucggcgucgugucgcccucucuucugccgccccgcacuuccuuuguacguaguuaauaagcagugucgcuccacauucgcugucuuuugcaaucugauagcuuuuguuuugguggugucggguggggguuaguagggaagcgcggggaugcggggagcgagaacuccccccggugucuacggccggaggagguggggguuuuauucuucugaaaaaguugaaaguguggcuuacugguacauucaagaugguaggguaauuugaacacgauuaaaaguuuaaaugucgcagaacugggacugggaacggugagggcguguuggugaguaaugguugccgaggguaugcagguggugccgauuaacuuugaaaaaaucacgacugagccuucacgagugaggcggggaaggaggaggcagcggagguuguauggccccaucaccggggcaauucagaaaggcuguuucuauaaacaaauccuuaaacgucugguaagaaaugaguccgcgacggaacgagagcagaucgugguucgcguguuuacugccgagugggacgcggacuggggccggaccuuccacagaucugggcucuccugcucuuuguuuucuaaacuuucagcggacucgauugggcgaaagccuuccggcucccuuuacuaagucguuuaggugguggcuggggggacaaaggaggguuuuuaucuuuaaaagauaaguacgguuuagaagacacgggagaaauaauccauuuuguuauguuaugcaguugaacuguauagcuucucuaguuuuguguuuuuaauguucugaaauucaaaacagcagggauggccuucgccgacgcaggagucgggcauuuuaaaauaggcuguuuuucuuuuggagcguucuucuugaaggauauucuuugugcaagacggcgauuuuugagaacacaggcaggagggaggggguguuuuaauguauguuuuuacuccaugauaccaaagcuuccccccaggaucccuuuacagugguuaguuccuggaaaccugauggguggucagaaggcaccccaaaucucgauuaugguuugcugaagucuugacugacucaguaccugccccucccuccaucucugaaauguggagaauuaaaagcuaugccugugaacgggcguucaguuuuuagccgggaaggugcuagaccacuuaacucugauagaaauaagcugcugagcccuaucagggagggcguucuuucagcuguugucugguggagaaauaaagacaggguguugguucaguugcagguauuuugcuggcguauugagagauuagaguuuccucuuugagugugauggcaguagaaagaguguuguuuaucuuagaaaacuuaguuucugaagcagaggcagucauauggauguguuuguuuuguaucaccauaaugugaacagagcaucuaaaugaaggcgguucggagguucugagugauagccagauaaucugagggcuauuuuguuuuuaaaaagucagcaugcacuuuaaauuuauuguacccaucuccuuaaaaggauucagucaucuuucuaccccaggcauccuguugucacagaaauguagguaugugaaauguugguguuuaaagaaguuaguguuuuauuaccagaaggagaacccagaaaaagaacuucugaaagaaccuaaacagcaaauuauaguuuagauccucuggagagacauagcaagcaaaugguguuuuguggaagggugggguuugugucaggauuugaaauguaaaaggucauaauguuugauuugucgaaaaagauuagaaaaguucaacucuaagaaauaugcuaagguugaauagaugaagcuuaaaaauaucacaaaaagugaaagaagucagucacaaaagaccacauaucguaugauccgguuuaugugaaaugucuagaauaaacaaauccauagaggcagaagguagaugagugguugccaggggcugggggcggauggaauggggagugacugcuggugggcacaggguuucuuuuuggggugaugaaaauuguucuaaaauuaguuuguggcgauggcugcauagcucuaaauauacuuaaaaccauuggauuauguacuuuaaaucggggacuuuaaugguaugugaauuauaucucaauaaacccuuuuuuuuuuuuuuaaagaaaugugaucagguugaaaauaacuuguuaugcuaccuuaaauuacguuaaaauuauuacauacauuugacaggcugaugucucucucucuuuucauuuaugaguuuuucagauccgugaguugcagcaauacaacaaacugauaauugaagcuuagcaacagggauucaaucccgcaguagaaaugggcaagcaggagaaaaagaaucuugguucuauguagcuucaguuagggauugaggagcuggauuuaaaaaacacaaaugcugguggagggcagauuuuugacaauagaaaccucagcugaaucugaaaugaugguuuuuuucaggauagaguuuaggagcugagucugaagggcuguuuguauuuccaguuuuauuauguuuuccaacaaagaaagacauugcuguuuuaagauguuuuaaacacucauuuuuugauaugccacauugaccacaagugguaguaaggacugaggaugaacagaacaguucauuuuaaugcaguauuguuguuucuuuucuuugcaguuuuauuuuauuucuuacauaguuccagggucugagcaggagaaagaaucuuuaggaugcaguaguuuuaggauacacuguuucaaguauacagugauuuuuauaaaauuaaaauuccuuacagaacgaaagguuuuaaaauguggcaaaggcauuuuuguuuugaaacugugugcauuuauccagauuuacccuggccuuucaauaggaaaagaccuagagaauaauuguuguuuacauuugcuuuuggucuuugucuaaggcuuaguuuacuaauaaaaauguuuccugcccuuccuauuguugcaagaucagggcaguaaugaaaaucaacuguaucauuuucacuuguugccuuagaguuuuugccaagaggaacccucaagggacggugguuuccuuuuaaaucugguuucauuuguuuuguaagaaugugcuguaagaagcaacugaauccagccugcacuuauugugcaccuacuguaugaaagcugaccuugugcuacucagugcaugaaccugcagagucuugcaugaaaccaccuuucuugaaauucagauuuuuuuucagacucaguauagggugcaguuuucaaguagacaguaguuagcauuuuaaagguucuuuuaaaaauauuucuguagacuuaggacucuaguguuguucaucagaagccuuuacccuauaccuuuuuugccucauuggugcuuuccguuauauugggaugucacuguagacugugacauacaggugauguuaacccaucuugacuggcggcacugucuucuuuauaacauuggauauggcaauugugauuuacaaacugcaguguuguaguugccuuuuuccaaaaauuaggagucacagguguguacaugaacguugcauagcauguuuugaguuguaagaaagauggaacuuauuucagaaguuuucuggauuacauauugcuuaguuagcuuucuagaaaucaggaagcauucauaauuucagggcauuuuauaauuuguaaauaacuugguguuuuuaaaagcgugagggaguaagagugaggagacaaauccugaaaguuuuuguuuuuuaauuguaaagcauacaagauacauuucuuuauagguugugauuuuccccaauuuguuuucaaaacucauuuaaaaaucagaccuaguucauggaagagguauuugcgccugugggcgaacuugauuugaacugcuuuucuuagccagcuuaggacaggugcugaguccaggggaugagcucuucucaauuguacuaaauauauaauaguugcacacauguuacggauauaguuucuugauuuccagucugagauguucugaaggaaaauucugaacacuuuagagacaacaaagugccuaaugagugaugcacucugaucccuccuggaaaaugguguuuggcaucagcuuagcaagaggagguuuuccaguuauuuguaaagaugugauguggcuuuaaguggggaugggggaggguagcagccccaguguuuguggacauugagaccuguugacauuugggaagcauaacugaguuccacuauuugaaaagauuaaaacuuugauauauguacacauccccucaugccugcacccccauccccgagggucuggaaaagaauugauuuguucugaggaaggaacauauauuuggaauauaaaaugguuaguaaacaaaggaucuuuaaaacaaguuagauuguuaucucaagagaagcauacuuccucggcaugauguuuucuuuuguuaaauugcuuugguuuuauuugacucaaaguauuaacaauaccuuugauuuugagacuuuuggacuuuugaagacuaaguuuuuaaauggucaauuuuacucguuugaaagucccagauaccauuuuugaagauuucucucccuuuuuuuccacugaugccggcuuuacuuauguuuuauuuucaaaucuuaaggaaaaacugauauuuccuuacuugaacugagaaauagucguuuucccucccucuuuucuuccacaguaaauacauguugaguacuuacuggaugcaguucuuuagguuuagaaauuauuugauacuguaaaaugucuuaccauaaguuuuuaaagauacccgucaaacuauagauguuacugccauguuuauuaaaaaaaaaaauaaaacgaaacaaacuaguaagcaagcuuaaaauuuuucuuuuuccugcccuggacuacagauuuuuuuuucuuuuuuuuuuuugagacagggucucuggucaccuaggcuggaaugcaguggugugaucacggcuugauucugccuugaccucccaggcuccagugauccucccaaguaggugggacuacaggcacacaccaccaugccuggcuaauuuuuuguauuuuuaguacagacgagguuuugcuauguugcucagguuggacucaagcgauccacucaccucggccucccggagggcugggaucacaggugcgagccaccgcccccagccuacaagaauuuguaaacucauagauugcucuucuguuuucacuggaccacaacagaaaguaguuucuuuuauggugagggaugaacaccuacgauugcaauauaaguuguugggccuuguguccauggagcucacuuggugguugguggucuugaagcauucacauucuuuggaguaguggggcggcuggcuagucacauggggaagaugugcacaccuguggauggggccaucacacacugcagcgauagcugggccuaccuuacugcucaccuggcugggcacagcggcuccugccuguaaccccagcacuuugggaggccaaggugggcagaucacuugaggucagaaguucaagaccagccuggccaacauggugcacccccuuucuacuaaaaauaccagaauuaaccgggcgugguggcccgugccuauaaucccagcuacgugagaggcugaggcaggagaauugcugaaacccaggaggcagagguugcagugagccaagaugaugccacugcacuccagccugggugacagagcgagacuccaucacacacacaaaauacauauauaaaaauaaauugcucaccugguaauagucuggaaaacauuuuuuuuuuguuuuuuugcauauuuuaaagacuuuagaaaguagucuugcuaauccagaaaguucuugcggggaggaguuugaaacuuuguuuuaucucacuccucagucuuagcccccuuaauaccauaggucucuacuucaguaagaguuacauaauacgaaugccguuuguucagaauuguguaucuccauccauccguccaucguccaaauucugcgaguuugaaauacauuguuguugcuguuuuguauacuuuuguucaaccauuuucuuuuuaacauggcacuagcuuucucaaacuggcuuuggaauuauuugucaguuuaaaaauaaauaccacuuuaaaaauuacucuugacaugggagaacaaauauauuuugauaguuguuagagcauaaauauuuuauagagcauaacuugaaauuuuuccugauacauugugauugcuuucagcuuguccucugcuguaaaaaauauagucgugguuagucucuguaaaguugguuauugggaauaugugcuugauuacguaaaugagacaucaccaauuuaagucagccaaaguuuagucaauagaacuuuaaagaacagaagucuaaugguaauuagggagagaugaauuuauuuguaggaguuuuccccaaauucaaagcgucuuagugaccuuugauaacuuccuggaaaaaguaggaagcauggagagaaauuccagguaggagcccaugauccaauugacugcaucagcuuacaaaguguuuucuaagucauuagcuauuaauucugucuagauuguaaaaucccucucaguuguguccacauuuaucuguguuguccuguauuuauucucuuuaccuaauuucccugagucucauuuuagugggauaauacacaagcuuacagacucaggacuuuaaagagaagcacagauugccacgaaaacaaaugaacacagagaccaguagcagcagagggagaucugcugugaggcuucccuuaguucuguugucugauuucuguggauaaugaguucacugcauauguuaggucacaacaugauaucguguagucguagguacagaacuuuuguuaugguagccuuucuucgucaggugauacaauugggauuuucuuucucacaugcaccucaguaaaauuuucagcaacagagauuggcucaggauggaauuuguucaguuucaguucugcagccuguccuuuucuggggagacucauuaauugaauguugccuuucgaucucacugagucacuugaaaucgcucagauugaccccuauuccgggauccagccugguccagugcagaccugcauugacucugacuacaugcugaguuggccucugaaccaguuccuguaccauucccuuagucugauggacuugccagcuccaaauacucagaacgugccucuugugguccuaggaucaaguccaggguccuuagaaucaaguaaugaaacagguccuuaguaauccugugcuguagggauccacuguuaguuccugguacuccccagcaucugugcauuagcuugauggaaaggaagcuguguuaugccugucuucaaguuuuugcuucugcuguuuccauagcugagaauguuuuuccucuucacuacucugcuacuucuccuuccauccucaauacugaauagcagaaagugccgcuuaagaacacaggaaggucaccauagcuuuaguuucuccuuagcugccaauuaguucuuugguccuaaaguuauuaacuuuucugagucuugauagaaaugcggagacuuaaaaauauuugggggagacauuucuccuuuucucacuaaacaacagaaugaaaaccuuuucuaacagguuuagaaaaccaaagucagaaaaauugugaggaaauagaauagguuuuuuaaauugaaauaauuuccaaguuccagguggaucuguaaaauagggacaagaucauaacuuucaaaaggcagcacgcuaagucaggugauuccuuucccccauaugccuuuucugugguuugaauaggucagagaugccaucuuuacauuuccaagucaaauuccucuuccuucuugaagguuuuugggauuucccuaacuuguauagaucuacuuucccauuacuccuuuugaguucauaacccacgguuuugcugguugacagugauuugucuuguuccuugcuuguaauuuuauuaggaccauggagccaaaguggcugguuugaaucucagcucuucaguagcuaagcucucaggcaaauaauuuaaucuucuugugccucaguuuccucaucugugaaauuauaauuuuaauagaaucuacuuuaaacauucauagaaaucaaauucguacacaugucaagugccuagaauagaaccuggcaccugguauuaagcccuuggacuucaacugcuacuguucuuaggguugugacauccucgaacagagauguucuuuggauagaaauauaaggcuuacuugauguuugauuguccuugccauuuaaauauguuauagaaccuggcacauaggugcucaauaaauguauaauaaaacuuuauuuugcuaagguguuuauuaacaagauggcauguugcuuauuaaacaguugugauuuuuuuuuucaguaaacgauggucaucccccugcaguuugccuuccauuucagagaucuguuuauuacacuuucucccuuaauauugucauuugucaauuucugcucacaccugagagguguccagugugcacuuugcccaucucgccuaugcauaggcuccaucuaguggccagaagggaaauucagcauauuaggugacugaauuaauagugccccaaggaggaagauagcgaucccaacccacucucuggcuugcuuccuggggacugauugcaagaaaauguggauacuacagacuucuguagaaaucacugggcuacaguuuuggauuaagguuacucuacugugucagugcgagcuguccugagagaauuagggucuuccuaagugaugcagacaggcgcacugcaacuccauggcagagcuguuaacaccuagugugucuuuuacaguuagaguuuuaagauaauuuuacaggacuuuaauaaauuuaaagcuccaaaauauuugagauuagagauuaaaaaaacacuacugauuucauuuggaaaaauacagcaagauuuaccuuccauugcucuauuuaaacagguaguaacacuuucauucucuucucucuccccuuuggcuauucuaugugguuaagaugcucgccagccagaaauacucacagagaauaagaauaaauacauccaguguuguguuaggucccacaccgucuauauuucgcuagcuaauuuuauguauuuuguuucauguuuuauugauauuuucagaaucuuucuugcugagauuacacaaaauauauagcugguuauucaguuuuacgugucaaaagccuuaaaccuguuuccccaugauugccuuuuauuauuuuuaauucggaaaucuuuguuuggcugucugagagagaacuucagccucccuuccucccagacauuuugaacaguucaggcuguacucauucgugucucuuugucuuggcagguggaagccccucugcuuggaauagcaaacaauacuaccagcuugcccucuggcaagcuccuuuaagaguuagcuguaauuucacccucucucuggccuugauucugcaugcagaaugauugcacugacuugagcuccuguggucucuugcuauaccuccuauuugggcaucucccccauauugcuuucccccaccauuggggaggggaaugguaccuugguuaucuuugaauucccaggagguggcccagugccuggugcauaggaggagcugaagaaacggaagacuucuuaaagggauacucgccauucacuuugaagcacuucuuuguacaacaaauuuauuuucaucugaucauugcaccucugcuagccaaaacauuuuaucacaccaguuacugcugcauggaacuugaaagcaauaaaauuaucuuuaaaaucauuguuugauuaggcuuuuugcacauugaggugaauaaaaaaaauuagaacuccuggaaggguaauuugugagucuggccuugugucaagaucaccucaucccuguggauggagacuuuguuccauaaguucccuauagauaagauguaaugaauaauucauuggcaccgauuuaugucuguagugugcuuuuaaacccucuuggagcuggguuccugaggaggaagcaucugcaggcuggacucggcugccugguggucuccggaguggccuggugcagagggccaggguggcaucucagaaaguuggguggguaggguacuugcacaccugcugaccuugaguuacaggguggaccuaggucauuucacaggcccuuccagccuucagaucucaagauacuaggcagagagagagauggagauuugagggagaugugguuggaacaagcagaaucaccacguauggaaguuggcuucuauuuuuugcauuguuuucuuggugaggccaguaagcuuuugccucacuccugggagggacaguagcaaggucuuacaggucucucuaucauugaagcacccucuccaacccugccgguuuugguugcuggugaaggccuuugacaguguccugguagggcgacggugaggccagcucccgaccucuggacagaagaaagcuuacuugucuagguuggugucaaggggacuccugaacuuaaugaacaccuuagaaauuauccuuaaagucuccucuuccgaggaguggggugggauauuucuugcagaaaauguaaacauaaucauuugaagcuggaauguuaauauucaagaguagcuuguaaaaaagcaucuugugaaauucucaugugaaugcugaaccggcuggaugugaacuuagcuggacagccuggccugucuuugcucugcucuucuccgugcgguuugcauaugugcagggcuuccuuugaagccuuguccccucaaacaauucacugucucccucucucccacgcauggaggcauguuggaaagggagcuccaggccucagugucucugccugugauuggaauaacacugcucuagcagggaugccaaugagaauuagcaauagauaauguauccaagcugcccagcaaaccuggcaaauagaaagcauccaauaaauggaugcuuuucucuuuuuuucuccuccucaugguggguggcccuggugggcucucucuggggccuccaguccuccuuccccacaacacuggggaauugcugccaguugaauagggcccuuuuuuuuuuuuuuuuuuuuuuuuuugagacagucuugcucuguugcccaggcuggagugcaguggugcaaucuccgcucacugcaaccucugccuuacugcaaccucuuccucccagguucaaacaauucuuguggaucagcuucccaagaagcugggauuacaggcgugugccaccacgccuggcuaauuuuuuuuuuuucuaguagagacgggguuuaggcauguuggucaggcuggucucaaacuccuggccucaagcaauccaccgaccucggccucccauagugcugggauuacagaugugagccacuguggcuggccaaggagggucuuuuuuugcacaucuacagugaaagguuugaacccggacgucugagucucaggucaguuguugaaaccacuaaguaaccaccuugcuucucugugccugaagagaauggguuuuuagguuaaccaggcugacugguucaaggucaugucccuaucuguggaaggggagugggaguggaaggugaguggugacagaguauggaacccuguuucugauaucuagauuauuugagggccuccaguggucucugcuccauggaaagcauaugaaagaauaugauuuuuuuuuuuuacucgagcuuguugucuaguugggaaaacucaacuacugguggagaguaacagaugcuaugaguuuagugcuaaguuaugggaugcugaccggagagaaguaugugggcugcaggcaguggggucacggaacugcagaauggcuugagaagcuuuaaggaggaugucugacuuuagugugcccuaaauauuugacucucaagauccaaggaggcagcuccccaggagaggaagggaccaugugugguguggguggcagugugcacugauggaguggagagggugucagaauccgguguuuguguggugggaaggaauugacugcuggcuagagaaugaggagcgcugaaaccuuugcaccauugcaguggacccgcugagaaggguguucuggggaggcugcucuggucucucgauggagucaggauugggggacagauagacaccccggugugagccagugaugguauagaugagggaggcagugaggacaggcucagggagggaagucuugucucuagaccugagaccaggaagcaggaauggacuggacagguuggcccagcugagggaggugacuggugagauggguccucggugugaggggcuggguugccagaggagcugugggcuggggugguuugucgagagagcagucccaguugauggagaggcaggacccgcaaaacagguuggcugcaggacugggggcgguagcacagggcagcucccgaggagacaccuggcacuuuuaaggcauggaauggagagagcuaggggagagcacaccugcagugaggcaauucacauagcaaaguucuccggaaacugcaguguucaacuuuuuuaaagaauagcuggauguuagaaaaguggaggaacugucaccuuuauuaggggcaucauggauaccugguagcaucaagggcuaggguuaaaacccguggaguaauacgcccuccuauuguguuccucuccucuaaaaaugaaggugaaacuguuucaggugagcgcuguuguuguucguuugcuggggcacugcuuucugauuuuuagaggaguccaggcuggagacugaccccugccuuuuucugaguugggccggcugggcccgaggcugguucugggcugggccaggcugaugcaguggccuugggcuucccgaggcugggagagggcgguggcccccgcuacccugaagagcuggccaacgcggcagggcucuuuccaguccuuaccaugcaagugaagaggaacaguuuguuuaaagaggggugccagcuucacauccaggccuggacuuugcuacuggugcuuuugaacuuguguugauuuauguuuguaaauugacuggacacauugugguucuugaugagaagcaauugcccauccuuagcccacgauuagugccacucucugggugcugccuguucugccacuguaacuguuuucacuugacaaauaacauuaaaaaacacaguucugcaagagacuuccugggagggugguaucauuuggccugugggcuuuuguaacacuuuccugcuauuaggagagugaauucugaauuuucaaucacguucaccuguuggagcaaguagaguuucagacggucuccgcuuuucucgacuagaaagcaggccuucucccuuuuccccccagucuuguuucaugacaccauuccccucugagaugaggguuggagaauuagaagucuacugaugcauuguaccggggcacguuauugacccucucugcucuccuuuccucaucuguaaaauggaagauaaugccacccaucaggccgagugcgguggcucaugccuguaaucccagcacuuugggaggccgaggugagcggaucaccugaaaucaggaguucgagaccagccuggcuaacauggugaaacccugucucuacuaaaaauauaaaaauuagccaggcacaguggcaugcaccuguaaucccagcuacucaggaggcugaggcaggagaaucacuugaaccugggagguggagguuggagguuggagguuggagguuggagguugcagugagccaagaucgcgccacugcacuccagccugggcgagagugagacuccaugucaaaaaaaaaaaaaaaaaagugucacccaucuuggaggaucguuaccaauacuucaugagugaauacauacacauuucuuagaaccuaggguuuauaaacacuaggaguuagcugauacuauuguugcuaaggauagaggaaauacgcauuagaaguuauuuacuuccuuuaaaaaaaaaaauacccuuuggguguguauugauucugauguuuugcuccuagcuacauuugccguuuuuuuuugacugcagaauuaggaaccagcuucauuuuuuuuuuuuuuuuuggauggaaucucgcucugucguccaggcuggagugugguggcgcaaucuuggcucacugcaagcuccaccucccggguucacgccauucuccugccucagccuccccagcagcugggacuacaggcguccgcugccacacuaauuuuuguauuuuuaguagagaugggguuucaccguguuagccaggauggucuugaucuccugaccuugugauccgcccaccucggccucccaaagugcugggauuaaaggcgugagccaccgcgcccggcaggaacccagcuucauuucuuguaaagagaguuugacaagcgcuccacuggggauagcagcacagcuuccuccuuuucugucccugucucccuccugacucugcaucugccuccguuugaagcauccuccuccaguaagugggucauuuggauuccaaggcccuuuugaggccauggugauggaucauuugcguuaucaaugugaacuguggaugucccuucgcccuucagucucuuccuucuucaaggagggggagguaauugggggucauguggccuggggaagagccuggucacgagcaugagggaugugagugggacuauguuuccagccaaaauuuagggcacaggaucugaaaaacacuuagauuaaguaucugcaacacaaauuaggguauuuuaaauugaauguggagaacccugagaaccugugcccuuugugcguggauggcugcuugcaaggaugagcauccccagcuggagcggcccauggcugccagaacaggagaaggcuucagucaggugggaagccagcugcaguguguugccugaugcaggauggugcgagaaggagcugcucucuugcucugcucccuggaucgcacaaggucuuccugagaccagaauucaagguuaguccuguuuaggcaacuugguagauggacuugaauggucuugcuaagcgaauauugccuauggugguauuugcaaggaaaacaaaaguguuuugagcccagacuaaccaauuuaacaaugcuaguagguaaggauacuacuguuugcuuucugugaugagaggucucuuaggaggagggguuaauucuuuugauuuaaaacuuacuacuugaggcaaauaggcacaugaaaagauguugaaagucacuagucauuggugaaauguaagucagacccacaauugguacuucauacucauuaguauggcuauuaccaaaaacaccagaugauagcaagcauaggccaggauguggagauguuggaacccuugugccuuacuggugagacuguuaaaauggcacagccuuuuuuuuuuuuaacaggaagaugauauggugcuuccucaauaaauucaucauagaauugccauaugauccagcaauuccacuuugggguauaugcccaaaaagaagugaaagcaggggcucgaacagauauuuguacacccauguucauggcagcaaauaauucaaaauagccaaaaagugaaagcaacucaaggguccauccauagacggguggauaaacaaaauguggucuauccauacaauggaauaucauugagccuuaaaaaggaaggaaauucuaugaugugcuacaaugucugugaaccuugaagacacucugcgaagugaaagaagccagucaugaaaggacaaacagugcauaauuguuacccuuacgugagcuauguagaguagucacauucauagagacggaaaguagaauggugaggggcggugaauagaggcuggggggagggagcaaugaggaauugguguuuaauggguacagaguuucaguuugggaacauguaaaaguucuagagguggaugguuacggugguugagcaacauugugaaucagugucagugaacuauacacuuaacaaggguuaaaauguuaaauucuuuguuguguauauuuuaccacaauuuuaaaaagcuuauuucucaauuguuuaugcgaguauauguguggaauaguuggggagacaaauucaaggagaccaguccuuguccauggcgguccuagguaccacgggaucacugcgggggaacugugaggucaggagaggccuugaaaaaaaacgcagguuugagcugagucagauggaaugggucuguuuucuauaucaagagacaguauugcagauaauuuuuuucuuucaaggaaagcaagucaggagucaaacucaugccaccguagucacaaaugaaauuuauugcuaaucagccaugugacguguaauugcuuuuucauuuucuuauuuuuccagaagagagauuuguuuagauguuugauucccucacugauuaugauuauacuggaaguuuuucauuuguuuugacagcucaauuuuuuuuuuauuguaaauggacugccucauuacagaggggggagcccuugaaagaaagggauugaccucugcaggcaagaaucugagcauccuaaaaguagaaaagggcuagaggcuucgccuuacaggccaggaagcuuggagggacgcgcugcuagagaccauggcacgcaugcugugugucgaaggccagguccgccugucugccucuccagcagauacucucuggggcuauuuuuuucugcuugguugucauccuuugguuuaaccaggcgccagggcucaggccuggaccugcuggauuccaaagaagacuucgagguggccgagcuugucuggcuuccagaggagcuuucucugucccgcccgggggaguggcucaccuuggucugagaccaaugggaggaagccugcugcgggcaacuggucugugccuggaaguuggacuugcauuuucucuggaccuccaaagcaaacccgaaugaccacucucauccuccccuuuugcuuguuuguguaugugcuuguuuugccuggucgucaggcaggagguggugucagaugaugagagguguugcucgucccuggguugguucucuuacggggcuguauggaugucuuagcucagacugcugugacagguuacuauagacugagggcuaaaaccacagacuuauguuucucacaguucuggaggcuggaagucugagaucaaggugccgaccaaauuugguuucuguuaaggguccauuucuuggcuugcagaugacaaaugucauguguccucacaggguggagagagcaaggggcucuggucucuuccucuuuauguaagggcauuguugccauuaugggggcucuacccucaggaccucaucuaaaccugauuaccucccuaaggccccaccuucagauaccacugaagguaucuggggguuggggcuucaguauaugaauuggaggggacacagucaugcaguucagaacaguggagcagugugccauagugaagggaucuccagaccaggauucucuauggaaguucuuggccaggucugagaguugguuacagaucauuaaaauuuacauggaauccaguacuugaaaguacaugucuucaggauggcgcugagcacauucgccucuguaaccaaaugccugaaauguguagugcaccuucugagcaccccagugcuuuccuuaaagugaaugcaguuugagaggaacucaauuauugagaaauuuuauaugaccccauuucucucauuuuaggacagauaaguugcuuauuuuaaacucugcaggagcuacauagaggaaguuauacuccaggagagcuuaaauuucacucucugaaaacucuguuccauguaaguacauuccuccucucuccccuccucagugagcacguacccaucagauguguggaauucuauuaaaagcagcuccucgugacccuccagggucuguuuuguaaagcugacaccagcaucagugaguuggaaggggcugccacagaagacagacuuacugcugcagcccgcuucagagcccucaguaguacuuuuuccucucccagcaaauccaggaggcugggaaggugauuguuaauuguuuaugagcauuaacuguuuaccagucauacuuacuauuuuaaaucugacccugccauuauguuguuuuguuucuguucacagcugagcuuuaagcuggguagaauuucgugaugagucacuccuaugacuguaaaaucaguaucgaucaagccuuccuguucauccugugagcaguuuagagacagaugagacaggcuuaugguuuccacuggcucggcuccgugcgugugcggauugggcuuccugagagccugguuagccccuuuuaucugcucucugaaaccugcgcaaggguguuuagcaugcaccuugaaaccucugcugccugaagacagugugcuuaaaugaaggguauacaaacccaugugagguuuucucuucccuuuuccaugaacuccaccccaauuaccuguuugaauuuugcaugccaguuauuuucagggaacuagugacccuuuucuugccacccugggcuuugaauugaaggccagugugccaccuuuucuuuggcuuuguuagaacguugcccucagggucauaugugcuggcugcuaugaauucuuacugcuugauggacagagaaaggugaggguuagauaucuggacagggcaugacagggcgggucaucgaguaggaacauugggaccuuuugcuuccaggcuugagcagugggugagaaacacugucuucccauuagggcagugggugaaacacugacuucccuccauccucugggcagccuugucagguggguguggaagcugaggugugucugccccaggcugugcagucagccccguguucuagcuucccgugccgaaccuggcccuggaggcugucugccuggcaagggggcugcacaaagcucggaggggcauuucuggugcuugguagaugguaggccugcccccagugcacugauaagagcaugggcugagagugccacuuggauucggcuacagugggcggcagagugggggugacugguguugcuuuuacucuagagcagaggaggcagaugagguagaucggggccccagggaugcugagcugagcuggguagagagaauuugguuuuguaggauuuggagacagagacaaauuuggaguguuuggauguucggggaccugcaggagguaugugagguguguaaaaugcagccccuguuuuaaaaagagcuuacauugucucuugagaagauaaggugugcccagcuguggaauggaaccagaugcuuuuaugagugaggauggagugagcacacugggaaagagcccuggaauuggaggaagagaucauuuugcccagagggaucuuggaggucuccuggaggaggguacuuagaugaucagaaggauuauacuagacuugaugggguggucuuggcaucagaacuuuaaaaauguauuuuggggcuggaagcaaggcuggagaggaagguuuguuuaaguuguagugggggaugaggcugggggcaaaucagggaugguuuuccaggucuguaaaggcugggguaagaggaaugguugguucuuaagagcaaaaaaaaucccuuacauauugguucucuuauuugugcuaaguuaaauacaugggaggcuacugguguuuaugaaauaacccugagccuuuuuggggagguaguaguggaugucugauggaagagauagaagacuggucccagggguucuuaguggcaccuuccucucaggucaucacugugcuuuugcacauugcaguuauauuugacuacauuugauuauggcagauuuacuuagaagggcacuggaaaaaagccucccaaauuacaacugacacaggaaaugacuuuauuuucuucuauuuuuuuucuuugcuuuucucccccaaucaacauacauuuuuaaaccugucaucucacaugaccugccgguagaauugauauguuuaauuucuguagaaaauaacuggaaauauuucacaagcuccaguagcuuccuguuguagggacccuuaggacuuuggaaugagaaguuuucuauugaguugucauauuuggaaggauaaaggugcccucuuuucccucgauccacauaguagacuccugugugcgggcauuuguuuggugucucacguugaugcaaaugcagccauugcagagugagccccgcucuguuacuggaucuccauuugcucaaaagagagcagugucccccuccaaaucugcaugucugaaagcauucaugcagguucauugcaugggucuuugcauuuuacuuagacuuagcaaaaaucagguauagucuuuccugaaaacaaaagugaccauuguuuuuaaucaacugcaggguguuuggaguugugaaauauuuagggucccgaguccauuccagauucaacauugggaaagaaugagaaagcugaagccuggggcaggcucugucugcagaaaccaugggcuaucacccccucuccuuagcagcauuguaaacaaacgucauuuguaaggagcaugucccaacugagcuuguaauuauaggggcaagauuuguguggugguaggggcauggagcuggagacugggggcuuccuuauugguucauuuauccuggcccuucucuuuucucucaagucucagcucuuuuaagauucagaaaauaaugcaaaaugccuaagauuucugaaauuccuggcuucagagacuugacuacauaaaagagccaggauuuucaggcuggccauuucaggaucagccauuucccacuuccugauucauagcuuccaggauuuguaaugccuguagacuuuuuucucuuuugcuuaaaaguggccauugaaagaaaaaauaaauagcaaaauccccaucccagaaguucuacuuccuguuguuguacuauugagcucugaaaaacagcuuuguaaguuuaggcucuuguuuggacuauuucaguggaauucuugagaucuuuuuguuuggacaggcaaguaugaaggcgauaagucgaaagaacuacagcuuacucagcacagaaaugcagaggcucaaauuuaaguucuuccuuagcuuuaugguguguauauuaauauaauccaagcaauagugaguugcuuagccagggugcacagacauuuuccacaaugccaguuguuucccucauaauguuuaauguuuauuuuuaaaggacauauuugggcacacguuucauuuuugccuguaaaagaauugggaauauuuaugauucuugcaacaaaggagaaggauccaaaguaaccaagaaaaugauggacuggcagccuucacauuuucccacaacucuuuucaugaaauaaaauguagauaaggcugggugccauggcucacgccuguaaucccagcacuuugggaggccgaggcgggcggaucaccuguggucgggaguuugagaccagccuggcgagcacggcgaaaccccgucucuacgaaaaauacaauacaaaaauuagccgcgugugguggugugcgccuguagucccagcuacucgggaggcugaggugggagaaucacuugaaccugggaggcagagguugcagcgagacaagauggcgccauugcacuccagccugagugacagagcaagacuccaucucaaaaaaaaaaaaaaaaaaaaaguguagguuagcaaaagugccuacaguucaaaugcuuccaugcuaaacguuguauuucuuccggucucauuugugaugagagucauaagauuuugagaaauacaaaaaccuuuccagcuuuauaggaugauaauggcuuggccacucaaguaguucugauuggguuaacuaauuuugguccaguaaucauuucauuuggggugaauggauuuuuccccccuaaauacggguaccuggaaaguugaagcagugaaucuggugaaacuuaaucagugauuucguaaggguuaacaaauguuucugggugggauuccuaauguccagcuuccucuguguagcucaguaagucuucuuuggagacacuagccugcauuguaagacugucacaugggagcaucuuuuuauuuuauuuuacuuuuuuuuaaaaaaaugaggucuuuauuauccuggcuggagugcaguggugugaucauggcucacuguaaccuugaacuccugggcucaagugauccucuugccucaaccucccaaguaguugggcugauagacaugagcuacugugccacguagcauucuuggggauuauuguaggguccuuuuggaccacacaugguuuuauacucuguagcugauugauguacuggcaugucagugacauuguguguaucauuacacuauuugguuaauugauguacugguggaauagccaucuucuggaggcucuuguuugcauacuucucuuaguggcggacuagcgguuguacaguaaauagaugaucauucucgcucuguuuuaccuuuccucagcugcucuucuaguaggaaaauaacagcccucuuagcuguagucuucuggaggcucucucaauaauagaaguggaaagaaaagacucaaaucccugggcagugacuuuuuaguuguuucauuugcuuuuaaggcagaaacaccuuuaacucuuaguagccuuacagaucauuuuugaaaacaccugugcuugccuugaauggggcggugaccacuggauccccccaugcuggguacauguuuugcagucacagacacugcuggccucaccuuugguggugaaggaauguuuccaauuucugcugaugguguagugcucuugggagcugggugcucugaaugagcagaugggcaucugcuuuuuuaagcgugcuguucauucugcaaaauaguuauugugcaaauaccugauaagcaccaggucugugccaggcgcuguauuuuguauuuugcaugucugaggccagcaucuuuuucccuguuccuuuuucuccucauccagugaacuuuccacugugguuguaguuugucugaaaaagauuuggaaaaaauguacagccauguuucucuugucuagagaagcugucuuaaggacuucgacaaguuucauuggcagagugaaugagugguggccucugaauaguugaaauguuaaugcuaucuauagguucuagagaaucugugucuuuaaaagucauagcgauaaagucucagcuuuuugagagaguggguuucagacauauuuuaaaauacuacuauacaggaaaucugauuguugcauugaaacaggauuuguuaucacaucacgguuagacauacccaaaaggcaaaaacuacaguggucaugauggcuuuacauaagauuuuggaggagaaacuguuagcuccaugaaagcaggaacuguguucacucuugaaugccugcuaccugcacauggugaauguucuauaaauguauauuaaagaaauggagguccuuagaguuccaagaucaccgucaauaucaucacccuaggcuuccucguccuuccaguuacuucuuuuccagaagaguccauugccuccuuuauaugaggucuacagagcgcguucagagggcucuuaucauugauucagcaaucacguguacacauagcacuagaaugacuucacauauuugaccuguuuaaaaauaacgugcagcuaugacgaacagcgaaccuuugauuagggacacauuugccugccgccagacacuacaaguauuauguguauugcuuuuuucaaauuauaauaguaauagaugauuaugagaagaaaauuagaaaauaaguuuucugucucucuauaaaaggaaaauaaaaauuauccuuaaucucaagguaaccauuguuaauauuuuguuguguuuuccugagauuuucccccuagacuuauauguguaucuauauauuuaaaaaaaugaaauuaguaguauacuauguacacacauauugugaauuucugcccauaacauuauaucuuuaucaccuggaaugaggucuuuaaugaaauuauuaaaauuaaaauuauucuauaaaugcuaaauuuagguauuuuacaauuuuuuuuuuuuuuuuuuuuuuuugagacaaagucuugcucuguugcccaggcuggaguggacugcaguggugcaaucucagcucacuucaaccucugccucccagguuaaagcaauuauucugccucagccucccgaguauuugggacuacaagugcaugccaccaugccuggcaaauuuuuguauuuuuaguagaaacgggguuucaccauguuggccaggcuggucucaaacuccugaccucaaaugaucugcccaccuuggucucccagagugcugggauuacaggugugagccacugugccuggcccauuuuauaauuuugaucauuaaaaaaugaugugauaaaauuauuguguauuguuguugauacacuacucugauuaauucuuugggcuagauuccuaaaaguggaaaguaaggaauaagaauuguguaagugugcaugauccuagauaaauauugccaaaauauuuugcagaaaauucuuaguuucagcuuccagaagcagugucugucauccauacuccaccagaauugaacacuaaauugagcuuugcaauuuuagcauuuaaaaaguuguaucauuuaauauagaauagcagucucuucauuaugaucuucccuugccuaguaaguuuauacucaagucaaaaucgguuaaucaugcauauugauuccuuguuuaucuuuuucuuuuaauucuuuaauacuucuagaauguauuuguaguuaagugaaguaagauaccuccuccuguugacgauuuaguuuccccacauugugcuguuuuuuuucuucacuggauuauguaacaauaucuuuucuuuuuuuucuuucuuucuuucuuuuuuuuuuuuuuuuuuugagagagucucgcucuguugcucaggcuggagugcagaggugugaucucuguucaaagcagccucccccuccccaguccaagugauucuacugccucagccucuuaaguagcugggauuacaggcgugcgccaccacgccuggcuauuuuuuuauuguauuuuuaguagagaugggguuuccacauguuggccuggcugguguugaacucccggccucaggugauccgcccaccucaccuucccaaaguguugggauuacagacgugagccacugcgcccagccuagagacucuauuuuauuaguguuuuuuguagacaaagucucacucuguugcccaagcuggagugcaguggcgccaucucggcucccugcaaccuccaccucccggguucaagcaauucugccucaaccucucgaguagcugggacuacaggcaugugccaccaugcccggcuaauuuuuguauuuuuaguagaaaugggguuucacuauguuggccaggcuggucuugaaauccugaccuugcgauccgccugccucgaccucccaaagugcuaggauuacaggcgugagccaccgcuccuggccgagacucuauuuuaaagcugucuucucccacugauuugccuuuuguuugugguaaaaucauuuugucuuaaacacuguagcuucauuauacauguuaacaucugcuaggaagaaucuccacucagguuaaaaaaaaaaaaauuugaagcaccauuauuucaggugaacuuuguguguguguauguuguuuuguuuuugcaauucuucuccgcuacucuuccaaaaaagaaaacacaaauucauuagguuuugauuguuaauaaaucaguuugggagaaaacauuuccagauauuugaauuacucauucaaggacauuucguguuucuccauuuacucaacuauuaucuaucuaugaagaaaucacagaaggucauagagguuguauacuuuuccuuuuggguuauuucugguuaaugaaugcuuuuuguugcuaauguagaaggaaucuuuauuccccauuguuuauuuuauauuuuuaaauuuuuuuucaauuaaaaaaaauuuuuuuuucauuccugagacagggucucgcuccguuacccaggcuggagugcaguggugcggucaugacucacugcagccuucagcuccuaggcucaaguaauccuccaccucagccuccugaguagcugggacuacugguaugcgccaccaugccuggcuaaguuuuuucuuuuucuuuuaggggcaggaucuugcuguguugcccaggcuggucucaaacucaugaccucaagugauccucccaccuucaccucccaaagugcuggcauugcaggcgugagccaccaugccugaccuuccuuguuucuuuuaggugauuauugguugugugugaggaaagcucugguauuuucuguacuuaucuuguaccuacccaauuuguugauugcucuuauucguuauaauagucuuucaguugacucuuccuaauuuuuuugugccgagaaucauugaugacaaauaaggauaauuuggucuccauuuuucugguacauaauacgucuuuacuuaccaucaguugugugucacuuaggaauauaaauggcugaaaauaacugaaagccugccuaauaagggaguaggccgacaggggcugacuuuucucaaguucaggcagucuggagggaaggagucuguggcugcugugaggugcucaaagagggugugaggacugggcuccuggcuucuguuuguucauccuuagccuguggcuuuuguccucgugaacacaagaugaccuccaggaauuaugucuguuucaggcaggaagaaguugagaaggaaugaagacaaaaggcaaaaaaggcagaaugacaggucagcaagcgcugcucagccaguaggcccugcuucuccuuggccagaacugaguugcaugcagcuggcuagaaggugggagaugaauguggguauggcuaguggguugggcauggggguugggccaaccaagcaugguuggucauagggucuugcugcauuagccugcacauccagaauuguuacauguugauuacaggcauauuuguccuuuuuugucuauauuaaugauaaugccucuguuucucaauguguaaggcaucuuuugguuuaagagguuuucaucauguugaagaauugccugucuuguuuucuugggugauuuauuaaggauggguguugaaugucaucagaugucauuuuggcauucauuuggauucagaagugguuguuacaccuauuaauugagguaggaauagauuaccuaguaguaaucccuccucaaauucccguguuaaacuauuuuugguugcgguggguggcuguuuaaauuccuaauuaaauuugguuugcuaacauauucagauuuuuuaaucucuuauuuuaaaugagauagcuuuacaguucucuuuagaugaguucuuuuccagauuuugcugucaggccuagacuaguuuuguaaaaugaauuaaugacuuuuccuuuuuaccuucucuguaacaguuuuuauaguguggcaauaaacuguccuuugaagguuuggaacaacucacuuguuaaaugccuggaggcugacacuuaaaaaaaaaaaaaaagaauaguuuuuguuguguuucuuuuuguuguugguguuguuuuuagucuucagugcaguggcauaaucuuggcccacuucagccuugaccucccaggcucaagcaguccucccaccucagccucccugguagccgggaccacagguguuuugccgccacacccggcuaauuuuuuauuuuuuuuguaguuuuuguagagaugggguuuugccacguugcgcaggcuggucuagcauuacugggcucaagugguccaccugccuucgccucccaagguggugggauuaacaggugugagccaccaugccuggcguaaaaagaugguuaguuuuuguuuugugacagcuuuaaaaaaggucuuccauggguguuggucuguuccaggguucugguucuuuccucugaugcucuuuuuuuuuuuuuuuuuuuugaaacaggaucucgcucuugucccagaugguguacagugguguggucauggcucacuguagccccagcccacugggcuccagcaagccucccaccucagccucuggaguagcugggacccauaccuggcuaauuuuuaaauguuuuuuagagacagagucucgcuauguucccaugcugguuuugaacuccugggaucaagcgacccuccucccuuggccucccaaaguguugggauuacaggcaugagccaccaugcuggccuucugguucuuuuuaaaucaauuuuaguaauuuaguaauuuccagcaagucaauuaaaaauuauagcucaguuguauguaguauuuucugugugguguuaugcccucuguaucuguuuucucagauguuuuaguugcuuuucucucuuaaucuugauuagaucugccagagcugugcuuauuuuguguccccauccaaauccagaauuaauugccgugcuccacauguuuuggucaaugguggaccucgucuguaacaguagucccaugagauuauaauggggcugaaaacagugcuguccccuagggauaucgugucuguuguagugcaaggcacugcucacguguuuguguugaugcugguguaagcccacugugcuuccagucagaugaaagugcagcgcauacaauugugugcgguaccuaauacuugauaauaaacaaccauguuacugguguauguauuuacuaugcuguacuuuuaauuguuagaguguacuccuuauacuuauuaaacacaaaauuaauuguaaaauagccucaggcagguccuucaggagguauccagaagaaggcauugugaucauaggagcugauggcuccgccuggguuacugccccuguagacuuccagugggacaggauauggagguggaagacagugacauggaugauccggacccuuuguaggucuaggcuaacguguguguuugugucuuagcuuuuaacaaaaaaguuuaaaaaguuaaaaaaaaaaguuaaaaauagaaaaaagcuuauagaauaagaauauaaagaaaauauauacaagaaccaaaauuuaagaaaaauaaaguuuguaaaaguaaaaaaaguugugcuuaagcuaaguuuaauuuauuauugaagaaagaaauuuuuaaauaaauuuagugaggccuagguauacaguauuuauaaagucuacaguaguguacaguaauguccucagccuucacauucacucaccacucacugacucacccgagggagcaacuuccaguccugcaagcuuuauucguggugguacucccauauacguauguauacuuuuuuuuuuuuuugagacagagucucgcucugucgcccaggcuggagugcaguggugcagucucggcucacugcaaccuccaccucccaaguucacgccauucuccugccucagccucccgaguagcugggacuacaggcgccugccaccacgccuggcuaauuuuuuguauuuuuaguggagacagcguugcaccguguuagccaggauggucucaaucuccugaccucgugauccacccaccucggccucccaaagugcugggauuacaggcgugagccaccgcgccuggccuuuuguuucguuuuuaagagacagggucuagcucugucacccaagcuggagugcaguggcgugauuauagcucauugcagccuugaacuccugggcucaacugauucuguugugucacccuccccaaguagcuagaacuacaggcucaugccaccacacuuggcuaauuuuuguuuuuuaauuuuuuguagaaauggaaucucacuauguugccuaggcuggucuugaacucuuggugucaagcaagugcuuggccucugaagugcugagauuauaggugugagccuggccauauguacuuuuuuuuuuuuuuuauccuucuuacuauauuuuuauuguaccuuuucuauguuuagguauguuuaaauacacacauacuuaccaugguguuacaacugccugcaguauucagugcaguaaugcacuacagguuugcagguugguagccuaggaguaauaggcuauacuguauagccuagguguguaguaggcuauaccauugagguguaaguauacucugaucacacaaugaugaaaucaccuaacugugcauuucuuagaaugcaucccugucauuaagugauacguaacucugcuucuuuaagccucuguagcacuuugguuauguuaggauucugugucuuuacaagucugcuuugcugaucgauugugacaucuugagggcggcugcacuacuuucugccugcaccuuguuucgcaugucuaccuggcgcaugacauacaccucguuguucaguucuugcuucucugcuugugucuuugcauucaccaccagcuauucugauaguuaucaggagguuuucauugauugcagucucgugcaaugggugcagguaauggguagccuuauggaggagaaaaugcuuaccuauuuggguucauuccaaggaguaguucaaggauaaaccucuaaguuuggggagugcuguaauuugcuggauaugugagccauagaagacagcuuggauggcaucugaugcuuccuggcugcagggauggaggcagcagacccuccugccuggggugguugguugccaucccugucgggggcucaugcuccacccucaaggcuauucuugggggaguugugacauggcuuucauaaaaacucaguggaauuuuacccuguguauuaguuaguaaaggugagucugguucaguugguuugagucaaaaaaucuguuaauaucucugcuuuagaccugcaucaggcuaauacuugaauuuagggucugucccuggugucaucugaauuuuuguuugcuaugugugaccaaggagauggucacucuucaggauggguggguggaggggagaaaugcuaugauuucuguugggucaugugaaaucaauuuggaauguggauggggcccuuacacuuuuucuuuugagcuuagugauuuucuguguaggguggagagcgauuaggaaggaauucaccacccuuagguccucaggcauagggucuucuaggggcaggacugaugagugaacagcaggguggauggagcagaaccguuggaaccuucagggcaggaccugccaccauuauuuggucacaggaaguguucaguggugaacuuguuggaaaugauuuugaguaacuuccgucuccuaaaucauauuaggacucuuuggucuccuaugguuaucugaguuguuuuccaggaggagcugggaagguaccaggagaaagaugacugucccucucauguuugcugaggguguuccuguaaggugagcuaguguuccuuuuagggcccguggagaccgaccuucacauugaagaagcauaucugugcuccgagauguuuucauggggagaagugucagguguaauuauaaaaggagucuuucucuuuaaauacuguaggcgauuuagaaauaguggagguuuaauugaagagcuugucuacguuuuuacauuuuccuuaggcacagagaaacuaguaucuuucucuggguugccuuuuuuuuuggagacagaaucuuacucugucauccaggcuggagugcaguggccugaucucggcucacugcagccucugccuuccgaguuccagcaauucuccugccucagccuuccagguagcugggauuacaggcacgugccaccaugccuggcuaauuuuuauauuuuuaguagagaugggguuucaccauguuggccaggcuggucuggaacuccugauuaggugauccacccgccucugccucccaaagugcuaggauuacaggcaugagccaccacaccuggccuggguugcuuuuuaaauucauaccuacugucuuauuugggucucaaaugugaucagugguuauacuuuucuugcuaugcauuuaaguuggagcaggcuccggggcaccacuucccucccuagaguugaugaaccccucauaucagugaccuccccaugucacaguguaucucgugugcacugcuagauauucugaucacacagugcugagauuacugguuucucucccuuucucuuucugugguuauagggauucuuuaagggcaggcaacauguucuuuguuuccauaggaucugacaaagugcauggcauagguagguguucaucaaaagggguggaauaggguugaucucaaggguuuuaagagagaucugacgaguuugggugugugacuuaaaaagcagauacagcgccuuuucacggauacaccuccgugauuccucaaguggucuggcuguguuuauuuuaggauucuaaaaguaaaguguucuguucugagucuuucacgaucugauguucuccaguucugugaggucuccuccuuuagucccaucauuggggcuguuucugcucggaaggccaggaaguugcuggaagucugcugggcuuugcaaagggacuuuugcuugugugggcauugcccaguuguguuacaacuuguuuacagccguugguuuuuaagggaugagguaaucuuagcucagcuuaguguaauacacaacaguuuuguuuauugagaaaaucauuguugaaguuuuucagauguuagagauguuaugaauugcaaucaagucgguauccucuuauauaagugcaucugacaagcccauuucacaacuacaucucaucagucacaguuggauggcaagguuuauuguuuaaaguuuuuguuuuuucuuuuuuaaguugggaaaggaagacagaugguuucagaagccaagaaagggcacaaaggcguggauauuuggaaaucgggacauaauucaccauucuucuuaauuuuuucugaucucuaagacacugagacagcuguuaauugaauugcuuguucacaguauuugagacguaaugaaaugugaguguccuaaucaccuggcgggcguagaucuuugggauccuccuggaggcuuaguagggcugcccugagcaguauugucuucuccagcugggccucugagcuguaccaugugcccgugcucagccucagucccucccucagccaguuguuaaaucacuuuggacgugugacagccucaacaugucacagcuuuaaaaguucagauuuuaaaaagguaaggaaaugaucuccuagugagacaacuucugccuaaaaaauaaaagcuucuaagacauaaauucuguguuaugaacaacuugcaauuuucauaguuuucaguuuuagcucuggcagccucugauagaucuuaaauauguuuaucacagcuggaaaaauguuuuauugucaucuuuguuuaucauaauaugccaccuacucugguugugucuuacaacuguagcucugugggguuuuuuuuguuuguuuuaugcuugcuaaugggggagguggggggugugggcggaugaauauaaaugauaccuagaaauugaaauuggaaaaaaaaauguauucagccaguacucuuuccagguuauagcuaaacgucaguuggcaaccucuaugcugugguuuauugaguaacacuuaauacuuagcacagcccucagugaagaucuuuuauggccuuuucugaauguuauacaaacauaacuaaagcuuauccagaugaggacagggaccuuucuuuccuuccuuuuuaaauggagcaaaauuuggccacuggguugcuguggaugagagaguagaaggagaaaggcagucaucgggagacugugugcugagagagcgcaugugggauuuggcuucaggaagucugggcuugcauucuauccagcgcuaauauuuagugagugugauuuggggcaaauuauuucgucucccugagcuucagaauguuugaaacuuugugaggagucugaccccacacuguaggcucccuccauguauauauuucuucuuccuuuuccuuuuuuuuuuuuuuuuuuuuuuaaauuuuugagauagugucucgcucuguaaccccaguuggaaugcaguggcauggucauggcuuacugcagccucaacgucccaggcucaagggauccuccugccucagccuccugaguagcuggggucacagaugugugccaucacgccuggcuaauuuuuaacauuuuuuguagagaugggagucucacuauguugcccaggcugcacucaaacuccuggacucaagcaguccucucccuccagccucccaaaguucugggauuacaggcaugagccaccaugcccggcuggaacuguuggcuuugaagaagaaugaugcugugcuugccuuugcaguccugucaccauacuuccuggaaaguggguggacacgcuggaugguagauguugaguucuuuagaugccuggaugcuuacaugcuuuguguggguucuuacuggggcuguaacuuacuagaggacagacuccaacuucugcuuacuuagucuggggagguuaauaauaaucuagggcacccgcuucccaguggguuuccaucagucuccuccagcccacucuacucucuguuagccagcugggcaccucuuccucugugucccuucgguaucuucccaguggcucuuuccacgacuggcucagaccauguguauaucugcucauugucuguccagggucccuccaaagaugccucugugggcugggccccugguggugcuuccuccagauaauuguugaagauggaacaggagugugcaagaacaccagcgugcuuccaguauucaggucuagcggcaggucccaggcaucagcggcucaccacuccaccgcagguagccugauugcccagccuuggagccgcagccuccuugggugguguggcagcugucagugucugaaaccauuuugaacuuuaaaggguggugucagacagcagcuauugaggcuacuuaaaagaauuuuuuuaaauguacgaguucaguggcauuaaguacauucauauuguugugcaaccaucaccacuguccaucuccagaacuuguucaucuucccaaacugaaacuccauguccaucaaacaacuccccauugccuuuuuccccaagucuuuggcaaccgccauuccacuuucugucuguaaauuugacugucuggauaccucauguaaguggacucguacacuauuuguccuuuugugacuggcccauuuuaugagcauaauguccucaagguucauucaggcuguagcauguguccagaaucuccuuccuuuuuaaggcccaauaauauuuaauaauauauguaugugugauaacacauuuauauaauguccauuaccaugugguauauaugcuuauccauuugucugucgauggacacuugaguugcucccccgcuuuggcuacugugaauaauaugacugugaucauggauaugcaaauauuuccuuaagucuuucaguucuuuuggguauauacccagaaguggaauugcuggaucauauggcaguucuauuuuuaauuuuuugaggaaccacuguacuguuuuccauguagacugcauaagaauuccaauuuuuccacaucuugccaacguuuauuuuuauuuauuuuuuuaaauuuuuuauaguagcuauccauucuaauggaugugaggugguaucucauuaugguuuugaugggacuuuugaguuuuagcaaauaucaaugaaguauuuaauuuuuuuuuuuuuucuuagagacaggaucucacauuguuguccaggcuagagugcagugaugugagcauaguucacugcagccucaaccuccuaggcucaugugaugcucccaccuacgcuuccucaauagaugggacuauguuccugcgccaucacuccuggugaauuuuuaaauuuuuguagagaugcggucuugguacauuuucuaggcuggucuggaaguccuggccucaagcaguucuuccaccugaaccucccaaagugcugggauuauaggcgugagccacugcaccuggcuuauuuaaauuuuuauggguaugaauucacuuaaaagcugaagguuuugagaggagagggagcaugugaaaaaaccuaaagguuuugggaggaggaggagaaggaagagagggagcaugugaacaagagcaacugauuacuuccuugucauucauuugcccaguguuuacuaagcaccugcugugucucagaccugugcugguuuggcccuugugaaggacaguaaauacagugcaguuccagcugcgcaugggaucacaguccaguagguaaacgagugccuaaacuuaagagaaaugagugcaguugggguccuguggcggugaaggggcgagucugcacccaggcgaguguuaaaggccuggccuagagaagauggguguuuugauggaaggagcugcugggaagcauguguacucggugucuuggaguuuagaaaccucaguuggcuccaugucucguccuuaguaaaggaauaucgggagcugagacuggauguauugacacaggucaaaucacagagucuuaggccauuucaaggagguuggauuuuucucuggaaggcacagggagguuuugaaggacuuaaugcagaagaaugggcacugucagguuugugguuuggaaaguccgccuugguaguaggguggagggugcauuauggagggcuagaccaggguccagcccccagcgagaugcugugugguaaccaggggagagagagguggugguguuagaagccacgacuuggcauagaagccaaagcauccccagguugucauuguguaauuaaugguuaaguuggggcaagaaauaaagcucuuaaaaguguccagcuguagagcucucugccuguuuuuaucuucagauuuuugucuuugccaucucuggccuccaguggaaggccgaaguuacuuaacuuccuugcuggaagcagggcuccucaugauugccagccccuguuugguagugguccuggagugcuguggaaaugggauacuuggugccacuuaccuuggggcuuugcuccugaacugcagcggugucuugugcucugugguuuguagcauggaacagaggcugaugggcggggaguuugagucccagugauugaggcccccugccugccugcaccuuacugaaggaaggacaugguggcuucucagugugcucucuggugaucugaaccuagauucuuguuucacggguagggggcaggguuuuggauucagcccuggccagcccuggcccaaguucauagugucaguaguauaguucucccaccacccccuucucuccugcuccuguuuucucccccgccccuucucuccuacucuccuuccucucccacucucccuccucucucugccuuucacuuccccccacacucucucucccccgcucccaacuuucuuucucucuucgacucaccacacaacacacaccugugugugugugugugugugugugugugugugugugugauggcacuguuauuucauguguauaccuuugcguagcguuggcacaugugggaaugcuauuauaaugcuuucguugggggucugugcuaaccacugcugagugugcuucauguuuucuagacagcaugagaccagagcucuccaccuugccauuagcuggugggagaauuuugagaaagucacccaauugcucuuaaguccucauuuuuuuuuuuaaaucuguaaaaugguaucacagaugcuuauagcucaagacuaguugaugagggucugugacucaaaaggccccauagaugggguucagagggccuuuggaaauggcgugcaagcucuuuguaaguguauuuuuuuuggagaaagggcccagcuuuuuaucagacauccugagagauucaggaccuaaaaaauaaaccuugauuaaucuuggaagccucuuuuuacgcaguacgcuuugauucaucaguauaugcauguggauggguucucagauggccugauguuucuccuccuuccucuguguggugggcgacgacuuuggcugcccagauguuaacaucaguaagcagaagcucagucaguguuagcaaaauuaaaucacucugcaaaaaucaauguuagugaaauuaaaucacuugaucuuaaaagcagcaugaaauagcaguuuuucaucuucauugugcuguuuucccacucuagauaucuugcagauuuuuuuugguugcuugguugguugguuuuuggcguccuuuucaaggacaagcagcuuuggacaguugcacuacuuuuuuuuuuuuuuuuuuuuuuuugacagagucuugcucugucacccaggcuggggugcaguggcgugaucucagcucacugcaaccucugccucccagguucaagcaguucuccugccucagccucccaaguagcugggauuacaggugucugccaccacacuuggcuaauuuuuauauuuuuaguagggacaaaguuucaucauguuauucaaauucugaccucaagccaucugccugccuuggccucccaaagugcugggauuacaggcgugagucacugugcucagccaguugcacuacauuuuuuuuuuagaugccauuguugaggauccagggguuugucauagauugauuaaucagaaaguauuaaucuaaaguauuagaauauauugauugcaggcagggaccuugcauaguuuaaagaugacucagaaggcacauuagguucuugccacacuuugcugccaucacagauggaugugaguugcccccuuauauaggucucucgggaugccccaguggagaacagcauugauguugaacagauccuguccgauggagagauaccagcguuucagccagcggugugagugagggcaggggccaccucugagggugcuugcucccucacacuguccucacgcugcccucaagcugugggcaaaggagagggauccugugccaucacagcccuagaagcagaauuccaaaaugugggcuccuuugggugugguuugggggucaaggagauagagcaaguaaggaaugaacuuugaggguuuaugaucauuuucaugaugauaaugaccuaaaaacaugcuuggcugggcaugguggcucaugccuauaauuccagcacuuugggagacuaagacaggaggauuucuugaguccaggaguucaagaccagccuggacaacauagggacaccccaucucuacaaaaaaauuaaaaaauuagccaagcaugguggugugcaccuguagucccagcuacucaggaggcugaggcaggaggaucccuugagccuaagaggucaaggcugcagugagccaugucugugccacuguacuccaacuugggugacagagcaagacuaucccaaaacaaaaacaaaaacacaugcuuaugguaggcaauuaaaacaggagguaaggaguaaacaugccaggccccuccuccucuccucugacucuuccuucuuccccccugcuucccaaggguaagcuuugcagauacuugcuaugcaagcaaaaaugcuauucuuagccaucguuuaaacacagauuugcaauuugugguuuuucauuuauauaaauuuuggcucucuuccuauagcagaaugaucuuuguuuuuaaaaugauuuuaaguauacaauuaauaugugaauguauguuucuuauggaaauuagaacaauacacaguuacagaguagaaggugauaggugauauagcucacccucuccucuuccugcuacucuccccagucugcuucacuccccggaaggaacuacuggcccaucagcaugucuccuuccaggcauuuuuuccaugugguuauguccaccugcauaagaaacugggggcggcaggguggggcgguguuggcgggucaggcagaagcaagccacagagcaguaaggguacuuuuuaaaaaaacauuuaaauagaucccuguuguccugcggcuuacaugcucaugcauacucacuguuucuuuaaauaaacuuuuucuuuuagaauaguuuuagauuuacagaaaaguugccgcgauagucuagagagaucccauguaccucuuaacagcuucgccucuguuaacauucugugucaccaugguaauuugccacagcuaaggaaccagcauuaguccaugacugucagugaacuaaacucaagacuuuuuuuggauuuuaccaguuuugcccaauguuccuuuccuggucuaggauccugugcagaauagcgcaucacagcacauuacauuuagcugucuccuucaccucuucuggucugugacagggucucagacuuuccuuguccuuggugacuuugacaguuucgagggacacuggccagguuuugugcacacugccccuuaauuuggaguugucucaugguuuuuuuuguuuuuuuuuuuuuuugagacagagucucacucgucucccaagcuggagugcaauggugcaaccucgacucacugcaacuucugccucccagguucaagcaauucuccugcuucagccucccgaguagcugggauuacaggugccugccaccacacccaacuaauuuuuguauuuuuaguaaagaugggguuucaccagguugggcaggcuggucucgaacuccugaccucgggugauugcccaccucggccucccaaagugcuaagauuacaggugugagccacccugcccggcccaugguuuucuuaugguuagucugggaccauggguuuuugggagcaagaccacagagcugaaaugcccucccuucagugauuugucagcaugaccuaucaccauuguuguuaaccuucaccaccuggaugaggcaguguaugcguggggacauacaucuauuugccccacugacaugaggguuggaucucuagaagaggagucacuguucagagguuauaggcauuuguauuuuuuggcagauguuguccuucaaaauggcuguacacauaugcuccucccaaaaguaggagagugccuguugccccauguccucacucaagcuugguguuauuagauugguaauuuuuuugugugugaaucuguuaaguuaaaaauauuucuuucuuuggccgggcacagaguggcucaugccuguaaucccagcacuuugggaguccgaggcgggcagaucacuugagcucaggaguucaagaucagccugggcaacauggugaaaccccaucucuaccaaaaauacaaaaaaauuagcugggcaugguggugcuugcuuuuggucccagcuacuugggaggcugaugugggaguaucacuugagcccaggaaguugaggcuacagugagccgagaucgugccacugcccucuagccugggugacagugugagacccuggcuccaaagaaaaaaagaagauugauugagauagggucuugcucuguucaggcuggaaugcaguggugucaucaucauaguuuacuguagccuugaacucuugggcucaagcaguccugcuccuuuggccucccaaagugcugggguuacaggcaugagccacuaugcucagccaagcuaaaaauaucuuagugugcauuucucuaauugucagaaguguauuuauuuaccauacccuggaaaccuuauguaagaugauggugaguuuggacuuuccaguaacauuuggaaacuguuuaguaccaagcucucauuaacaauauaaacaaaauaggggucuacccuuaaggaaucaaagccauuaucuaaaagcucuuucccgcaacaacuaccugagauaauguccuuggucauaugccccagcauuuaaaaauggaguuagugagagucuguuguuuaccaccugauacauugguaagagcugcuugaugguauggggacaucaguagggaggauauagacguagccacccccgcccuagauaguaggggccucagggugggguaagccugggugggggagguaugagugguggaacagugggagacccuggauccuuagucuccagcgugauugcauuuugccaaggcuuugucccaugucccuuugucccguguuccauuugcccgugguguugccuagagagcauggaggggcugguggagcaugcucugugguucccuaacccagggcuguguggggagagcuugcagcaccccccugaccccauaugaacguccuugcuauuuccugcugugccauccagcaacuauaggaugcugugcuguggcugggagaccuguuuggucuuggaagcuggguccuggaugagcagaaugaggcaggcauagaggugauguuggcuacgggcaggggagcguuugcuuugccuuggaguagugccauuuccauguagaggggcaagauuuaccacccuguuguggggauuugagacuuuggguuuuguuuuccuuuacaccuugagcuuuguucuacagcaggucccugggaagacugguccacaaagcugcugaauggggcugcuguccuucagcccugccuccugcugcagaaugcagaggacgcuguagacuugcuuggugggugccugggguuuucugccucccuggugcacugggcacagcggcuugccugccuuuugggucgucuccaccucccagggauguuuuuguucccugaucgaaugaccuccuguuuuguuuguuuuuugagacggaguuuugcuuugucacccaggcuggagugcaauggcaugaucucggcuaacugcaaccucugccucccggguucaagugauucuugugcuucagccuucugaguagcugggacuucagguguaugccaccaugccacgcucauuuuuguauuuuuaguagagaugggguuuuaccauguuggucaggcuggucucgaacuccuggccucaagcagugcgccugccucagccucccaaagugcugggauuacaggcgugagccaccgugccuggccugaccuccugucuucuguuuuugcccacugucaaggguagacuucuucaaggcuguacuugugcuauccuaaagaggaguaaugggagacauuucugacuuugucagcaugcugcuuggcagcaccugccucguuucuggugaccauuuggaaauguguccuuuaucugguagcaaggagcauuuacauugaucccuaugcacuuaauuggcauacuuuuauuccucuggauuuuuuuuuuaaagcauaauuguucgugucuacaugauguaacaugcugcugacuuuuaagcaaauuaacagaguucgugcugaagcgcaagggugcagggaaacaaaaugggaggguuauuaaaggggugaggcggcuccucaaagaugucacugcaccauucauucuuguguuccuggcccauggcaggcucauuaauccuccacgacaauccauuagcaugccugucaacccuucagagaagaugagccauaggaaggcuuagggauccccacuugaacugcuguguggcucuaugaacauccccaccuuccuggagugaggugguuguggccaccugacuuuccccauuuuuuuuuuuuggaccucagccuccagcgcuccugggccagacucagggugggggggaugcaggugccagugacugacacuuggccccucacacuucacugccugauuugcuuuaaaggcaaggguugcucaugcuugucugagcucuccaucuguuugagaauuauauuguucucaacuggaacuuguaaaagagaaaaaaauguacuucucaauuuccauggaagaauauagauuuucuggugggguggaaacuuucuuagcaugaagggaucuuugugugaucugcgcaucagcacugaauaaagaaugggugcgccgaagucggggaggccgacuuuccuguggcuugcuggggaaaguuugaacuguguguaagcagugcguggaaggaaagcuaaguguggagauaacgaagggaaugggauuuaauagaaacagggugugaugaguggcaguugccugaugaaguggaaaucuuguguuccaaauuugugagauccauuucuguccucuaaggaaaauguuguaugugcaggaggaguucauguaguuggguuagauuguguuuucugucuuuauuuuuuuuccugccucuauggguugugaacaaaaacaagaauuugauauucugcaguauaguuaacucgugcaaacaguguaugcuuuucagugggauauaaggucugaaauaauaggauuuucccuaguaagucaguuucauuccuuuacauguggguuaugagauacaaagugaagcucuguaaagcuuuuuacgagcucccuguguugcccuccuuugacgggucaaggcauugggguugacagagguuucuacucucagaggcuuuaaagaggugcccacucuggugagauggcugucagcaugcacgaugugugugagagagcaccucuucaaucauaugcaccuggcuguagcauccuugucagccuuaagagauaccuccaaagcggaauuuucuaccccuagaaucaugugaggucaucucaauuuaagccccagcucugcucccuaaauuaccugagugaucccagguaggucauuugcucauuguuaaccaucaguuuccuuagcugcaaaacagagcagauaacaccccaaaagaguucucauaguaaaucacaucaggcuuacacaaucucagaaaugugcagcuccacaggaaucuucauuaccucuuuaggcaguccagucggguuucaaaugaauccuacugucuguucuuauauggaaccacagucccucacccuguguugaucuaaguucucuguuucucuccuccagcagggucauaaagagccugaccagucccccucccuggagaccuuugugugcuggguuucugcagccguucuccaugagaagggacuucuggucccugcucucacuuggauguucuuccacugacuuaucucucuuaauguguggaggcagaaacccaguuuucagggucucuccccuggccccuuacuaagucucccuuagguacagucuaagacugccugacuuuuucuucuuuuuuuuuuuuuuuuuuggcagccacaacaucacaucgucacauacagaaauuauauccaauuaaaucuccuaagucuuuuucacaccuccuacauuugugcauuucuuuuuuugcacccaaguguccaaauagcauuuauuuccucucuauugcaauuccaaucuguugaucuuuuuagcucuugacucugucauccaguguauuugccauugcuccuggaaacuugucaucuuugaauuagauaaacauuuuaucugugccaucguucaaguaauugauaaaaauguugaaaucuacaguacucagaaagagaccuguggccucccacuagagaccuuccuuggucuguucauuaaucagcacuuuguaggguaaauugaacauuuacuaagcuauucagauguaguucauauuucuucaccuugucaacaaagagaucuuagcaaggcauuguagaccaaguauguguuccuggaauauacauauuaagaaaaaauccuuaugccaagaaaaugggcacauccccaaaacccagguuauuguaguuuacggcuucugacccagggcuucacuuuguagcaguguuuuucuucuguuuuugccuuuggcugauaccacugcuagagugcagauaagagaauguuacuaccagggggcuugagugucgggcuaugauuggcugucaucuggagcagagugggacugagcugcucaggagaaaggucuucaggugauuuuuuuugggaagcuaagagcacugguuuuagacauccucuccuggcugaugaugggauuggccuucauggggcugcugucuggcugggcuggugggcagagguuccuguggguguggauggagaaauccuaaaugccgaggguaccuggucuuaguagaaaucguaggaugccucagugaagaagucagggaugcggauuguccuccggaugcuuggaugagcgugcaguggaaaaaguacuccuuugggggaagaggugaaucuggagguguuagagcagaagaguaaaugcagaaguuguagcagauacaaaggcuuuggcaagagugggagugaucauugaagggaaggcaggggcuugcugggacaggcuggagccgugauggacccucauaguaacccugcugcauuuuacaaaggaagaacuguguugggguacagaugugccaaacacucaaaguuagaaaaucaacgcagucgguuguggcuucugcccuugaaacaucagauagugagaaccugccacuguucaguuugcagagugguugguugcauacaguguuuuagcucuugcccacucaauacagagguugcaugcgggcguccaccugcuccgccaccucugccugcuuguggcugugugcccagagcccauuucccuggggagucagugcagcacuccugggggacccuucuguuuguguccugacgaaucugacugugcuggaugcagucccacagccacaccugguauggguggcaucuuuaaaggccuggccugugugugcuguaucugcagcagagcuguggccaaaccugcuuuccuuccaucuggguuccccuugguucucggugguggacgggcuguguggucuccccucagcuguccacuugcacuuguguuaaaaugcggcagaacuuucccucuauacuuaaauuguggugaaauacguaugacauaaaacuuaccaucuuaacuuuuuuuuauugagacaggaucucauucugucacccaggcuggagugcgguggcgcgaucucugcucacugcaaccucugccuccuggguucaggcgauucucaugccucagccacccgaguagcuggaauuacacgcgcccgccaccaugccuggcuaacuuuuguauuguuagagaugggguuucgccauguuggccaggccggucuugaauuccuggccucaagugaucccccugcuucggccucccgaagugcugagauuacaggcgugagccgccgcgccuggccuuccuuuuuuuuuuuuuuuuaagagauggagucuugcucugucgcccaggcuggagugccguggugcgaucuuggcucacugcaaccucugccucccagguugaagugauucuucugccucagccucccgaguaccugggauuacaggcgccaggcaccaugccuggcuaauuuuuguauuuuuaguggagaugggguuucaccauguuggccaggcuggucuugaacuccugaccucgugauccgccugccucggccucccaaagugcugggaucacaggugugagccaccacgcccaccggccucccaucuuaacauuuuaaaguguucaguuuaaguaccuuuacacugcuguccaaucaaucucuagaacacuuuucaucuugaaaaacggaaacucuguacccauuaauaacucccauucucuccuaccacagccacgggcagccacuuucugcugucuccgugagucugacuacuuugaguaccuaugagcagaauccgcaggauuucuccuuuugugacugccuuauuucacuuagcauaauguccucaagcuccauccagguuguugcaugugagaggauuuccuuccugugcaugaacuagagugaugcagggacugaccucuggccaugugaugggugguuggugauggauccaagagguagcuggucucugaauacuagcccaguccuuuuccuugcuaggaaaguccccagaucagauagaaagccucaguauuucaagaagcuucuguuuugacaccacauccaugaagaaucacacugcaggguaggggaacagaugagugggauuucuacacuguuaucagcuagacuuagauaacuggcuaauugaaaagaguacaggucacuuaaggaaacuggagcauuguagggcaagguaaagugcuuuugaaaugaggaugugaacuguaacuggaaugauguaauguguucuacaaaaugaagccagugagaggacaggggacacagggccgacuuuuauuuaggacauuugccugguucugagaagaaaguugaaagucacgagagagagggaaaggaaggcagaaggaacuugguuuuugcaggugccugcucagcaugggccuugccccagcuuggcuguaccucacagcaccauccacuggcucuacagucuguccuucggagguuuagggugcugucucaugcacagugggugcuaggugguagugaggacagggugugggacuaggcaggugcugccccucggaaggccucauggugaggcaaagaucucuggcuccgagggacucuaucuccugguguccugcuucaucgagaagccagccacccaugggaacuguggauaauuagaaaggcuuagaggcucuucuaaggguguuuuuugaaauauggagaccuagaauauugggcuuugggauauuuuaagaugagaaaggcauuuggaguaacugucagagcagauaaaguuguuuuuaugaagauccgggaaaacgguuguuacaaauacagcucugcaccaauucugcgccagucuguuuggcuacagaugcuuucaguggaggggacacuggggcuuguguucccuuuagucuuugaauucccguuaaaguuuccaugucuuaaguggcguggcaggauagaaacaucucacccaucuuaguaaguucuuugcuguauguagcacucugguuuuaacguucugagccuucaggacugcccuugaugugugcauuuauuuuguugauaugcaugauguguggguggcucugcggcaguaaaacaguucacauucaaauuacacucgguuucuaauuucuguucucagaguuuccucuguaauggaaaucucuuacauucuuaucauugccuucaguuauugaauguguuagguggccaggauugcugucugugugaaaugggaauguauauauacaacguaaacauguucugauugacacgugaagauaaagggcuuaacaugaauugugucgguuuacacuuacacagaaaauucuacuguaauaaacugaagugucaguaguguuuguuaucauaacauugucuuuuucccucuuuucugaucucugauuuuucaauuaggaaugaggccuaaagaaacccaugcucucucuucucugagcgcaaggagggugugcugagaccuugaagggcacagcaugggaggaucauauacuagggagagucugucuccaccccauuuuucuucugcuuugcuuuguuucguaguuucuucgggcuucuuggggguuuucugagagagagaaugucaauuugagaaguaacaggugcacaggcuuuaccugcaccacacugcagauaagguggguagggaggguagugacagguggugugguggguuauucaguucuuuccuagggcagugggucucacaggguggugcuuaggccagcagcaucagcaucaccugggugcauauuagaaacaaauuuuggggccucaccucuugcguuuuaacaguuccuucaagugguccugaugcauguugaggacuuugaacacuccuccuacaagcaaagugaaguugaccucccacacacuugucucagucugcuuucuagcaucugucccauugccuuuguuguucuccccgccacacgggcugcaccccugggauucccccagcugccaccaggcaucagcuccagcugccucccagggugugcuccugccucugcuuggaguacccugccucccacucuuccuggcaagacccugcucaucuuucagggucgucucugcugagaagucuuccugaccuccucggagauagggaguuguggggccuugucuuuauguucccaggguucugucuauugcgcuauuaaaacuuuuuuuuucauuuaauuugccacuugcuagagagaugguuguucugccuucguugugcaaaauucagugauacacuaauccucuccuaaccucuuaaaucauuuugacuuucacagagugauagugucuagagaggguuuuuguuguacuaaguuauugguuccaaagaauucauuuuaagaggaguaaagaacuacuauaguaugccgcuuacugagacaaaaccgacuucucacauaagcccaaagguuuuguuauguuggauuuuaccauuagaguuaaagaugaugauugguucacuaaugugcuuuaccuucacagugugccuguagaccuguaguaaaagaaggcuaauuauguuuccugaugucuuuuauuuccaacuauaagcuaagccuaucucauuuuuuuuuuuuuuuuuuuuuuuuuuuuuugagauggagucucguucugucacccaggcuggagugcaguggcgugaucucagcucacugcaagcuccgccucccggguucaugccauucuccugccucagccucccaaguagcugggacuacaggugcccgccaccacacccggcuaauuuuguuuuuguauuuuuaguagagaugggguuucaccguguuagccaggauggucuugaucuucugacccgugauccuaccgccucggccucccacagugcugguauuacaggcaugagccgccgcacccggccaaccuaucccauauuuuuaaagaagaguugaucaaguaguuacccauuuuaacuaaauggauaacuauaacauucuuuaauggaauuguugacagagggauaaucaguguuuuugcuaauucaugccacccuccuuuguuguauguuaguaauauuuacauuggggcaacaaaauagaucaguauuuccauuaauguuuacuuaauaacagcugcuaaaagguauuacuguuugcaguaacacaaaagcacuuaccugauucuuaugccagcuucuauaggguagguagugacagcccauuuugcaggugaggaagaugggguuuagaggugaggugugucugccugagagcaggagcugguaaauggcacucugggcucaugggagucacgcuguuuuuuuuuuuuuuuuuuuuuccuaggaccucaagguugugucuaagacauaauuuacaguucucguguaggucuuccaaauacuuagcuacacagcuuuggggcguuuucucagccaaaugcuuuucuuuagcccuucucauauuaacauuuaguucuuagggauuuauuuucaaaauauauauagcuuguauaugccauucaccuaaguuguuagagcagacauucugccucuugaucuuuagaaaauaccuaagaguauuuuguuaacaguacucauuucagcugaaagacuuuauuuuaaaauuuaauuuaauuuuauuauuguuuuuugagacagaaucuugcucugugucucccaggcuggagugcaguggugugaucuugacuuguugcaacgucugccuuguggguucaagugauucuugggccucagccacccaaguagcugggauuacaggcgugcaccaccacgccuggcuaauuuuuguauuuuuaguagagaugggguuucaaacucuuggccucaagcgaucuaccugccuugggcuaccagagugcugggacugcaggcaugaaccacugugccugacuuuuaaggcuuucuuuaaaauggcaucuuuuggccagguguggugguaaucccagcacuucuggaggcugaggcuggaggauugcuugagcccaggaauuggagaccaaccugggcaacauagggaaacccucucucugccaaaaaauuaaaaaacaaaacaaaaccuagguguuaugguguaccccuguggucccagcugcuugggagcugagguggaaggauugcuugagcccaggaggucgaggcugcauugagccacgauugugcugcagcacucuagccugggugacagagugagaccacgucucaaaaaacaauaaaaaauaaauaaaaugacaucuuuggagaagugaauucuacccagguaccaagccccugccugccccucccaacucccuucccugacucccagcacccccaucuguuuugguucugcuguugccauucucuggcuuuggggacuuugcugaggccccacuguccccaucuuccagcuguacccuuucucucugcuucccugcuugucuuauucuuuacagggcugccugggaucucacauuccaaaaguuuuuggguuuguuuuuggaucaugccaauaucgguugcuuugagaagggagaaaggguauuuugcauuuuccuuuuaaucaucggugaguagccacaaagggugugucucucccucuugugcuguguuuacuguuuacucccucggugcaugaauuauuucauggcaccaguggagcauauuuucuucucuuuccuguuuguggcuugcgccuccugaacgcugcuaucauucaugguccagcuugguuuucuuuuucacuguuucuaucacaaaaccuccugaagaccaguggugucagucauaggcuccaaaacagcugguuccuaggcccugccucgugcucugugguuugggcuugucuuuucuuccagaguaaguggguagcuucuuccuacuuuuuuucucuuuucuucuauaaaugggaggaaaagugugaaguauggagacugcucuuucauuugaaggaaauucacaguuccagcucuguaguguggccucuguuaacuaguggucaacacugacuguggaaggggggccagauggcaaagugaagcagauucuuuccuccugucugcauuuugauugcaguaugaaguucaacuugcuucagucuuugucuucauguuguuucacuagguacugaauuuugugaucuguuggaaauaacaaguaaauagaugccuaacgcuuuauacagguugagccugucuaauccaaaaauccaaaauccagaaugcuucaaaaguuucagcuuuuggagcacugacaugacaccacaaguggaaaauuccacaccugaccucaugugacgggucacuuuucgaaacucaggcacacgacacacaguuaauuuaguguccccaggggaaaaaagacccucccggcccccuucagcugugaugugucuuuuccacacaugcccagauucccucagacaccuccacaaaggguaauaaaaugguucguuguauacaaacuuuguuucaugcacaagauuauuaaaaauauauaaaaugacuuuuuagagaagcgagaagagaaaugagagguaggggagggagggaggaguugggggacaguugggggaauaguugaagcuaagguguuuaggcagagcucugaggaggugacguuugaguggagacccagauggcuagagaauggggcagccuccugaaggagcagaagcacugugggcggcaggguaucacagaggaggagcucgguguguuggagguuggugagucccguggagucuugucagaugguguugggacagggacggaccgugaggaggcuggaucauggggaauguguugcuuuaggccaagcuggaguugauaguggcucagaucagagcuaaaguaguggagacacacagacauugaaagaaugaugaaauucacucauucugcgugugucccaugucauguguccgcugcacaccaaguacuguuuuaggcacuggugauauaauugugaaccaacuggagcugcggugagagagaccaugaaaagaagggccagagcgguguccugcagagggugguguaccuugggagggaaguguguaggguuguugaggaacagcgugcugcacagggaggaaagacguggggcagcauugugggaagagcaaccaagauucucauaggcuugggagcggaagcccugaggucuguugcuggacuagauaugugaggugugagaggagagaagaaucaggaaugacucuuugauucuuaacgugagcaacucagagaaugagagugcugcaguuuacaagcuuggaagguggauuauguggggggaugagugaguuguuugacaccucaauggauauacucggauguauacguuagagcucaaaagagucugggccagugacaugaauuugaucauaucuagaguaugaguggcacaggaagccacuugucuggaugaggugacagaggaaaagguugaggauagcaaccaacauuuagagguaagguagaaggcagagcaguguggaaucagggaagccgagaggaggaggcaaugccaggugacuggaaggucaagugacacuucgacagugucacugagggcucugcuaggagcuauucggugucauaauggggacagaagcucagucggaguggguuaaagguaaccaggaggugagggugcugagaggugggacuauugacaagccuugugucaaguuuugcuauguaggggcugaaaucuaauguaugugacuguguauaagugacuugacuuccccaaaucuguuuccucaccuuuaaaauggguguuugccaagugcugguuucugcuauucuuuucucugucuuaggggugucauuuucucuuugguaaaacagaagaauuagaugauaugaaguuucacauucuaaguucucaagcuuugcccacuccucagcccuugggucccuccacuuccucuucucuucgcuaucucugcucaguuucugucuuugauuguaauguaaugcccagugggacuuuucuucucucccucgucuguucacuuauuccguccugcacugggccaccagauuaauccugcaaaaggccucacaugggcuucucucccgcucaggagccuugugggggcuuuauuccucugagaugaaaguucuuauccccacaugugauccuuuaugacuugggugcuaucaaauucauuuccucaacugcuccccucuucacccugaccaucagaucugcuggcacaugggcauaccuuguucugcauugucucuggccugugggauauuuaccgagcuuuaaauccuaggcacccuuugggagccggccugugugcagagcuccccuuagcacgguggcacaaagcuuggacaccaccucuugucuguccugcuuaauuccauucacaucuagaguggacucgcugugugcacaccacugaccaccugccucaugugacaguuguuccucaugggucuuagcucuuugccuucaccaugagccuccucagagggcagggcacugccuguuggcauuucucgugguaucauacauguugggugcuucccaaauuaauuacaucagucagaaaacuucacucuaucugagaagcuuuaauaguguacuugggauuauuaaauccuaaaaaagguuaucacaaagaguuuucuuggugugugucugugcuuagaauuuagaaaauaagucauccaguauugaggccauuuuaugaaaagccuuuaaaaucugcaaaugcguuggcccagcacuuccacuucuagggauuuauccuaagaaaauagucuuggguaucugccaauaauguucacuggaguguuguuuauaaugugcaaaacaggagcuaaccuaaauguccaacaauaagggauugguuaaaaaaaaaaaacaacccucaugguguguauuaauacucuggaacuacuguccccuuaaaauggugauguagaaggacauguauugaccuaguaaaauauuaagugaaggaaguguguuuacaaaugucauuuuugucugauuucacuuaccuucauuuauagagaguggauaauuggcauagauaguguuaacauuguuuaucguggaauguugagaucguugaugauuuuuacugguuuuuuuuuuuugguuauuaccucuaaacucuguaggaagcaugcuuucuugaucaauaaaacuuaaaguuggaguuuaugcugcuuuuauucauaaaaaaaucacguuuuuaaucuuguuagguuauccuuuaugucuacauuaaugcacguguggagagaacacagucuacucggcuuaugucaaaugguagugggaagcauggaagcaugcguuuuuuaguccccacuuuacaagucacagugacgguucuccaguguagaguagauugauugcccuguguccuucaggcagggugcaguaguaaguuauugauacuuggcugcugagcugucguucaggccuuggcaacugacgcucugcagaacggaccaggagugugcggugguggaguccggcuggccuggguugcagauuuaacuuucgccucugccucugugugccucugggcuguaagcuuuaguuugcacgguuaacggggauggccucucccauggucgguuggaguguguugcacagcgucugguccaguguuggcacuguauaaaugccagcuaacugguuagccaccuaaacugucagucugcaacccacagcucugcagugaacaauugaaccucauuucuuuaauaauaauacaggauuccugaaaaccaacuguauuauuguuuggaaaauaguuuaaaaauuauuuccuucuaacugagacguuuacccucuugucucccuucagucugcgggccaggcaucgacauccgcaacgacuaucagcagcugaagcgccuggagaacugcacggugaucgagggcuaccuccacauccugcucaucuccaaggccgaggacuaccgcagcuaccgcuuccccaagcucacggucauuaccgaguacuugcugcuguuccgaguggcuggccucgagagccucggagaccucuuccccaaccucacggucauccgcggcuggaaacucuucuacaacuacgcccuggucaucuucgagaugaccaaucucaaggauauugggcuuuacaaccugaggaacauuacucggggggccaucaggauugagaaaaaugcugaccucuguuaccucuccacuguggacuggucccugauccuggaugcgguguccaauaacuacauuguggggaauaagcccccaaaggaauguggggaccuguguccagggaccauggaggagaagccgaugugugagaagaccaccaucaacaaugaguacaacuaccgcugcuggaccacaaaccgcugccagaaaaguaagaaugaugcugacugcugcuuucucucugccucucucucuccucuccuccuccuugaccucccuucucuucugagugcacgaguuccgcugggcagggugcagucguguugcauuuaggacguggcaugccugcugugcggaagugguucccagugggggucuugguuggcuuuccuuugcaucugggacucuuggauugcgggacuguggcguggcuggaggccaucauggcugcugucaagacuguucaaaucacauguuagaaauaauccagcacacuccugggcuagacacuugcugaccuucagcuuugaauuccugaugagaaaggugaccuggugugcuuggaagucccugagccuuggcagcugggggcugcuuaugugucagcucuuucauccuuugugcgaagugauauuuuuuguucugcaggacuuccuuaguuugaauggacuuggaauaugguuaaauaaagggaagguaaagcacuaacucauauccugugaaagugguccuuagguccuagugaugauguuaugauacucagguguccugguuaugacagagcaccuggcccaggugggagaccucuggacccauuucugcaagucccagguucaggcuguacuugcagguagcuguguagcagggugcauuuuuaaaccucugggauucuguuuucguucuuuuauaccuguuuacugaacaguugugaaaaucuuaagauuucacgagugaaggaacuuuggaaaguauuuacuguucugggggucagauggugguauuuugaagcuucuuguauauuuaucugcaauaugcuuauuuucccuugagaauaacugagcucuugccuucaugugaucaguuccuuaagaaccaggcuguuugguauuaaaaugugacucugagccuucaccuuauugcauucagcaauaguuauguauauuggcuaggaagcuuuuccucacugguuugaagucaguguguuagcuauaaauagcuauuauuuaaguguuggcccaguuaaagauguaaggaacccauguucucuaguuaugaagaaccaagaaaccccaaauuguuagacuugccuaaaauaaauaaaaggcgagaccccacaggggugaaguguguaaaguaaauaaaggacagaccucccagguagcccuucaguucccguucaaccaguccugaggcaggaaaaggaucuguguacccugaucugccacgcacuuuucuauucugcagaauuggaucagugcguaugugaacauugauuagugagggcaggggucccacuggcugcagccaguaccuuguagagcucugagaaugcagucaggccacuuuaagguuggcuggaguuggagggagaucuuaugcuaaagucacuugugugguugauuaaaacugcccuaucauuaaguuacccacugguuugagaaaacaacaaaauauauuuuuuaaauaaccuugacauuuaaaaauuuuaucugaaaaguaaaagguguuaucaagggaggcagcauggaguagaaaagagauguugaauguggugaugagggccaggaaugaccuuggaugggccagcccuucugggcuguaguugggcuuuuuuaggauauuucuagggcaguccaguacaucccuuaguggugaucauauaugggcaugaggauguuuugaaaacucauaagcucuuuagagaagggaggugccauaugaaacgucauuaaguggagaguuguucacgaacuagguagguaguuacuuuggucuugccauagguuuuuggcuguuucugaugagcuacugauugaagaccccugggguaggggugaggccugcauucuggguccaagucuaagaguggcgacuagaaaugagcaaguuauuuaaauugccugggccuugguuucuucauauguggaaugggguaaagccugccuuccucauagggcuguuggaagaugaaaaggaggaaggaaaagcaccgugaaaauguuaacgaugguuagaaggugggcucugcuggugacagacagagccuugauaucaccuguugguuggucaccugcuuccccaaggccacgcccugcagccuucuccuugaccaucccagcccugcugauguuccuugugauuucacaauggaguacuuauauaaaauugguaacugcuuuccgggaaauugacuucccuuccccuuguccugaaaacucaggcaugggcauauuucuuggagauuuucuaguugaaucagaacuuccucuugguuugcguagauuccauuuagaccugcauuguccagugugguagccgcuuauugaguaagccacguggcuuauugaguacuugaacuguggcuuguccgaauugggacugcuuuagguguaaaauauacacuagauuuccaagacauaguauagcaaaaacucuguacaccauuucauuaauaauuacuauguugauaacauguugaaauauaacauuuuggauauauuagauuaaguaaaauguguucuuaaauuucaccugccuguuuccuuuuuauucuuuuuuuuuuuuuuugaggcggaguuucgcucucaucacccaggcuggagugcagcggcgcgaucucggcucacugcaaccuccgucuccuggguucaagcgauucucuugccucagccucccaaguagcuggaauuacaagcaugugccaccaugcccgucuaauuuuuguauuuuaacuggagacgggguuucaccaccauguuggccaggcuggucucaaacuccugaccucagaugauccgcccgccucagccucccaaaguguuaggauuacaggugugagccaccaugcccgacucuuuuuaauucuuaauguggcuacuugaaaauuuaaaauuacagauguggcuugcauucuguguugguaagcugcuuuagagcauuucuuuuaacaccaggaguucuuccccucaucaucuuuuuggcugagucgucacugcagcgcucauagccccgcauguaccucuccagccagaacccuuaggaaucauuuggggagcuccaugaagggcauugaguccaggcagaauggcuaccuugaguucaacauaagcauuaagauggccauucgaaaacauuaagcacagaagaaucccauucagguaaucuucuguuggcuggcuguagaacuacggagaacaucuggagaaacacgucaagggugugugugaaaucguugagccuacucgauuuugucgugcuguugcgcgguuuucacuuggcacuguccuuuaaacuccuucugugccgugacucugcagugucuggcagcguaguagacucuacucccucuauggacgugaucccucuguggguucucugcacacuucuguauuucucgguucuuuuuggauuuaggaguggauuuuauacauuuuugagucauuccuaaagagcgauugacccuuaaagaacuguguacagugguuuccuuucaguaagaacauaguuguguggcacccccugacauguggugugguugauucuucuuccuugucuuccaacgccacccucuuaugagucucuuccuacccccacaggugccgcuucucugucucccuucccucagucuggcuuuuaacgguggucuccugacauaguccauucaggcugcuguaacaaaaucccauacccugaguggcuuacacacaacagaaauacugcucacaguucuggaggcuggaaguccaaguucaaggugcuuaccagauuaacugucuggggagggcccacacucugguucacagaagcaccuuuucacugucuucacauguuggaaggggcgagggauuuuuuuucuggcgucuuuuuuauaagggcacuaaucccauuugugagggcuccacccucauggccuaaucaccucccagagccaucauacuggggauuagguuucaacauaagaauuuugaggggacauaaacauucagaucauagcauggcuggaguucuguccugggcucucuuuucacuuuccuuguucucaucucauccacugguaacugcauugccuccugucuccaccuaaacuuccaaguaucuccagcccagaacccuuuugaguccaggaccugucauucauauccaucccagaacccuuuugaacccaggacuugucauucauaucagaccaccacgagcauuucacuacagccucugauggucuucccuguuuccucacuuuugccuauuuuuuuucuuuucuauucccucuuaagugggccacacuuuuguuccccugguucuuaugucaggaauguggguguccuuuggacacuuccuucuccaguuggauaccaggcccuuucccucccgaauggaauggaaaugcugcuucagcuguguuccucugcuccucccccuuacagcagugacauagccucucuccugcuauuguguccuguggcuccaccgagcacuggggagcuuuucaguaugcacuuuuuuuuuuuuuggagaaagagucuuacucugucacccaggcuggagugcaguggugcgaucuuggcucauugcaaccuccgggcucccagguucaagugauucuacugccucagccuccugaguagcugggauuacaggcccgcaccaccacacccagcuaauuuuuguauuuuuaguagagacgggguuucaccauguuaaccaggcuggucucgaacucccgaccucaggcgauccaccggucuuggccucccaaugugcugggauuacaggcaugagccacugcgcccggccaucuagugugcacuuuggacugaugagcuccccuaccugaaauccuguagcaagucccuauaggauaggcaugugguacagugugaagcuccugaguggucaacagcuaccccgugacaacaugccacacuccaugugccacucccucccgccugccugcuguguccuuggccccaguggugcucucccgugcugaccagccggcacggcucaccuggccgaacucuagccuugccuuuuccucucaaggauguaaaggcucugcagauuucgggaggccugucucccagcaccugaugggacacuuuuugccccacuguaaauucuggguguauccuccacuguaugcugucaccccaagggcaagcacugcaucugcuuagugaaggauuuauuguucggaagauacauuuuccccuugagcagagaguagcguauccuggcagucuucggugagccaguuguaccaggauuaugaaaugcagauguuuacugugucauuguugcugucauugcuacugaggaguacugaccagaaucaucugcaacucuuaguuggcagagaggaccacuauggcggguagcucuuuucuuuccugccauuguggggaugauuccaggccaaagaugauggagaaguauggaaaucaucugaaagguugaagcuuggcacgugaagccauucaugacuuuguaaggcaguuuugcugaaggccaguucugcccugggagggacggaggugaauccuccugaguaccugugguuuucuuacuuccugcugaauuuaccuaagugccuguuguuugcuugcuguggaggcuuucugguauuucauuucaggugcagaugccuucacuuucccacaaaaaaaaccccaacaaaaccuaagaccuuacugcaacuaagucuccaaguacuuuuuaacccauugggaugaacagccuguggucugcucagaucacccugagugcgugugagaaggccugggcuuugccaggaaauccaggaaggcagggccgggcuguguuggaagcuggcuuagcugguggggcagccuuauuucaauuaaaagggcauugacugggagcagcaguccuggaguuuguugcauuuccuauugcccucaaaaugagaaaccaggaaaauagcagauuggagccuucgagaaggcaguaaauggcuguuuuuauugacaaaaggaaaacauuuuacugccaucucacugauggcaucucacugacuuaaaaugaaggcagguuguaguaaaaaaaaaaaagucuacauuuuuccaccgccacguucuuauauccuuguuugucagccacugcucacaagggcaguguugucuugcggaguagaggcgcucuccuucccucguuuuccucuauagguugguguggcugaccugcuagaucaaaguggaggaccuguuuaagaauguguaaauugaaggcugggcgcaguggcuaacaccuguaauccuagcauuuggggaggcugaggcaggaggaucgcuugaguccaggagcucaagacuggccugggcaacauggugagaccuuguucauauaaaaaaauuuaaauaauuagcugguuguggaggcacgugccuauagucccagcacuuugggaggcugagaugggaggauccgccugagccuggggagauggagguuacagugagccgugguugugccacugcacuucagccugggcgacauaaugaaauccugucugagaaaaaaaaaaaaagauuuuguaacuaaguuuuauggcuagcuuugagaaaggaaaauaauaauaaaaaaagaauguguaaaucaccugcuggauggggggaagaggggcacauugucuuuguagugagacuucacucaugugaugugcaguauuucaucuuaacauuuuuuuuuuaaacuuaagcuacuugugaagagcugagauguuucuguuaagcacuguguggucugcugcuggucuucugcaggccacuguuccccagacugcuaagacgaucaugacacaggcuugcauuuucagguggacucuugggaggggcuuguggacccuggaggagaaggcagccaggagaggggcaucuggcuuuguguuguugguaggaacuugucucgguugcccuggaaggccucugcucuggucagcugcucccagugugggggugaucuuuauuuagaagggggucacaugcccccaggccucauugcuaugccuuuuauagucaggcguggagcucacauucucuucugccugauugccgacgcuuguugccgagauggugaagcaguuugugugcagguucccugggaccuggcuuagcccaccucauuucuuggggcgugugccuugugccucaaagacuuugcuuuuggcuaauugucauuagugauggugucaccauccugggccuccuucagaaguuuuuaauagggaucucgucuaagagaccaaaaagcuuucagaaccacugacuuguggugauuuuugcaugccaaguauuuggaaaauaucuggagccccuucagcucucaccaguuaaaccuauuuguacaauuguucugguuucuuccugugcuugaaaagccucuuucuuuguugcguuaauaccucugucuugcuuuccucauguguaugccagugugacauucucggcagaguggggaugacguggagcgugugggcccgugguuaaucuuguccugaauugccuugcucaacuugcguguauagggugguucaaaaguuaaguuuggcugguggugaaguuggaagcaucacuuagaaacacgccuccuuugggcauauggugugaaucagggacucuggcuauaaaagguggggucucugagcaccauccugguuggaauguuccccugacuuggagguagcgagagacagccaagguguuuguuccagggaggcuggugggugggagaugggauuuuucugucuguggcacaggcaguauuaaguagagcaggcuguuuaaaucacauuuuaaguaaaaaccaaagugcacagaugaucugcagaacuucugggggauaagaagcugcuuuccucgaagaaguucaucuccaaaccagcgcccauggcucagcagccagcauggcagccccagggguacaugggacuugggcaugugaggcuggugagggacagggacagcuggguccagcagugccuuuccuagggacgguugccacgucaccugucugcccuguacuuccauuuccuuucuuugaacucggggggcuugcaucggacuaccugugccguuuccucaaacucuaaaauugaguaaguuacugaggguuuccguggucugcucugagaagauuucuugcuuccugaucugccuguguguucguguugcuuggucucucucucugucucucucucucuccucuuugauccuaguacauacaggcaagguaugcagcauuuaaaauguucauaacucaucaaauggcacacugaucaucauguauaauuugggaaucaggguuuaagaaauuuagagaucauuuauauggaagaaggaaccccaaguagaaacccaaaaucuagaccauucuggguucuaaucuguaccugccacuggcuaacauauggcuuuaagcuggauguuacaaugagagcuggaguuucgucugauugcacauagccuugcuuuucugucuuuggaaaaguagcucacuguagagcccugguaaacguuugaacugcauugcgggaguaggcagaagaacagaacaguccuuggagcuugguaggaggugugagggcuuaugggggacaguugucuuuucaagucaaggaggaauaagggcuucuggggccgguggaaagggugagucuuaggcagggaaggugaccauccagguuagaucacuucuucugcggggucagcuuggccgcuguuagguuuucaggaugucauggggcuggccaggccucaccccugauaucccugagcaucuguuccuuacaauauuguggaguccgugggggcagaagcuaccauccugugccugcccucacucucagugugacuggucuucaggauguuuagguggcuccacaugcggauguacagcuuuccccugcuuguuuuccccauggcauauuaacagcgagaucugcaagaauacaucauuuuguacagaacaggauguauuucuuuuaaacuacguuccuguguggacaagugguaucauaugcaaagguuuaaggaccguugaugccuugagauagugccaucuguuugccucagguauguggugcuaggacaaagcugccagaccucaccuuccuucagugagacaggaauaggacaguauuugaaaagcaucuaacauguuuccaagcacauagguuuuugguaaaugguggcagcugcugcuauuuuuuuuuuaaauuaaacuaucuaagaguugcauucuaagaccaucuaaaauucugagucuuaagcuguguugacuauauauguucacuaccauaacuaaaugguccuucuguauugcuuuucuaaauuguagaauuucaauuauuguaaauagcgggccauacuguaggugugguucuugcuaauuugauucguacuguucaaauucuugugucuguccagauaaacuguaucuuuacagaacauucagcgagguacauaugucuauaucggggugccaguggagucacccuagucauauguaaacucuauuuauuugguuccgaaacugaauuuauuuuguuugcaaguuugguauuugggagcauuuaagaaauauccauagauucuuguaugauacugacauuaaaucauuaaauaccauauuuuuuaaaugccucugucuguuugcauggauaacauuaaagugguuagagugggcacaguuauugguaaagauuacaaagaugugcauuuuuaugacaacuuuaggucucacauagguagccaaccaucugcuccaggaugaagcaugugccuguuuauccucuucuuugguaacgcuagguauaugugugcacacgugcacgugugcguguguguuuguguaugugcguaccacuuuauucucccacccagccucuucuccuguuuuguuuaguuucauuuuccuccucucacccccauugcaggaaacaaacacuggcucucuguccucccuuaggucuuccuuccguucaaggggaucaggugggugggaaaauguugugcaggaaugccaggccucugcccgaagccgggcuucuguuucaucucauuauugaacagaagucgcuuuuuguuucuuugccuuggucacaaacaagcgcccaguccucucuucuuucuuccugccauuuuucccagaauccaugugggaugggaacagaggcagcguauuuagggacugucgguugcuugauacccauggccuuguuuagagaagcugcacccacugccccaacguguagcugcaucugauuuguuuuugcaaguccuaaugaagggaccuggaugaaguuagugagguugccguuccugggguuaaugcagaguggcccauggagcuuagccacccuucaugcagaagguggggcugagggcagccagugugacugaggcucgcuggcccacccugagcugcuugugcccauggggccccuggggaggagggcccagcugcagugcgcauacaucugcccuuggcagcagaucugugaacccaggcugccauucuggauuuccggauagaugcaaagugcuuggacguguuuuagcagcugcugagaccaggaguugggcuuaguaguaaaaagggggaacaaaauaaaagaagaucaggagacaaagagccuacaguacaaaaaaggaaagacgaagguugauauuauuagaaauacuuccugggcagccuuacuguuugaauuaggaucacccccacccccaccucccagagguauuaguuguaaugcagagacaaauggaaacuagucagauccuuggguccuagaaaagaccagcuuuguuccuggggugguaaccuaguacaacguuuccguuccuauuucuugaccucugaauggccccuucugcuuugcuaaguagaugauauuauuaggugcuuagacuauucuucagauaggauguaaggauauauuuuuguucucuuccucagugaacuugaaaugauuggauuauuuuguaauacgucgauacuacuuuuagaagcuuuugaauaacugugucaaagaagcuuuagaagagguuuuaagcaggauugcagagaauguacugaguguguuuuuccacucacaaggaaagacagcagcugaaugcagaagugugugucugguucuaacucuuuaucacuucagggacuguccaggcagcaccauccguugggucuccugcccuuccuccucccaccccugccuuaccccuggccauucuuuugugaccaguaguccuuuaugaauggaauucugagaauguauaauuuucucagaagaaugcuucuuuagcucaccaaauauuucuuguuugcugaggggggaaaaagauccuccuuggaaaagucacugggugccaaaggugggugaugaggagagaugaacuucugggugugccuagcaaagcuguuucuguugauaggcgauuaacaaaacagccaaacuugaccuaacagacugccauuuugagaggaauuuguuuugcaggauuaauuggcuucgagguguacugguggcugugcagugaugacggcugucgugccuccugugucuucugcucauugugaugcagggcaagugcuuaggccucagacacaggcucccugaacuucguguucagugcuuuaggguggggggacuugagacccuugacuugacucggucccacuggaaagcuucuguugcuuauuuggguaaccccaacucuaucuuauugggcgguaguguuauccuaauucuuggaaauacucaguguagaauaaagagcugaugaaaauguguaagaagggaguaaguggucauuagagagaaaugguaauugggaugaugcucugaccccuucagcaaaaaauaaaaggugaaugguuuauuaugagcuaguucagauucuguuuuuggaaaugagcuugguuauacauagugcauuugaaaagcgugaagcauggacuuucagaugccagcuccucagccuccuguaacuccagucgcaaaaucccuccaguguaucuaaauaaaugcaaacucaucagugccuuaccauuauaaagcugggcuggagaggcagguggccuggagaaucaaaugacaagaaguauagggagcagcccagcuucaugaucgggggaauuugcaugaaaauuguguacacuuaagcaccauugucuauugcagaaagcacgaucuggccucuucuacugacuuuccuuccagcucugagauucaguuuugaagacaagguuguuggggaccucggauagaucuguuggccguggcuuucaguaaacacuacuagagacugaggacauguucuagacuuggaaugguaugaagcagucgaacuuuuuaggaugggcccuacccuuagggacugccuacgaaacuagaucuagaagaggaggcuguggacauuaggagguggcugcaauuggaaaguuccagagagcuuacugagggauaacggauguaggacaggaggcuggcaaagcaccucagugauagggcagaaggaaauaaagugguuagggaaggaguugagagcaggaaauucagguaggauugauguuaagucuuagaucuuugaagugacuuucucuggucuggcuuuugcuguuaccaaagugaauuauucauaagugcauaugagaaaugcugauguaacucgauuauguggaaugaauuuaaauucauuuaagucauucuuuuccacuaaaguaagcuuucccucauccagaaucugagcagcccgauagccaagcaggaguuuccuugugccauggccagugauugaugucuucuucuaugaugcugcugaaaugcuggggacucugaagcgcagcuggagugaucaaagcaaaauuaaaauacuuucucagugguuugggaguugggugcguucugcuguauuuuuugguuuucggcaucuggguuuggugugcaugcauggugagcucuagcuggagcagacguuaccuacugaggcuacgcucuucgugguuucuccuuaaccaucacccacuugaucuuccaugaagccccccaaaucuuccuuacugaggacucuugcuuccagguugcuuuugugcucauccauugcuggguuauuuggucagugaugaugguuucucuguacuuuuuaucaguagguucagaggaccuuguuuacuccucauucaucucucuccccaaacaguugagaaaccacuuguggguuaggacucaugcuuuguuuauaauguuugauucuccaaccucacagcuaaugggaagcccguggaggagauacucuguaaaaauccaucucccaugugggcuugaccccacuuagugucugagugguuugguccucauaguucucuugggggaggaggaagggaaggaggaggagguggcgauggcaguggcagcagugguggcaucuuggaccagagugagaaaucuuggaccagagacaaaagaggucuucucucaggguagugcaccaugagagggagcaccuguuuacauuuuguauccuggacaccaaucuugccuugcucuggugcuggcccugagaggugcaggaauuuuauaaagagauuuacaaaacauuuuuggaugaccaaauuggucccugguucuagcuggaaugaauaaacaaacuaaauaacaguagagugugagaguaagugugugugcuagagaaugugugcacauguauggccuaggugaguucuucacuuugcugacuugugaauuauuugggguccuaugguccuccccaucauucuuauucaugucaguccaccaucauuaaggaaguggaagcgaacacauuguguacauaucacucccauagagagggagacuggggaagagguuugaguuauaagucgcaccuagguuaggucuggaugugucuuugcagguuuccuugcuaguuccuuggccagaguuuccaucgugucccucagcugcacaauuaaggugcccccguuuugugcaagucucaugcuaggcaguaugagaugacacaaacuaggauucuguugugagauaagauaaaaacacuugacauuuaaaagagagagacaacuuaugcggugugacgagacacucuacgacuuuugccagaagagaaauagaggcaacaagugcuaggagcucagaggaggguaaguuccacauuuggaacuuuggauuaaaagaauauuugggucugguugaaaucgaggccuuucaugagaaauguccacacuugcucaguacuguuugccgaacacuguauacaaggcccucgacucgugaaugaguuguaaugcaaaacuuugccaggcauuuggaauguggaguauacuauuuuguaaagaugaggucugaauggugguuuaggucccaggccagugucccucugccccccaccuccauaugugcccucaagccgguuuggcuuagacauuauuuaucucugacuacuguguacagcuuaguuccauggggaggaaaaggcuugaugaacccuacccuggaaggcugguggcucuguuuucugauggaugagguaggagugguggaaagcugguaguuucuacuuugugccuguuuaaaaagcccccucugaggccuuagcacuuaacagauguucaggauugggggaauaaaggagcugccuuugcagaggucugugggcaugcagugggugagagagcaggcacugagugccccgaguuuccugccugugugggcaggaggauucucaguggaaucaggagcaucuccgccuggugcuggaggagguguggaguugaaggugggauucuuccucuugaaggacuugaaugaguuucuguguggcugaacagaaacugguucaacacccaugucaugauuuuugugaagcgaggacuuggggucccaagucuagguuuuagguucccugcuguaacccguggccaccgagagagaguuuuaugauaaaaugucagcaaaguaccugacaacgucucacgcuagaaugaguuucguacauguuuaguucccucucuuuuuauuccacgcucccccaccccaacuuuaaaucagaaacgugagggugcugauugaagcuuuuuauaacuuuucuuauugagaauuguucucuggaguugucuccaagaacaaaggaauuccagacguucuucuucucuccuugucucuucuguccuccagucaaagaaaaacucugcauaugaucuuuggccuggagaaauauuaaaucuauguuaaguaugcagacaugaaugggcaaaugaaggauuuguggcaaagaagaucugccgaaacaaauaagucauguaaaugggcagagggaaauauuaaauugauugcaucuuucagcuccugguacuuaaugcaaagauaaaguagugggaaaagguugucauuugaaauaauggaaagaugagggaguuuugaagcuagcugggauuuuucugccuguuaauagagugacuuggauuacagacuauaaagauaaagaguagggccguugcauuuaguauggaucaugaugcugauugcugucugagcaaccucuguacuaagggaggagaagcuaacauccccgggccuggaagauacuggauacuagcucauuaaacucuugugagaagccuucauuagcauuaugggaagacuugcuguaucuauauuaugaaggcauuuagauuuuuuuuuaaaugcauguucuuaacauuuuuuguuuauuaaguggggcaguagauuaggacugaauggauuugauucucucauccuacauagugugcccagaagccagaagguuucccagaauuuguauuauggcagcgagggcaaauuuaauuagcagauaggaaaagcuuuggagcaguuuaggccaauccauuuaauuguaucagcaauuaauauuuugagaaaauggaaauaauuaaauuuacauuucuucuaggacuuuauuuuguuauccuuuaagguuauuguaaaugaggagacuuuugaacucacagacuaaagcaaacuacaccagauaaucauuaacuuuuucuauugugugccacccuucccaaccagauuguuccauaguaucacuuaugaaccaagaaccugugagcuugcaaaacgcauuuuuaaggagucucaacuuuucugauuuguguuaaaguuuaggugugggucccagaaaugaguuucauggaggggagagguugucucucuggguggguaauacaggggccacugggggcucacuguggcuuucuggcacagacauuuaugaagcaggggugacuaaagugggagagagcagccaguucuccagcagccccagugagagcucucauggaucugccuauugcacugggguaggagccaucaccgucagcuuuucucuggcccacagugccauuuucugauuaagcugagaccucuguaauagacacguugucauuuuuucuugugucuaaaaguuugcuugacugcagugggucuccagcucagagcaggucuggcuagagaaaacaggaggugaugacuggagcacuuugcccuuauggaacgugcucugauguagaaagcaagaggauuuuccuugcagucacugaagguaccuuguguacacagaaagaagacagagggagccccggaugccucgguaucccucagagccggauccuucagaccugugcaguaccuguggauuugguuagucgaugaugcgcugccauuaaaacaaaggcaucggcccuggaauagagaaguucagugagaaccucuguacuccaugggcauuuucuaggaaauaauuucaccugcccuguguaauucucuggaagaaucacagugaguuggaaggaaacuuaagacuuggaaaaggauugagagguuagcccagaccacaccagggcucugaaggcccagcugggguuagaaccugggacacccuccagcccacugucuccuguucccuggccauuuacugccccacuccccuuucuacucucaggggcccuggaucuaaugaggggauucgugcaguuugcugcacuaauacauugcaaguggugccaaccuaaagguauucugaugguggaaucagagcaguagcaucuuauuaggucagaaucuguaucuccucuuccaagauuuuuacaugauuuaguguuuucugaauuggaaaaaaacaaaaacaaaaacacacaaaaaaaccaugucuaaauccuagcauuucaucccauguugaugaaagggcaucuuuuuuuuccccuaaucugugguuagaacucucagaaacuuuuagaagaucccuccuauguuuuggagguuugcagauuugaaccccaguuccucccacagugcuucuccaacuccuggaaugagguaaaccuccaggcagccuguugacccaacccaugcaugccggucuuugggacuccuagauguggacccuggagugaauagggaucaggugggaaaugaguuccuuugaucaagauccuuguaccagugaacugaccccacuccccgucuggauuccuguggugauuacccucuguauuagucuguuuucaugcugcugauaaagacguacccaagacugugaagaaaaagagguuuuaauuggacuuacaauuccacauggcuggggaggccucagaaucauggcaggaggcaaaagguacuucuuacaugguggcagcaagagaaaauguggaagaagcaaaaguggaaacccugauaaacccaucagaucucgucagacuuauucacuaucaugagaauagcacgggaaagaccagcccucaugauucaauuaccucaccuggguccuucccauaacacaugaaaauucugggagacacaauucaaguugagauuugggcggggacacagccaaaucauaucacccucuuagcaaggacuguguucgugaucaugacuggcauucacugaacaaugacuaggugccaggcaccucgccaguauucuuuaaucuuugcacagucuguaggguggauauggauauuacuguuccauuuuuuguggaagaggaaauggaggcaagagaccugauuauaacuugugcaaggugccaugcagcuaagcagccagcccaaauccagaccugcuuuccuaugauuuuccugcccauuacucucccaucguagcucaccuaauacuuccuagugggcugcugcugaacacacacccagggaugacuuaguggcuugucuugcucugaagaaggcuaggcaccauguuggaugaguucuugaagaugucuugcucuagucaagaaacuuuuaaaucuuuggaguuuuuguccacaucugccuaguucuuaguaaacaugauguggguucuauuagcauggcgcccucccucccuuccuaccaccuuuauaugagcggagaacaucuaugacucuuaugagaaaggaaagaugaaaaucagagugacauaguauaguuaaauugcagaugcuuaauuauaaaacagcuuguuucugaauuuuaauuccuugcuuuucucugacuuuuuaaauuccccuccuuaggcagaauucauuuuuacauugaugauuuuuuuuuuuuuuuuuuuuuuuugagauagagucuugcucuugucaccccggcuggagugcaauggugugaucuuggcucacugcaacuuccgccucccggguucaggcaauucuccugccucagccuccugaguagcugggauuacaggcaucugucaccaugcccggcuaauuuuuuguauuuuuaguagagaugggguuucaccauguuggccaggcaggucucgaacuccugaccucaggugauccacccaccuuggccucccaaagugcugggauucuaggugugagccgccacaccuggccugaugaauuauuuucauguguggaacaaaacuuugaugcugaucagugauuagguaccuuuguuugguucauuuuuaacuaaggagauuucuuucuuuuuaaaaccauucuuuaaucuuguaaaaauaucauuuaauggguggauguuuuagcugugaugaaugacagguugucguaaaggaagaaagguaugugguuuccaguaaacuuuuaauucuuuugcaaaauaaaaauaacagucguacagagaguaaaauauaugaagagucaggaagugauuuaucaaaaucagaucuuggacugcugguuuuaccaugaauuaggcucuuggaaagugauugggccaguguagguuuacauuuuuuuuuucuuguuuuauuugucaaagcaaacuugugguugccugcccguaguuuaauucugccuccuuugggcaaacaaccgacuuuuacugggagucuuucucagggagauaaaggugcacccugaaacucugcucucugauuccucagcaaagucaguccugaguauggggcuugggugucucugcaaggccuugcaagugagaugggcugucaccugagcucagguggggcugcuccugccuuggacagccuccccagcuucuccugcauuauacccaggggcuggagggcagagagcaggucuucuucugcuggucggggcagucacaggcuuuccucucggccugcuuguccuccggguggguccagcacccgcugggauuccugugggcuuagucacuguguggcggcggcagaaggacuggggaaaccgccggccggcccuggugcgcugucaccccgaaggaaugcgggccaggccggggcugcugggccuggaaaguucuccagucccuguugcagaucuggccugccgacucaaaguaaaucucucuuccccuuuauuucccaucaaauaaaaaaggaacacgagguagccacuguacucacugaagaugcauuguuuuuuuuuuuuuuuuuuuuuuaagcgagcagcagcaagauuuauugugaagagugaaagaacaaagcuuccacagcauggaaagggacccaagcggguugcccugaagaugcauuuuuuaacuugcuuuuuaacuaaguauuuuugcucugagcuuuccuggaucuguaaacacacccccagcuauucaagaugggcuucuuggugaaaagugauguguccuaggagaaaucacgccuguuguugccgcuggccaucacagaucccggugccugucugugaaaggcuggccgggcuggguggggaugagaauggucggguugucuagacucagccuggacugucuuugacuggaggggccugagcuccuccuccacugcucaagaccccgguuaaggggacagcagagcagggaugagaaguggcccucuucacaucaccucccagcaagagggccugacuuagugcucccaccauugccagccccaguuucagggucccacucaguuguauuugaauaggucucaugacaugugcuuugcuugaagagcggcuauuagcagcagacguucaagaggcugagcucaagcaggugagcauguucugagccauugugaacccagugaggugccuaugcugaugcccagggccgccugggcggggucaggcccccaucgcuucuucauccuagcucugggagugcauucugcacucucccgaggccagcugguggccuuuggugaucacccucucuguaaguuuuuaaguggcuuccuuuccucugguggagaagccagcaccuuuauccuaugacaagaaagcucuuuguaguaggugguaguagaaucagacagaucuggcuuaaaaucuuggcugugcuaccucuuggcucugcacauuggugaagagaauuuaccuuccuaaggccucucagcuacacgacuguggacacucagcuuccuucuaaggucguugugagagguaaagaaaagggguuaguccagggccagacauggcacaaugccucaaugaaauauuagcugauacuaucauaauuuuuaaauucccauaggacucacuguuaaaggauuacaaggcugacacaaaaaauacugcauuuugaauuugugucugauuuauacauuuccaaagaguggaauucucacuacaacagcuguucuuugaaagguuagaucuuuguucugagauaaauuaaguggaaaaagguguagagcauuauauguacucugauucuucagggcuuaauuuaaaaagagcauguuugcuggugaaugcugguucaaucauuaagaaguuuuugagaaggaaucccagaaaguaauaagcacuuauuuuucauggaaaggaaccggaagugcuuggugaccuccacagguaaucuuguauuauuuuugcacuguuuggaauuuuuuaaccaugugcuuuuauuucuucuauucuuuucaaaggucaguagguguuaucuggacaauaggguucuggucuguuuucuguuuucuucauuguacugugcauuaagaaaaacccuaaugugcuuuuuuuuuuuuuuaagugaaccuuuccacaucucauuguccuucagugagagcaggcuguguguguggucuuggugaacugucccguucccuggagacaguaucugggggccucccugcccuucccaguaagagcugggccuucacaggaauagaggccuaggauucgccuucauccucuugaagagcccuaacaguagguccuggcuggggucuggcauagaaugcccuuggcacgaugugugugagugugucuuuccuuaguaaauggccuugaaaaugccaugugcuucuggcaggccuggauaagguuugcccugcauaacccuuggaaagcacaguucucacuuguaacacccugucugcagguccaugauauuguaauuaaaaaguuaugggaucacaagggccuauuuaaagggcaucuggucuaaaggcacaguuaaaagcagaauuugugucaguggcucccuuaauuucucaaauaugguucuguuucuaaauucaucccacuggaugucuguguugaguuuucuguugaugaaagaauguuuaaaaaugaggcagauccaaauucuaaugucugaguguaccacugcuuaauuacuuugggcaggucaccucaccucucuuggaaagaaaggugauauacuacaucugugauuuucaauuuuuuuuuuuuuaacuagacccacaguaaaacauagauauacaccaugaucccaggacagaauaaguauauaacuaaaauaaguguuuugaaaucacuucuugucugacacagcacucacgcuuucuauucauguaguaccacgauacuuucuucuauucuaaugcugguaagagaugccuuaaacugauuuugagaacuaccaauggguagcagcuagcggcuuaaaaaggauguuauuaagguccuuuucacccugauuuugacucuguuggcucucagcugagugccccauacuuagugcacauagaguuggccucugaggucagccuccuguuuuccugugaaaaugaggauggaagagagucacuuguuucccuccuucauggcuacccccugaggacugggaagaauuuaagaauuugaguauauguucccaauagcaugauguguuucauuguucaucuguaagcauuuuuaaauauucgagaucuguaucuuggguaauuuuuaucaacuuuuuauuuguaaaauaauuucaagucaguuauuaaaguaacaaaaauaauggcaaacuugauaccuucccguauuuuuuuuucauauuuuuccuugaaugcuuacagaaauauuaaagaauauuaucacaucauuguagucaccgaugaauuauuuucugguggcuuaugauuagaagagcuugacucggaguggaaacagauaacauuugagugcucuuucuguuaauucauccuugucaauaaccccauuagcuaacuuccagcaaggcuguguuaggaauguggaaucaauuagaugaauuuugaaaauaacuuggucuguucuaaaaggcccuaugagauccaaacuguuguggccuggugccugguaacuuugauggccauuuugaaauguuaccguagugauaauucuucuggaaucucaagucauuaaaagugauauggcuaacucugggcccugugcuauaaaaauagaugucaugggaugugugaauccuuucuucaguguuauaguuaauagcaacugaaggaacguuuuggucaaaucccgaauacuuauuaggggcucacugcuuggcugcauuuuucuccucugcguaaaucaucuauccauguaauuauuaaccccuaagaaugaauagcauuuuuaaaaggguuccauuuuccccucauaugacuuugguucauucuccuccuuguuucugucucucagugaacuuuccaaaagauggguuaugaugaaaggugaaucgucguugauaacugcucuuacuuaucuguguaucgaaacugcagguagugcucuucagcucuguggcuggauuuagugccucuucuagggagggguggguguuggcacaaagcguaucccauuucccugaaugucguguggacacgugagaggacagugcacccuuugggcuuggugcugcccccuucacgcuacugaaccccagggucauaauuaaaagcuguguuagcucuucucugguuagaggcauacagguuggaggcuuguacauagccgugagccgguuggucuaggccaggaagcaaaccauuggaaaaugugguuagcagugacaguugacagcauguuugccugcaguaguggugguuggugcugcguguugacuggaguugcuugcauugggagagccugacuuggccaaguguguagcuugagaccaguuggauuccucucagagagacagucuucacccccaagcucuggguguugggcgugcagcauucguauucagcaaacauuugcugauuuccgccucugcaacuacugagcucagcuuuggggaucugaagaugaauagacacagccacacuucuggggaaaucucccuguggggaggcugacauggaaaccaaccaaaugggaguguggugcauaucuuauuagagcuuugugcaaagugccacaggaagcaggagaagggguagauugguguggagggggcaggggaagacuugccuaggagcagggccucgcaggaugcagaggaguuugccaaguaccagagauugugggguaggugaauaaaggcugaguauaaggauaagucaauucaggcagauguccucuaagaaugaaggugagaaugcuggcggaaaccaguuguggcccugucugccuucccuaggagacuggaccugacuuuacaggcagugacggugaagcagggcagugccacgagcagaucuguguuuccugaagggucucuggcagcugucuggggaaggagggaagcuggcagagccguggguggaggcagaugccauugcuauggagugagcauggggaagggggucggaggccuuuuggagauagauacagcaagacuuggugaaggaugaaguuggggcagguagaggaaaagcaaugagcuuacggaugacuggagacugacuggagaagaugaccacccuugccauuaacuaggauaggaaacaacaaaggguaggaguuugacaggggagaauguuugugcuguugaguuguugaguuuaggugcuuguggcacgagcaaggggagugagcuggucuaggagguuuuuggaaacacugaccuggcugcagagagggagauccugggacaccuguuuugggaguuaucccaguggggaaggaucacugggaagggggccaccccuuugggaggggucagugggacgacucccaagggaagagguugguuauagggaguuaaaagaaaggagcaccccucacgcgagcccauuuuucaaggauacauguuugucuuuuagauucuauaaggaguagcugcuacacagaaagaugucuacgugugggugaacaccuggcguaucccaugcagggaggcuucagcagaccuugguggcgauggaaccaccacagugauccgaggauugggucugaaggcuccuccgagucuccaauaaaagggguuguuuugaagggcucagguucuuccugggcuuuuuugggacagucuugcucuguugcccaggcuggagugcaguagaggcaaucauggcuuauugcagccucagccuccugccucugggcucaagugauccuucugccucagccuccugcgugguugggacuauaggugcauacccccaugccuggcuaauuuuuaauagagauggggucuugggcucaaguuauccucccaccucagucucccaaagcgcuaggauuacagacaugagccacuguaccuggcugagaagguuuuuuuuuuuucccccuuccaaacccccaugugguccagacgaggccagaggaucucaggggaauucccucuccgaggagccuccacugcuauugcauggcccccagcauagucauuugagugaagagcccuccaaaaucauuaagcugauuuguagaaucaguuugcugucugacuaccugaugaagaugagaagugguagaccuccccccacuguaaggucuuaacaagaucuagguggaacaugggacuguuugcaagcuacuucuguuucugaaaucacaugcuugggaucccaaauaaucuacugaaagcugucuucgggaggcaaagcccagggauuuguuuuguuugccccuaaucaucucuuccauccccuuucucaaaagucuuauaucuagauaauuuaguacauuugaucuacuaacagccagggccauaacaggagcugauauuacauaccccggaaguccuuugcaaacacacuguaguggcgauugauuaguguuccgagccauagguaacauuagccugccucguaggacccucagaugcugaccguaucugcugcaauucuuagauguaaaagagcgcgcaucguauaaaucaaaacuagaugauuauuuucauuugaaauuguuguugcacuguaauuucucaggguuuuguauuuuccaacaguggugucacuuaaugggaagaucgcucaggcuuuguaacugggcauaauaccagguauucucguuuaggcauucugcucaguaguauuaaccugaagccauaggacaugccaauguuuuuuuccguguuuuuuaaaaaaauuaaaaugguuggcuacaaaugcauccuuuuuuacuucagaguaagucggccuugguuaagucuuaauauuucucaugccuauuuuuuuuucuucaaaugaaaacauacggagagaaaauagcauguuuaugccuuuugguuguacccagcacugcccagaauggcuuacagaguuuauacccauggagguuucguaaaggugacauuaacuucgcaguaaagucacugaccccgaaccugugucacuucaggcuuagccaaaugcuaacagagcagcucaaagcuuaagcagagguaugugcuugcuaaguaaguguguguuuuggacuaauuggugacuaccauucugaacauuaacugcccuuuguguuuuaauguugccaggaggccgauuguguaaccuuuggaggcuucccugaguuuggagaacugaauucauguggugacuuccuauuuauaaugucuuugggggagcuaugaaauaacuuuucuucuaagugugauuuuugcuuuuuuaaaaguuuuuauguuguugucaauuggguauuucccuucuaugccaagacgaauuguagguucagguuucuaugcagccuguauguaaacacuggcccuaaagaaggacucuaucacucuacuuucaguuucuugcauuaaaacaaguauggguagcgguauccuucuuauuucugcuuccugguccugugugagacccugaaagguccuaauggcagugcugauuagauuguggccaggguucacccacaaguuccgaagcuggggaagguggaagugcuguuaacugacuugucccaugucugggguuuugcagccuggggagaggugaccaccccucguuucaguccagguaggguuuuaugucccugucaaaaauguguugugugaaguaccuugacuuucauuucccagggaagaaagcccguuucaauuggcucaagcggaaaagagcacuguggguccacuuaauggaagagucuaagaguggcuucaggaaguccacugggggcuccccgugacucugcccaccugcauauugucuucauucuaaggauccaggugguagcaaaaggguuguuacaacuuuaacccugcauccccaccuucagguucaguacccaagggugagcaaucuguuccaguggcacagaccuguuucaagaggucucuagccgugauagugcuaggccacugcccuccaccaguguguuccagagaaagaugcucugaugugccagcccaggccaugagguucccggccucaguaaggaagaaggaggacaagguggucccuuaggagaaaauguggauauucaagaaagagggucgcaaaauagcaaacacccacuauggcugggcaguacaggguugcagaaauauauuuugaugugugaucgcauuggagcuacuucaaagagcaaacacaccacuuugauuuauuucucuuagugauacaguauuuagagagggagauacuuuuuaucuucgugggauacuuacaguggugcucuagaagccauguacugcuucuggcuucuccuuccuuuccuccaaggcuccuccugccuccucccaaagcucugugcccugaaagagccuugagccauugcucagaugucaaaauuguauuaagcagacacaucaaauuaaaacuuuugggaucacucaccaauaugguuuccuguacaguacugcccugaggggggauuacaaguaguuaugcauccauuucauugauguaucauuuuuauuaaaaagaaaaacaauccaaccaagagaggaaguguagccagcugccuaaagaguggcgaugaugggagaugauauuuugauuacauuaauccauauccuguuaguucacuuugcuucugucgcugcugcuggugaaguuacuaaugugaacuaauuacauuugcucugaaaagccagaauuuuuaaugcaucucagcaagaaagguuaauauuaucaauuuaacagcaugaaugaaacauuguguguauugaacuugaacuguccuaaaagcuuggauaauaaaaacccaguggcuucuuuuauaacucacuggauaaacaguuauuggugagacauggauaaggcuuucuucucuuucaguuuuauggggggugguaggcagucagcauuagaugcugucuguuuacagggugauaucguaacuucgugaaauuggaggccacauuuaaaaaggcacuccuuccuuuuaaaagcuuugcaagggggcugcauauauuuuccuaauuagugggaauauuuucuuuuuucuuuuuucuuuuuuuuuuuugagacagaguuucacuuuauuguccaggcuggaguggaguggcaugaucucggcuuacugcaaccucugccucccggguucaagcaauucucaugccucggccuccugauuagcugggauuacaggcaucugccaccucaccuggcugauuuuuuguauuuuaguagagacgacguuucaccauguugcccaggcuggucuugaacucuuaagcucaggcaauccgccuaucucgggcucccaaagugcuaggauuacaggcgugagccaccgagccuggcuggugggaguauuuucaaagagaacaacaauucaccacaccccaacaugguaacagucuuuuuguuuuagaagcaucugugaauugccaagacucguagaacuaagauguauucaaagucagucgauuuucuggaaacgacccagucccugaagauagucuuuuggggaguugaguguuuugagagggacacccccucuacagggacuuaaaauggaauggcuuuuugugugugcacaugguaccugcagugauuucuuguguuuaauuacuuccugcacucaucugacuuacacagugguaaacaaugaggaugggaacaggcggcagcugcucugugccauccaccgucuugggaaccccagcguggcauucucucuggggcagcauguugaaguguuuggcuggugacauuuuggugaccaguuggcuccucauugucuuucaauguggagauuaggaaccgagcgaggauuuggaacccuugcguuuguucugccaagaacaugacuugccucuggccugagagcaguggaguaagcugauaggagcuagaaauacuguuuuggguaggacuuacccaaaagagugggcugagucacagaacucccaaguuugagcccugucaaauaaauucugaauuguucucagguauguuucucaauuggaauuuuuuuaaaaauuuaauuuaaaaaagacuucgaaaaguuaccuuguucucauuuuucuucucccucuuugccccguccccacaauaucuuagggcgaagaaaagcagguuugagaaaagcuuuuuuucaucauguauuuguaauagcuggagccugcugagaugaugagguagaguggagggagaaagagaccuugaggagguguggagggggaagggguggaaaguucugucgucuucugugccucucucucucucuugcucagggucuccagucagcccucuggguuugugcccuucgugcugcacugacaggucaaagccgacucaggccuuugaugucugcucuaggagcaaaagugauuccuggucccgcagccguucccacugccuuguguaugaaggucugcugcucugagguggaugguggcucuaggcaggcuguuuccgcugggugcgguuguugcugcagguuuuucuauauagcuuggucaugcuccuguaucuagauuaaaauccuaugacagaugggccugcuuauaucuaaacuuauucagagagucuuaugauaggcaacagguuacccuuuaccgggguaaaacaugguuuauucuacaguuuggucccguuguaaggccaggagauagagucucacuaguuugccccggcugaacucaaacugcuggacucaagggauccuuccgacucagccucccaauuagcugggacuguuggugucaggcacacaccaccuugccuagcuugaagaucuuucuucuaaaugagcgggcuuuaaagugaucagugggaccugggcagguuggcucuugccuauaauccaagugcuuugagagaccgagacaggaacaucacuugagcccaggaguucgaggcuaaagugagcugugagcacaccagugcaccccagccugggcaacagagugagacucugccccaaagcaagauaaaauuaucccacaggauuuuaguccugacuuguguauuacuaugcaguugugucugucugaggcucagauucccccccauuuaggauuuguguggcuaaaucucagaucucauuuucaggugaauuucucuauuaagguuauaaaagaccaaaauaacuggaaauucaacucuguacuugaauacuugguaaugcccagcauucucuugacuaucccauuucacaguuugccggucauuuccccaguguacucacuggauucuucccgcagccaugaaagguagguauaauuaacuccaguuuacauucaggacaauagaauguucgucaaaaugcuuuugcacauguuuucucacccugaguggcuacacuuguacagucauacccuccaaacucuaagauguauacucuuacauaccaaaacacaaagaaacaacaggaagaacaaaacucaagaggucugagugacaucuugccuugcuucacaacuucagaguuugcauugcuuuaaaaacauugguuauaagugaguguggaaacaguguguucacuauuuuuaugcuguggcugugcugugcaggagcugggcuuuucgugcauuuuagacagaauugaccuugguuaaugcuugacuugggaacuaugcagaaacauccaggaaguggugguggcugauccugaccguccucaguuuugugaagcaacagccucugugccucuuucucugcaugcucuguugacggucuagucuugagagagaaccugcugcugucccgucugucauagccuuccuagcaacucuuaggccugcgugcuguguuuucaugaucucccccaaagcggcacuuugauguuuuuucagagucaaaguaucacuguggauauuuaucccaaacaaaauugcaaacugaucaaauguuaugucuuuugauaccaaaucaaaaacgauucuugguggcugaucagguugucuccuaaaaauuugccuuuugaaccuauacugccuuuaugagaugauuaugaaaguagaaaauagccugugaaaaaugguaccuuugcuaaaaagaaaaaaaaauuuuuuugaaacuaagagucucuguuguccaggcuggagugcaguggcacuaucuuggcucacugcaaccucugccucccagguucaagucucccgaguagcuggaacugcaggugcacgccaccacauguggcuaauuuucauauuuuuaguagagaugggguuucaccauguugcccaggcuguucucgaauuccugagcucaagcagucugcccaccuuggcuuccgaaggggcugggauuacaggccugagccaccgcgccuggccugcuguaagaaaauauuaaacuuaggaugggaaaugugaucugaacaggauuccugugaagguacccaguguaggucuuagucuccucuccaguguacauuuauggaggggcaagauuucaccauucugugaagaacucugcguguugacgacugcucacgccuagggaauaaauuucagagcaugcguagauagugccauuuucuacuuaaaauacuauaauccauuauuuacuucggaaaauaaaagcauuaaggcugaaaguuuuggguuaguaaucuugauguuuuaaaaugccuuagcauuccuucauuuguuuugcuugccacgugguuuugcucugauuuacacaccucugugcauggcuaauccacugugccacucuuggggcuuuauuaacucuucucugccaguuuuucccuuagagaauaucauggccauucucuaagaugauaaaugggacuaagaguaaaugcaggcugaaaaagcauuuaacaggucaaggaucugaagcuuuuaagaaggcaaaacaauaaauaagaaacccaaacagagucuugaagcacacccaucgaaacccaaguuucagaauuugcugcagccuugcugccaaaucacaguaaaagcugaaaaggcuuuugugguuaguuacgugugauacaagaaaucgaugugucugagagaaguaggauuucucuuuuugagggggaaaaauacagcaaggggaaauguuuuauuaacaauaaauaugcggcuuaccauaucuguagggcacagauuugguuaguaguauuuuggaggcaggauaaaggaagauccuaaaaucucugugcuguguagcuuccauucgagcugcacauguuaaaaacauucuaggauccacacaguuuaaacaagguggcuggcuuaggaaaugcuucuccccauuccuuggcauccccacaacccuauuccccuacuuucucuuauguaucuggacuggcuuuuaaaagauauuuagugaaauuuaauuuucuagggaaacuccacuuugucaaaaguguaguauuccucaaggauagcuuugcuggucggcaaaucucaguugaguguauuugugguuuaaaaaaaauucuuucugaauagaaauacaaagagugauaauguuuaacauuuuauuuuuuuaaaaagcuuuacgcuguguaaauuguggguugacuucauguuucuaaacuuugucuuuuagaaugacucucuuggguaaauuauuagcagacacucucguguugacauguccauuuuccuuuccauuaagcugucuccauugcaguucuguugauauggcuuuauauaguuuuccugagcuuuuuuuuuuuuuuuuuuuuuuuuuugguaacaagauaccuaugcaagcugaaaaacucuuggcuuuuuaguuuguaucacuuccagaaacuuuuagaugcuacguauagaaguggcuuucuuuuaggguuagguaagauacuuccuuuuuuggaaauaguuuugccauuuggucucgcugccugauuugugcuuuuucuucuucagcagguagugggaggcuguguauuguauugccuuuuaccagacacccagaggggucauguuggaaaauagcauccucuuagcaaaaacacaaucccuucucugagaauaaauugccaagucuuuccaggucauugauggacucucaggugcugcauuucugcacgucggggaacaagggugaagaacagagcuaguccagcacugcuccguccucccgcauuucuucuucuguagagucuuuugcaaacuagagagucuugcagagaguuguuggguuuucccaggagauacuguaugcaaagaauugucaugaagacauaaaaucaagucuugguguaaaacuuuuaauaaauuuaaaggcaugucucuguuuuucuccuccuccauggggauuuucaugugguuaguaauaaaacuguaggcaguuguaugucuagauuucuauguaauuuguuuguguucguauaugcacaccuguauacaugugcacauguauucaagaaagaccugcaguaugcuugaaaggauugaggugccuaguuugugguaguagcugaacagagugggaggucaaaguuaagucauugugaggcaagggaacuugacuuagcccuuuaagaauuggucugucccugcuaagccaaggcuauuaguguuuucuucccuagcuguguucugaaaugguucaccugacauucagcuggguugggggagaaccucuuuaaacaucagaucuuauuccggaggaguguauccagccuucucacagcauauccuguuaaauaucuguucaagguuagccuaggccuggaguauggacagcaugaagccagaucuaaaacagaucaguucauggauaaaugaugaauuuaauaaaauuugaaaauaaaccccacauaacuagugcugcuauugaucauucauauagccagcaggaguggugagaggcuuggucugccugagguguggagaugcuugugguggggggcaagguggacgagggcuggggcugcuccuggagcaucuuuacgcggguggaggagcucugacacaguggcaguguuuguaacacuuuccaaagggauuaaaauaauucuguagaguuaacccuaggcuaguguggcuugaucugaaacagucccagccagaagguaagaacuccuguguuauguuguuagcauacaauuugcugaaguucacauuuuaaauuuuauauuuaaaaaccaaaaaguaguacugaucauuuuggacuguuucaaagugauauuguuuuuacuuguuacaaacauuggcuugccugcaucuaauugcacucacaaugggccggaugugguggcuuacaccuguaauccuagcacuuugggaggcugaggcggguggaucaccugaggucagaaguuugacaccaacauggugaaaccccgucucuacuaaaaauacaagaauuagccaggcuugguggugggugccuguaaucccagcuucucgggaggcugagacaggagaaucacuugaaccugggaggaggagguugcagugagccaagauugugucauugcacuccagcgagugcaguguaaaucccuuaaggaaacaguguguugugguaaucaugauaucauaguaaauagguuuuguucguuauuuuuuucuuuuacuuccuuuucuaccagugacuaguccuaauguguucuaacuuuugaaaauaaaguacaaauuagauggauuuaaacauacgggaaguaagacggaaauucauuacuuuuaaaaaacaauuuguuguggauaagauuuagaaauggaaacacaauaaacuguguuuccaugacacagguauacuaccaaguucuuacaauguaccuuugagguaacgaauuuucaugucauuuggaguagggcugggccagugagucacucaucuccuuguucauucauuacgugaauaccuaguaaaugcccacuaggcacccuggagucauuuguguagaguggcaucucuauacaacuguucgacuaacugucggagacacccuaaucaccccagccacaaacaaauagaacauuguaugugugcugaaucccacaaaggccagacaugaugccaugagaccaagaaggaaaagaaauaauguggaaaggguuugggguggaaagguggggaaccuggaggcgggccacauggggccccagaagccauguugaggguuuugucuucaccaaaggaucagugggagauuaguguagaacauuaaacagaggugggguaugugucauauuuccauuaaaaaauucauccuggccacaguguaaagaauagauuagggaggaagccaaucaggaagcaauuggaguaggcaaugcaaaaggcaaagugaacuuggacuagugguggagauaaguugacugcagagagaguaggaaguaaaauuggccaggccuguguugggggugggcuugugagcaggauaucaaagauaauguccaggauucuggcuuggaugacaacuauggcaaugcccauuacugagcuaggagaugcuggaggaagaucagguggggacugugagcaugaguuugauuuuugcagauacuggguuugagacacuucugagucaagcaggcauuuggaaauguggacuggugccgagaaggaauucccagcagugacuugguuuaggugguccuggaaaguagaaacacacaugagauaauucuggggauggagcuuaaagggacgucagcguucaagggccagguagaggaucaugagcuguaaagggacccagguggcuccagcacagcgaggaaagcaugcgagugugauggccaggcuuccagggagagaggaggguuuuaaggagaacaacgugcuaaaagccacuaagaagccaagcagagugagaaaugaagaccuccacugggucuugcaagaggggaggccuuugaggaccucaccugagagcugaugaaugaagugauggcuggaagcagcucuggagagggaggaauacuguggggaggggaggaacugaagaaguagagaagcauggcugugcacaggggaggugggauggcagccagggaggagcagagguggaauguggaucuuguuuuccccaacagagauagaggggggcuaaaaguccauggaagggacucugcugagagggaaggguggauccaugagacagaaggggagagcuccaguaaggacccagaggucugaggacaggccaaagcacagauggagggauuagcuuuggaugguaagaggaaggacagauggccccuuaaacaugacgguaaugcaaacugcucuguuuuuuuuuuuucuuuuggcguuugugaugaacuuuguauaugcuuuccuuguuugauccuuaucaaaccuuaugagaagaaacuaccauucuccucauuugauggaugaggacccuaagcccuggagaggccaggaaacauucccagagucccucaggaggaggacuagugcugggcuccuuuccuccuguucugcugccucugagaggagccaggauugaaucguagccuuguccucugaccuggaggucugggaguaacucucuuaugacuuuuuuagccuaguagaauugaacaugaacuucauguuuuaagggaugguugcauuuguuugaauggucacuucuuuuucuaucaguauuagcuaauauagggagaaggaagucaugcuucucaaguaaagcaacaguaucuguguauccauuuacuugauugagcuuucuacugaauuacaggaguuaaauuauacuuuguuacacucuugauauuacaaaaugauggccaugccuuuauuauaaaaugacaccaguuauucuuuccuggaggaugugccuugugucacuagccgcacuaagcacuuccccacuaguggccccaugugguugugugucaucgcugacuaccuguuacaggugaggaagcuggguggugcagagacagaaagccgguggcccagucaggagcuccuaaguggcagagcccugucuccuggguuccuucuccugucuuucuugccucucacuugaaauaagagaggacaucagaacuggccugaauggggcccugguagggcaggaacaggacaccucugugguuuuguuaugauguccugaggauaaaggagugaaaaaaaaaucuuugaggaauugaagauuucuuuaugaaagauggcugaaacuccugacagcuuuucaaauucaucuuuggagaaacuuccguuuucucuuuccuguuccgaggcuuaaagcugcccugaaaucuacacauuuaucaacagucucuugucaagacuccagggagacaagaacucuuauacauugcuguugagaguguaaaacgguacaaccuuuauggaaggcaaauuggcguuauaaaugcguguuaccuuugacccagaaauucuacuucuaggaauuuaucuuaccaauacaccugcccacauacaaauugcagcauuguuuuugauaguaauacguuagaaauaacccacguguucuucagugggagacugguuaauacacuaagauauaugcacaaaauggaaugcucugcugcugagagaaaccacaaguaugcccugcaccccugugaauagaucuccaguauauuagguggagaaggcaaggcaggcuucuuuuuuguaaaguuaaggaggguaaauaagacugcauguuugcaucugcuuguauuugugcagacugacacuagaagggaaaccaaguaacugaaaaacacgaugauucaccgggguagguggggaaacaucuaggucgggacagguaugggagugacacaccucaguguacaucuuuguaucauuuuuaaaagucugugcuugcauuauguaucaaaacuuagugcuaucuccucaggugcaggguucucuggaacucugucuagguuggucucuuggauggcauucuugcagacuugccggaaaaccaaacaaaaggugugagugcaugccuccuggauagaugucuuuuuaguguaacuuagcacaccuuguacacugucagggcgccucucagaugagucaucccggcagccccugcuccaugagugucuuccccacaguccugagugcuucuaaaaucaucuacaccaguggaggcaaaacuagauauuuucuuaguuugcagaaaggaauauuuccagacaacaugaacuuguucuccuuuggucuccuuuuccuugucauuguucaagucacaaggucugcugauuaaauuuccccuuggguuucaaaagaacuugcuuguuugguuguuguguuuugccuuuuaauuugagaguugaggcccccaggugcaugugguaaagaauucaaagggcuaaauggguguguguuguucguuauuucuuugaaccucuuggcacuugaauggugucaguaauuucacuaauuaugguuggcaaagaaacucugacacauggcuuuggagcuguguuguucuuacaucauaucucuugaguugaaccuaugcucucuugauggaugaacucguaauucaccaggugcguggaucgcugugauuaauuguuucaagcuaucaguuauuuaacucucuagugccaaauguucaggagaaaauguaagugcaguguaauguaaaaucaagccggcaacuccagcaauuugcucuucaaacuauagcucuaucaguucccauucauuuauacacuuacacuauucaauuugucguuguuguuguuguuguuguguuuuugagacagaguuucacucuugucacccaggcuggagugcaauggcauggucucggcucacugcaaccuccaccucccggguucaagugauucuccugccucagccuccugaguaccuggaauuacaggcacccaccgccacacccagcuaauuuucuguauuuuuaguagagacaggguuucacuauguuggccuggcuggucucgaacuccugaccuggugauccgcccgccucggccucccaaagugcugggauuacagccacugugcccuggcacuacucaauuuguaauaaaucaggguaaguuauuuuuggugccaagucgauuaauugaauauagguuauuuugcaucuuagauucccucugacgacuaaaucuuauaagcagagguaugugagcaugagaacugugucgggugguccugaagagauuaguggauuagaaggagauuuggagauuuuuaaaaaagccucuggacagugaguuaaaugguggguugacacucuguggucgggacuuuuuggagagucuauaaaguucugcuguauuucucaagagcuagagagagaugauacuaugaccaaauuugguuugaauguauuauaauguacugaguaucacuaauuuguugggaaaugacuguuaaaaauacuuacugacgcuuaaaaauaucaccuauagcauuaguauaaguagccaacugauuuacauauauuucauguguguguugggagagggguguggauucguuaggccaaagauuucgguaauauauuuggaagagauaaaugaagauaaagagauaaauuaccuuuugaauaauuccaaaacuaaaaaugcuucccuuaauuuuuauuucugauuuucuuauuucuaucagagaaauguuucucaugugacaaauauaaugcuuucauauuuacuucugcaugcacaacuuuuaauuaaguauuaauugauuaauuuuuuagagacaggaucuugcugugucauccacuuuggagugcagugguguagucauagcucacugggaccucaaacaccuggguucaagggauccuccuuuuucagccuccugaguagcuggaacuacaggcauaagccaccuugcccagcaaauuuauuauuauuauuauuuuuguagagauggaggucuugcuguguugcccaggcuggucucaaacuccuggccucaagugauccuccuuccccagccucccaaagugcugggauuacaggcgugagccaccacaugcaguccguguacacuuucacaccuuuuaauuucuuuacucauuaggugcauucuuuagcaauuauguguaaaguggaaaugagcgugcaaaucgucauuuucuauugacuugcacuccagaauuggaaaauuggaaaacuguaggaaacuggaaaauuagaaaacuguaggaucuaaaacaaaucgcuucuaugacuuauaauauucacuuguagaacucacuggccuuugucagcuuucagaguaugugaacacuuuuugccauguaaguaguuaguccauuggcaauggauauauguaaguugguaucuucacugcaaacauuuaguuaauugcguuuauucuugagccauucuugcucuacccuuaggacuugauuuucaguagcuacagugguuauuccagaaguuguuagaauuaagagccaggaggagguacuauguaagcuacauuuagacuccacuggacacucacauauugcacguggaauaucuuaaagggguugugugcuguggucagggugggaauuaucucuuuucuuuccaugagaccuccacugugcauuauuuaagggccugucaauugcccguuauucaaguuuuguuguucuuggaggacacuauugccuauuucuuuccuuguuuaaaaaauuucauuuagguaggcuuagcauaguugcaguagaauuuaauaaauccuuuuuuuuuuuuuuacagaauaaaucuuuuuauuacguaaauacccuuuaauuugccuauuuuuaaaauucuuguuucugugcuuaccuuguuguuagacagccaaggggauaugcugcucuuuuuagugccaagguaaaagguaaagcuguaucuuaaauauuuguauuucucuuuggucuuggugacccaaagugauuugggucauucugacauuuaaucaaguuuaaacaacauggcucuuagaaguauguuuaccagguaaucugagggcugguuaccugguaacgcaauugagaaauuucaucaagacuaauugauuaauuuauuaagcacuuauuguccaguuugccuuuaauuuucauuuuucuaaguuuccauuagcuaucauggccucacuuguuauuuaauaaugaaugguuacaaauuguuuguguguuuuuguaauuagaauguaauagcaaucgucuaccagaugagcugacauuguaaugacaugaagucaguaacaauuaugccuuacaggaaaauuaauucuguaauccuaucaucccauauuuugccuaagagauucgauuuggcugcugcuaggcugcuuaggcaggugacagcauggugggacacuucucauuuuucugguuagacuacuuaaccauaacguucauggugccaccugaaaaaauaauuuuaucguuuuagacuuuuaaaauauuuuuaggcuuuuuuuuuuuuuuuggcuuaaaaaaagaaucuguucuacuuggguauuuuguucuccuuauuucuuagugaacaaagauauuugcucgacuucuaucccagaaggaccauccuuucuucuuccuuuuccuuaccucuaagggauaugaagcugugagagggaauugcauauagcaauaccauuuugauuccagugaaaguucuuaccuuucucuuuugucauucucaaccucuuaccugaagaguccauucccucaguauauagagcaucuggaagucuaaggugcaggcaggacugaaagagcugagaaaggccucacaucaggugacacuggggcaccuggcugugcucccuuguuggggggucccuuggccugggcaguuuugcgcuucucccuguuucccugugcccugagacuuugugggucacaggcaagggggcuggccucccugaucaagggcccuuggccuaggagggccccuggauuuaucuaguccagcuucucgucguccaggugcaaaacugaugcucugagauguuuagggauuuguccaagagcagaguuggagccacaguccaaaucuucugagccuaguaugguauucugucauccuugguuucauuuuguucuguucauaaaaauugcccaaaacugcugggcaaaguggcucaugccuguaaucccagcuccucaggaggcuguggaggguggauugcuugaggccaggaguucaagccuagccugggcaacauugggagacccugucucuuaaagaaaauaauugccuaaaacuauucaggguuaaaaauuugucucuaagcuuaagaauuuggaaaaacucagaaaaguagccaccuauaacuccagcauucugagaacaguuaaguguauuuucuucuaguuuuuuguuuguuuuugagacgggaucuuacugucacccagguuggagugcaauggcgugaucacuacucacugcagccucuaccuacucaggcucaggugauccucuucaccucagccucccgaguagcugggacuacagguguacaccaccauggccagcuaauuuuuguguuuuuuuuguagagacaggguuucaucauguugcccaggcucaucucaaacuccuggccucaagugauccacccaccucggccucccaaaguccugggauuacaggcgugagccaucaugcccggccuucuucuagauguuuaaaacaaacacauuuuaguguaguugagccucugaucguuacauguuuauuuccuagcauuuaaaagccuuucagcgacauacacuccuuauuagcuuaauuuuuucuuuuaagagcuguguucuugcucugucacccaggcuggggugcagugguaccaucguaacucacugaagccuugagcuccuggcuuaagugcucuucccaccuuaaccuucugauuaacuaggauuacaggugugcaucaccacgcccagguaauuucuaaaaaaaaaaguuuuuuguagaagugaugccucgccauguugcccaggugucugucuugaaugccuggcuucaagcgauccucuccccucaacucucaaaaggcuguaacccugauuuuaaugguaguguaaagugacaugggaugaaggaaccguaacauucuuaaaguuuccccauuguugggcauuugcauuggucccaguuuuuuauaaguaaagaaggcugcagcaaacucuguuguacuacuuaaucuuuguccuuuauuucaaauuaucucccuacaauacgucccuugaaauaggauuucuguggaaagguaucaguuuaaagcucuugacccauauggccaaguugcuuuccaaacagcuuaccuguugagacucggaccuaugcuucuaaagccuaugugugaaauguucacauugucuuugggagaagcuucccacgaauaagaaaaauaagggaagaacaaauaacauaauuguuuggauauaugcugugguuuguguggacgucucccacccuuucccuuccccagcccaagucagucuucuguauaaacaacuuacauaauacagacucuucacuguuuguauuauacauguauuuugugagucugugucaguauuuguuuacacgggaauuagggcaucaggcugucuuccuaggguuccucugugcagacuuguagacaguauggguucuuugcgugcugaguugagguggccccaaaccuuucagacaguugcucagauaccuggcaguugcucauuuacccuuccagaccuuccugccucuauauuagccaaugacaagcagaugcuuuccacaaaacauucgugugugaacuguugacauuuaugacuguuuucugagcccacaccaggucauuuuucuauaaaaucagaacugugagagcucagggcauguggccauccuggauaauggguccugcugucuggggagucguuuucaucaaaauucacuuuuaaagaauagaguguuuauuaacgaaaauaugugagccuuggcugggcacuguggcucccgccuguaaucccagcacuuugggaggccgaggcggguggaucacaaggccaggagaucgagaccauccuaacgcggugaaaccccgucucuacuaaaaauacaaaaaaaaaguuagcugggcgugguggcgggcaccuguaaucccagcuacucuggacgcugaggcaggagaauggcaugaacccgggaggcggagcuugcagugagcggagauugugccacuugcacuccagccugggcgacagagcgagacuccgucucaaagaaaaaaaaaaagaaaguaugugagccuuaucccccaaauguaccugacaugugaauaauauggcucaaacuaaugauguguauaauauuaaauugacuuuguuauuauaagugauacauaauucaauuuuaguuaaaaugcauuauuucaaucaauaucaaauauugcagaaggaaaaccuaaaauaguagccaaaguuacucagaugagauaaagaauauguuuagggcuggaaaaucauacuauuuuuuuuuuuuuuuuuuuuugagauggagucuugcuguguugcccaggcuggagugcagugacaugaucuuggcucacugcaaccuccgccuccaggguucaagcgauucuccugccucagccucccaaguagcuaggacuacaggcacgugccaccacaccuaauuuguuuguguauuuaguagagacaggguuucaccauguuagccaggauggucuugaucuccugaccucgugaucaccugccucggccucccaaagugcugggauuacaggugugagccauuacguccagccuuuuuuuuuuuuuaaauaaagagggucucaggcuggcgugcaguggcacgaucucggcucacugcagccuugaccuccucugcucaagcaauccucccgccugagccccccaaauagcugggaccacaaguaugcaccaccauaccuggcuuuuuuuuuuuuuuuuuuuuuuuuguauuuuuuguagagacggggucauucuauguugcccaggcuugucucgaacuccuggccucaagcgauccaccugccuuggcuucucaaagugcuaggauuacagaugugagccacuaugccuggccaauaauuauauaaauuuugauauaaauuccugcucuucaaggagauguggguuuuuuuuccuccugagaguauauuuauaaaguuaauuggauuuuauacaaaagaagcuuuugacucauuucauuuagcuuuuaauguuaucaucugggaggagauggugaagaauucuguuagccaaaccauggcgaauuaauguuucuuacagaugguuuuauuacuuuuuaugauauuauuuggaucaugaaacaaguaucuuggaaaaugugagauacaaagaugugaguugggaggucucucuuguaugugaguuccuucuauaacagagaaaggauacuuucaguuuaagcugagaugcuuuuuccuuuucacucuugaaaagucuuuguugcaggaauuuucugugcccucccuccucugggacagaucugcuucuugauacugcagggcuccagccuuccuuccagccagcucauuucucagggaagccuuguuuuccuuuuucagaaaauuuaaauguauauuuaacgcacaauuuaacucccuuuccuguugauaauuuuuuucuucuucauauuuuguuauuaauaauagcuuacagaaugggaucaguaucaggaucgggagguaaccaggucuccaaguuuucccuuucguuuuucuuuucugcuuuuaaugagccuuaauuaauccagggagcuaggcugcaguaucuguggcucucccugauguuuucuuucugccuuucugucuuggaggggaaccugaggauuuggaaguagagggcucuacuagugcuuccuuuuuguccuuuucucauuguccaaaagagucuuaagcgaucuccaggaaauccccugcuccugccaggaaucugccugugaguauuugagugaguugcugcuuuuuaaguaccaguugagaagcugaagguugguguugugguugugauaaacucccaacaugaaaacugaggaccaccagcguuuucagcucaccuuugacucacgcuggcagcuccaggaacacugaacaggaguccccacugaaccuuugcugcguuccgaagcagcacagccaugguuaggcacugccaggcagcucuuggaaaccacagggagggaaguuuugguuccuucuuucugucuuuguuuuugagaggaaugagcuuggaauaaaagaacgcuaguaaugacugauuugcagguuagguguaaacauuaaauccucauaacaggcuaaugagaggugggagaaauuauccccauuuuacagaugaaggaacagaggcuccuagagacuaaagaacuugcuacucaaugaggucaggauucacaccuagguugaccugaggauagcugcugcagugcucacccuuccuaccuucccaagaaacaauacgcagagaauuucuuuucuaaauauugugugccuagaaggugcuuuguguuaucgaaacagauauauauguguauaucuggucucuuuaaaauucucuuuaauaaaaacaaaaagugaugcuaguguaaaauaaaagauauauauagaaaauuguguguccucguuaaucuucuuuaggaaagauauaugcauauaugcaguauaguuuuggguuuuuauaaaaaugagaucaugcuauuaguauagugaauagccucuauauagucuuucguaacauuuuuacuuuuucucgguguauggauaucaauuuaggucaguugcugcggaguuugaaacgaguuaaaauuucagcaguucacaaaauggaugauucauaguuuagucgagccaucaucuguugauggacagucaugugguuucuuguuuuuucuuucucuguguuucacuaaugaaacaggauuacaguaaauugacucguguauguguauacauccaucuuugcugguacuauagaaaaguguauugcuggcugggcaugguggcucaugccuguaaucccggcaauuugggaggcugaaguggguggaucaccugaggugaggaguuugagaccagccugaccaacauggcaaaacccugucucuacuaaaaauacaaaaauuagcugggcgugguggcaguggaggcugaggcaggagaauugcuugaacccaggaggcggagguugcagugagccuacaucgugccacugcacuccagccugaaugacagagcaaaacuccauugcaaaaaaaaaaaaaaaaaaaaaaaaaaaaaaaaaaaggcauuacugccuuguuccugauuuaaauaaaaaaauguguuuuaacaaggaauauguuaaguuuugguaaauauaguuuaucauauuuaaguuguguauacucauucauguuuuaauuuuuaucggaagaggcugaugaauuuuaugaaaugccuuuuuggcaugauauaauugugagcuuuugcuuuuauuuggugguguaauaaauuacguugauuagauuucccaauauugaaucaucuuugcauuccuggaauaagcccuaauuuguuauggugugauaaucuuuggauauguugcuauuugauuugcuaauauuuuuuuaaaaauugugacuguagccuacaaagcccuacagauaggggucuuuaguuuuuuuccuuguuugcauucuaucagguauugauauuaggauuauguuuuuuaaauaauuuaagaagaauuucacccuuucccagcaucuagaagcauuuacauaauauaggaaauaaccuguuuuuuuuuuuuuuuuaaguuagaguaaaauuaacuggaaaacuucauaggcauccccuguagucccaucccagaacauuuuaaaacaaauuuuuuaguuuuucagaauauauuauaguuguucuguucagcuuuuaagccuuuucucuggauuuugauauuuucuacuugcugggaaagaauuuaucuacaauuugaguuuaucgcacaguuauuuguaauauuguuaucauuucucugguaaucauaacccuuucucauuacuaacacauauuuuugcucuuuuuuugcuuuuuucccccuuaaucaaguuuguuagaaguuuauauauuuuauugucuucaaaaaacuagguauauuaauuuuauauuuauccugcuuuuaauuucaucucaguauuuaauuuuuauucacuuuuuccauuccuuuaaguuuauuaaguugaaugccugucucauuugcuuuuuagucuucuuaaaauaauggcauuuaaggcuauacauuuucuuugaaaauugcuuuuguuacguauuuuugguuuuagacaguugaucuccuuuuuguuguuuucuagaugguuuguaauuaaaauauuuauuugaucuuugauucugacauuacuuagaaguaugucuguccuugaauuuuucuuuugcuuaccuuuugauauuguuuauaugauuuaugaaugcagcucugagguaucugagaggauuuauuaacguuuacuugcauccaaguacaugauuaaguuuuaauugcuuuguggacauuaaaaaauuaugcccuugguaaaaugcaaagguuuuauuuucuguauuuaguaaaucaaacuuacugauugcauuauagucagaucuuccaaauucauguauguuuucaguugucaaauugacaguuaaugaugcaccuuuuauaauuuuuuuuuuugagacagaguuucacucugucgcccaggcuguguagugcaguggcgugaucuuggcucacugcagccucugucuccuggauucaagugguucuccugccucagccuccugaguagcugggauuauaggcacaugccacugcaccuggcuaauuuucauauuuuuaguagagaugaggucucacuauauuggccaggcuggucucaaacuccugaccucaaaugaucugccugccuuggccucccaaagugcugggauuacaggugugagccaccacaccgggccccuuuuauaauuuuuaaacuuuucauauuuccaagagaaaugcuuaguguauuuaucugccguuuugcuugaugcaucaauauguguaauuuuuuuauuuuucagggauuacauauuuaucacauguaauaucccucucuguccaguuuaaugcuuaauggccuugaguucuugguuugauuuuacuauugccagcuuugcuuucuuuuuacuugacuuugcuugguauacucuuguucaauuguuuguuuuuaaauagagcuggacuuuuaaaacccauugagacauuuuuguucucuaauagggacguucugccuugucuuucuuuacugugauaaugcauacauuuugcuuuauugcuuucaucuuauucaaugguugccauuuauuuuacuuucuguuauucucaauucccauguuaauugaacaaguccuuugcuaauuugaaaaguguguuauuuucaaagcuaccggugccuaacaauuugaaaaucuguauuuuucuccugaaauagguaccagcauuaaauuacuaauucuuccaccaggguuugcauuuccgcaauuucugccguucccaugacuuucucugucuccuggauguguucucugucuuuucacucauggauucuaguagauucuuauuccuugcucuugggcgcucgcauuucuucuucuuaauccuccagaaucugauacucuagagcaacagaucuuuucuguucaauuuaaaauuuuaaaguguuuuuuuuuuuuuaauuccugaaaguuuuuauacuccaauugugucuccacauaugcucuuagacuccucuucccgucuaguucuccuuucuugguucgauuaguucuguuucagcuggugccaccuguugcagcugagcuuggucacccucccucaggcuccugcgucguccucagugggucaugguuuuucuuugcuugccgauggcugcccucagccgucacacaagucauggguuagugucacucaaggaauggcagaccagcagaugguaggugauaagccaggaaacagauacugugccgcugaguugcucuguucccagucucuuccgacaacauaaggcuugggaacaguuccaccuuccauggaagccccccuucccucugguuucaccugggacagcaggaugagcagggugcagggccuucuucccuguggauggacucucaguuacaaugaccauggagaacuguacccgcucucuguuuuggagauuugggagauccugagggccucagaaggcccucacucucaucccaugcacuaccuguaagcucauuagauuacuguccuuguuacuuuagagaggggacugugagggaggcaggaccaaguauguuuauucaggccacugucuuccccauaaagacuauauuuguguacauuuuucuuugcuguauugugagaaggagguagaaaaaagaugugcaugucugcauuuggaaacaguucugagaguggugcugcaucagcggggcuggauugcccucaacuauaagaaagugggauacuuauauaaaggaagcauaauacagcauguuucucuuacaggaaggacuguuucuuagaguccucauccucugucuccaucacucaguauagcaaaucauacauuccaucaauguuaaugacaucaauuguaugccuguaaguauguacacacgcacaggggcagggggcacuucuucacuccacagcuggaaaacuugggacaaaaugccuagccagcuuggcccaaauuugaggguauugccaucuguaucucagugcagguguuucugucugauguucacagucuguuuauccagagugccccagaaaggacaguaguguuagguuaaaccuguguaugucuguucuugguuuuaauaacaguccugucuuuggaauuauuuaguguguucucucauuucucaggaagucaggauguuagugccgaagcacuucucugacuugguccgacauugaaguaccuuccccugcauuacagaagaacggccccccagggggucuguuugaugaacacauguauuauugcagugagauacucuagaaauagcuucauguccuugcaaaauugccagcacaaguaaggaccuggaaauuguugcuaugcauguaugucagaagauuucuuaaccaauucuguacugaauaaaauaaaauuuauuuucaaguuuuguagggaccuggggcaauaugucagauagaguugaauauuuucaaggcauuuuuaguucauggggcacauaguuggcuuaagauaucuauguguaucaggacugaaagguaaagugcccgaaccugcuaaugaaagaggugucuguguggccaucugagguucagccacaaugugucuugcagaauuauuuuauuuugcuaguuuuuaauuucucaaacaguucagcugccugucccgugguaccgugagacuucuaauucaagaugaccaguauuugcagacagagccacugccuuugcugccacauuuugcuugguuauugugugagaacaccauuuuucucuuuuuaaaugaauuguguuucucuuuuuaaauugagcaucugacugggcgcgguggcucacgccuguaaucccagcacuuugggaggccacggugaguggaucaccugaggucaggaauuugagaccauccuggccaacauggugaaacuccugucucuacuuaaaaaaaaaaaaaaugcaaaaacuagcugggcaugguggugcacaucuguaaucccagccacuugggaggcugagggcaggagaauggcuugaaccugggaugcggaggucauagugagccaagacugugucauugcacuccagccugagcaacagagagagacugccucaaaaaaaaaaaaauccguuuacauagugauaaauaaaguaauuacuauagugguggcauucugccuaagucaucuugaaaacugaaugcaaaaucuuuuuaauagcuccauaauggucucuugaaguguuacagauuuuuauaacgauagcuguaauacaagugccuuuauuuacugugagacuugaacauuuugaccauuuacauggguacuugugugucuccagcugagcugagugcaugucgcugcggcauugcaggcgugugugcauguuggcucuugcaacggggcgucugccagggguugucucgggcaggagaaggaggccagacuggcaccacuuguagugauuggaaugugucuaguccagcucuucaguuccauguaggagguuuuaggauggagauuguguuuugggaacuccaagucacuguccaauuuggagaguauuauguaagaaggcuuauguuuucugauuacccauccuucgauacagaccaaauaauaccacagugauaaaaaugggaaaggagcugucgcucagcucuucuuggccguguuguuugcuuuucgaugucuaauuuaugaaagcauuucaaagugacauauauacugaacagcuucgucuugccaaauguaaaauaaacuggagaugaguuuagcacagagcuuuguagauuguuguccucuugguagagucggggccuaaacaccaccuggccucugugccaguggacaggugaccugccuguccuacugcuggucucugcagcucucugucuugggcaacccuggcucugaguuccagaguguucuccaguaggagagucugcaggggcacuguggagcaccuggguaugugcacaucuguuguuggcuggcguugucucugauggcuuggggugucacagagacaugacaguacugucacugcauaccucucaagcuuuugcugaguccuacaugaguugcaggggcagagagggagggagaaaacaaugccuagccacacugagaaaggggaaagugcuacagaguccuggaaggaagcgaggauggacauggacggggaagcauucauaccaggcaggaaaagugacuucauggaccagucacagaggacagggccagggaucaaaccuuccguaauuugccuccacaguuugucugagacuggcuaccugguugagucugccagagcccugugugcagguacuaccacucacugucaccuccaggcaggaaaggccaugugaaugcaugcaucuuugcaggaacuugccccuuuccacugagguuugaggcagacuccaaccacauuuccauccaguggcuuaguggucuuacccgugagcuugaacuguugucccugccaggacagucuuugccucuguaaguaucuccauauuccuccauccuuucaggucccauucagucccuagguccuccaugauggaauauugguugaugcacuuauuccacaaacauuuguuggccaccuuucaagugccagacaacccuucuagguauggagggguacagugaugagcaagccacuguuucuggcugcagagggcucacuguuuagugggagaaacagacaaaucauacaucuuaacuacacugcccuugauugcucuuuaccuguuauaucagucgaucuugccugccuagcauuuguucccuguuugggggccuguaugauguucguuuggauaccucaggguacauuuucccaucuuugugaugauguagcucacuuggucugaaugauauguaauccugcacauguagagugaccauuauauuugcauaaauagcauuggaggaauauauaagaaaugaauaaaaguuguuauaucauuugauuuuucuuuucuuuucuuuucuuuuuuuuuuuuuuuuugagauggagucuggcucugcugcccaggcuggagugcacuggcacgcgcauagcccaucgcagccucaaacuccugggcucaagugaucgccugccucagacuucauuuugauuugugaaccucgugauucuauuacuuguuccacaaaaaauuuuaaaugaaaaaauauuucaaaaauacauauauuccggccaggcauaguagcucaugccucuaaucccaucacuuugggaggccaaggcagacagaucaccugaggucaggaguuucagaccagccuggccaacauggugaaaccccgucucuacugaaaauacaaaaguuagcugggcgugguggcacgugccuguaaucccaguuacucgggaggcugaggcaggagaauugcuugaacccgggagguggagguugcagugaaccgagauugcaucauuaugcuccagccugggcagugagugaaacucugucuccaaacaaaacaaaacuaaaacaaaaacaaaaacaaaacaggcugggcacgguggcucaugucuguaaucccagcacuuuaggaggccgaggcgggccgaucacaaggucaagagaucaagaccauccuggccaacauggugaaaccccaucucuacuaaaaauacaaaaauuagcugggugugguggcaggugccuguagucccagcuacucaggaggcugacgcaggagaauugcuugaaccugggaggcggaaguugcagugagcugaggucgcaccacugcacuccagccuggcgacagagcuagguuccaucucaaaaaaaaaaaaaaaaaaauuccuccacaacauauauuccaauguuuaguuuuucuguuacagagaucacauguacucuaacuugucaacuaaauuuaaaaggaaaagacaacuuugagagaaaauuaaaaccaaugcaguguguguaaaugccauuuugauaagcucuuauuucauguugacauauucuauggugcucgucuuacauaaccuaguuagggaaauguuuuguuccagucuggcuuuguuuuucuucauguguuuagguccuuccacuuuccuuuuguuaauuuuugguguuguacuucaggaaaugaauugaggguugcaaaugaccuggagggccuuaguuuguuugcuuguuugauuuuagcaacagucaccgugguacaccugacguggcugggacuccugauuuuuuuuuuuuuucuuuuugagaacaaagaauguguccuugucuuggcauggacuggguagccuuguucaccuccccacccaucucuccuuauuggugaggcauuguaaaccguguuaacagguagcauccacagaacccuggaaagguugugaagucccuuuggaagccuaaggguuuugaucucauccagguuguaaucuuaaauucugguacaaauucccuuguuacaacuggguuaagugguuuuaaccucuuuugugccuucauuuugaaugcuuagacuggaaagucguucagagacuccugaccgaauaaagccuacuuccaaaugaguggguuguccaggugugcuuguagaugucacauacuucuaacaaggcucugcagcugcgaugucaccuugcccagcgugaccucauuagcauguauguggcuuucaguggccauguacuuugcuucuagagcuuucuuucccauucuggguucuuaggagggggcugugcuuuguguguggccaggcagaaguccauguuuuagcuuuucaauucucuugaagaaaacaaauguuguugauaagaacacuugucauggcauccgauuuguucuugugagggcuguauuagcaauaaauagacauuuaguuugcauauuuaacaccucaucuucuuucagcccacacgucuucacuacaggauuagcuuuucauuacuuaguagagcuuuuaauuaccugaagcuuucgugucuuuacugggauauaacuuuucuccuuauuaaccagaaaaagucacagaaaaucuuguaauuuauaauggaauggaguaauauucacaaacaggcuuuggcaggauuuuuuuuguuauuguguuuuuuguuuuuguuuuuuuguuacacuaguuuuaucacaagacaagaaagaggggaacuuuuagaaauaaaaauuaugugcuaaaauaauuaaccuuccugaguaacacacacagaauguugguauaguguuugcaccagaggaauuacauauggaagaaugcugggaucuuuuaccaaauaagggaaaguagaguucauuacaaauagaggcuucuagcacagaaaagaggacauuuuauaaguacugugaagcauuuucagagauaauuaaauaauagaaaauauuaaaccaauuuaaacaauuuguaguuuuuuucuaauaaccaguaaguucuucgucuucgaauaauucuuuuauacuguucuauuuccagcuccacugagugccccuguguuuucagagaaaacaggagucuguuuuggacuuccucuuugguauauauggugggagauuuguuuaaaaaauuuuuuuauagagguaaaauucauaugacauaaaauuguccauuuaaaggugaacaacucagugacaucuaguauauucauacuguugugcaauugccaucucuaucuaguuccaaaauacauuugucaugccgcaaggaaagccuguaccccuuaagcaguuaauccccauuccccuuuccgcucagcuccuggcaaccaccagucugcauucuguuucuauggauucaccuauuuugcauagugcauauaaaugcaguuauauaauaugugaccuuuugugucuggcuucuuucacuuagcauaauauuuuuaagguucauccauguuguaauguaucaguacuucaucccuuuuuaugggugaauaauaguccauuguauccaguuguauccagaagauuugcuuuucauugccuaacuucagggcuucagacaccucaaucuuuguucugagauggauguaaacuuaauguauaucucucucucucacccaaugaucaugccaacaccuuuuuuuuuuuuuuuuuuuuuuuuuuuugagacagucucgcuguguugcccaggcuggggugcagucuugguucacugcaaccucugccucccagguucaagugauucuugugccucagccucccaaguagcuggggccacaggugugagccaccacaccuggcuaauuuuuuuuucuuuucucuuuuuuguuuuuguagagauggaguguugccauguuggccaggcucgucucgaacuccuggcaucaagugaucugcccgcuucagccucccaaagugcugggauuacagacauaagccaccuugccuggccaugccaacaauaauuauuuagaaguauguugagaauacaucccaauaauagaagugaaagcucuuuaaaaagaaaaauauucaaaacuuaccagcugaucuuauguuucauuuagaauggcugcauucuuugcaguacccuaggguuguagaaauucucccccaugauugcacaacccacuccuucucagccagugugcaccuggagucagcuguguuuggccuuaagguguccaugguccagcagggagagggcagaugggucaguguuguccugcuagugaugaguaucccauggugggcaugcugaugccacgcaagggagagggugucugguucugugcaguggcaguggugcaaccccuuaccaagguaccguggggaccuggguuagggcaggaggaggaagguguucucuacagacugcagggcuuggaggcagccugucauggggaaggguguggaugaagggugagccgggaccccaggcagguacggagcaguucaaggccgucaagugugcuucauucuucagucauuagggugucucugaaagguuuuucauugaaucagaauuccccuaauucacgaauucuaaagcuuaaguaaauucaguaauaauaaacugucaauuauccaagcgaugaauauaaauccauaagguuuuucaaauccccagaaaucccuuucgucucccaccugguuuugcugagcgccugucucuucugucucuuuucugauucccaccuuucacuuuuccuccauuuuucgcuuaauggauuuauacuuuaaaguagguauucugaaaauuccaauuuuaugaauggugugacggugagaacuuugauucauugaaagauaaaaauaaucauuacauuuuauacugcaagggucauccuuaauauucuucguauuuuuaauauagcugcaugauuugaguaguugaguuggggauuggauaauguauuuauugauugauuaacucucuggggguccauacauaccccucuuuauaucccuguggucccuuuuuaguccuuuuguaaaaacuugauaauguuaaccucugccaaaguugaugcgguaguugugaguggugggacgcaagcguguugauuuauucuuggagacagcagaaacagcaccaccuucaacuguuuugucaugaucaucuuguaaccauaauucugugcuaagucagaauuaauguuauuuuguuaauucagguuauugugaaaaucuccacaggagguuauuuaagcaagucacaaauugauguuucuguuuguagaaaaacuccagcucauccagccagccacauuauuccagggcugcauggugucagcguagggaccaggcucgguguagagaccaagggugccuuuccccuuccuuuccgcccguuaauugccuacucgcccagugguaccuucugaacuuuuagaaauccagauaggauuuccacaugguucauuagaauucauuuauuuuuuuccaucuguauuucuuuuuguuguacucccuagaucauuauuuuuaguuacuuuuuacaugcauugguuagguuuuucauguaaucucucaguaagcguacugggggaugagugaccucaguauuuaaauuuuucauaggugggaugaaaugucuuuucugagugugaguauuucuguuccauucuucuuuuccaggcaggcucucauucugugcugcaguuuggauucagggagcacugacccuucugucagguugcuccugcuaugaaggauggaagggcauuuugauacaugaggcauaacuguaauuauccgguggggcuugguuugugcuguuuuccaccucuucgucauauuuuggaaaacugaggccaaaagcaaaguucauuuuccccuuuaaaagcuucuuuaaaaaaaugaugaaagagcuuuaucaauguuuugaauaacccagaaaauauuucuuauuguugauaaucugcaguuugcaagugcagcgaaucuuguagguagauuuaccuugaguuuuuugaaacgguagaauuaauguauuaaaacauaugguuuuuaguuaaaauaggauguuaaaggaauagagcgcacgaacaaaaaacuuuccacuugaacccauguuguuucaucugacaguggguauggugucccuggcaggauagggcuuccaccuccugcuggugccgguaggacagggaagagguggggaacacugugucuccaucucccaagcaucuuaccucccaagucagaucccuggcauuguuugaauacuugcguguuuguguguggggugauguuuuccugagaauguggcaaaauaauagaaggucccaggguuccucagucugcagaccauagcugaguggugugugccucuagccaugaggugaagcauaggugaaauucagauccauaggaagacagacagacuuugcaaguuaguaagcuaacuugcuagaggaaacgguagacuccugugcuggcugccaacuaaaaagccuuucuccacaguucuguucucauguacacccucaggaccuuggaugagcuuguguguucaggaaauugggcaccgagauuuuuuuuguaucuuugauuuuaguugauauguaguccuuccaaggaaaguauucguuggaugcccuuucuacacuuuggcauugugcaagagguaucaaauuuuaaaguaaaagugcacaaccuggccaggcgcgguggcuuacgccuauaaucccaguacuuugggaggcugaggcggguggaucaugcugucaggagaucgagaccauccuggccaacguggugaaaccccaucuuuacuaaaaauacaaaaacuagcugggcgugguggugcgugccuauaauuucagcuacuugggaggcugaggcaggagaaucacuuuaaccagagaguuggagguugcagggagccgagaucgcaccacugcacuccagccugggugacaaagcgagacuccaucucaaaaaaaaaaaaaaaaugcccacaacugggcaugguggcucaugccuguaaucccagcacuuugggaggcugaggcgggcagaucacgaggucaggaguucgagaccauccuggcuaacacggugaaaccccgucucuacuaaaaauacaaaaaaaaaaaaaaaaaagccgggcgcggugccgggcgccuguagucccagcuacucgggaggcugaggcaggagaauggcgugagcccaggaggcggagguugcagugagcggagaucacaccacugcacuccaaccugggugacagagugagauuccgucucaaaaacaacaacaacaacaacaacaacaacaacaccucacaacccuggucucccagagcuuccauauuaauaaaucuagacaaugugaaaugcaaauccacuuaauauuugaugcaaaaaaauuuuauuugaccuguuauuuuaacucuuugacauaaaaucucuaaaucaaaauaaucagcaacaguuuuaaguguauaaauauguauuucuuucagugcuugaacauuuuuagacaggaagauucuugaucuucuuuguaagcaaauagcaucaaagaguaacauuucuguaccuuugugguauguaccuuguggcuaauuuguccaugaagggauaggcauuguguuuuguugcuuaagucgcuuaaggccuuuaaagcauuuccaaacucaccuauuuuugcucuaagggguauaagguguuaaaaaaugaauggaaguuaacucauucucaccuugucugcuaacuuccuuuuguucuuuuucuguaagaacucauaaagcuguaugcaucagcugcucccaggggccuucuaaggccucaguccaacaacagugcuacaggugaggaaaggaaagaagacacuaugucaucaugucauucuuuuagacuugguaagaaguauauucaagcagaucagaugcucucagaaucacagcguguuguacugcuaguaauuaaaacugaaguccacauugaauaagaaauaauuuuuuauugauugcuggcauuugugagaaaggguuuaauuagaccaggauauggaggggacuuaucgacaguuccguuguacauuguugacaugguuauuuucuguaucucauuuugccugggaauuugucauucucuucuauuuucuuaucaguagcacugcuuuuacacuuauuagcccuagcuguuugucuugcuuauuuaaacuuguacauggcacaugcucaaagauuuuuccaggcaaaauuucuuuaaagcaggauuugagauuuucuauccccuuccgucugcuggauuauuccggugaguguuaaucucccgccuuugucuuagccucucuguggucuucgguugcuuccuuguucucuguagaucuccugaguuggccauuagcugucaacagucagcacuugcugccucucaagucucuuccccuccuggcucugcccugguuuugcucucugacggggaucuaaauugggauucuuuccaguguggaauccuggguguccaccaugucacucugacuuccagaugauaaugagugugaccaugggcugaaugaaugucucucugcugggauuaaaaguuagaggaaggcaaaaacagauauugcguguucucacguauacgugggagcaaaaaaaguugaucucuuggagguagagaguagagugaugguuaccagagacugggaaagggggcgaugaagagggguagagaaugaguacaaacauucaguuagauagagggaauacauucuaauagggugacuaucguuaacaguaauuuacuguauauuuccaaauagcuagaagguuagaaauguucccaacacauagaaaggauacauguuugaaaugauggauauccuaauuauucugaucauuauacauugcauacauguuucaaaauaucauauuaaccccauaaauauguacaaauaucacacaucaauaaaaaauaaaggggaagacauagguguaggcauagauuuuuaagcugagaaccuuuugacagggaagaccagggaugguuuuaggguguggggaaucuguguaaguuggccguuagcugucaacaggcaacaaucacugucucucaggucccucccgcucccugccguguccugguucuacuugccggcagggaucuaaguuggaauuccuuuccaacauggaauccugaguguccaccaugucaaaauugugucaaaauucgucuguaugcauuuuucuugguagaaggguccccaaaagucaccacauucucagagacuucugaucccuaaaacuuuagaucaacagucaauaaaaaggucccaguugugucuuaguccccauggcaguacuuuugaacauuuaaagguggagaauugcuacugaggacuuuguucuguggaugaaacuucgaaugaggauuguuggugagaguuggauuguuguuguaugaggaagugcaccuuggaaucuaauggggucuucacggagggggagucaguuguggcacuguuuguguauuccauucaucauucaucccuccauccaagcacccacguggagcucagaaagaugacuaacacauacccccugcugcuccuguuuuucuaaggugugcugggaccauuuacauuuaguucuuuggagaacacaacuacuuaggauuuuuguuguuguuguuguuuuccuguacauugucuuccucucucccuucugguacccauuccacccucucuccccuuccucacugccguuucauagggguucucagauuccugugaauaaagcaaaccgaugugcagauaugugugcuuacacauguggacguauuugaggagguaagagggaccugcacaaggcuuuagugaguaagcagagaaguuauuuauauauagugagacccaguaaacggugaugucgcaggugaggcaguugaucuggucagaauaugccuccagagacaucacuggugaggccugcaugcauguugaaaagaguguaucuuacaucuaggcuuggguuucccccugcagcucacuuaugaauaacaacguaugcaagagauuugaacauuuucauguucaaaugaaacaugaaaagggaaaaaauuuaagguuacgguuaaguuuggauuguuugcuuauugguuugguuauuggcaauugcuacaaaguccaggguguucuuuaucagcagcaugcuuaucaaguuacugacauucaagcugaguuuccuucccucccuccuuccuucuucuccacugacauuuuuuuuuuuuaaauagguagggaggcauuuaaucuuguagcagcaugagaguagcuuaaaugucccuccucuagcaguauguuuauagcagcguagguaaggaaagcccagcuugcacagcugagcucuaaagugcauacaucccuuaaguucucauacacacacuggccagugagacccccaaacugcgaacagagaauucuaauugaaguaaaagcaugaaguuuuucuuuauugaccauguagcaacuguggaaucauuugaaaauuucugaaaacaugaaacagguguuuauaaggaguuuucugacuuaacaaaauuggugaaauaccaacuuuacuaaaaacuacuaauucauaauuuuuugauuaauaauuucuagucuggaaaagaggaauuuuuugaaaaucacugauauuuuugauauacuguuguuuucaaauugaguucucauaguguggucggcucuguucuauggaauuaauauugaacaagcuguucugaaccuaagaaagguuuguaaaaaauaaacaugaaggaagacuucauucaagaggucacuuaaaaauuauuauuauuauuauuauuauuauuauuauuauuauuuuaagaauuaggucucuguuggccaggcuggagcacaguggcacaaucauagcucacugaagccucgaacuccugggcucaaacaguccuccucccucagccucucuagcagcuagaacuguauauguacaccaccacgcccagcuaauuuuuuuuuuuaacuuuuuuuuacuuuugaagaggugagauuauaggcacuagccacugugcccagccaaaaggucacuuuuuuuuuuuccuuguuggggaggaaucaauaacaggaacaccagucaugauuugguguuuuuuccagggcagacaaauaaagaugauauuacgauguuuguuaucacagaauauguuugcuuuugauagggguugggugcugaaggguaagugguuagaaucauucuuuuucuaaggguacagccauuaauacuccuugauucaaaucacuauuuaaguuauaaauacauggauuuauuuucuaaccucaaaauuauagcaucuuaccacauauuugcaugccucucuugaguuaacuacuggugaugauucuuagcucaucuguggccaaguauagauaagagaauuagaaaguuguuuccagcgugugaacuuuuaugauuuucuuccuugguuacuguacucaguucuuuuuuguuuuguuucuauacaagaugaguagcugguggcucagaugacccccgugcugcauguacagucccauccagagaguguugggggcuguguaaaccucgaggcucagaguggcugccauuuuccuaaaagagaaguauggcugcuguuggccucaauguucagcuuuacaaaaacucccguaauuaaugaaggucaaggcaucugcaaacauuaauggggucacaagggacaaaucaguuccuugaggggaaguuaaaaugcuagauugcuuaccgcuccagacaaggcguucucaagaaguaugugcaguuucagcacaaggauuaacacggagcauuacuugagccauggggugccuugggggacauggaucagcaaccauuuccuuuugcucacagcgcccagauuuuguucuggggaccacucuuaucugcacugcauagcagccacacauuuugagugaaauuaaccccaacuagcauucgagcguccuccccucccccaaaagauggacuguaccccacacuguaaucagcagggaggcauuuccuggccacaguucagguuggucccuuagaacgcugcucagaacugugguuugguggcucugggaagcagugcucucucugagugugaauaaggauccacauagcuccaguaggugucugacgacaucuugugauccggggggaagccagccuaaggacaaagccauuguggggugagagacaggauuggcacaaucacugacaaccgcaguaguagcccagaauaaacugugccugaaaccuacccuauuuuuguauuuuuuccaguuuuaaggaaauaaauccccuuuauuguauacucaguuugaaucaauuauuuuuaucucuuugggauugguuuuugguuaaucucagcaauucagaaauagcugaagaacuaugcuguggguuuagacaucaugccgugacaaaaagaagaggaucuuagaagcgggggacauucacugaagcuuuaugagccuuuccugaaucccuucaaaucagaucaaguucucucucuccugugcuuagaaaugcugccuguuaagucacguuggcuacagcacccaucucagaucccuugugauucaguuguaaaguagauucuucuggucugaauuagaggccaaaacacaagacagaucaaaaauggggaacauauugcaaauuuccccacaaaagacugaaggauguguuuaccauugauugcacagggacugcagugucuaugcuuuuaggcauggaaaaugcaggguuugacuaucgaguuuagauuuuaaaguugaggauuguuucuuuaagaagaaauauagaauauuauucaguccuaaaaaggaaggacauucugacacaugcaacagcgugaaugaaccuugaggacauuaugccaggugaaaucagccagucacaaaaggacaaauacucuaugugauuucauuuagaugagguucccuggaguagucgcauucagagacagaaaacagaaugauggcugcggugguggggggguggggggugguuuggggaagggaguggagugaugguuucacuuuugcaagauggaaaaaguucuggagguggcuggcggugauguuguacaacagugugaacuuacuuaacauugcugcacucuacuuaaaaaugguuaaaacgguacauuuuguuauggauauuuucccacaauuaaauuuaaaaggaagaugaguaguacucgacucauuauuggauauuacaucagggaacuggagguagggucucacuuacuaguuacguagcucaggaaccuggaaccagacuccuucuccagcugggcagucccagguuugaguccuggcuccacuggagguugucugacuuggagguuaauaauaaccugccuuagucccagaguccuuagagggaaaauagguuauaauaccugaguccauguguaucaagccauugcugguuccaggccccuggagcacucagaaauggaugacccccagcugggucaggccaaguccucccugcuguagcaagcgggaccauugccucguuccccccaccuccacauggaaggugccuuuuguguccugccccaucucuguuuuaacagucacaagacuguaggcagaucuaaacuuguuugcacauuauuaucaccuggggagcuuugacgauuccaaagccaggcugccacccccaccucuagaccaacugaaucaccauuuccaggggugggacugggcauccguguuuucgaggcuucugggugaguaccuugugcaaacaaguucagggaccguugcccuagacacuguucuuccccucaugucucaaccugggccuccuaccacugccaccaccacagcuaugccaccugggaugugucccaagcccccacuugucggggaagcagcuggggaggggucuuuggccaccucugcagcuauaaggaucagagcaacaccuggcuucugugccuguggccccugcuggugcugggucccugguccgcacugaaggauccaggcagaguacagugggucucccaggucagaauccccuggguugcuuguuaaagcucacagggcugggccccaccccaggguuuccgauucagcaggucucgggcugguuggaugaugagaauuugcauuucugucaaguucccaugugauccuuuuuggggucugggaccacacuuugagaaccacuggucuauuaaacaaaucuuugcaaauuagggagguguguugugggaggaagagacugauaguugaaagaauauuugccuaaauacagugccuaguauuugccaaguacgcagccuucuuucuggcuuuaaucauacagacuuucucaaucacauguaauugcacauccuuuaagcagcuuuugacugacuuugguuuucucuuuuguggugauuuuccuuaaacucccgaagggaggguggaaggggcaagagaaauuuuuauuuauuuauuuuaauuuaauuauuuuuuauuauuuauuuuuuuauuuuuuuuuugagauggagucuuacucugucgcccaggcuggagugcaguggugugaucucaggucacugcaaccuccgccucccggguuccagcaauucuccugccucggccuucugaguaacagggucuaugggcaugugccaccaugccgggcuaauuuuuuguauugguaguggagaugggguuuugccauguuggccagacuggucuugaacuccugaccucagaugauccacgcgccuuggccucccaaagugcugggauuacaggugugagccacugcgcccagccagauuuuauuucuuuaaaaaagaaacuuacuaguuaucaggacacuuguguucuugguacuugauuuugucagcauuauuuuuaagagccucuucccuccuucccccuaccucccuguugagcccaggcucugaaauaacauaggugcaugugaaguuccccuaccugccauuaccagacauuggugcugggcggcccucaccuccaccuccucucaccugaggccacagcggugugcaaggauguggucugucuugaguguguuuucaaagcagcuguuuggucugugccuuggauguuuuuccacagauaagcccaaaagagaaccacaucuuaaaacgcccgugaccuugaauggucuuuccggaggggcggcuggauuugugcucucaucgucucagguaugugucaagccacuguuguuucagagcuggacacaggugcuuaggaaaauuccucacugaaggguuuucaggauuuacaaguucuugcuguuuuugugaccuugugugguuucugguuucacagaaggcuuuguuucuugguucuuguugcugcuuucagccuuggccuguaaucacugggcgccagggagggcugcggucuguuucccggggugugcucagauaccgugucaguucacauguguugcugcagcggcagggggccaggcaggaggggcggguguccugaagcacgcucaauuugcugaucagggccuucacuuggauuuugcacuugccgcaguggagacauuccucguagcuacucagugugguuuguuuuaagugggccauccguuaauucaugugaccuggaacuugguuaauguacuugccaagguuaaaguugagacgcuguuuguuaaaccuuucaaagagggaagaagguugccuugaauucaguuccaggguuugggagucugagagggagguggugaggggcccggggaggcccugagaaacaaaaugcugguuaaggacacagucugcucaccgaccucggaagucucuagacgucuaaagaaguccaagcaaggaaugaugaccgaagaggaaccucaagggugcaggcggcucugggaucucagcacaucucagugauggaaugagcugccggggaaugaccccugugggggcuguccaaagucagagcagacacaaacguagcucuccaggccccauaccuuggugggcaagagggcagcaagugcauccucacaguugauggggagagcagcauuucagccugcagaaaagagaaccacacagauguaagaugaggucugcacucacuugccuggucaugcagagacggagcugggagcagcugcaugacuuuucagagaaguggcacacguuuacuguaagggucccaaauguagaccacugcagaucguaaggucuagauggagggaccaauaguagggaaguaggggagaagaaaguaaaaccuuacaguauaaagacccauagaugcucuuuuguuuuugauguguguacggggguuagauauuuauugagcaccuacugcaugacagaguguucagcaaugacaaugcagagcuuaauaagaacagguucuagacuaaucuuuuagggggugaggauagaacagaaauagguaauuauguccugagaacaugagagaguguugguggacagaacggcgauguauccccaagggcaacugaagccuucacagaagaugcaaagccuguacgugguccucggagucaugccacauggugacugguuaucuuagucguaggaaaacugagaagcuuugaggcauguucuaucugucuuugugggcaucaucuucauuauuugaacaauucagagugcuugaugccuuuugcuucguucucacaauccuugacacuaagcugugggcuuggguuauagucacucauucuguuauucaugucauuuugccuauccuuccacuucacagaugagaagacugagacccagagagggucaugguuuucauuagccaaauggugcagaaacccaguggucacaguggcucucuagcucuuugucacccacagggcccuugauaagaguacggucuuucuccaggggagcaggguugaggagugggggcagcccuggccuggguggccauauccugauuuccccucccuuggcccauagcucucuaucuugggugaggugagaaaguaaggcugcuccuugacuguggucccuuuugugucuguccugcacugggccaccuucccaggggccuugugucagccugguaguggugcuaguggccuugaagugagaguggguggaucacacauggcagaucucuggcagugaccuuuucuguggauuuccggugacugaugauagccucuuuggaagucagcauaugcauagcucucugucuuuugaaaacaauggaaaaacccaccaccagccccaaaaccagcugucuuucuucuuaugaauagauauccaugaaaagcagaagaguaguuucuuguaaguacucugggagugcauaauacauuuuaaauaagauuaaaaauuauguuuuauucuuacuagcaucacugucagauaauugagcgugagagcauucagugcugugugcuugguacgaaguaguaacaucaauucaguguucaguacauccacuuuguuccagaacaauguauucaaggucgguguauuuuggcugugccacagaguucuggaaauucccaagagaauaaguuuucaccuguuauauaauccagcacaagugacuguguagcagcaaccucauguuucaugaugacuuuaaaaugcaauugauucuaaaauuuagcuuuuaaaaauuucgacuucagauuuucucugaagguuuaagguaggcuucuccuuuauuaauuuuuucaagaaauauuuaagaacacugcucugugcuauguaccauucuaagcacuuuacagauacuaauucauuuaauccucagccugguuagguaaguacugcuauucccaccguacagaugaggaaacagccucagaggaguuaaaacaaguugcucagguuacaccgucagcgguuuggacuacuucaguuucagauaaucacugugaaauuuuacuguuuugagcuacacguuucaaaaucuuuucugaugcggaacuaucauuaaaucauauaauccgcuucucuggagucagagguugacaacacauuagcacuugacucgagccucucccuggaggaggacauuccgucugcggggagccgaguccgaggcuggagcaacucuggaaccacagcccuccaguagagggcacacgagagcaggcuaucuguggagauagccuguuggcacaggggugaagaugacagaggcgaacccaagcaaagagaguuaauuagcagaguuugcccuccaggcucggagggcaagucagccuggggaccuggaguuaguucccuuuucagcugugaccauugaagacauucaucaaguucucuggcuccgggaugucagcugugguagugacuugcaugggagguuauccgacauaccucacacacuuuaacuccaccucuucagaguuuguggccaagaauggagccagguggcuauuuuuuuuuuuuaaauuuauguaauaacaaacauucgcauuuauugaaaacuuaaaguauaauaaaaaaauaaauaaaauaaaaaaagaaaaaagaaaacuuauuccugugucaggcacuuuucuaagugcuuugcaguguauugucucauuuaauaguuguuuaaauuaacagaguaggccgggugugguggcucacaucuguaaucccaguacuuugggaggcugaggcggguggaucaccugagguugagaguucaagaccagccugacaaacauggagaaaccucaucucuacuaaaaauacaaaauuagccacagugguggcgcaugccuguaaucccagcuacucaggaggcugaggcaggagaaucgcuugaacccgggagguggagguuguggagagccaagauugcaucauugcacuccagcuugggcaaaaagaaugaaacucugucucaaaaaaaaaaaaaaaaaaaaaaaaaagagagagagaguaaauaaaauuguaaggugaauauguuaucuacuugauggaauuuuuuaaacuaccuugaaaaguuuuauaguuuccuauuuacagaugaaauuaacauacuaauuauaaaucaugccucacuauucacuuuaggcagucuaucuccuuaaggaucuccuuacgguuuagauagauaagugaauugcuuaauguuuuuggaaguaauaaaacugcauuucuuuuuaauuaaacaauccagauaacaagaaguaauucuaauaggaaacuuguaggauguauuuacagaaaaucuacacaaucuuacugaacaauguagaaaagaagauuuaccagccugggcaacauggcaagcuuugucucuuaaaaaacaaaacaaaacaaaauuuagccgggagucguggcauacaauugucauguccacuucucaggaggcugaggugggaggacuacuugagcccaggaggucaagacuacagugagccacauuugugccgcuguacuccagccuggaugacagagcgagacccuguuucaaaauaaagaaaaagagauuuaaaugaagcgaaaugccauuuucucuaggugagaaacuggaauauuaucaaugucacuucuucccaaauugauuuauaauuuaaaaacaauuuuaguacuucugcagcuuguuuggagcuugauaaaaugauuguagaguuugucuugaagcuuuaauagugaggcagguuuaaaauugggggcaaaaaagaaauggguuuuaggguguagaagggacuugccugaucacuuuugcuagaaauaaaugucccuccaaauuaaauuacuaaugucgcacaucagaucguauuuaaauccauuagaagauuuuacuguuccauuagagcuacccauagcuggugaagacucugcuuauaguggaaccuaguuucucaguuuuccauuuauauuuauuuaccugagcuuuuuguaaaguaguaaguacuugacugaauuucugcuauuuaucaaaugcuuuuugaauagaaauaaugaguuaauaacauuuagccuuuuuugguaaauaguauaaacaagauagggcaaauauguaaacuacuuagaacuuuaucuaccuugcauauuuuguaccucuuauuugcauaugcaugucacaugcuccuuauguaccaugugcuauuacugugccgggguacuggggcuauauugagucuauuuccugucuuuguagacuugauggauaauuuggacagcauugugauauuccagguuuaagagucuuaagguucaagacuacauuaaauguuaauguaguccaacauuucuugaacucugaaauccucugagcaucuuuucaugcacuggccuaaaauguuuucauagcccagcaaaaggcugauuacuuauuucccuccuauugauuuuuuuugagauggggucuugcuguguugcccugucugcuugugaacuccugacuccggugauccuccugccuuggucuccuguuuauguuuuaaauagcauuucucaaaccuauuugagcaaauaacuuuccuguuaauauguaguauuccuugaaagaauugaauuugugagucccuaaucuagacacuuuuaaagaagaaacaaaacucaguaacacauuuggauaaaaaccugaauauguccauuuugggaugaaaggaagcagcuuuguuuaccauguugaauuaaguggaaaacaucuuauuuuaaucaugauugauagaaaucuaaauuuguaaauucugauuuuuauguuuuuuuuacaaugaaaauacauuuuaaaugucaccauccccuuccccaugaagucuucauuacaacuaauuuugaaaauacucucucauuuauuuauauuauauaugcauauguucuacuguauaauuuuaaauacuuaaaugggguuaucuuuuugcauuguucuguaucuuuuuucagcuuaauaauuuaccuugcuuauaauuauugucagugcuugcggaccugcucuuuaugcauuuuuaaccauugcauaaagcuggaaugauggacaugauuucuuuaaucacuccaaauuagucauuuaguuguuuccaguuuuuuaguauuacaaauaacucugcaauaaacgugucuuggguaugcauucuuuuaguuuaaaauagucuuguuccuucagaaaguugcucaauaauagacuuagaaauucuuuugugcuaauuacuguaauugcucauuuuaagaucuccuuuuauuguuuucauaguauauaauccuaaacuguuacaacugaaauaguccuugagcuaagaaagcaauguggcuuaaagauaggauuucuaaauagagacuuaaaaauuaaccuuuuuggagcugugacuuccugaugaaguggcagcacacaggcugaauauguucuacaucuggauggcccaacaucaugaugcugugauuugcgagaagcucucugccugccuaggcugcuggaggauggcaaguuaauuuauuuguuguugggagaccucccccugcccccauuaaaaaaauuauuuugaaauacuuguagauucacaugcaguuucaagaaauaauaaagaguaauuccaugcaccauuuuccuccaauaguaacauuuugugaaacuaguacaguaucacagcuaggauauugacguuaauauaguaaggauauaugucaucaccacaaagguacaccuacuucccuucuaucucuccucucuccuucaugccugguuacaaacuaaccuguucucucuauauaaaauuuuaucauuuaauaauguucuguaaauagacucauaguauguaaccuuuuggaacugaaguuuuuccaucagcauaauuccuuauagauucauucagguugcuguguuuaucaauaguuuguuucuuuuuauugcugaaugguauucugugguguaaauguacuacauuccaugagcauggcaugucccuccauuuauuuaguuuuucuuugauuuacuucauuagcauuuuguaguuuuuguaguccuguguauguuuugguagaguuacacccuaaguauuuaauuucuuugcucauugccaguauauagagauacaacuuauugaacucacuuuuuaguuuaugcuaguuuauuacuaauuaucaauacaugcucaagauaugucaacuccuuuuauuuuuauuaggugucacuugcuacauuuuguggagaauaccgaugcuguugcuagaaagugcugcugucacaaaguggguuuauagauaguaccacgcuauccuucuuccuaggcuagauuagaaguuauuuaugugcuauaugcacauagaguuuuugauuggucuauugcaaauacuauggcaucugaaauuuuuuuuuuuuuuuuuuuuuuuuuuuuuuuuuugagauggagucucccuuuguugcccaggcuagagugcaauggcgcagucucagcucacugcagccucuggcuuccggguucaagcgauucuccugccucagccucccaaguagcugggauugcaggcacccgcaaccacacccggguaauuuuuguauuuuuaguggagacagaguuucaccguguugaccaggcugguuucaaagugcugggauuacaggcgugagccaccgugcccggccccugaauccuauuuuuaaguauaaaaagucuuuuuucagcucuggauuauggugcugcaagcugauauucuucucauggcaguaaacagagaaguccuagggguaaucuuaccccucuggggaguccaggauaucugagcaucucccuuuucuuuuuacugcuagaaagaauuucugcuaguagaauuuuuauuuuggccaacucugaccccuuagguugaugucagaaugagguguaccaaccuagguggucagaguuggccaaaauacacauuuuccugcugagcaauuuagucuagguuaagucauacuugaccauaugcccuaguuuagcguccaguuugugaacauucuuuaccugaguuauuguaauucuaaucucuuauguaaaacugcagguagucagcccuuugucuccuucaguucuacaucugcggauuccuucaacuacagauuaagaauauuuggggggaaaaacaguaaaaaaaaauuacaauacaacaauaaagacaacaaauuuaaaaacuaguauaacaacuuuuuauacagcauuuguauuggguauuguaagcuagagauggcugaaagucuaugagacgaugugcauacguuauaugcaagcgcugccauuuuauugcagagacuugagcauccaaggauuuuguauccgugggaguccuggaaccaaucccccuuggauacugagggaugacuguauuuacaacaugucuagauuuucgacaacuugaauuaaaccagaaagaauaugaacacacagaaguucauguguauauauauauguguauguguuuagaagggagcaagcuguuaaacaugggaaauaguugcuaguaguuuguaauuuuaugauuacaauuuuaaaauucaauuuugcaacuggaauuugacuugauugguuagugccuuacaguaauuaaccuccaaaucaucagaaugucaucuuguuauuuagguaauugaaucuacuuuucuuguauacagaaugcuuuuuggaaacaauacacuguauaucuaguuuguaccaagaacuaauuguacacagucagauacuugcaguucuuuuggacuugaguuucuuuauccuucuaucagaugucacaauucccucuucccuuuguagcauaugaaaguaguugugugugcacuguauuugagaaugucaaguaauagaaucucuagaaaacauucaugauuucagucccagguaauccagaguuaaaaauaauguucauaaggaaggguagcaaaauuuagauuuuaauacuuauaggagguguguuaauuggccccagggccgcaggcuuuagcguucagaggacuuuagccccaaagguuuuguggaacuuuuccagaguccucaccaguacauugggaauaaauggaaugccuuuggaaguacuuugaagauugaauucgauaguguugguaaagcagucuagccugcugugauugugcuauugaugcaaauauucucuagccuguauuauuuuuccuuggagcucaggaagugauccccacccaccucaagcaguaaaggaaagagaggcaggagggucugaccaugugaggugccccaauaaagcaucuguauuguaaaucaggaauguagguauuggguuuccuuaaaacaaagcacaccuacgugaccacuagcuggagcacaaugugggcucggucugcugaaagagucaguugguugcggcugucuaauccaauuauggauggucccagcgcucagccuuucagcugcugccccuccccugcagacucugccucucucacccucccuuuuagggcuuggucuguggcuaccccagaaaucacgugcacuccuaggcuucagcgaguacagccuuguuaaucucagacauggaaagcaaguugccuaggucuacagaugaguauucaguuuccccaccaguugaccucagugcagguuuuguugguuccagucauuuggggucagcaccuguuugaagccaggacacuuagaacaagguggaggaaaaccugaggguacauacagugugguuuccuuggcucaucuaaugcagagucagaaugauuagccacauugcaaauugucuuuacucagugguuuaauuguuaaccagggaguuaauuuuuuuuuuuuauuaaacaaagaagaaaacaccucuagauuuuucugggacagauggccccauugaaagaggccaugugcugcagcgaauggccaggccucggguguggcaagugccuuccagcucagugcuugcuuugugcuccuuugccuauuugaagacguggaugaaucaaaaucuauaagccuauuucagucaaguauucuaaggaaccuggaaacacaggggauuucucuguugccucuaauacagugaaaaaccacugucuuuuuuuguuguuguuguugcauugggggaagaaaguccagguuugcauguacauuuucacucauaggauuuuuuuuuagaauaguuuggggaggacauugugcucuggccaauaacugggccagugucuggucacaagaugaucaggcaggugccugcaugacuguaggacagagaacugggcagcuagagagccuguguggaacgugaagccuuuccccacuuuguugccguccuaaccuuuucucaagucauggagaauugauccuuagacauuccuuaccucucucacccacuugaggauugcucagagccuggguuucggauugaaauagcacuauuucugguuggugacgacauucugugagccagcaauguaguuuaaauauccacaagagcgcccugguuccaucagcgccccuucguaauuggucaugagacuuggaccuccuucggggcugggacucgggcaagggaguugaguagagcuucucuuucugggcuccugggaaggauucauggcauaaaagugggacuucagcauucucugggcacaccugucucuguuuuuguccucuccugaaucuuucuggccugcagagcagaauaaagucacucugugccaaccugacuuuuguucaugacuauauuaggggcauggauagaaagugcccccauagcacucucagauaaaacaccuucaaacaaacccagaaacccaugcucacaaaaccacccaccuuaaauuaugaaacuuucaggcugacuaaauccugaaggcguuggagcgugagcaaagggaaaauggugacacagagcuuugcccuuccuaauccaaaugaaaagcucuguaacccuccccccaccuuugcuaucaagaaauguuggaccuuugggaagcagauguagaguauugauccuuaaaacagagaccucucacccuaggucucuuaaaacagagaccuuaaaacagaguauugauccuuaaaacagagaccucucacccuaggucucuuaaaacagagaccucucaccacuuucuaacugaaguggguuccacauuggaaguacuuugcagaaacuucuauuaccgcaauuacuuuugcaccaacaaauaguauccucaacucagaaggaaagaauuggaacacucagcuggaggugucugguagggacaugugucugcuuuuugaaucagucguauauguuuuuguuccugugccuggaggcccuuuguggugugagaacauugaauuuggagagggaaagggagacaaaagagaaaugggggugaugcuuaagggaaaguaggguuuuuaguuuguucaccacgcuugauggcagauuugccucuggauccucaggccacguuccuaugguggguagggaucucucucucucucucucucucucucucuguguguguguguguguguguguguguguguaaauagugauuucucuaaguuaauaaagaauguggggugaccuccuacacaugcccguaugcuauuguguaggaacaaaugcaugguaggaauggguagacucuaaucugaaagcaucaaguuguaugcaucuucugcaauuaggaaucugcucaccagcacgagugcugugguuucuguaguucugggauucagaggagcauuuuaaagauguaggauguuagaggaggaggugcagggaucuccccuuggguaaagagugggagacagucucugagucauaaucugggaccaguggaaggucaaagggaagaacuguccuguugucugcuaagucacaggcuuccuuccuguucucugagcccugucacuuacccaaggugcagcaacaauuagugucuguuuacacauaacagacaucucuuucauaaaauaauuuuuaaggcauuuguuugguagaagcuucccuguuugggggagucuuuucccugaaugcauguaaauaacuucacaguuugcgcaaguuugcaaacggucuauacugcucagccuugauugggcuacccaaggaugcgcccgcccugcugaggucugacagcucugggaggccagugaggccuguccuaaucccuguucuggccggugauucagcuccagguggaggcugugcagaaacagccccggucaucuuugugugaaauacauuugucgucuucauuuucuuuuuucuucugcugguaucuucaugguuuucagcaaaacuguguacauuacauuuuuuucuuuaccauuucuccguaguuauuucuagcauuuuuuuuucagcugaugaaagcaaaugaagaauuuuuaugcuccauagucagucaaacauugauuucucugacuuuuaacuuagaaagucauuuugcaguggcuugcguguguguauuuagacugugcuucuacaaaaaagcacacguaggcuuauggcucaguuuacuuguuccagcucacuuuccuguucauuuaccuucuuguaaaauggaaagacaaacauaccuuaaacuuaacucagaucgugauugccaacuuuguucucuguguguaaguaguuauauuauuccuagguuauggcaucuugauuuaucuuugaaagaagaaaacccucacugaguugacagggacacauuguucuaggcuucuacaauugugcugaugacgcuuuuucccauuggaaugacagggaugauaaggucggcuggcuagccuuuuuuuaaaauguagaaaaccacaacuuuaauuuauagcaucaucauuuuccuuauguauguaguauguuucaaaaauaauccaaugucagauucuugcuucugugaucaaggucuuguuuuugcccuuucuuugcucaccaccucccugccccugacgccgaguccucgccuuagaggagguggucagcuuauauugcaacauugaaaauguuauaccuuacaaagaaggugauaugccauuucuuaauuauaaugaugugcaacagugacuucugauguagaccuuuaacauugggccacgcagcuuuuucuuuggaggaggggcauuucaaauuggaugaugcucuuauaguuuaauaaagaaacaagcaaacaaaauaggcuauacagggcauguguucuuaaacucugugacaguggaggugaacccagggcccuuucauggccuugggaggguccucagcuuugggggcgaguuaucuggguggaaaagcaccaugggaggaagaagucagagaggcggguugcuggagcucagagaauaaaagcaagucucugcccugaaaauggcccugauuugcuucagauguacucugucugccaacauuuagugucugugacuuagccaaaggaaauguacauuaacuguucaguuucuauguaguuugugcucuaggauuuugccuccggaggauuucugugaaggaagcucuguucaaguggcucuguuccacuuggguuuggaaagaggccgggacaggugauuucgaaggaaggaugaggacaauggaggagaugggcuuggucauugcagugugugagguggcccagcuuaucuggcauuuugggguacuauaugugccauaugagguggguauggguguuugaagggaaaggggguggccugggcaacuuguguccuugccuagaaagaucaucacucuuuuuauuuaaaagaaacaugugaaagagccaucagggauaguuuuguccucccucuucuuacaagugaucauucccuugguagggcagugccagacccugcuugugagcacagaaaacgccauaagcuccucaugaaagcaugucuggggaagcuuaucucaaaugcaguuugcacuugcaaagguccugugguauagcgggggagcaggggagauggagucugggagcggugaaggcugggucacuagcuggcuuuguagccucugggcguguuguuuuuauccucagaggggccacugcaccugcuccauggucucuucccacagcagacccuucugucucugugccucgaggggcuauguggaaagcagagaaagacucaaccagagucuucccuuaaggaaaucggaaggaaaacaaaauuaacggcauuagaacugaguauguauuaaaacuucuacugucuuacaaaauuuaguuuucuuucuuauuuuucuuuccauguugacucaguagguaaauggacuaaacacacauucauuuagggcaggaagaacuucaucauuugauuaccuuuaguucauuuaccuuauaaugccuaaaacaaagcagaaagugacguugguuaaucaaaaagaucacuuucuuuuuuguguucuuuugugcuauugugagaugccucuucuccagcaagcuguaguuguucacaaaguaaagcuguuccuaagccuucauuagauugaagcuugucccagacuuucuuuaaagaaguuugcauagcuuaguucaugcucagaugauucagugaugaugauggguuguugguuagaaauuacuuaaaaaugccuaauacauuauugacugauaaauguuaagacauauucuuuaagggucuaaauccuauucuuguggagcugcaaagaucuugggggugugguugcccuugucuguugcaucaucuuucaaaugcaacagcuguaaugauauucuguaucuugaaaaacuuaaaaaagcaacaacuaacuuauuuguaucuuuuccucuaauauuuaguuuuuacuucacuuguaacuuauuacauguauuaaggaguuuauuuuuauaugacauuuuacucauaaaaggaugaaaccaagauuggugaucuguucacauagauuaaaauccuguuugugaccacuuagguguguaaugugugacuuguggacugugucagaggaagauuuuccaaccaaaaguacccauugguaucacagaugaaaaguccuuauaccaucugaaaaaaaguagaagguggggagaagcuugaaaaccuaaggaggccauuaggaaaggcuguauauuuucugauuccguuuaaaauuuuaaguuggugaaaauacuaugugaucgaaggaugaacauauuuuaguaaauagaguuauagugcuacaaugagauaaauuucacagguaaaugugacguagcuaaugcauaaucauucuuuguguugcauggcaauucuguacaaauggaagguagcauguuuaacguuccuguuauuucacauaaauacagacugagaguuucaguggucugguuugaaagggaagaaauagaagaaggaaggagagaaguuggcagaggagcaaucugcucuaauauccuccaguacacaaucuagcuauagguccucaccuggcaggguuugaggaucagaaugguggcucagguuuagacaauucucccuguuuguggggcccagcagcuaguuaagagaaaaaucuuuuuuccuucccuauuacccuauaagguccccaaauucauuguauguagaauacuugagucagaauaacuuuccuaacacuuagguuucagguuuguuagguaugccugacagcucucuuaucaacucccauuuauuugcuaaucuaaaugaaaguuugaugguagaguauuguaaauguagggaaggugaaguguucaccuucagaugguagcuauuuaucucagcaagaagagcagaugacuaacacccaaauacauaaccauuauuauauaacuuagcauuuauaaggcauuucuaugcauccugagagacuagagcacucucaaaugagguuucagaguaagauuaaucuuugcaaaugaagacaaauuagcaaaaucuuccuauuuuuaaagugugccuuuugauuugauaccuauuuauuuguuuggaaagaagcuuuuaaaaucaaaaccaugaaucugugguuaucuucaaaggauaaauuaugguaggugguuguuacccagguuaccauuuuaagaugauuauggcuggcccaaauuaggggaucuuuucauauauguauuauauauuuuaacuucagucuuuuaaaaaugaauauuccuagguggcaugggagggugggaaggucaaaagcccaaacuucucuuacuuauuggcugcuuccuugaacuuagcguuuuucuuuuggaaaagugagcuuuuguuuuuggauauuuuguacugauacucugugccuacacagauuuuguuuugguucaauaagaguugauauuuugccagggguugccucccaugagauuccaaauacagauguaaguuuaacaggcuucugaacuggauguuucuaugcgcugaaacucuguaaacgcguguagcuuugucuaccauuguauauugcuguauugauuuguuggguuguuuuuuuucuuccuccugaaaagcucuggucuguccucugcugauacaaagacugguccauuccccagggucacugcaagagaaccuccagggccuggccacuguuagauauuacuaaucugugaaguugcuccaaauucucuugccccgaucauaaaguuccauugaguucaauuuuaugugaagguucuuugucaaaaggaauaaauguuuauucaacagauccaguuguugucagcauugacagaugugaaaauuagcaaauagcaagaagucuccccuuuagaaaaggaaaacaaguacuuaaaaaaaaucuuguguugucaauaaacaaguccauuuuaaaagcaucuuugaagguguguaaugaaaauggaggccuuagguuguaucaggguuuaugaggagccagcuuauauguaaucagauguuccuguuacuguuaucacuguaguauagggcuuaguucugcccuuuaagucacagacucaaguuacuccugauuuuaccagcagucagaauacauuuuucuuuaaaaggaaaagagacgauaucccagugcuucucuauacuaaaacaggaagagaagcuuccuuguugaagugacaguuuagauguuguuauuuugacagaaauauuaguaaauaugucacauuaucccuugcuaaauauuuauagcauagaacguauacucugaugcauaauauuuuaugaaagaaauaucuuuugccucaaaucccuuucacuguuuugacaugaaucuauaauuuauacccagaggucugcaggaaaaagacuuuauuaagacccuuuuauuucagccaagauaaaacuccauccuaagagggaacacccuggaaucuuugagacccuuaaaggugggguauucugaaauaccuguguucguuccuuugcuagaauuuagauagcuucacuuuugcaaaaaggcacaaaaugagggcaauuuuugauggaaaauuuuaguuuuugagaugaagcagggggcacaguggcgaagcgcccuaucuuagcacuuagguagcagccguaacaaguguccuggguauuccucccuagaaaggaaauguuggucacaaauggcaguguccucugcauucaguucagcuaugugacugaaagacacuguucuucagcagcugugaguuuacaagaugucgcacauugaguauuuuucucuagcuuauuuagaaacgccagucuagacuuccgcaguuuuggauucguggccauaguuuuggccuuuauuagauggcccucaaagguacuuuucagguggacauugauuucaugccagcugucagagaugauuuucccuagaaauggcuggguauauggagacauucuguauuagaauggagguauacacccaucucuucuguauuagagagcagguguugccccccguggugcucagauugcuuagugugagaaggaaaagaccagugauaagaggaggaaaacugcgccuuccauguagcucaguuaacagcaucaugauucuccaggauggccccauuucuguuuuuauuuacaaaauggacuugagaauuaauuaguaagcaaacugucuccauuagguaaguggcauucugauuugucuguguaaaguuccauuucccaaguaauguguuccaaagcauuuuuauguacaacuacuggaaacugcuguacaaauguuugcugcuauuugguuguaacaaaaucaguaaugaguuucaaaauggaauaauuucagagcccuucaucuacaguaguuugggaaacacuugaaauaccaagugaucugaauucacuacaagcucuccaacuggaaaaugugccuggugucgucuucaagcaagaaucccccgccccuuaaccacugcugcuguggacuugagucuucaaccuuguuuuguagacuuuagcauuuguauugugucauccuugacaccuccccaaccccagccuucccagcuuugauugcuuaccuuagcaaugcucucagcuuggaccagaaggcacggauguuucccugaccuuaaccucacuguguaucagcucaaggaagaagccagauuugcugauguuguaagcacuaaauuauguucauaacauuuaacccucacauccauaagcaaacuaagugggaaaauauugacuauuguagcagucauagauuguuuaggaagcagcaaaaaggcaaauuuuucuuuaaaguucaaaauggggcgaaagaggguaggaaaggaaaaguuuauuaagaaaauuguauacuacauuaauuugacuuugccgucuagacuuaaauuaaauucauguauuuuuuuggucuuaacacauugacauguaucaguaaguuaaaaacuuaaaaauacacaaaugauuagauuagcauuauuauguguuucuuucuuguuuuuuguuuuguuuuguuuuguuuuguuuugagauggagucucacucuguugcccaggcuggagugcaguggcaugaucucggcucacugcaagcuccgccuccuggguucaugccauucuccugccucagccucccgagcagcugggacugcaggcacccgcaaccaccccugguuaauuuuuuuuguauuuuuaguagagacaggguuucacuguguuagccaggauggucuugaucuccugaccucgugauccaccugucucggccucccaacgugcugggauuacagucaugagccacugcgccuauuauguguuucuuauagaaaaucucucuaauuuuuuaauaagcauguuuuuacaaaugcuguuuccugagaacugucgcaccacaugcgacaugccaugcaugcgacuggaacaugccagauauuuguggguggucccuucgugucaccugugccuucuuaccaaguaauuugaaacacccguguaaacuaccuuuggcaaauaggauagcuaaaucaccgcuaagauuuauaauuuacuuuuuggauaucugaaacaucaacaauacagccauccauggcguguuccucuggagugugguccgugccgucucugccugcuccaucuggcugaucccaggcaggcagcucagcucucagcagacacagauccccagcacauaugaacgugaaagaggcuucuccgugggagcgaaguggccagcaggugucacaggcugugugggcccagcaucgugugggcacugugcugggggaaucccaucacagcaugugcuggcguuaguaguagacugugugugucucagaggguccagaaaguaauacaguaaaggcgccugggggugugugggggugguugguugggguuugcuuguuaguuuguuguaaaagcccagcuuuucauucuuggaaagauuucagccaacucgagaggguuaccugccaggaaugcugcagaagcaagaacucagugggugagcacuuccauuucuucaacaaaugcuucugagucccugaccugugccaggugcucuucuugagcugagaauccugcagggagaaaagagauaaagaccccauaguccugugguuuaccuucuaaugagcauacuuuugucgaucaaacagggugaccucucuggugucucugcacacuaccuguauggucuuugcguagcugauggggucuccugacuagugauuggugauuuuaaucuggauuuugccacagcacuuauuuucuaacauaugacuuaauuuacuuaauaauugugucuauugaauguauucuuauacauacacacaggcaugcacacacggacacgaauauaagcuuuacaaggacagaaaccuuaucuuuuauuuauuucuuccuuguguauccugagcacugagaacagccuggcacaaagcagggcucaggaaauguuugcugaaugcauguucacacuggauguguucgaaggcucucacucgcgacuccuguuggcuuguggagagugcaucuagcuguaaaagccauggugcuuggaugucuuggggugcugagccuguuccccccucauuuggggguguggugcuaugcuggcguuuggguccaugccccgcauuucugauggcugccccaucugcccugugugggguggcagaguucuguguacacagaguuacauuucguuguuccuggcuucucuauggaugacagcagcacugauaaaugccacaccugcuuucucagcagucuugcggggugauuuuuccucuuaaggaagucaccugauguccaugcugaguaggaaaugcauccaaagcuuugggagcucaguguuggccccugggcugcagcccgagccccguuuuagagcugugucucccaggcagcugugaugacugcucgaaagcccacucagggggaagguaaaccugaugcccggguguuuggacagugagcauggcgaguggaccguuaccugugcauagaguuguucauauguggugacagauguugggcuguuauuuaguaacuucaaauuguuuuucuuugcgucggagccaugucuagguucugagugcuucucccaggucagauggagagcucuucauuugggguugggggagcggggugguguuuucaggugcccaaggcauuccaugcacaugcaccugcaggguaugugucaucugggguaagacagagcccucccgguuccucuucuggaugugugcuuuuaguuuuuaaagaaugucaguauauacauugccauuuauucaacaaauacggacugagcauucuguugugcugacguagcuacuugggguuacagagacaaagccaacuccauucuccaaauggaaaacaaauggaaacauucuagugguagaaacagacaacaaacaaguagacagaaaauaaugucagacagugguaagugcuaugaaaaaaauacagacucacugauugugauggagacuuuuaaguuggauucucauagaaggccuuucugaagaggggacauuugcccugccacugugaaucagccaugagaagacguggagaggaacaugaggugguaggccccagcgagggaaagaucuccaugauggcaucgauuauucgcuccacaaauauuauugagcaccugcugugugccaggcacuguuccuggugucaggguuauagaaguggacaaaaugaggccucugccucuguggagcuuuuauuaaaguagggaaggggaugggagggcugggucacauguuaggugugggguacaggguacguggugccaggcagguauccggguaccuuuuuacguaggguauucagagaaggucucuagagaggugacauuuggacgaagaccuaaaggaaagggaagggaaaggcgaggagcuuggagagcuuggugcaucuuggugggggaugggguaaacugagucaguuauguagggcccuggaggccacggugaggacuucggcuuugacucugaaaggagauggcagaguuuggagcugguguguacguuaacaggaccaugcuggcagcugcguuaagagagacuguaagggcaaggacagaaguagagagaccaguaggaguaggcuguugccccaguguagggcagagaagaugaaccuuagaccaggaugguggagauggucaguggagagaaguagucagagucuggaagcaccagcaagacugucuggugcacacaggaugcacgugggauguccagugaggaggaugagaugagguuggguggcuggagccuggugagugacaggcagagagggcuauuagaucacaugggcccuggagccauggugaagaauuuggauuuuguucucuguguuggaaaguuagcagagagcuuauauggggggugagauggcauagggacaauguuaauaacagcaacgaauauuuauugagcacuuacuguguaccagcuguugcaacagccucucaaggguucguucugcuauuagagccauguuauaaaugaagaaacugaggcacagagagguuagcuaacuuguccaagaucacacaguuagggacaaacuugacagaauuauguguguccugguauguauuucaguuuucuuuagggaagguaccacaacuuuggguaacuaugccccuaccccaggauuuaagauguuuugaugguugaagggcgauguuuaagagugggaccagagaauauugagguauuaaaaucucacuaaaucuguauucauuauaucuguauucaugguauaauucaugugccucccccuuucgugagccccucaaacaugaucauggauauguuuucuccacccguaaaguacguucauauucauagaaaacccacagagaacugcagaccugaagguuucuuuguaagagcuuucauuggauagcuagaagggcugcaguaaguuuaaaaaaaaaaaaacccaaaccacccuggauuccaggcugcacagccucuaggagguguggguaaucccuuuauaaagcuuggcauaauuucuguuaagacuugcuuauuuugcucucagcuugcuaucuugauauguuugccuuugaggagguuagaguuauugugauuuaaucacagaccauguauuucgcaagauucauuugguaucuccagcuuguuuucuuguuuccucggcugucaguccacaggcagaggugggaggcggccggcaugggggaccgagugugguagaaaggaguguuuacuuagcggaggggagugcugagggcugcuguuaccuucccagaauggcugauccccagcagugaugagcaggcugggaucgugguguuaaauuugguauuuucuagaaauauauagcaggcuuuccccuccaccugccccccuucaagguuucgaagccuuguguuuugcaagaguugagaggggaacaguuaauagcuuggauuaucuugucucuggagagaauuuauguaucaauucaccggaagacugcucugguauuagggcaacaagaaugguuuuauuucucccuuccuuuccugcacucuguucuuauguaauucuuguauuaaaaccauuccugguaaauuagaacaugcucuuguauuugggcccugcuuugaagaaggcugcugagucuaaaaaguuugguagccucucguuucucauggugauuucugagauuucuagggacuugguguuuuacagagcuuguugaguugcacaaaccagccuccuuggcccuucuaggugauaaaagaugcugggcugggagggcagcuguggaaaagggugugggcgagggagacagugcuucauccugccuggaugaagcauguugguuguugguuuauucauaaauuagaaaaauauauuaagaauugaaguuguuccuuaucucauaagauuucuagcaggcugcauaaagucuguagaugguaauauccauuuaaaaguggacaaugaaaaaauuaccucuuugggaguuguguugcuaucucuaccccaauuuggcaaucuuuaauuaacuuggcaacccccguuuuaccaacaaagaacaaccuuugauuaaaaaaaaauaaaaugucagggagugaaagauacggagugugacucagcagaugggaauuccuuuaauaacacgcuggguguuagcguuagaaccgccacugaacagcucugcaggaugcccucccagcccucccuccaccuauuuggauuagaccaggagacugcagcaaacuucucaaggggaggcgaacuugguguugguaucugagcgauugucuguuucaauuguuucccucugucuuggaaaacaccggcacaaaacacaaauccagucccaguuccugcagcugcuggggcgaagcaggcuuuuuaugaaugaggcccagaagggggaggagagggcuuguguuacagcagcaguuggguaauacauuucauucacuugcagccaucuagcccaggcuucauuuuaaaggauauuguucauuuuuggcaauucagauuagacuuuuuuucuuccuugugcaacuguugguaaguuagaacacgaagcaugugugugcauucuuuuugcuugcuuuuuugaguguuugcuccuuuaguugggauaaaugguaggagagguaggaaggcuuugucauccccggggaccuugcuuacuucucccucccagcaccacuuaagagaagaggagguggccucccucuccccaaccucagagcccucaaagcccuugauagugagccugagcacuuguuaggaggugacuucuaccuggggugugcugggguccacaugugccagucucucugcccugcuccccgugagcggcucuuuauuuguggcccuugaggccccauuguuguggccaccaaaaccugaauuggaagcugugugacaaugcuggucccccucccugcacugcuuccugcugggggcagaacaaagagagcgggcauugucucuggcauaaaugaaccucuaucaaaacaaacacccagagagaggggcagccugguuacagcugccugugugagccucgacagugggccucauuccucacaaagggagcuuugaggcccggaagaggccuuuccuugaugaucgagcugugcacagggagcaaaccccaagccgacugcuugucugugccacccucaaacaaugauuuccccaaauuggacagccuggguuuguauccuugagcacgguuuugggaagagcauucugcaugaggcauuguagcuauguguauggaguauaauucuguuuucagguugcucugccacagagguuaagaacucccucuuccaagguagacauugagaacagagacgaccacacuggguuuucacugcagcuuuuaaacaggaugacucccagcccccauccccguggcuagcagcaagcagggacucugaaacacugcaagccaauggacugagcaucuuacuuuugcuguccguguuuugguguuuuguaaacccaucugguaaugacccugaugccccaugucccagcaagggcauagguaccugccauugugcaccaaagucccuuuccucauggcccuggcuguucuccugcauggggucaugugugucccguuaccaaguuguggccccuuuucaaccuugagugccacaucugggcuguuguaggcauggguaguacaagcuggguuuguuacucuaaaaaugaaagggaggaucaguuguuaauaccuuccuguaggugcgagagggaaugaguugaggauucgaucacuguuuauagccagucucggauccugauugugaagucauucuuucuggauaauaacuacuauauccagcaucuugagaguauaaaauaaaggcacauguuguacgucaucucugagauguagcgauggcuuggacuuuggaggcugaugagagaaaacucaugguggugagcuggagcaggguguggcuggcggauucugaaggugcuagcccuaguuuuacagcugaccagggaaggucauugaacccuacagucuuggcccugagagaaccuuggaggacuuaaggauggagaaaggugacaaaagagaugcaagccaacagcaauuuuguggaacaaaguguguacaggauuugaacuuaacucugcgaaagacagggguugcuuguaugcacgaauucacaucugaagaaugcaucugauuguggcugcaauuucuguggacgugcaaacaucuaccugugcauuuuauuugucuagcaucauugaaagaguuuuuugcuugaguugauuucccagguaauugaagcuuacuucucaaagcacaagauauuuuuucucauauauuagcggucuuaagugagugagaccccuaagaauucuuaauuccuuuaucuuacuuuuccuacaggaaacuuauuauguuuuccuagauaggaauugugcuaccaaaaaugaaaaguaaacguaauauguaauguucuacugguaauuguuuccauuuuagguugacaccgaacuaaugauauuuaaauuguagcugacuugaaacacagugaaaaaaugguuuccugcuguuuuuuuaaagcuggauucaguaacaugaagguaauuaaaaauguacagaucucaguaauagacagucauauguugcuuaaugacagggauauguucugagaaaugcauuguuagguaauuggauuuuaucauuaugccagcaucauacagcguacuuucacaaacuuaguugauacagccuacuacacaccuaggguccaugguauagccuguugcucguaggcugcaaacccguggagcauguugcuguucugaacgcuguaggcaaugguaacacagugguaaguauuucugaaucuaagcauagauaaggugcaguaaaaaauauaguguaaaagauaaaaaaaugguacaccuguauagggcacuuacuaggagucaggcuugcaggaccagaaguugcucugggugagucagugagucaguggugaguaauugugaaggccuggauaaauacuguacacuuaggcuacacuuagugaauauuacauuuuauuuauuuauuuauuuauuuaugagauagggucuugcucugucccccaggcuggagugcaguggugcaaucacagcucacugcagccucgaccgccaaggcucaagcgauccucuuaccucagccuccugaguagccgggacuagacgcacacaccaccauggcugacuaauuuuuguguuuguaguagggaugagguuucaccauguugcccaggcugaucucaaacuccugaccuuaagugauccacccgccucggccucccaaagcacugggauuacaggcaugagccacggcgccuggccacaguuaacuuuuuuaauaaguagaagguguacacucuuaaauaacuauaaaaaguauaguaaauacauaaaccaauaacauagucacuuauuaucauuaucacauauuauguacugugcacuguuguacgugcuguacuuuuauacagcuggcagcacggguuuguuugcaccagcauccccacaaacauaugaggaacauguacaucuuaccacgguugcaaugucacuaggcaauaggaauuuucuagcuauauucuauccuuacaggaccacuaucguauaugcacuucaucuuugaaacgcuguuagcugccucaugacuguauuucuauuccucagucaugggcucaccaugcaguacacauguguggucacuggagggaauggaagaacacugaggaaaugcauagccuguuucauauauuuauuacacuauuauuuauuuagaggaauguuaagaaaucuugcuuuuauguaguuuuagaaugccaugaaauaucuaguuggggcauuaucugccauuuugcaagguaaucuuccacuucugaauaacguuacaaguaacccgcguuuggaggacugauuugggacuaaggcaaggaauuuaggaggcacaaguagaggggaagaaauaaacacaugacuuuuguuuuuguuuuuguuuuuguuuuuugaaagaaggacagugguuugcuuguugauucugcuuugagaggauggggaugcacuccagagaaagugaaacggggcuaugggaggaagagagcagcgcacacacagcaccugcauuugauugugaaugcgauugugacuccuuaggcaggaaggagagugcuaagaccgucaucauggacacucagaaaauaccugcuaauccguuuacuggaagauacagggagcugcagauaauuauuguuuuuuaagauggaguuucgcuggagugcaauugugcaaucucggcucacugcaaccuccacauccccaguucaagcaauucugccucagccucccgaguagcuggaacugcaggcgugcaccaccacgccuggcuaauuuuuugaauuuuuaguagagacaggguuucaccauguuggccaggcuggucuugaacuccugaccucaggugauccuccugccuuggccucccaaagugcugggauuacaggcaugagccgccacucccggccgcugcagagaauuuuuaaaauaaaugauagauucucacagauaagaaguacaggauaauuauuugccaaaguuugaaacugccauuauauucaaaggcauucucuuuugggagugguuuuauauuuaagguuugaauuuagaugaccucaaucuugagguguuaucggagcauuacaggggagucuuauauacaugcaggugcgauuuaauuugaagauacuuccauuuaaacuuuaugcugccagaguuggccagcuaagcaaaaagaauucugauaggucuuauucuccuccccaucccacacgcugauuuuuuuuuucuuuguguuuggccgaaacauuuuacauuucucauuuuucacagagcuacuguuucucuaggauuguuuucccugaaguguguacccuguguuugggcagagcagcaagaccagacuuccaaauggcaugcugcguuuuaaugugcuuucauaauugucuguuccaaaagggugccuguguguguauggugugugugugugugugugauucagagcaccugagagcacacugcccguuguccccuccagcccuucugaaaugcaggccacccuuucuguuucaguugccccuuggguggcagucugugauaacucaaggucaggaggaaguauuuguuuugguugucuuguuuaacuaauuaaaucuuuaaucuugguccuuaaaagaaacuaaaauaaaaucguaaaguaguucugauaaguccuugccauaaauuauugcuuuuguaaacgcacauaaaggacucugaacuguugcuacucauaacauuucugacgccaaaugugugggguuuugccauaccaacaaccaguugucuaacucuccagacaccaacugggggccuuacaauucagugcaguucugacacucaccaccuggaguuagcacagacuccacagggaugaggguucagucccacgagucugcccuugcugcagaugcgaguagcagguauggggugcccacacuucugucugacuugccugaaagguugagaguuuguugccaggccccuugcuuucaggucugauaacuugcuagguuauuaaaccugaaacuugauaacuucuguagauguugaaauuagaacggccucacucaccugggcucacaaaauuccagaaaguaguugacguccuauuacugguuuaccgugaaggcucuauguccagaguggacaggacaaguggaagaguggcacagggcgaggugugggggguggcguggagcuccuuuucaggagucucuaagaaggugggacuccagcggcaaugccuuguccaugugcuaagccagccgagggcgcacgaagugcugugugguguccaagcugacuugggagggacaaguuuggggccagccccccagccucccuugucaugucccaccucugcuggcaucugugggcuuaaagugccuucacucccauccuuuucaacuauuucuugauuaaaaaaaaaaaacaaaaaacuguugaauaguaggagacucucucucucauugguauuugugggaauaaauauuaaauaaacacuuucuaauagguguuaccaggacgccuaaggaaauuaucucacagaguuuucaacacugugaaaagagaagcugacugccagggagagaucccuuuuuccuaguccuugugaacaugugcuggacagccaggaguggcacuguggcaagaaacacccguucucuggcauuaguaagagggauauagccaaggguaucuguauaccaguguuaggcccauacauccauaaaacauugaugugagagcuuuagggcacagcugacccuaagccuaacgugaucauuaaugucaugaaaauuggagaauuggucaggcgcgguggcucacaccuguaaucccagcacguugggaggccgagguggauagaucacuugaggucaggaguucaagaccaaccugggcaacauggugaaaccccgucucaaaagaaaaaaaagaaaagaaaauuggagaauuuauaacgucugaugugaccuguucuuuagguguugaaauuagaacggccucacucaccugggacauucuucagcucacgcccuguaccuggcuuacaguugcucagugaaaugcuuucuugauuguagcauggugggauuuuuauaaauccaaaugacuuagagguaggugucacauuuuuagcagcuaaaaucauacuaaucguaaagcucagauuccuguaaguagggcgcugagcacaggcugcauccuggauauaugaauagaugaaccagaucguguacaugugggacacguucuuuguccuuugggacuuucuuuugcuuggauguugguaguaaccauguaaguucgggcagcuuucuagaaacuuuccuuguugugcaacauuaugcaauaaaugcacugcuuugugauaucugagacguuuugguuuucuucagcuuguuugaguuaaauuuagacuccuggcauaguuuuagguuugaaugcauucucugagauaggauaaggaccaaaacauccacucagcagccagaugggauuuuauccuugugcugccauuuuugagacucaugccucuguuucacucucuguaagauggcauuaauagugagggauuguugugcugugagguuuaaaugagcuaaucccugugaggaguuuacagcagggccugggccauagugaaacacuguguauguggaagccacuucacuuuugucauagcuuuguugucauuaguguauacccugucuccuugccguuuauggguccuucuuucaagcagucggauuuucugucugacauaguauaaguuuagaggaaacaauagcagcuguaagauaauaguaauuuuccuucugaaaucauuuuggugaauuuagucagaauaucugauccauaaacucucauuauaaaacauugccuuaugauuggaguuuuuucugagaacaguuccaaugaacaugauuuuuugguggugagguacuauuucugugcaguaaugaaguugugaggacacacagauaccacauccauguuguuugggaauuguuugggaaagguacgugggauagccuggcauggggaagaaugauguuaggguauucuccuugaggagcucagaauaaccaaagguaaagcauuuggugguauaagauauauucaucuuaaaaauaaguugaaaauaauaagauacugggagauguuagccaccgaaguaaauaacuacagugaaauagcucuuuauuaauuuugaaaccuaaaguugaaagaguuccguauuauuugucaguaucuuuauccucuucaaaaauguuuccagcuuugggauaaauugugaauaauuguuucacuuuguuuuuuaauauuggcuauguagugauuuugcauugaacugugauauaagaaugaucaucagccccuugagauuacuguguguaccugugucaccaguggcauauaggggcuuaaaagcaaguaaguuuaauauauacauucauugagaacacacuguagacuguuaggauuuucggugcuggagccauagugaugaauaugacaaggcccucacccuugaggugccuauagucguguggaaccuagguccucgcagggacucuagggcagguauguucuugaaagauuuuuuuuuuuuucuuuuugaagagacagggucuugccuuauugccuacacuggagugcaguggugcggucauagcccacugcaagcucaaaguccugggcucaagaaaucguccugucucagccucccgaguagcuaggacuacaggugugcaccaccaugucuggcuaauuuuuauuuguauuuuauuuuuauagagucagagucuuacucuauugcccaggcugaucuugaacuccuaucucaagugauccuccugccucagccucccaaagugcugggauuacaggcaugagccacugugcccucuguaaaagauucuuaucaacaguuaaaauaagaagcugcucaagacauuuaccuauccugaauguuucaggcccucaaggugccagguagcugcaauauaguucuaguguagaaaagaaaacccugacgaggucuauauauuccaggacucugucugaggcccuuugacacuccgggggcacccugccgugacccugacucuuuccugcauguacugaggauggagguagccuauggguggcacagagauuugcugucuggcuagcaguacuucaggguacuggguggcuugaggaccuccuguuagaagcuuggauucacuuuucccaaggcaaccacgauuggauucuauuaguucugggucuugagagccugcaagggcuuccuucugcgaaggugagucugggagagacgccauggagucagugugaguucugcagccucccaaguuccgcuggcgugagaggcuugccuggugccagggcucugggcauugggaacauugccuggucuaccgggcaagaaacgugaaccaccgcagugaacuggcagcgcguuggcauuuuucccuccauguuuuuauaaaaccgcugaguagacaccagauuauaaauccuguguaaauagucuugaagaguuucuggguucagccccagagaagacugguuuggguuuugaggaauacuucaagaaaauguuuguugguucuguuuuccaacguaaagugcugcacaaggacugugcugugagauccaggagugucuuuucagcccucagugagugccugcaggggacacagcugcuuuggaggaacgugguuccggaggguuucccacucuccauccuaguugcuaaagucacguuccacguauuguguucugaugauagaaugaaagcccacuccccgcacccuggggucuagguggggaaaggagagguguauaugggauagccacgggguuuggcaugagcucaguagagacagcaaacugacccagacagacucccgcuuuagggaagcugggaugaacuaagugaaggugggucaugggagcaaugcugaaccacuuuggugguuacagugaaggcugcuacacacccagcuuugggagguggggcccaggguguccagcuuuguagaaaggcaugguguggggguggcuggcggaggggguggugggugguuuuccucuugaaucucugagaaacuugacugguguacugcucucugcuuuccuaagggguccguagcugugcuggugguuugcuugguaucuguauuacauccacucugugcuucagccuguuuguccaguuacugugucuagugaagcuagcauucacauauuuuagauuaaauuccacacuccacccccaaauuaaaacccugcuauuuaagguaaaaauaauuuuaaaauguuuuauuuuggucucuuuggauaaauuaaucuugaggaaagcaauacuuacugaauguugauguguguauaugucuuucucuuuguaccauacuuaacaggcaaguaacucucuuguaaaaucagauucuaaaugauuuucuuuucuuuucuuuuuuuuuuuuuuuugagacggagucucuguagcccaggcuggagugcgguggcgcgaucucugcucacugcaggcuccgccucccggcuucacgccauucuucugccucaaccucccaaguagcugggacuacaggcgcccgccaccacgcccggcuuauuuuucguauuuuuaguagagacgggguuucaccguguuagccaggauggucuugaucuccugaccucgugauccgcccgccucggccucccaaagggcugggauuacaggcgugagccaccacgcccagccucuaaaugauuuucuuaaguguaauucaggaguuggcaaacuacagcccaugcugccacaucuggccugccacaccuguuguugcacauaaaguuucauugagucacagucauacucauuugcuuucauauugucuguagacaaccuagaauguuagaaaauucuuucucuggcuggacgcgguggcucacgccuguaaucccagcacuuugagaggcugaggcggccggaucaccugaggucaggaguucgaaaccagccugaccaacauggagaaaccccaucucuacuaaaaauacaaaaauuaaccagaugugguggcacaugccuauaauaccagcuacucgagaggcugaggcaggagaaucacuugaacccaggaguuggagguugcggugagccauggcucaugcauguaauccuugcacuuugggaggcugagacgggcagaucacaaggucaggagaucgagaccauccuggcuaacacggugaaaccccgucuccacuaaaaauacaaaaaaaaaaaaaaaauuagccaggcgugguugcgggcgccuguagucccagcugcucgggaggcugaggcaggagaauggcuugaacccaggaggcagagcuugcagugagccgagaucacgccacugcacuccagccugggugacagagcgaaacuccaucucaaaaaaaaaaaaaaaguuauuucucuauguaaacaaagaaaacucuccuuccuuauaacuuguauguguugggucuauuuguauucugugaaccauaagaaauaagucaacuaucagcugggcgugguggcugacgccuguaaucccagcacuuugggaggccgaggcgggcggaucacgaggucaggagauccagaccauccuggcuaacacggugaaaccccguguccacuaaaaauacagaaaauucucugggcguguuggcgggcgccuguagucccagcuacuccggaggcugaggcaggagaauggcaugagcccgggaggcggagcuugcagugagagaucgcgccacugcaguccagccugggugacagagccagacucugucucaaaaaaaauaagucaacuaucucaagguaauuacccuuuugaauacuugaggacaucuuuucugugcccucugaauauuuccuuccccagauaaaauauuucuaguucuuuuacuuguucuuuguuucagaguuuuaagucuccauuugauaaaguauaguuuaauagccuucgaaaccacaucguugagauuuaaaaagcccuccuugagagacaugaccaguagaaaucauaccaggaccguuuagcacccuaacucugggagccauggcucuugggaugcggcugaagauuguguuaucguccugaagcucucuuggacagcugagucaaugacuggagguaggaaaguuccuugaacucuuucuugugcccuuccagcugugagcugugucaccauuguauuauuuuuacauuguuguuguucuugaaaaagcuuuuuuuuuuuuuucaaggcagagucuuacucugucgcccaggcuagaguacaauggugcgaucucaguucacugcaaucuccgccuccugguuucaagcauuuguccugucucagccuccccaguagcugggauuacagacgccugccaccaugcccggcuaauuuuuuuaauuuuuaguagagaugggguuuugccauauuggccaggcuggucucaaacugcugaccucaggugauccucccaccucagccucccaaagugcugggauuacaggcgugaaccaccgugcccggccaaaaaagcuuuugaaaacuucgucguauaauauuauggccauccuuccaaacgugaccuuuuuauguuguauuuuaucuaacuaauuugcccuugcccccaacuuuuaucuuggaauuucuuacguauuaauauacugucagggucccugcuuggggcauuguccuugggcuugucauuagauaacuccaaguuggcuugacuccagaggagcugccuucacacgugcugugaaauguacuguuguugaccagagaccaucguuaucauuaaguccacaaaccugcuuccugucucuuaggcuguuccagucuucuaucgaaaaacagugguuuaaguggcuucuccgauagugcuggugaauuggaagcuucucgucaucccccuuggcuggggcgaggcuuacuuccuggggccuuggcaguuuugaucuaacugacuuauguuaccuuucuguauuaaucaagccuuuuuauuuuccauacuucugaugcuuugacaucuuggggccuugcugacccugaagagaccagccccccuaggguuagccaguuccuagguagugaaugaguacaaugcucauaugcaaaauaaccaauccaaaggccacgccccucacucauaugcaaaauaaccaauccaaaggccaggccccuuaccaccuuuauugggauuucauacuccaggccaauauugcccuaccuuaaucacccuagggccagauaccaggcaagagacagccccuacaccccagagccugucagaauuacuccagccagcuaguccuaaaccugcuuaccuugugugauuuauuccuucccaaggaaaccacaauaaaggcucuccuccauguuuuccuaccauucccucugccucaggaccaaccuugguucuucuccguguggccccuuggcauggugcacuaccucuucuuggggacugugaguaacagacuuuuucaguggcaauugucuuuuaacuguuggccucaccguaccugaauagcaguaaacccuacaucuuaaaauacuuugagauugucacauacaguacccagaauaggugaggaugaaggcaauuuacuggaugcagagcggccccaguccauuccuuauguccgaaugcuaagacuugagaaagguggagaggagccugacuaucaagaguugccuucuuggaugaagugggcugaagacacacgaaccccuuccauuaauacaucuacauauuuuccaccauuguaauuguauuaauaauuggagaaaauaacaaugacugucaacaacaauagcuuaauccaguagagaugagguccggaauagguucuggccuaccucaguucauguuuuuuacuuucaaugcugaagcacaagcaaaugcaaaagcuucucuugaauguuuuguaaauugugggauaauugagguaugugacaugguuaauaacccagugucugcucauugagcacuggguuauuaaccauacauagcaaauggagcacaucaucguggguugcuugcgucacuagauccuguugcaaaaccaagauucaacuuuaaaauacauuuuaauuuaaguuacucuuucuggcaugaaugauacaucacuuuggagcaacacuuaccaggcagugaaagcuuuuuuuaaugcccuguguagcacugcuuucggugcccuuauaugauuuggauggauggauggauggauggauauagccacagggucuugcucuguugcccaggcuggagugcaguggcaccaucauagcucacugcaaccucaaacuccugggcuuaagcgauccucaaccuccugaguagcugggacuacuacagguaugugccacuaugcccagcuaauuuuuaaauuuuuuguagagaugggggucucaccguguugccgggguuagucucagacuucuggccucaagugauccucccaccuuggccuuccaaagugcugggauuacacgugugagccacugugcccagccuguuuauaugguuuuaaaaacaaaaauguauaugcucucaagauggcuuucagagagcuuauuagugucuuggccauuuggaauuccauuucacuuaaauuagaagagugaaagagaaaugaauggaagaccaaaaauggggagaagaaauuguaucugauauaagcguggcucuaccugggagaauggccauuccgaauuacuggaaacaggaagaagacuugcuaugaugcuuccuuauaucugugggggaaaaucaaacuuacauucugaaaggaaacuuaauacuucauguuuuuaaacacaaaaggauauuuuuucagaguagcaguuauaaaguuguuaguuuaaucuuuuaguucagcuuuuuuucuuaccagaaaaauaauuaguaguacaaaaauuuaugcguuuguuuuagcucuauucugauacuguuaagaagauacaugacauaaaaacaggaauauuuucagucagugauuacaauuuaaaaucauauucgaaauuuaauaaaaaguuuaaaagaaaucaccagcauaagauguugucauuuggcucuuggggcaaaccagcucucuucuggugaaagaacuuucuggaugaggucgaaaggcaacagaaaaccuggggaacaauggcugucuuuuuaaugggaguugcuccuauuccuggugguaacaaccucuuccuguugcuccuuuccgaauggaauugccucagugaaguuguugaagaagugaggagggcgaaauaugcccauccuucuacaguggggagaggccuggcgcaugaaagcaggccuuuguguaugccgggcugggcccaugcaaacagggcacaaucaggcuauuguuuguuugggaaaagcuauggcauccuauugcaauuauuuauggaagaaaauauuugauguuuuuggaagagguuagguguggggggugaugagggagggaggaaagagacugggcuuaccucuugucccauucacuccaaaucucucagugcguaggauaggguccaucugguccaaaggagaguuuugugugacucuguguguuggaguguuuucgaaaugcagagaaauucagagcuucucuagcuuuggcuagagaaggaacaauggaagugagucuuauucuaccuaaguuugauguggggcagccuguucuguaguugccuuccaagcccuucuucuuucugaugcuuucuugguaccauugcccacaugcugccuccacccuggaugaggucuagaccuguuacauugauucucaacuaauuaaaagucaauaugguaaaauauuugcagcauuccuucuccuucccuguguucauuucugaagcucaacagucuuccauacucaagcuguggggaggucccuuucuccuuugacaccagccauuuugugaucugcccuuucaggccaccccagccacccuacuuucccagucuugccucugccuacuucaccucuucucucgaaccucagaagcuucuggagucuucacaguggcccuaaucaugggucucauccuuguuuuccugucucuuugagguuccagcagccagcuuugccucaucaggccuuucucugaaauucccaucaauaacuacaagaucugcccaguaccuugugcauaucaggucucaggaaauugugaguuucuuguuucauuaaacauuuuucuuuccaggaaucaucauucaucgcauugccauauguguccagaucccccuuuucagggagccaguaauucgaaagcacuugccuguguugaauaugguggaaaaaacaaaugucaacccuagccggccaucacuccccaucggcccaccccauucucuugugccaguaggacuugccuguguuuucuuugggcaguucaaaguugggcucuugagaaguugccuguaaauucaauugaagugaccagaucucauccuuacccacucuguagcugcagauaauaaacacuggggacuucccuugugccuguguuuuaauguaaccuuaagacuugaugcucccuggaguguaagaauaugaauagcuacucgcuguggauauugcaguuaauuacuccuuccugucccaugugguccccagaggaauaugagauugccacaaacauggcagcuuucuuuggggaggugggagagggagaugaaucuuggggcaaggcacauucucauaaccauguggcuccagaaagcugccugacucagagaauggcuauaaaugcccgguuguauggaucugagauccucaaagccagguucauucacuuauuuauuaauuuaacaaacauuaggcagcuguggugcucugucugcuccagcagugaucaagacagaaaagauuucuucaaugcugcgugugguggcucacaccuguaaucccagcacuuugggaggccaagacaggcggaucaccugaggucaggaguucaagaacagccuggccaacauggugaaaccccgucucuacuaaaaauacaaaauuagcugggugugguggcccaugcuuguaaucccagcuacucgggagucugaagcaggagaauggcuugaacccgggaggcagagguugcagugaguggagaucaugccacugcacuccagacugggcagcagagcgagaaucugucucaaaaauaauaauaauaauaauaauaauaauaauaauaauaguaagaauacugggguggggaugguaggaugcacaguaaagagaauaauaagcuagugaugagcaucuaagaagaaaacacaaaacaguacugucaucacaaugcaggagugcuggguugggggccaggugugguugaggggugcuguauuacgcuggguagucauugaggccucugugaaaagguggcauuuagacuaagggagauuggaagguccagccaugggaaguucaggagaaaggauaagaagaaaaagcugucacaugggcacagacugaugaccagcaaggcuggaacuuggaagaugagggaaacugagagugauugucagcucaggcugcuuugacaaauuacuguagccuggguggcuuaaacaauagacauugcagcauucccucucccucucuguguucauuucugaaguugaauagucuuccauacucaagcucuggggagaucccuuucuccuuucacaccagacauuucgugauuugcccuuucugaccaccccagcccuacuuucccagucuugccucugccuacuucaccucuucucuccagcgucaugguuggagaagcauauucucaugguucuggaugcugaaaguccaaggucaggugucaacaaggucugguucuagugagggcucucuuccugguuugcaaacagcuaccuucucacuguauccucauauaguggugggagagagcaagcuguggugucucuucacugauuaaggacauuaauccaauuguaucagggucucacccuuaugaccucauuugaucuuaauugucuccuuaacagcccuaccuucaacagagucacaugagggguuaggguuccuacauaugaauuggcaggguggaggugggagguggccggggaugagacacaauugauuucauagcgucgaguuauaagaugggucacaguauuagaugggaccagagcagagagggucuguaggccauggcaagagugagaauuuacucaauacacaguggaaguuggggaugagugagaagcacaagaguggcacacugauuucuacaacagucagucuagcugcuggguggagaaggggagaaggaggaauaguggaaaaagcagggagaccgcuuaggaagcugcugggaccgugcauaugagagauguugguggcuugaaccagugcuggguuucucagcauuggcaguauugacauuuugggugaaauaauuaguuggggaguggcagggcgggggguaggggugcaguccugaaccagugccagguuucucagcauuggcacuguuggcauuuugggugagauaauuaguuguggggggcuguccuguguauugcaaaauguucagcagcuucacuagucucuaccugcuagaugccagaagcccacccaccccgcccccuagucaugacaaucaaaaauguaucuagacauugacagauguuaaccugggauuaggggguggggagaccaaaauuguacccuguugagaaccacuggaccagagucauagcaauuuguaguggauagauuuaggaauauuugaagacuuguaaaauauagccugaagggaauggagacugggagagugaaagauaccucugagacauuuuggcuuggacagaacaggggguggaggcuuccauuccugagcugcaaaggaguggggagggaggagcaguguaguuugggaagugugugguggagaaggcagauggggcaggagcucugucuugcaucucucaggucagaaaugccucagacauccagggggggcaagcuaagauggaguugaacacagcaguguagggcucaggggacaggccaggaauggagagaaacauuuggcacucaucuacuuguagcuucccugucgagaaaaaugaaaucauccagggguuuucaaauucaguggucucuggaccccuucacacuguuaaaaauggaaaacccugccacugucuacauguuuauguugccccaguaaucuaugcauugaaaccuaaucaccaugugaugauauuaggagcuggggccuuuaggaagggauuaaaucgugagggugggggaccuuuaugaaugagauugugccuuuauaaaagagagcugcuuugccucuucugcuagaaggugcccuccgugaaccagaaaguggagcccucacaagacacugaaucugccagugccuugaucuuggacuucccagacucuagaacuguaaggaauaaguuucuguuguuuaaaagcuaccuaguuuaagguguuuuguuauaggugcccagacaggcuaggacaaacgccaauaagcuuucguuuauguggguuguauccauugauacuugcuguaugaagaauuaaaauuaauaacuuuaaaaagauuuauugauucagaaacaguaacaaaacuuaauaugcguuaacguacuuuuauguuggauaaaaacuauaucccaccccaguauaugaauagaguggcauuguuuuauguguuuaaucucuggcuuaacagaaggcaauuggaugaucauaccugcuucuauguuuauucugcugccaauaucacacagcuucuggaaacuuccacggcacacauucaugagacaauaagaguuaaaaagguaaacagugucuuaguaguguaugaaaauaguuuaaucucauagacccccugaaaaagcugcagaauccuuacgcguucacaaaccacacuuugagaacuaaagaucaaggaguacaguuuucucauuuuuaugcuguucagagugugguugaaguucagccaucacuaguccuucacggauaguucauaccccaaguugauggccuuguggaauugcugaugcuauuuucauauauauauauauauauaauucuagccuuuuucucuggucuuauaagagucacauacguagguaauuucauauccuacaaauauguucuaaacagcagaauauuccaggaaaccuuaagugauaacugaguugaaagagucauauuuuuuaagcaauacaauuuaaauaauuuuuaaaggaaacauuucuaaaggacguuuuacauugcuugcauuaaaaagaauauaaugaacauaauccaacuuuuucucaauacucagggucaucacugugaaaguaacuucauucuaugauaagauaaugaugcucccaggugggcaaggcaguuuuucaucuaagguaauugagacaccuuuuaaaagcaaaagauaaauucacagacccucagugucauuauaaauuacuugguauaaagauacuuaaauaccuacagccuuauaaggccuaggugucaauuuuuuacgcuugcagaucuuuuacaacuguaaguuaaaugauuuuacacauuaagugcauauaaaacaaaaagauucaaacccaaauauuaauuuaaugacauggguaauauuuugcuaaaaguaaaccacugcucagaaugugaauaaacugaccucgaaggccugaguacguuugaauuacggaacaccucucuuugacaucacaauugaauuuuuucuuuaaguaucgcaaggccccaguucacggaaguaccacaacauaaauuggucuucacuugguaugugaacacauauuuauauguuaaaugugucuuuucuuuuugguguacaacagcuagaguaaugcaguuugcuugcaauguguuuuuuauguaaaugcugaugccgaauccacuuggcagcacugaguuacaagaagguuaaguagaugaacuagaagauggauaaacgaagauagauaaaaugaagaaaaacaaaaaucaaggagaacucaggcguccaagaguguguaaacaacuucuggugugagacgcgcuacauugcgcuaaauggccugugcgcuucugguuuuucccuuccucuguugauuuuuuauaguugucuuuuauuuuaaacacgccuccccccccccuuuuuaaacugauuuuaccaucacucucucuagcccugccucccuagaauuagcugcuucuuaccucccuuggaucuggaacuuaaauauuaacguguauauaaguuaauaguaaguagaccgugaauuuagaagaguaaaacagaaucaugaguacguagucacuguggccccuuuucugcuggauuucaaguucguaagcauuuuuggaagagagucgaaggggaagggguggcuugccagucaguugagugaugcgugagggaggcguuaaaugugcaugaugcacuaaaaugcauguuucgagauccaguaugacugcucuuccauagaugaugaaaccaaggcagagaaauaagauguaacucucuuaccuugauuagugaugagaaugggacagcuuuauucaugaaacccggaaaccacuagcccauucuugggaugauugauaucugcaaggaucuucaggaauagaguaccuggggcucaggagccaagacuagaaguguugaaaggugagcaggaauuagcugcuggccucagacguggagagacacacggguguaugugugcacacacacacacaggcacauguauauucaugauggcuucuuaauucccacuccaggccaacucauuucccuuucccuuccacagguacuuauaccauaaaagguauaugaagugcuaaaauacuuguagguauguugucaauaugagcuacucuguaaaugauaaauaauaauugacuggugagucuaggcaaggcaagucaaugagauuacaagaaaagagauguuaggccuucagaaagauggaaauuucucuuugucccugcagggacuguugcagagcauuagagccacccucaaacaguuacccagugagucuccucaaagcaaguggcacugagauacaaccuuccuacagguuuucaagucaucucguguggugcacaguccucgcccuaccucgaaggcccgggcgaaguuuuccugaguguguauacucaucucuuuguguugucucuggcagggagcaagugaguacaggauuggaguaauaggcauuuuuaggcuugagauggcuuuguguguuugguuaaugucacuacauuuccuaggggauaauaaaagucuagcaugauaaaagaucucgucuuacaaggucccgauguaaaguuuggagccuaacuuagaauuuaaaauaaaauacauuuugacccauuguauugagagcugguauaauuuaauauagugagccccucggcuucugguugguuggguuauaaagcuucuuauucauucgcucauccauuaaugcauuucuccuaugaggaagcuuuuuccuuugagcugaacacacaaaauuaaucgugcucgaacucuccaaauuuugugaguucccugguaacugacuguauggaagacagaaauaaaaaucagaauaaacuuuuauuuucugaaucagaaagcaguugcuccagcuuuugguggucacauugcuaagauguaaaaaacagaaguuaggugaaauaaauuaagaauaauuauuuuggagaaagagaggguaguguuugacuaaauuagaaacauucucugagucuuagaagcgugaaugauuuaaaugagguuccagcauaguauugcaugugguuucuauuuuagaguuuucccacuugaaaacaaacuuugaggauuuuuauugaaguccaucaguuuuaacuuacucaaagcuuagcagccaccuuuugcuuuucuucccguuccccccaccucaugcugugaagaaagucauacaccauugugguguugauugaaaccuuuauuucuccaggucuccucucauaaacugggcuaagaaacacaaaggacauuugacacuucaugacuacauaagaugugcuguuccucucucuuucuguuugaaagugacuuggcagggugaaguugagaaccccuuggaaaggaggaagccgaaaugcaaacaaaguugaaucaugaagugaugucacucugaaccaauuggagcaguggugucaugugccuggcagcuacuucaaaugcccacaaaacaggaguaaugguuuaagcuguuucccucuuccccucccaccaccaaucagcagcagacugcuagaggacagaugcaaaacaguuauuagaccaggcuuaguuagacauggaggaugcaucuuaacaaguuaguaccuuuuugcaaagcaugaagacuaauucaaagucuauuuucugguuuugcucuaccaguacggccaaaaccauuucuuuuuaagugagaaguggggauauggucagguuugauuccaguugaaguugugagcugcacagggcuggucugagcccaguggcaucuuuccaggugucagagccaugauuuuaagcuccuguuaaauucacagugcuuaguaaccauaacuucuugguuucaugaucauagggguuuuugcauagcugccacccccauuuucuguuugugauccaguaguuaaaacucccagaaaauauuucucacccugguuuaaauaaacaaaacagccaccacaaaaacaaacaaaaacuuggcuaaccacuauuuucaggcauauucugagagagaaagagggggaaaaaaagacuagacauccuaaaauuaagcaacauuauuuuuggaauuguguuguuucuuauacucagucauuugugaaugaugugguucaaacaaaacugaaacaaaaauaguuuuucucauuaaaaauauguuugucgcauagccagcacucggaacuagggaggguaacauggaaguauugucauucucggggcugacugguugacagcagccuauacaggaguggagaauauugacagggcugcccguucuccccaggucgaagagagcaaaugcacaucccugugugcacggccaccugguuccucuccucacuugcuggugaguauugaacggcucacauaauuaggcagaacucaggaacuuuccucccuaucucuuucacucuucugaaaugcccuuuauguuuuccucugcucuuucagucccagugccuuuucucuggugcagccucaugguucggucucaccuucagcuuuuccuucccuccaauacauccuguaaauuauugucagacuucuucuuaucuaaauaacucguuuagguaagguacucauauguucaaaauaccaugguggcucccuguucucugugaugugaaguccuaaccauuagacucagcuuucccccaggacaccuuggcuuaucuucuugcugcuuuccagaggcaugggccauuaggcugguuuucugaagguucugccaaaaggcugggcccuugucucccaccccacugcuguuacucauguguucucccacuugcucggcauucuuucccaugcuuuuuccuugaucaucacuuacuagcuaacaucuauuuuuuccuaaacacucuguugcaguuguagucugcagucacucuccuaagacuugaucaucuauuacgcuguuucguucuuuauuuuuuaacuuuucuucuucuuuuuuuuuuuugaaacggauucucgcucugucacccaugcuggaguguacuggcacaaucucggcucacugcaaccucugccuuccggguucaagcgauucuccugccucagccucccuaguagcugggauuacaggcacgcgccaucacaccuggcuaauuuuuguauuuuuaguagaaucggaguuucaccauguuggccaggaggucaggucgaacuccugaccucaagugauccaccugccuugaccucccaaagugcugggauuacaggcaugagccaccaugcccgguuguuuuguucuuuaauuuuacaaacuuggcauagcuuagaagaccauauacaguggcaccauauacaguggcaccauauuaguggcaccauauacaguuuucccugagaaaacugguaccucccaacagauaccaaaaucugggaccaccccaacagauaccaaaauccacagaugcucaagucccuuuuauaaaauggugugauauuuguguauagcccaugcucaucuuuccguauacuuuaaaccagggauccccaaccccugggccacagaccagucccgguccauggccuguuaggaaccaggcugcacagcaggaggugaguggcaggccaacuagcauuaacugcaugagcuccgccuccugucagaucagcagagguccuagauucucauaggagugagaacccuauugugaacugaacaugcagggaaucucaguaaugccugaugaucugagguggaacaguuucaucccaaaaccaucccucucccccacccaucuguggaaaaauugucuucuacggaaccgaucccuggugccaaaaagguuggggaccacuacguuagaccaucuguagauuacuuauaacaccuaauacaauguaaauaguuguuaucauguauuauuagggaauaaugacaaggagaaaaguccauacauguuuaauacacaagcauccuauuuuuuuuccugaauauuuuugaucugcaguugguugaauccauggguguggagcccucagauauggagggcaugcuauacugaucaccccuaugggugugaauguugggcagauccuccagugucaccagccauguggccuuggugaccuuuccauacuuuucaaucagaaugaugaucuccaccucucaggaaaguuguggggaugaaaugguauagucuguguguguagaguuguuaggcuggggccugccauguuaaaugcccaugaagcagguaauuaugguaguagugguugauaucuugaaaucagggggauucccaaauuucuaccccaaaucuggaugacugcauauugcgggaguucaguaaauauuuguugcacuaauacuuaugugcauacgcugaaauaaucuaaauauuuaaaaaccaaacuaacgguaggacuuuccucagggauuuaacguuugcuguagaagacugaaugauagaauauauaagcuguauuuuucuugugauucuacacauuguccauguugcaacuuaaauauuuuuggaaugcaauguaaaagugauuuacuguccuauaauuguuuuccugaaagcaaaaugauauuuaagugaacugcaaugaaaaaugcaacgacuguaauuuaucguugaagggcauuuucaaaguguauagaaugacuaaagcuuaaguguauuaaauauucuagaggaagacauauuuaggcuauaaaucuagacuuccuuuggaauuuguuuccuuuuucucagccagguguaugaagauuuuaaguucuuaggccucagugggaagaagauuuaagguuccaagaguacauuuguaucucuuuuaaauuuucuauuguuuaucagugacauauguaaauguuuuagggagcuguuuacuguaacauuaccuacuuuagcucugugcaguugucuggcaaccaaugugauaaagacagagggaagugcuguauuuuguugcugacaaguauaucuuaaaagugcaggugcaccugaauaggcaauaaaguauuaagagcugcuccuggagcaguuugcucucugugacgugugaaaagucuacgggguuuauaauuggucuggccauacggcugccuaggauuagacucuuuucauaucccacuaaacacucuccuuagaagcaagcacaaggagauaguuuauuuuaaaauguaauugcuauguuacuaagauuugaauuugaguaccgagaauaaaccauauuucuguuuagaggcugguuggcuuaaaauugugucuaauccuuccccugccccccaacuccgaaucagagaaugaauaacaaauaaacaugacaaugaagucucaugcuguuguuuucauauuuguauuuaggaguuucagagcaaaugacuuggaaaacaggcaaauccacugacauaggcauuuuuagccaccuuggaauccgaggagggauucugcacuaugcccuguaaccucguucacaugccguuugaauguauaccaugaagaccccuuagcucagggagcuuugcucuauuuaaguaauguuuauauucuuaaugaaccaaagaggaaguggucaugggaaaagagccaggacuagauuucauucuaaugcuuauaaggagaguucuaggaaacccucagacuugguaaaccaaggcauuuggagauacuaugaauugguuuaaaaggccauuuaccacuucuuuuguaauuggccuuuuaaaccaacucucacuuagcugauuaaauguggucauuuaaacugcuaguuaacaaucggaagugcaguggcgcaaucucagcucacugcaaccucugccuuccggguucaagcgauucuccugccucagccuccugaguagcugggauuacaugcgcacgccaccacacccggcuaauuuuuguauuuuuaguagagaugggguuucaccauguugguuaggcuggucucaaacuccugacgucaugauccaccugccucggccucccaaagugcugggauuacaggcaugagccaccgcgcccggccuaagauuucuuauugugguauucugcaguggagaaugggaguuggaaagaaauguuuucucccacaccugucccgcuccugucuacugaaagcugauuaaucagucagauagugaguuccuauugguaguacgccuccaaaauuuggaagaggggagguggcgugaugugaaaaagcaaggcuuuagggagagauucccgcugggggcauucacccucugguccagcgugccuguuacagugaucacuccauagugguuuugcaugaacaagacugcccaguuugcuuaggaagaaaacaaaggacauaagguaguucucaugucuucccagcacccuaaauacucgggcuaaacuuccacagucagaccgucagcuucaggaagggcugcuguugggaacuuuuuuuuuaguuugcaguuaguucagcuccagccaaaaaccuacaaaaagccacugcaagcccucugccugcucguauaagacaccuugguugggccccugugacuguccauccauaggaugguuggccauugacugcacagagagguagggcaagauaaaacgacucauuuguggaucugacuccuuguacuucuguuuggauucaaacagaggaagauagaguaguggccuugggaaaccguggagagagaaaaggcauagucagaauguuuucagaggagcgcagacuuuucaaaaccccucucaucacguucccacugaccuucaguuccagugcuguggccacagggugucugcaccccaacuucuuugccaagaaauuaaugaucugugaagacacacagacaugaggcggacuuacuauuuaaaggaauccugaaacgaauauuuuucugauacauauuuauccuaauauauuugcugagcaugguuuuuuuuuuuuuuuuuuuccuauuuuggaguuuuuggguuuuuuaagccuagggaaugccuaauauguacuguggagugcauuuguucauuuauaucccagugcauuguaaaaucgagcaauucagugccuuagaauccuuucugugaacuugaugcuacgugaacuacuugagaacaacuacuuucaagcccuccgaagcacucaguuacaacugucggucuaauugcacauuauucuaauucauuaaaaaaguccccaagggcuucuuaggauacugcucuauguuauuagaaguccuuccaaauagaaaaacuuuauuaauuuaaaaauaaccgccaauucagacuucgauucaaacaaggcauuuuaccaaguccggcugaaagagcuucuuaccacaucuggcauguagaauggcagaagacuauuuuugcuagauuccuuguugcugcagccguuucugauguccuuuuccccuucacaccuuucguguuacacaugucugagaugacaugaugcuaaguaaccaaaguacugcugcgauggaauugcucugauguuuuuuuccagagugaaagcugcuauuacuuuaaaaaaaaaaaaacuugagguuugguuucuuucccccucuauccggguguuauacaaauauguaauuaagauguuuggggguucagaugacaaacaaggagucuacuucuaagaaugcauuugcaagccaaaagaguggugaaccacuucagagugcgggucugugggggaugaugucugcuuugcuucguuuuguggaauaauuuuuaacauuucuauuuagcauucaugauacucuaaauagaagcaggagaacacuguggcucucggauccaggagaggcaggccacgagggcuccugcuguuuggggacagucuguaacucuaaaucuuuuuauaugcagcaauuaugaccuuaaaaaugggugacucuaauacuggcauucauugccuaaaaauaauuuuaaugugcaaaugccagagaccaggucaucucagaaauggacuagaauugaccacugcuauguuuuggugaaaccugauaaccuugcuuuucuccguguaccuuguuuuucauuguaaaacuauuuaauuaugaaaaugagagugugaaaggcaaaguaugauugaauuuagggggcaguuccauauaguuguaacaaacugauuaucaaauguccaccauuaguauguuaaaauacgguuuucuaauacugagacaacagggauggagcagccuauccacugaagucuuguuguuugucccugcugugucccaaccuggaaucucuuucuucuuccuucagcagacccuucgagaucagcuuaagcuucacugccuuagagaaacuuuccugucuaccuggacugucuucuagauuucuagagcaguguuccugcccuuuuccuuucuaaauggggugggaguucucagagaacucaucuccuuuauggcuuuauccaucacagccacacagauagguucugucuggaccauccuuuucccugagcuuucuucuccuuugccauguguuuucauuucugccagacacuggcacuggggaagccucccaucgucucagacucagggugugugaaaaacaaaccugcuuucuggacucuacaguuugugcacuagccuaagccgaaaaucuugaaaucugucaucagugacuauuguaguccauaggaauacccaagacuggguaauuuauaaagaaaagaggguuagcuuuuuuuuuuccggcucaugguucuucaggcuguucaagcaugguuccaacaucugaucaucaucuuuuuuuuuuuuuuuuuagauggagucucauucugucacccaggcuggaguacaguggcgccaucuuggcucacugcaaccucccacuucuggguucaagcaauucuccugcgucagccucccaaguagcuaggauuacaggugugcgccaccacacccagcuaauuuuuguauuuuuaguaaagaugggguuuugccauguuggccaggcugaucuugaacuccugaccucaggugauccccccacccuggcuucccaaagugcugggauuacaggugugaaccaccacgcccggccaggaucugaucauuuucuaggaggccucagggagcuuuuauucauggcagaaggugaagggggagcaguuguaucauggcaagaagagaaagagagacgccagaucuccugguagauaacuaacagagugagaacucacucuuuacuguggggagggcaccaagcccuucauaagggauccaccccaugacccaaacaccucccaccaggccccaccuccaacaaugggaaucacauuucaacaugagauuuggagggaacaaacauucaaacuauaucuacgaccaaauuuuccuaauuccuuucuacuuaaaugcuuucuuuuccauuuauuucacccacaucugacccuaggauuucaacguguucuaaaaugaauuucuugcacccauuuucacuuucucuccaccagaauccaucucaccacccaccugccaguggcauacuccuugcauagacccugcucuagcaugaauauagcccacuguuaucuguuguagaaccucacgcccagcuucccacccugugugacaucuucacccucuugcccuggcuugugccauccacauuccgaucuugaugacucugguucucuucucuuugacgguggaggguugaucccuuccuuccccaugaucauaaaaggucaugccaacacuccuaaaacaaaagauagauuaauaagagaaaaaccuaacaaauuuauuauaugugugcaugggagucauacaaaauaugaaaacucaagaaaauggccagaugguugauccuuaaaugcuuuauuuauuggugagaagguauuggggguguaggaguaaaugauuuucagggaaaaugaauauuucccugagacagcaauuuacuuguaaaugaugcucuuuagaauuugaacacgcuccagaggcagaaauugucuugugaaaaagucugucuggguaugguugcauuccucagucuugagcugguggauggcagggugcaauugcaggccguaguguuccucuuuggggaucugguuucuagguggguaagggaacuucagagaacagccuuguccugugcuuugcgagagacaaaggaugaggaaggggggucagggaccuugaggcugcuucagcaugucaagagugccauguuugggacgccucaacacuggaaauagccuucauuccucugcuucuugggucuggauccuuuucuuuagacuccaagaaauucuuccuuuugccccaaacucacauuguuuuugucuucugucccucuacuucuauguaauucuauuauuaugcacagauucugugugcccaaggagacuguaaacuccaggagggcaggaauuaugucuuaaaacacuagcgguuaaacaguuaagaggugucuuaaaacauuccuguagccccagcuacacucuugggugcaggaaucacaagugccuuauuccccacaggguccccagcauauuccaggagcucauuauguuuuuaaaugaaugaccuacugaaggcaagagaccaggaaggaaaguuuguaaaaguuuacauuauuagauuaccccugagauguguaaccuucucacgaguuagauuucuugaaccacugcccggguauuguauuccuacucuaggagcuugaaggauuaaugauaauccuuuuacagauauauucacaaguuucugugaaugugaauuaaguauguagaucuugauugccuuucuugagugcaugguuuuuuucuagaaaaacaaauuuaaguuaggugggacaccuaauaaagcucuaggcuccuuucuuuuccucuuuuaagacacaguuaauuaccuuaugcuaaguuggaauauaggaauuaucuuccaaaacuguguuugcuugcugugucuacauaaaaauugauacaagguaugccaugguuuauacaauuucuggcacauuuaccuggucucuguuacagguuugugaaaccaauuuuuuuauuguaaauaguacguuaccagcuuaauugcuuuagaaccuagacagucuaugucugugauaguaauuacauucuuucaugacuuuguuugguaaccugaauguugaacuagcucuacagauuuaggucaugucugaugcuagccauuccuaggaaaaaguggugaggacuacauuaugggccuuucccccuagacuuaaaacugugaagaagucauuuuggguugagguauccccugguacccucuccugaacuucaauagaauaacaugauguggugaaugaaccauauuagaaaaaccagccaaucagccaagauucuuguauugacucuucugaucucccucuaccucuccuuuccccaucugccaaacaaaggguuuggaacaguuaaauucuaaaguggugucauugauggcucucaguauucuguggacuuuccugguugauucaguacuugugauugaccuggacccccugguuugguccagccuuagagcggguuugcagguagacaccuuccuaauguuuguuccacguaagcccccggagcacaguauuuccaucagcuauuuuguggaagugagcgauucucuuuugguuguaaaccuucacuauuucaugugggugacuugacaauggcuccauuuuugaauggcccauugauaguuguagucuaaaaauuuccagagauuacacaaggguuuauuuaaagggaaugggaauagggagaagguauaaccuuuccaaaacaaucuuuaaggcaauuauaagcuguuaggaaaugucauguaauaauaacacagauacccaagcuuauaucacauaaaucauucauuuugcauguuuuugacagggagauuuauuuuccagguuaaaaacaaaaaagaaaaaucuuaaaagcuuaagcuuuuauuguuugcuuuuuuuauuaaaaaguaauuuggagccaguaacuuaaccuguuuuucauaaacaugcuaucuagaggcagccaaaaaaauauucaugcuugcauagucaggguccucaaaugaacuuauguguuggaucaugauaacucugguaauuacucgaauuacccuuguugaguaauaguauggacccugaauacaaggguuugauuuauguggccagcucugugcugcuggguuuaugaggacuugccagaugucaucuccuaauuaaaauccuucuuuacccuuaauauccucuccucuguccccaagaaauuaauccauucuauugcuggagcauguaacagcugauguugaaguuacaaguuuacagcuugaacuuugccuagacuguaccuuuuuugggaaagaguuugcaaagcuuuuaagccugacucuugucuuuagaucaccagcaucaccauggugccuggcaucaguggagccucagcaaguguuuaugguggaaaccucagaagcugucacuuucucuggcuguaacaguugucaucuuuguuuacagggaaaaugcucuugagaaaauggaggucauuaaacacuccagcuucagcaauaucaucagagcuuuccgucacgugaguuaucucaccaaagggucagauucugguaaaaacucuugccuucacacuuacuucuguuuuauuuugccuuauuugacauuucaccagaauugauccauagguucaauaaggcuccauucuguugggacaaaucaagcuagaaagacacugaacucuggggguuaccagaaauaucugaaagcaaagcagugacugugaggugggaaucucucugagaauccuuugcagaaccauguaacagcucugcaucacuagacgagccaagcgaagugguccuggaugguucaguaggcucaagcauugaggguccagagcauccuuugccccuggacauggaaggguuuucauugggagauggcauuuagggcauccuuauaaacgagcaggaguaaaccuagcaauaaaaaccaaaccucugccuucagagguauaugcuauuacuucugcuuaaaccguugucagagcuaacaguuuugguuagggauuuuuguggguccagggcacgcccagacacccagaugcuucucuauguuuguaagauggcgaguguugagaugucuuauaggcuuauauugagugaaaaggaauaggauccuuugucaguaguaacuuaggcuuuuuagguggccagggcaagagaacacccccccuacacacacacacacacacacacacacacaccccuacacccacacacacccaccccuacacccacacacacccaccccuacacccacacaccuucccacacaaaccuacacccacacaccuucccacacagaccuacacccacacaccaggauuugaaggcucugcuaagaggcuacaacaacuguagcauacaacuagcacacuuguugcuauuauguguaggggacuagauggaaagagugcagauaggacuaccuaccauucaccccuaccagcgaaguggaagcacucaucuucuuucccuucuuacccuuucaaagcaaguuguugagggaugaagaggagagugacuuuaaucguggcuuuaaguagagauuuucuuuaggaguaauuguuucucucgacagaguggauaggcuuccauaguugucuuaauaccuuuuguccaccccaaggauugacccaggcaaggaggaugaacccuccucaauuugggaaaguuaaauuuuaggcacagcaggucaaagaguagggaagagcugcaguuguuggaaccaagugacauugauuuagucuggaaaggagucacagaggaaucaaaagccagacccuccuggcagcuuuagaugugguuggggucugggaauaaugcuggucccaaaaucaccucuggaacuaacuccuguaaaaugaagccucugcauccuucaguaacuuacuuaaaauuuuguuagggcugcauuuucuucaaagccaaguucugaauaagaaguauuuguuuugggcucuagccagauuacugaaguauuguugagggagauuugcuguggaagguguuggggguacagggauugugaagauaauguaaaauauuuaacauuuuaaaaauuuucaguaaguucucuuuccccaaugucagcaugacuucuucauucauguucuuccaucacucuccauucaguuagaaucucaauuguguaauaucagugguagcgacaauuaugaaauucguccagugaggaaaauccgcagagcuagagcccaaaccagcaacuuuguagugaggaugaccccacuggccggggagaaacugaacugauuuuuuuuuuucucucucucucagcuuuuuauuuugaaauaauuuuagacuuacaaaaaaguugaaaaagcauccaggcaugguggcuuauaccuauaaucccagugcucugggaaaccaagacaaaucucuuaaagccaggaguuugagaccaagcugugagacuaucucuacaaaaaaaaagaaauuaaguagccagcagugguggcacguggcuguagucucagcuacuugggaggcugaggugggaggaucgcaugagccaggaguuccaggcugcagugaacuaugaucaugccacugcacaacagucuuggagacagauuaagacccugucucuuuaaaaaaaaaaaaaaaaaaaguuuguaaaauaucacccaguuuucccuaacguuagcauuuuacauaaucuauacaccaauucucacagccaagaaauuaacaaugacacaauacuguuaaccauggacuauuugaauuucaccaguuuucccacuaauauccuuuuucagucccaacauccuucauuguguuuacuuacuauaucuagucuucuccagucuguaaaaaugugucuaucuuugcuuguuuuucaugaccuugauauuuuugaauaguauggacagguuguugcauagaaugcuccaaauugguucuaauguuucucaucauuaaacucauuuuuauacauuuuggggaagacuacuacaagauugacauugcaucucagugcgucacaucugugugaugucagcaucuuaccacugaugaucucuuagccuugaacacuugauugagguggugccugccagguuucuccaguguaaauuuucugcuuuucgcauuguuacugauaucuuagggcugauacucacaguaugcagaugucucguuucucuuuuuucauauuucuuuucuuuuuucuuuuuuugagacagucuugcucuguugcccaggcaggggagugcagccucagacuucuggguuugagcaauccucccaucucaguuucccaaguagcuagugugcaccaucacuaauuagugccccaccaguuuuguuuguuuguuuuuuuguuugggcagaaucucgcucagucgccagacuggagugcaguggcgcaaucucggcucacugcaaccuccaacucccugguucaagcaguucuccugccucagccuccucccaaguagcugggauuacaggcaggcaccaccacacccagcuaauuuuuguauuuuuaguagagacgggguuucacauguuggccagguuggucuugaucuccugaccgcccaccucggccucccagagugcugggauuacaggcaugagcuaccaugccuggccuucaccaauuuuuaaauuuuuuguagaaacucacuauguugcccagucuggucucgaacuccuggccucccaccucagccucccaaccacaacuggccaagguccuguuucucaucacauugucacucacugaucuugucaugcuuugguggagcuuaucuacaauaauuauuacugccaugcuuuaauggcaauuuucuaucuuauugucauuuauucauuggaauuuuuacauaggaaagaccugcuccuucucaaacucuaaacaguuucauucaccauacuuuucuccagguaacuuucuggguggcugaaagugacuuucaaagaauggagauaucuuuucaauguugagagaguggcagucugcugguucccaagaugccuucuucaccuagcauugagacucugcagaaugccuugaccacaguugugauuuggaucuguuggcuugcaaagcccauuugagaauuuacaaaaucauuuucacggccugagagucuuuuagguacugauuuuuuucaucccuucuuuacuaacagacuuuauuuaguagaguauuauuggacagguuugggguucaccuuuaugagaaaaaacuuagauuuucuaauuucagcuuuuuuauuuucuuccaucagugggacaaaguugacaucauugccuaaaaguaauuucugugauuaucuguguauuucaguuaaccauguucuuuggacucacuguggucuucagcagggaugguggccaaacuauguuuagaaagauaaaaauuaaaaugacaucugcauccuucauguaaacccauaaaaaauagcacgugacccugaagauccucugccucucauuccaggcauuacaauugaaaaugcuaucugggauguuaaaaacuaaaacuauucuaggacuuaguggaauauugauaguuagggaaugcuguuugcuuucuugaauuuugaaccuguuauugagaagguagaugcgccuguuuaccccaggaaggcuccucuuugaagacagugccccuggagcacaugaccuuuucaugcccuugccugucaagacuuuuccaguacucuaaggucaaagggcguugggccaggcugaucuaaucaggguauuaaccuugccccacucaucuugauuuauuccuagaucccaguucccagagcaucccuuuagagccucagaaauggaacacaagacagcugaaauaagcccguggccaaaaggcacucugagcaugagggaaguaagcaggcuucccugucacugcugaggcucugucauccagccccagcuguccucuugugaucacucagcagacccgggaaaaauucaagaauuuguuuuuuagugucagugggagacguggggauccugcuuuugcugggagagcuucaguugucugaguccccacucaaccccaggcuccugccaaggccaccaagggcaggagcacuggaaggcugacuauggagugaagaggccacuggguuucacaaacagcacugucagccaaagcuguagcuuguuagccauccaaaagaaucuugcaccugcugccagugagcuuacaccuagaugacagcuggagcugacacucauucagcccuuacucuaugccagguacuauucuaaacacuugccauauacucaguugucccacagauacaacuauuuauccccacuuuagagacaaaaaauugaggcacagaaagguuaaguaauuuggccaaggaagugcagcuaguaaauggcagaccugggguuugaaccgaaaucagugugacucuagaguaccuacucuuagacccuacucucuacugccucucauuagaagucucccccaccucccuaccaccaccaucaccacccacccucccagccacauauaugcucacacugggugguucagauggcuagaaguggcagcucaaccuugugugccucggacacgaaaauauuagguucagacaccacucagacuucacauuuucauuaguuuuggguagaggaaugagaauaaauauucagcgagacagccuuuucuaacugcaagauugcauuccucuucuuucuagaugcaguggcaagaacaguacccuggaugguggagcugguagugguagaugagauagagcagucccuugauucugcuuuguccccauuaaugacagaucugagggcauccagaaggaaucuccacaagcccagccuccacaguggcugcuuccucuacaugguagaguggugcucaccuccacuccuccauagaugccaagucaucugugguauagauguggaugucuuuguucaaaugguccuugagucuuugcucagaugauccuugguucuucauuucaccugggaaagaaaauaauuugccuguugucauuuuauccauaauauuaagaaaacuuaauggcacaaucuaagcuuuuuaccauguuauuuaucaugggauuacuuuuuucaggugucuucugaacacgcaguugucccaccaaacuuugacacugcccuugugauuaauuuuugccuacauuaaucacucucccuuguuuuaauugcacauuacauucuuuucuguccuucccggacaucuuugcuagcacagugagugcagggaggacugucacggacucucuccccucuugaaugggggcauuccagcagaguguguuacaugagcucagagcacaugaugugagagccucgugaugaaagauacugcaaaaacagugcgcacuguuaucaaaccugacugccuucacaucuugcuuucuguggugcaaaauaagguuuuuauaguguccuguuucuucuguuaucaucuaaaccaauggggaacggugaguaaguaguaaucuucagaaaagaagaaaagacagggaggagaaaguguacuggaggccugcuuuaccauuaaguuguuaagauggagucucacucugucaccccggcuggagcgcaguagugcagucguggcucacugcaaccuccaacuccuggguucaugcaguccuccugccucagccucccaaguggcuggggacuacagguguaugccaccacaacuggcuaauuauuuauagagauggggucucauuuuguuguccaggcgggguuuuuguuuuuuguuuuguuuuuuuuuuuuuuuugagguggagucuugcucugucaccgagguuggagugcaguggugcaaucucagcucacugcagccucucccucccagguuccagcaauucuccugccucaaccucccgaguagacuagcugggauuacagcugcgugccaccacgccuggcuaacuuuuguauuuuuaguagagacgggguuucaccauguuggccaggcuggucucaaacuccugaccucaggugauccgcccgccucggccucccaaagugcugggauuacaggcgugagacacugcgccuggccguccaggcuggucuugacuuccuuucgcuuguagccucccgaagugcuggaauuacaggcgugagccaccgcaucuggucucuaaguuuuuuuugaaaguguguguguauguguugaaaaacaaucuuacugccaucauauugaaguuaccuagugcauuucuucuucaggguacgaagaaaaaagaaaaguauguccugugguugauagaaaucaguaaaauggagcccuguacgaggaagugcugaugagacuccaacuaacuccauggagaugagcuacaaaaaaaaauacugauuggguucaaauccuuggccugccauuuacuggcugugcuuccuuggucaaauuacuuaaccucucuaugccucaauguucucaucucuaaaguauggaaaauaauugcaucugugugaaaacugaguuacuauacguaaaguuuuuagaauaguaccugacauacaguaagugcugaauaaguaucagcuagagagagagagaguuaguuuccagcagccuguuucuguuuggggucacauguggucucuguccaccuggcuuuuuaggccucucuuaccuguucccuguuuauccuugccugccccagggaggaguuugaguugguacauccugacuggguacucugccugugguuagcaaauacucugcauguugagugcuuucaaaauacagaaacaaacaacuuguggaggcauuggaaaaguguguuugagaaacaagcagccucaccaugaaugggaguuuguuucccuuucucgucuuucuggucaucugcugcacgggcaggaggagcuguggguugcuuuucuuccuuggaacauggagcaccacucuccccugugcugauacacuuacaaagaaguucaccuacuccuuggaaaguucuggaaaaggggcuucuacacuguuggccucucgaggagaacgguuuuuguuucugucuuccuggaaaagaggugacugcuggcaucaucuuucuagauaaacuccuugcuaugaugccauuagaagcaguguucuuuuguguuuugcuuuuguuuuucccuguagacaggaauaacauuuugacuagaaacuucccugauguaauaacgaagauggccuccuuagaaaguuccagaacagaccccuucaccucuguccccagaagcagaaguaggugaugcacuuucuuggcaagccacauaacuaccauuucucuacaaucgaagcucaaaaaucugugcuuguauacguucauuuuuuguuuuuacuucuuuacuuccuuugauaagacagaaacuucuguauuaaaacugauuuaacucugaggggcuaagugaacaacaaucuguuguccuauagaggucaaggcagugcucacaacaggaucauugugcugcuguaguucaguuuaggggacggggaauguuuauaaaaacaaaguuuugaaaugaggacagggaaaggcuuuguuuaccuggggcucuagacuuaagguacucauuuugccugcagaauaaugaaaugcagaguuguaauuagaaaagguugauguaauugauguguuaacaauuuuugagguuuuucucuuuccacuuuaggacagucaugcaauuauuuuucugaaccaaaaucagaaccaucagucgaaggcuaaaacaggccuggggaaacacugucuuuuggcaaagaaagacaaagauccuuguucucuaggccagugugcauauguguguaaugcuuuaaagaacaauuuugacaagaacucuuaggaugcaacuuguagagugauuuuuaaggagaugcaguaggauuugugcaaguauucugcuaugagccuaagauuuucaacauggaaaucuagccaugcagugacucguucacuuuggcagugucuaucuuagucugggggugagcguuuguagaaaauauuuagagacucaaguacacucauuugaauuuuugcuguuagcaaauaaauggcaauauguguaacguggugaaugggauguaaagcugucuuuauauuaccacgguuagaauuuaauuuugaaaguugcaagucaaacugcuuccucuugcgucauuaaguugugccucuuguuugcucaccggcauguguguccuugugucauuuugguugcugugaaauugcucuuaccauucuuucauccuucaaccugcugugcuacaauccuaacaugcuguuuuuguugaaaaugcauucacucuuuuuggcaucuuuuuuccccagaaaguuagaauauugggaauucauugguauuagugaaauucccaccuaaugcagcaguuuuuuucucuuaccugcauaauagacgcagaacaaauuaacucuaaacggauuagagcugucaacugacagauacugugcgagauacugaggaagccucagagaugauaccaauaaacaggacagggccuucuggucguguuucuacuucucuuauugguuugucuuagcaauuuugaauugcacugaaaacgaaauuucauagguacacgauacaguaguuaguuuuaaaaguuuuuaaaauauuaaaaaauugaaaguauuuaaaauauuuuuaaaauauuuuaaaaucugcugugugagauagauaggagaccuagcuuuucuuccuucuuaccuugauccauagagaaagcaacccugaaagaagaaaaacucacccauuugagcuuucuuuuguuuccacugagcaauacggaagaaauucaccgcugguuauaggucuucagugcuuucuucagagugggauuguuuuuuguuucaccauaaguaguagucuauuaaauuaacaguugcuagagaagaagcugcaucuauauaugcaguucucuucuugucaagcaguauauuuucacgauagcaaugaaaaaauuccauccucaccagccgcugaaacauaguaauacugcagaaauuccugugaacuaugcguuugcugcuuccuuuuguuuguuuguuuucagagcagaugggcuuguuugcuuuuugcuuaaacauuaaucaaaaaucaauuuauggcuauguaaguggcauuagauaauucucauucugacuacaguaaauaauaucuauuuguucauguuagauaagucugggcggcaguggaauguaaaauagaauuacaugagauaugacauauggcuauguguuuuauaaauuaaugcuuuuaugcaugugggaggagaaguaauuuagcuuacugacaaaaagaaaagcaaaggaaauuccagagaaagaacaggauaccaagucuaaauaaauuuggaagacaaagagaauaucauaguuuaguucaaucuuuuaaacaaauugucacaauuuauacguugggauaagagaaccaugagaaaagguauauucuaaguccugaacaucuuucuauacccugaagauguuuuuauagcucuucugcugacucccugccaaaaaaacuauuuacgguuugggguagggggcgugucaugccauacagcuaaauacacuuuuuuccuaaucuaggaggcaugucuacuuacaaauaaauugcuuaaacuaguuaggcuuguguaaauguaacugacauuuccuugagaucagaaaaaguuuugcugauuaacuauauuuguguguguguguguguguguguauuuagagagaaggagggauuuuauaauuauuacaauuugauuugaaaugucuagagaaagugagagauuauggaaauuaccauaaaugcucccuuuuucauagauuuagaucuguuaauugcaagaaaucuuuuuuuaagugaaucaaugggaacuuuuuauuucuucccuaagauucauuuagccuugaaaaggccaaaaguugaaugaagcuucuaaaugccaaucuuucccuccuucuguuaaagaguaugcuucaacuauaauuacauuugcauuguuuaaaauauuaguaauucuacagccagaccucugagauagcugagaaaccaaaaagugaaguucaaagacaucaucaggcacccucuccacacacaacauaccaggcccaccaaggaguuuacaugaguguuuuugccuuguuagccguggaacgaccugggcaguacccaaaacuuagcaaacucuucuuguaccuuguauucaguagacggucaguagcaccgagaguagggagaagaguaaauauguuucuaauacuuuauucaauguauguuguuaacaguguagacacucugacuuuccuugugaauugcgccucaguauuuaguuuucauuuacccuggaucagauagggcaugauaaccuuugaggggcuuugugcauauguaauuuggaaucugagucagucgggcugugucucucccaacuucccuucucauauucuucucucuccuccuccuccccucccuccuccucgccucccuccuccucccccucccucuuccuccccucccuccuccuccuccccuccuuccuucuccugcccccuccuccucccuccuccuccuuccuucuccuccucccuccuccuccuuccuccucccccuccuuccuccuccucccccuccucucuccucuucucucguuucucuucucucucuucuuucucucuucucucucuaccauugcugucaguugagaugggccugugcggcacuuuguuugcaguugauuggcaaucuucuguucuacuacugcaucugaaucaucacuugcuuccaccaguucucugaaugucuuaccuagugauccugguggggaaauuacagugauuaguguuccaauucuuguuugcccauaaguguuucaaaguaguauuuuuaaaaacucuucuaagacauucucucuucucauaguagaugcagugaaucuuaaaggugcccuaacuaaaauuuuugugcuauaaaauuggcagcuuuacaaaauaaaagguucgagauaugagccugaucaaggcucugcauuugcaacaauauccuugguuugccuggcccuguuauauuuugcuguugugauaugacuccugccagugcuauuuccauuuaaccuuuguuuuucuaaaagacaguaauaauuuuucauuucuagggagucucugacaucagcuaaaggaaagacacuuuucuuugacuguauauacauuucuccccauuucauuaauaucaaaguugcucuuucaaauggcuuauaaaauuuuaaaauuacaccaguugcauaagccugcauaaaaagcagacuccuacauaagcugacaaugcauuuguaccgugguguugagcaguuuuaacauccuccgugccucugugcuucugcuagcuacugcucugauaaaguuaucaagguaucauuggaugcauugaccaggaugaagacacaacaguauggccuuauuaaauuuggaaauaaugaacagacgaguagagaauuuaggagcaauauaggcaagcuuaauaggucuuuacuuuggggccuguaacuccaacuacauauggaagaauuuaaguacaggaaaaguuaagcucuuuucccaguaguucugcugacaaguugggugacuucgggaugguuaccucuucaugauaccacacggugaugguaacagaggcacuguccagucucugguucaugcacacuggucuucucaggggucccuguauaggugacacaguggagaacagggcaguacugccagacucagggacccaguucaucgagaggggcaguguuucucuuaugcugccuuaaaggcauuggaugccuuuuggaaagccaguggacaacuccugcauccacccaagauuaauguuaacagcuuaaagaaucauugcaaucaagggaaauuuugcaacacuuuguugggauauuuuuaaauaaaugugugaacaccuuguuuuaggcuugcugaaaaugacccaggaauuccuugacccgggaauauaguguauggcugccaauuauuauauuccuucaucagacaaaggcggaacaguucacucuuuuucuuuuuuuuggacacaaauucucacucccucacccaggucagagugcaguagcaugaucucggcucacugcaaccucuaccuccuggguucaagugauucucaucccucaguuucccaaguagcugggauuucaggcacguaccaccaugccuggcuauuauuugcauuuuuaguaaagacaggguuuuaccauguuggcuaggcuggucucgaacuccugaccucaagugauccuucugccuuggacucccaaagugcugggauuaagguaugagccaccuugcccggcuaccggacaguccacucuuuacaggggggcgucuugguauaaguauggaaagcuccguagaugccgugucaguccauacccucaccaccuucuugacccugugccgauaaacuaagagaugugggcaguguaccaucuggaaaggaaaaggcuuuggagccagguaguccugccugcauuugaaucugcuuucuaccacuuacuuacaucagguuuuccuugucuauaaaauggaaguccuuguacccaccaccuagaauggaagugaggauuaauccagaccaacgaugaagaguccagcaugcaggaaaugcucguuuauaaccauggaaguuucgaggacuuuugaaauucgaugacauuaaccuuugaggugcauuuuaguuggcuugugugaugaggccuuucuacuucuaguuccagaaucgucuggaucuacauuaugugggaauguuuauuccccccuuuacuuucccaaaauuugcuaaacauuuucauugcuauuugaguuuuuuaggagacauacugagaugaaguuagggaugugaaagguuuacugaggauaacaccaaugaaaggaagagaggaggaagaugauggguguggggagcgguuugaccaggacucugauaggacagacacucugccagcccuccgggagcucauuugcagagcccccuguuagauggauauaaccgggcccugggaccauugcugggcucaguuacuggccaggagcugccuaggaagagugugaccuaggccaaaaguugaaguggacccuagaagagcuagcagcuggagggcaucugcuagugacacucuggagcuggacagcaaguccuuucugaaagaggaucugagcugaguaucccugugguccaguauuucaaguuggaaccucuagguuugaaaaauacauguuuugggugagaguuugauuauucuuaaagggacauaucuuucaaacauauggcuguggaagaggaaacuuguuuuugacuuguaaaauaccagcagagccuugcagugaucacaacuuaugugaaauacagaccaucacccacaguuuacguguucacacuaaagugccagucucucuauggguuuuagagcugauuuagauacaugcauugcuaauacagucagcccagccaagauagugccauccuccgcaagcauccacuaaggcauggagucagcuuccgucauuguuagaucaguacuuguuucuuucccuugcuuauuuuuccuaaccucucugaaccugcuguguuggaagcuuaaggaacaucauccucuguugggcagaauucuuccauggccaccccagcauuaugccccacaccauuugacuuacucauuugugaaugccaacucagaauguauugcuuugauucuugauuaggaucucaaccucuauuuauuguuaagacuaucacccuuugauucccccccaucccauuguguccuucuaaaggcacagaauagaacaucuucugccagaaauaacauacaaauuuaucaucauacaacuguacaauaugcaaauaacuugcuagaugauauuacugaagauucuacauccaauuaaaauaaaaagagaaaacaccuuaagauaaccauacuauuaaaagauacagaagacaacuggaauaaauggaaagacauaccacauuuauuagacaggaauaaucaucauuagcaagauggcaagaugucaguucuccguaaguuuuucaauuuaauauaaauccaaauacaacagauuuuuuucuuuuaguuagauucugagguuaucauuaaaacaaaaacaaacaaacaaaaaacugaacaagagcaaggaguccuuaccagguauuaaaaacuuccauagugccuaaauaauuaaaauagugagauaccaauagaugaagagacagaccaauggaacagaauagaaaguccaaauguagaugcaaguaccuguggaaauuuaguuauucgauaaagguagcuucacaaaucauugggacuaagauaaacucuugauuuacuggauuggggcauguaaauuauggcccaaucaugccauguuucuuuucucuggaaaagaaaguaaauuagguucauacauuauaccauguaccaggcuagacuccaagugaauccaagguaaaaguguaaacaaaacuaugaaaguccuggaagaacacauagcgaguuccuuuuuauaaccuuggagcagagaaagccuuucuaguuucaacucaaaauccagaagccagaaaagaaaacauucauaaaaauugaauuuaaauuacaaaaaaacuuucugcauggccaaaaaccauaagcaaagacagaugccaaacugagaaaaauaucugaaacuucuaucacaaagagcuaaucucccuuguuuaaaaaaacaaaguaaaacagagcuccuagaaauuguuaaggaagaggcuaacaguucaauaggauuugggaugaaguauugaacagauagcucacagaagaagaaacacaaauagcuaagcauagaaaaaaaguuugauuucacucauacgagaaaugcaaauuaaaacuacaccaagauaccauuuuuucacuucucauauuggaaaaaauccaaaauauuugauaacacacucuuuggaaaacaaccccacauggcugggaggacggcagaauagcacaucuauagaggagaauuuggcaauaucucucagguuauaaacacguauucuuugacccaccaaucuuagagggggcauuuaccccauagacuugcacacaugugaaaugacaguugugcaguuguucauuguaguguuucaaauggcaaaagaugaaaaugucccccaaauuccaucacugagggaauaaguaaguuagggugauagcucccaagcuuauuuucucuucagaaucaccucaugaagaaaaugaaggucugugugauaguagcuggcaggugggcaugguggugagggugguguuugagcggagaccugaaugaagguugagaaggagccagccacucacagacacagaggaggccuucaggcugagagagcagagaaggacccuguggcagagacaagcuggaaacagcacugcuuccauggucuggagacuggaauauguggguucugcagacaccuggggggggcaccaccugguaaaucugccuuucagcucuugguucuuccagcaaaccaugccagcuguggcucuguagccauguccucggaagauggcagagguugcaacgaggccucucugaggugcucugggagcacagaggagucagguggaacuuguggcauguugccaagggaagaagugauuuuuagacagaauaggaauuugccaagaagagaagucagaaaagcauaacuggcagaggaagcagcauacguuacaaguaacugcauguguacagggaaucacugagugauggacaagggcuuggcacuugguggggggggguaccauguuaacauguuagcaagaaacuagguagggguacuugacuugggggcagcagaagcaggugugaguguuggacaagacgagaacugagugcugcaaauguuuggcaagacuugauugagugcauauuguggaccugugucuccacuggagacacaaauuagaauauaacaccuugcccugguaugcucagggucuacugagguggagaaaccugcaaguagagucggaguacaguguugaaaacaccaucugcaaccuuaacacagugcuaccaaaaccgauuucggagcacuccugcaggaagugggcuggccagggcaagggaagccguggagaacaguggccucucccgggcaggcaggguaaggccuagaaagaauaagcugagugaagguuuguguguggcccauccagggaccugcgacaggaacacagcggcugaggaacggaugcuuggagaggagggggugcuuuacaugccaggcgggcagggccgggguggggccagaugcuggaggagagggcuggccaagggguggcagagaggccccccagguggcaaguuugcacccuguugcuuccugcaaggagcuuuuguuuacguuuucagcuuggacagucuggcugucuggccaagagugacaacgugacuuaccaucagagcgaagcaccaaagagcacauaaaugaaguggagaucccuccuguguccagccucccccuccccguggccuucuccuaccuucccaguccuccaucaguaccccggggccuugccagaaucucagaaagaaucucuggacucuggcucaggaccucugaggugauuaugcaucuagaggcauccccaggugcugcccaauuuggggaagcagcacuucccgcuggaagcugggaaguuuccccuggcuggggguccugugaggauggagaggccagaaugaggaauggguugugagucaagaccaaccagaaggggacuuagcaaugucagaugauagccugggugaacuacauccuguguggaaaaggcaagguguaacugcuuauuucuugucaagugagccuaauaucaucauguuucuuuuuaugccugcucccaaacucagccccucccagugagaucacagcuccaggaacuugcaaggaaagggacuaacggggcaucugauucacccgugugcccuuaauggcguauugugugaauaaagcaacaauuuuuaguacagggauuuaaaacaacuucugcaaagacagaacuaaaaauuaaucuuaaaagguggaggguugggguggagggcaggaaagaggaggaacuaaauugccauucucuuuggagacuuucuaaaaccuaagacgaagaagaggagccgaauuauggaaacaaaaccuuugcgguuuuccacagaacaaaaaugaugugaagcugcaagucagcaguucuggcgcaggggcuccgggggacgcccgcuccgccggcuguggugugcgcccuuccugcucuccccuccgaggggcugaggcuccuuuugucuggcgcgcgcgccccaccccgccccgggugagggaagagggagcgggcaccccgcgcccgcgccgccgccguggaccaagguuguuuacuacuuuccacuccgaauaacacgccaaucaccagggcccacccuccccgccggccaaucgcugcguugggaaauuccaccuuuccgcggggcccgggcagcgacuggcuggagugucugucagucaagugggcaucccgcaaggaugcagcaggaguauuagggaggcgaucaccagagcagaggaggaguaaccuuccccauaaacaagauguguuccccccacuaagaaagcggguggaggguggaggagccaaaacacaucccagccccggggccccaccggagcgaagcgggccgagcgcagagugcagagucggggaaucccucccuccgccucccgccgucgcugcaguuguaaacacguuucccuccaugucuguuuucccuucucucucaccguggccauuacgggcugcuguuuacaaaaauccugcaggccuuugacaccccguccucccuucccccggcaucccugcccuuauucuggcuuucuucucuuccaucuccuggugagcacagcauacuguucucaggcuuguuuuccuuuuauugcucuccaugugggacaggucaugcuuuaucaacauguaccauuuucuacaaaugccgcccuuccucuuuaaauugcuuggaugggcagaucgauuuugauuagcaacacugcagcagaaacaaggugcaucucuggaaggacugggugguuuucucguuauuguugcugguuugggucacaucggaugcuauuuuaaauucuguguuuuauuccacgaugggucuugaauccuuucccuauuccuagguuugaaauauguuuccucccuuuaaaaaaaagaaggggggcaguauuguguugaaccaaauguuuuucuaccuucuccugugaucugaaucagguuucccauuuccagcaguacaaugugguuguauucagugugauaggggcguaguggacaugaauuauuugcgacagggcugccuggaagaugcggagcggaguuugcguggcccggagcagcuccagugucugaggcuucucugugucacaggcuccaagcaggaagcgcaggcaaaauggcaaaauacagcauguggcauucaguucaaaaaugcccuuuuuuagaagucgguauucuaaaugacauccagucuugcuuaguuuuuuaagagaaaggaaaaauaaucuaugaagaugguuuggaauauuuugugaaaagccuuuucagcauaaaaaagaugaucuugagggucugguuugcggaguggaggauaagccucccuccugcgauucugaauugcuuuuugguuuguaggaauuucaggaacauguugcaaagccguggccgcuugaaagggucggugcccugcgccccgucucagccccugcggccccugaacuuuuucagugauggggcacuuggggagaagugcggggaguggaggaggaggggaaggugcauugcaaauagaaauguaaggcguggccuggguggccaggaugugccagagcagccuccagaccuacuuaaaucccaggaaaaguccugccucaaguuaggcacaacaucugacuuggauuucucucuguuuuuuucucuuccaguugucugucugugcgcccucucccacaaggaauaguuuuccacacugauggaauuaaugcauaucgugguauuauugguggaauauguuuaaccuuuguuucgugauuugagaggaaugguucuuguguaucguguggugacagcagguuaaggagagugucagagcuggugcagaguuuugccccggggccaugagguucugggcaucaugacucucuuaugaaguuacaaaacugggcaagugauugaaggcagaaagacacuguaauaaagugugcuccagugaugugugcuccggcuucucucccuuacucaucugggccaggugcuuucgccacagugagccuggguguccccugccugagaugagcacagugaugucuaugcgagguuguaggacucagugaagugccuuagggauuuugccuggcacucuccugggcucaugaggugccuagggcugagacuuccccuucucugucugguaaaucaucucucccauucuuucuucugcggcccuucauaugagcuuuguaauuuacucaggguggcagggugaauucaucuuuugcuggguuucugcaucaccugcuccuuucuggccaggucagccuguucauuuuuuccaugccaacagccucuaagugccaguaagucacgucugaacaaccaaagcauguuucccugcgggagaaugccagggcaggcgggucugggagccaagaggauuucuccuguucagauaagucgggggaauagaagagcccugugacuugagacaagcuuugagugacacccagugaaucucccaucacuacuuuaaucccugccccaguguucugguucccccuuuccugcaugaggcaguacgaguacccuggccuggcuuuggguucuacacggucugacuuuagccugccuuggucuuuguuccccucucacucccuccaccccugccccccccaacacauguggaguaccuuacccugccuuccuaguucuggaauggcugccccugugccaggccaccccauuuucuagaaccaccuucauacagccccugcgcaucccacuguacuauuuccuuguuuguuuuuccugucaaucuugccuuccgcgcuaaugggacacugaugcuguauggugauguguucucccacagucaucuuuuccuccugugguugggguggggagcuuucucuguguccccccaugagagugaggacagucucauuuaauggcaccauggucuguggagccaggcaggccugugugucugacuccacuucagcgcucucagccagcgugggcaccucggacccagacagacgccccgagccugucuuucuggagaaggaaguaguaauaccuuuuccuugagggaguuaugaggauuaacugugccuggcccugaauucgugccuugcagguacuuaggaagugaguuauuacaagcagugcuuuuuaucauccauagauggagauguuaucuaugcuauaggacugcagaaagaauuacagagaauuauguagaaucacuagggacuugauuaauauuuguuuaccuuucccccacauggauugauguccuuuauuauacuuuuguacccccgcuuggcaagcccuugacaaauauugauccaacaaaaaauuagcucuuuaauguauacguuuagaaccuguugcuuugucaguagugguuuuuaugaaaaugaaugcuuauaggucagacuucuggaaacccuaaucugagggaauugggccaaauaggaaagugagccccuuaaaggcaguugucugaccaguacuuggagcacaacagguucuugcuaaagcacuguguuuuuaaaacaguggaguuauuagguugaaauucugaauagcaagaaaaagaauaauggaagugcugccagccccgugaugcuggugcagcuggucaguuugcagaaggaggccaguuacuagagcagaguggccguagaggcugcaacacgguggccaaagcaugaagcugcuguauaguggcaaggucacagugauuuccccacagccucgguuuagagggagacggggugugcugagcugugccugcuucuguagaaggggccuucuccaagucugaguagccuuaagccauuaggacugcugagucuuucuccacaaaaauaugugggaggccugcagggcaggugcucaacuaagcucuggggcugcaaagauccagagccaugccccuccuuggaggcagguccuuguagacgaggacaaucguagccuuccugauuaaagcaggaauuguccaaucaggcuauaugacgggcaucguccauagucuucaccaggggagcuuuucugacuauacaucucuagcccuguggcuugagccagucacuuaauuuccccugagcuuugguuuccuccuccugguagcagagagacuaucagagugaggggcagaugcaauagcauauguaaaacacuuagcguugggccugguguuuaacugcaauaaauguuagcucauauuuuacugugacauagaugcuguaugccuuuugcugaguauuaaagauacugagcuguagcaugcauacuugcaugaaucagucugcuaaguuauuuuaaguuugcauuugaaaauaaaggguggauugcuauccaaauauaaagaauuggaaccaggcucuaaaaggauguuugcuguucuuuagcaaaauaccauucuucuuaaguuucauucaaucauuccacaaaaauuuaagcaucuguuuugucccaggcaggcacugugcuuguaauggaugugcaauagcaaacagaacacuugcuuucagcucacacagagcugacuccugggcagagaauuucgacaguaaagaaauacaagugugaugaaggagaaacccuuugguacuaccugcuacauguuuuaauauuuaaauguugacuuagggaggucuuuccaucuaaaaauaaugauuugcccuuucuccuguaaaugaccccuuucucuuaaguuuugggugagagauuuuuuuuuuuuaaggaagaaagauauucuacaaucgaauguacaacugagauaaugcuuaggagagaauguauacuggguuugugccuuggaaguugcuuaggggaaacaguugugugcaguuggaaagcugaugcuuuaaagaagcuucuauaaagugaccccacaauuaaacuguuuuguguacaucuuuauuuauuuauuuauuuauuuuuuaauugagacagagucucacccuuucgcccaagcuggagugcaguggugcgaucucggcucauugcaaccuccaccucccagguucgagcaauucuucugccucagcuuccugaguaucugagauuacaggcaugugccaccacacccggcuaauuuuuguauuuucaguagagacgggguuuugccauguuggccgggcuggucuugaacuccugaccucaagugauccacccaccucggcuuuccaaagugcugggauuacaggcgugagccaccacgcccagccuacgucuuuaaaaauaaauguaaauacccaaggcucacaguuccguucuuccaucuagucuagcaccguccaguggaaguuuccaccaugauggacuguucuguggaugcccuguccaguacaggagccgcuagccacauguggcuauggagcacuugaaauguggcuagugcuacggaggaacuggauuuuggauuuuuuuaaaguuuuaauuuaaauuugaauagcuacauguggcuaauggcuacuggacaucacagaucuaacacaggauuaacugacaaaauucuuuccucuuaaaaauauguguuuauuuugauaaggauaacugagaccuguacauuccauuuuuccugucauauuuagggcucauaaagggggugguaugcacguuuuaaaaaaugcaacacaaccaguuaaaccagcugucuaauuguacacauuuccuggagcuguugguguugauuauuagcaaauacuaaguacuuguaaugaccuaagaacuauaagacaagcaagucgucuucuguaacugaguaucagcggauucaagcguuaaggaaaaugauuaagagaaaacaaccaaaaaagucuuaaugguucugucaaucaaguggcuaucaauucauggcuauucaaaagcuuuuguggcuaugaaaauaaacuagauugaaaaaauucuaaaacaaaauugaaacacucauuugaguuuaaaauuuuaguugaguugauuuuuauuucuuguuuugguucauuuguaguuuccccccgcuucguuguuuccucagauauggagaauaaagccuggcuggucaguuucaguuuuuauuuaaauucauuuugucuucauuccuuuuaaucuagcacaguccugugauguauugggaucacagugcucuggggaaacauugaaauauaaaaacauuuuccugaaaacauuuccaguuauauuuaauuuuccuccuugaauagaaaaauauuuccaacuuaauccucccucuccccucuugaaaugaauugcaugcuuuggaaauaacaucaauccacccaaguacacaaggacaaucucagccauuuaaucgagauauaaaggcuuagagaacucugggcuucggaggcacagacuccaccuuucaggaugcuaauaaacguggacgaggucucgccugggcuuccuccuccauuguucagcgcagcaaaccagcacagcacuccguggccaggguuugcggggagaaaucucucacucuguuuuaguagcaucaucauccuuaucagcacccugcuuuuauuuuugaacagccaaacuuccucuuuccaaacuucgugugacaucugggaccagcuauguuugaaggagucugaacaugccacauaguggcucacgcuuuuaagggaggaaggccaguaagccuccucaauggcagaauucuacuuucagucuacccuuugguucuguugugguuguuccuuagaacuuuauucugcucauuaggaagcccagccuccggggaggguuuagcuucucaucuaagcaagaaguaaaaugucauaauggaggaaaaaaaaaaaaaaguccaaacuuuuuuuggacuuuuagaaacacauccaguuugagcuccacugagcuaucauugcaguuacaaagcccauguauauugagaucgguguaaaaauucagcauguccaccugcauaauuaugaccaguguauugaaagcacauuucauuuaguuuugcaacagccgaugagguagauucuaccaacauuguuuuacggaagaacaaauggaagccuggaaaaauaaauugucuaccucacacacuucgcaggugguaaacacaggauuugaacuaagacauacuugauuuuaaaguguuugcuuuuccuuugcacuacugcaucugcgauguuugcacucagacacucuagaauauuugguguugcauguuuuugccccaagaaagaacccauuaaaaugaaacuuuccaguucguaagcuuugcccucaagaagggaaagaacuucuugcaagguuucugaaacaaaaagaaaaugaaaaguaacuuuacuguaucuggguuuucugauuaaauuacgguuuuugcaagcuugugcauuucucaguguccagauagccaggauuuuuccuuuuaauaaauaucacuuuaaaaaacaaacacacacauucuuaaaugcaugauuaacuguauagauugauuuaguuauaagauguccuagccuaaauauaagaagguguauguguuagaauuaauuucuucaauaaagagaaagaaauucaggaauugugguucuguuggucuucuguacuguauauuuuugugcagccaaagcagcaugccuugcuucuugguuucaugaccacauggguaguuucuugaaguuuuuucuuuugagauggagucuugcucugucacccaggcuggagugcagugacgcgaucucggcucacugcaaccuucaccucccggguucaagcaauucuccugccucagccucccgaguagcuggaauuacaggcaugugccaccauaccuggcuaauuuuuguauuuuuaguagagacgggguuucgccauguuggccaggcuggaguuucuugaaguauugacugauccuugacucugaacuguaugaucaaagacuuuugaaauggcacaccguuucuuaacauuuaggccaauuucaguugcucauauccaaaaauaagucaugauuuucggagucagugcgcagcacuuaguacaacaauccaaacccuuguacagaccauccuaguagaaauguggaucuugaguaucucagcuucuuaguagauuuugaacuccgugaaagcaggagccaggccucucacagcaagucucuccaauaugcucaguaaauauuugucagaucgagcaaugaccagaugaugaaauacauuaaagccuuagggagaacugagacuacugcaccaguuuuugugcacuaucaugcuggaaaucuuuccaacauguauucuguacuucuuugcuucuuacuccagugaauauaauuuagucauuucuggccaacuugaggacaucagcgagcauaaauuguuguauuaugcauaauacagugauacccucaaggcugagugggaggcaguuugcccucugcugaagguuucuugugcuuauuguguucuuaugguuugguuuuaccauuuuuaugucuccauuucuguuuaauagacuuauuucaguaagaagagaaagccgucuccaucagccccucuguaggugauuauuugccacuuccuuuuugcugugagugcuuugaaaacagauuucuaagcuuguuagaguuauguguuaagaguaaauaggcaguaagugaaaccaagcuucuuccuggugcuugacuaccccagaaauguuuauuugcugaauaguugaguucuggaaaggugagguauaaaugugugauaaauuuauuccuuugcaugauuuuuuuuucuuuuucuucccucccucccucccuccaucuaugucucugucuuucucugaacaucucuccgucucagucugucucucucaugauaguugcuggaauaauuuaaaugaauguaacucauuuacccacaucgaagcccaacucaguagugaaaaaacaaaucuuccaaaugaaugcacuuuccccuugaugugcuauauacaagaccuuggcacaccuaguucaaugacauaguauuuuagaagggccuccuuacaccuuccucucagauaaauauacaugcagggacauucugaagaaguuuguuaucggucuucuccccuccuacuauuagcuccgcccuccuaguccuucucuuucaccaugcugacccgcguagggaggacccuuacacccucugcaugcagcgcuggugcuccuuaguguucauaaccccaaccuccauggccucucucgcaguucucagguuaggcccugcuucuaggggacauuagcuuuccacccucuacuacauacuuccuaguuguugcagccuuugcaagcaaaacuuguuuucauuugggagacagcauggucugacagagccuagauccuggggugaagacauucuggguuuguaucccgucuuuaccaccucugagccucugaugcuggacaagucagcaagucuuugcaccuuagucuccuuucuguaaaaaggagcuuauggggauguaaucagagaagccuuagcauggcucuugguacaaggcacggaccaaauccaugguacgcucacuccuuuccuuucaguaauacugccuaaauagggcacauguaccuaaaaggauuuuguacauuccuugacagcagaauucucaucuucuguugcauaucccauaaugcugggaacacaaaauaaaaaugguagcuuuucacauucacuuuuggccucaauuuuuuguuauuccccaaugaggaucauuucauuuggggcuggucuccggaaaaaaguagaucaagcuuuucagaugagauuugggugaaacccugacaaacucuuuuuauugccuucccuaccacauagugguggaucaggaaacuguagggcuuaugaugcugggaaauuucugcuaaugcaauaaagauuuuugcuguugaaagaauuugaucuguuuuauguauaacaugcagagagcagaagcauauauuaucuguagcagaugauagagcaggguauaugggcaaguuagaaaaacacaguucucacuacauuugaagaaaaaggacaaggaguugucacaaggauccaggagagucgcacauaauuuucugucgugcauuuuguugacuguuccucuuugcauccuucaaccaucuuaacuucccacuugcaccucgcuggaagacaaaucuaagcuaaauuaaaugcuaggcaauaugucagaauggaaagggcccucaacuugggaugcccgguucucuaccagccugaauaaacuccagcaacaguauuucucuaggaaucaucuguaaaaaguagagguuugucauaucucuaaacuagggauucaccuuauuuauuaagcuaucagugacuuuaucuugaggugcacggcuuuuaguaacucugguucaagugcaaggaaugcaaaguuaaguguaucauuggaggugggauuuuugaguuugucagucauuuauugauuugcauguauccuuauaguucaaaggucuuuuucucaacuuaguugaugaucaugcuguaaguuguuuucuuuugcuuuaucaacuuuuaaaaacguuuauuaacuuuuuaauuugaaauaauuucagacuugcauaaagguuacaaagaguaccaggaguucuggaacacccuccacccagcuuccacagauguuaacaucuuacauaaccguaauacgguuaucaaaacaguguucacuccauacuccagugcuguuaaucuccagacugaauucggauuucacuauuuucccacugaugucccuuuuuuugguuccagauccaagagacgauccuaccuggcauuuauuguguucaguuuuucuaauucugggacguuuuccuggguuuucuuuagucauucacgaaguucgcacuuuuggagaacauggggccaguuauuuuguagaauaucuuucuguuagaguuuguggauguuuccuccugauuaaauuugggggguacauuuuuaacuuggagaucacagaggugcugcuguuugugucuuugcgcauccugucaggagaugcgugauguuuccuuuccuggugcuguuagcuuugaucccuuaguuaagguggucucuguggcuuccuccauuaucauuacuauuuuucucuuuguaauuaggaagaaucuuuuggagguagauacuugagacuaucuaaacaagcauucuguuccucauuauucuuucacccacuaauuuuaacauccauuacugugauguuugccaaauggugauuuucuauuucuguuuucuacacuuaguaauuggauucuacucucaggauuuuauguauuuuuuaacagugagggacauaaacuuuuuaacuagcaguggcaaguccacuuuuauuugggaggacaauuacuagucacaugaagaagaaaaaauaugcagaagcuuaagaaaucccacauaugaauguuauuugaaauguucuugcccuuucucccuacaaaggaggugaagaagaugacaggagauguuaauugccaaaauagucucauaguuuugguccuggcugcaaaucucucguuuuugauacucaagagaaugcuauuggggaacugacucugaagcacagcccagaugcuugagauggguugggaagguuuacaucaacaccaugaauuuaauuuaucaugugacauuuuauuucugaguuuuuaaagcuguaauuaaaagaaguguucaaaguguugcuuuccucuuuuagaauaaacguggcuggguguggugccucaugccuguuaucccagcacuuugggaggccauaggcaagaggauugcuugagccaggaguuugggaccagcuugggcaacauagggaaaccacaucacuacaaaaaaaaaaauuagccugucaugguagcaugcaccuguggucccacuuacuugggaggcugaggugggaggaucaccugaguucaggaggucaaagcugcagugaggugugaucaugccccugcucuccagccuggacaacagagcaagacacugucucaaauaaauaggcaaacauuaccaacauggcaaacaaguuggaggaggcccccuauuuaauuaaauuucagcagucccaaaucuaauugguaugaagaaaucauuauucagaauuuuccaucacugaaauacuaaaaucacuuguuguuugagacaucuuggccugucacccaggcuggagugcaguguugcucucauagcucacuggagcaggagccucaaccucccagguuuaaguuaaugcucccaccucagccuccugaguaacugccacuacaggcgugugccaccaugcccagcuaauuuuuuaauuuuucguagagauggggucuguguugcccaggucccucuugaacuccuggccucaagcuaucuucuccagucggccucccaaagggcugugauuacaggcgggagccacagcgcucagccuaaaaauaacucuuuagccaaaagaaaguuuuaaaaaauugucuguuguauucuuugauuuuacucuauguggucuuuucuauuauuuuuaaaauaaaaaagauuuauacuccucaaguguaacauuuuaucaaaucucaugcuucuguuugaugaaaccgaauggcuaaauuuuuuaaauaucaugcaauccaucccaguuuguaauuuuauuauggcccucacacaagagcgugcaagcuauacuaagcuuccuguggcccucguuuuuccucacugauauuuguaacucauuccaaauuaaauuuuaggagucugaaauguagcuguuauauuugggagaugugaagaaaagaaucguaggcaucucaguaggcuagguaucagaucacacaugcuugcuggaccaaagaggacuccuuacaguaggauacaugauucugaguuaguuuguguacuaaguauauacuauauagcuuuugaaggggagacgggcacagaauucacaauaucaugcacuaaggguuauuuuguguuugcaguuuccagaugaauguuuuaaaguuggcugcagaauacagcgagauagguaaaaucuauuugaguauuacuuacagaccccaaaggauaucccaaaggauauguuggacuaauuccuaaaauauccuguaagucauugcagguacaggcguggaucuggguuuggaaacgccgccuggaucgcuggcugggcuccugcagccgccaaggaggggcuggcuggagguggggcucggcgugcauagcggccacgugacugcgccccggccacgcccaccgucccucacguggucccaggccacgcugggcuucggcaugugcuaaaguggauagaaaagggaguggggcccgggcguggcuuugugguuugggaagauaugaacuccuugggguuuuuuucucuuuuaauucuuuaauuuugauauuuggaaaugcguaaaagguuuuucauuuguccuugaccacgugguccaaaccucaauuucccuagcagaacgcgguuucgaucacugguggauccgucucacagcaccagucaugcugccucgcugggaaguggagggcucaggauucccgugguucacgauccauuuuauguuggaaggaaaucauuuugaacuaucucaguacacacccuaguguaucuuuaaaccuaauugaguguugauggaaaaucugcgguccgagaaccguaagaaaagggggcucccaccucccgcucuggggucgccacuugccucgcaggcaggaggaggcucccagaguagauacaacuugcccgucacccggauggguugguagugcacauaugcacggggcgcaguuuaaaaugaaaguaaaagaugcaaauguguuugcaaaagaaaaauuaacauaggauacgugcgggcguucucaguugaacucggucuuacuguuccacgcgagcaccccaugacucagagcccaaaucucagcggaacagcccaggacgcuccugccguccacaggaagacgccucugucucugucccccgccgccaccacacagaugcacguacucucuucacuuccguguacccaguaaaugcagauccugauuuaaaucugcagcacgcugcuuucuucccauugcaugugggaagcuucagguucucuucgguuuauuuucucaucaccuuuauuaaaaugcaguaaagcaaggaguauauuaaugcgggccucugcaaauagagggaauuuauugaaaagcagaauggcuugaaagauugaacuucaucuuaaaaaucagaaacagacucuuguuauuaauagcuuuagaaacgaaaaucuaacuucugauaaauuauuucagaggagugguucaaacguguaguagauagcucugccuggucaucaauuauagugacguccuugcaucagcuccagaaacucagaauauucaugagcuuuccagucugacucagaccuucaggagccaugaaauuuuccuguugggaugagaggaagcgcuggcggucguuucggcagcuuaaugaaaccagaaauagauaagcacgagugaggggugauguccgcuuguuugcucccaucauguuguuuuuaaugugugaaagugaaaguuuuaaaagucauacuaaaugugugauccuuuuuagaauucacuggguacggguacguggaggaaguguuuuuguuuuugugaauuuguuuaaacaaaugacugaggcuuuguuuuccacucugucuggccaagcaccauugcuacacuuuuuuaaauucaugacauccugagcagugaagcuguucuucagcccgccucuccauuugugacuggaagacaaggaggcagacaccaauggcgccucucacaauggagguuuauuuuuuuuuaaucuaacggagggauuguagaugguguaaaacuuccuugugccaggagagaaagggggagagagagagagagagagagagagagagaaauaacccauucuaaacaacuuuaggaauagaugauccguaggcaucaacuuugcgcagcaacaaaagccacuuucugaaccucguucugugaaguuuuaaaacaaauuggguuuguuuaauuaaaauauuucuuaaaggcaaaaagcacugagcuaauuuuuaagaauuuuaaguuauauauuaauaugaguagugauuuauaauuuucuguugaaauacauaaauucgagaagccccaccccuaccacuugccagucuugaguccccacggcuccuuugccuaggucuaaagucacugcuugcacacuccugccuugcauaugccuugccaucgugugggccucuuggcuggaaguguucuuguccucccguuagguaucuuuuaugacgugaauccuuaccucuaauuauuaucuguguguacaucucaucaccugcaucugacugugugccuuguguaugucucuuagcccucacaauugccugacaugccuuacaaacggguagaccaaguguuaaaugaacaaauauuuaauaagaacuuaaaagcuuuuugacuuuauauauuuuuaaagccauugugauuaaacacuauguuugauguggugcuaauucugugcuuuaucaacugugugaauuguaguauuuuuaaaguaggaauaauugagaaauauuuugaaguuagguuaagcauagcaguaaaguuuccacuuuuuaaaauagccaaauccaggccaggcgcaguggcucgugucuccaaugucagcacuuugggaggccagggcgggcagaucgcuugaggucgggaguucgagacuagccuggccaacgugacgaaaccccgucucugcuaaaaauacaaaaauuagaugguugugguggugcaugccuguaaucccagcuacucagagaaguguuugaacccgggaguuggggguugcagugaguugagauuucaccacugcacuccagcuggggcaaaagaaugagugaaacucugucuccaaaaaaaaaucagagcgugguggugcacaccuguagucccagauacuugggaggcugagauggaggucaaggcuucagugagccaugauggcaccacugcacuccagccuggacaacagaguaagaccuugucuccaaaaaaaaaaaaaaaaagccaaaucuguuggguuuuuuuuuuugggggggggguccuuuagaauggcccugacagaucuuuaaggcauggaaaugagccuuaugcaagcuccuggcaaucaguaugugaguucugucuccuuggcaagauacagccucuuagacccucagucuggggaaauaaugcugauuucuccuacgaguuacgagaauuacgcuagaaaacucuguggcgcauacaggugcccuguagccuguugguuagaagcacugacccugaagucaggucgcccagguuggaauuccagcucugccuucuucaagcugugugacucugggaagucacacacacucucucuuugugccucaggcucugguucugaagaugggaacggcaggcccucccucuuuggcuuguugcacagaugaaaucugacagcguaugccaagcgcuuagcacggguagcagugagugccccguaaauguuagguaccuuccuacuacuacuaaacauucauucuucccuucccugcuaguaccugcagcucugacucaucucacacccuugagagaggauuaucuucauuaaaaaguuuuuggucugcccagaagcaaguguuaccugugagagagcugggcuugugcauagguuagauuauuucuuuggguuauuccuggggaaaccugcaaagaaaugcagccagaggccucugguucauuuuacugcucaucuccuaaaagugguuucucagauuuuuauccuuuuuuucucuuuuucgaggaaggggcaaggaaauauuuuuucauauuauucuugucaucgucuauuuauuuaauaacaguugacuguugaaacauaggaaaguacuuauccgccaggaaacucccuucuauuauuggacuuacuugcuuuccauuuauauguugucuaauuccaaagagauuucgagacagcuuucaauuaaaaaaaacaaacaacaacaacaacaaaaaaaaacaccacauaccgcauggguauuacacaggaccuguauggucaaauuggcaacgaccacaccacaugagaaggaagauuauucuuccuggaaccuggcucccuugagauucuuuuuuuuuuuuuuuuuuagacggcguuucgcccuuguugcccaggcuggagugcaauggcacgaucuccggcucaccgcaaccuccaccucucggguucaagcgauucuccugccucagccucccgaguagcugggauuacaggcaugugccaccacacucggcuaauuuuguguuuuuaguagagaugggguuucuccauguuggucaggguggucucgaacucccauccucaggugauccacgcgccucacccucccaaagugcugggauuacaggcaugaaccaccgcacucccuugagauucuuguaagccaaggcagaagaagagacaucuuaaagucuguaugugcacaccugccuccccccauuuuauauacaauucaagggcuuugcuuuuggaaaguuugccuauguagucguccagggcuaaauuaacaccugucucuaucuguguguaaggcucucugggaggagcugugaggcaaauaaaaauaaggaauggugucccgcaaggagcuuacaaugugugcauuacaaguauauacugagcauggcccugggaacacagugaaaaaacaggauuccugcccuaguacaguguacacuaguggaagagagagaggcaguaaaccuaaaaguaagucuuuuaaaaacugugguaaaaugcacauaacauaaaauuuaccauccaaccguuuuuauguguacaguucagugacaguaagaacauucacauuguuuugcagccgugaccaucauuuauauucagaacucuuuucaucucgcacaacugaaguuguaccuauuaaacaguaacuccucauucucucuuccaccuaggcccuggccaaaaacaaaaauaagucuuugauuguaaacacgaucagugcuuugaaggagaugggaaggauguuaucauaaaaugauggggcugcaggaauggcaccuacucagagagggcggucaggagagaccucuugggaaugaugacauccagcaggcaggucauuaaggcaucucuaggcagguccagagugcaaggaggcauaagccaggcagguggaacagcgugugugaaggcccagagucaggaaauggucugcuuccuuccaaggaaaagaaaacagccagugugguuggagcaggggcuaggagagaaaagaugugcauguguguguguguuuguguauccccaucaugauuuaguacugucagcgcuucuguguucugaaccuggaguacaggcagacacagccgcaucccagaagcucaagagugcccauaccaggaaauuacagaaaucuuugccaaauggaugagugaaugcaacuuccuugauacagggucagagaggggaaaucugagaaaagcaggugggcaauguacuccugacauacucccuuccguugcaauggccuugagugauggagcaagagugaaggaauguucccauggcacuggcaccaggaugacuuuuugugaagcagagcaguuggucuuagauaguggaggugcgggaggcaugagaacugggcagucugacggcugcaccagccaguuggcuguccuuuccaccuccaugcccaggagcuggcccagggcgcgcaugcacaaagccagugcucuuuucaaucagaaaacagccugcguauguucuugcuugcaacucagauauccagcccacugauccaggaagagauuccuuugaccugggaagucauaauggcagauauuuagacccagcucucaagcaagcauccaaguuguuccggugaacccguaacuuugaguaaccucugauugaaccagagaguaggaacuaggugcagaaccuuguugaauagaauuguuuagcaucguccauuuguuagagcauuucaggaugccuguccuaaaauuugguaucauaaugguauuuaccucucacucaccuccaucucagcccaguaauuaauaacaagggacuugcuucuucaccuguuucuuuauugguuguaggaagucuuuuccuuaccacagaggaaggagcuucuggaucccuuugcuacguccagagaguuuucaucuaaucuggguguauuaguccauuuucacacugcugauaaagacauacucaagacugggcaauuuacaaaagaaagaaguuuauuggacucacaguuucaugugacuggagaggccucaaaaucauggcggaaagugaaagguacaucucacauggcagcagccaagagaagaagagcuugugcagggaaacuuccauuuuaaaaaccaucagaucuugugagacauauuaacuaauaacagcaagggaaaaacccaccccaugauucaguuagcucccggcgggucccucccacaacaugugggaauuauaggagcuacaagaugagauuuggguggggacacagagccaaaccauaucacuguguaaaaguugaauaaaguuauuuaggagcacauuguauugggaguuuguuuguuuguugaagagccaaguaaagucauuggaagcaugggaaacuuuuuucccugucuaaaaggaacuccuuccuaguggaaguugaaagcuuucuuggcagccucagcccccacccuaccuccaccaccccaguggguaccugcauccugaagacccuucacaauagcaucugaacuauacugggccuucaaaugaugucuuggguaaacccauguccaaccugcacuaaaugaagauuauuuucgagcgaauggauugaagaacagugcugaaaaacuagaauuuguaauauuuucauuugagcagaggugaaauuugaaauauuuuagaaucuugucuuaugauuuuuuuucuuucuuugccacauagcccuccccuggaaauuaaaucuguggauuacuaguauaugaacugaucagagacauggcuuggggucuccccauuuacccacuucccagcacguuauaauccacuggacaccuccaaggaugagagaccagcgggucauaaugcgagacuggacaucucuccuaccccauguacacuucagcugagcaggcagaauuagcagagucaggacuagaaguucagucuagggaucaaauaauaauaguagcuaauguuuaaagaguaccuaagauccgccaggagacauacucaguauaguuccgugguuugccacauuucaucuuauaccaguagcacaggugaaauuugucuuauguguauacugaggaaaacaagucccucugauacacagcagccaauaaaugacaaagcugggauagaaacuuacuucauucuaacccgagagucccuguucuugcaugggcacagccugccauccccaugcucugccuccuaagcagaggaugaacuuaagcaucuuaaaauuuuaaacauugacuuucccuaaaaccaauuaaaaaaaaaaacaaaacagacagacagacaugacuugugcccuuaaaaaugcagccaggcuggcauauaaaugggcguaggcuguuucuaaauuuuuugcuuuaaauuuugccagcauagcuucuggacugguaguuuuguuugcuuuuuaauauauuuuugacacuguguacagaggaaugcuaccucgcgucaucauguccuccucccugaaggcaagccaaggaugucaaggggccacuucaggggaugugcacccugaagguaaagcugcuccagugggagggguugggguaaaugacaauguuagcagcugguaaauuuuuuuacaugggauaucucacaagacuuauugaugcauguuauacguaauaaccugaggcacaucaacauuuuccacuuuuuccuauucuuucuguauuuucacugauacuuuuuuucaaaaaaaucuccaauaaguuuaggaucagcuucaagauuucucuuuagguaaauagauuuguauuuuugauggccauccuaguccaguguaaagauauggacaagaaaccccacauaaaggaagcaagaucgcuggcugcuuucucuagguagcuugaguuguauacuaauuuguagauuauuucucuucaucgaaaaaacaaaacauucugcagagggcagucauguguccgcugugccucugcuccugugugcaccauaaaacuugaaagugagccagaauuugaaaauaucggauugggaugugauuucuuuaagccucuggcuaauuuaauauaaaguguuuacacuucauuuuucuggcaguggauuuucuauguaggugguggaagauuuccuguaaguuuugcaaguuccagggcaaagagaguugcaauaugcaauaucuuucuguggucacaccaacagaaagggcgauuucuuaaccugcugcaguuaccauguguguagguggaugcuggcuauuacagaugguauccuuucaacccucaaaauuguugcaaguucacagguauguuaaugaaaaugaauaaguggcauuuuuaggaauuccaaauacugagucuuggaaguagauaaucuuuucccuaaauguaugcuccggucagaacugcugccuaccacaccucgugggugaaacagauauuucgagcaugacugagcuuauuaagagcccugcggcgcuuccucugccggggguuuagaaauuucaaaggauggggguugagggagggaggaguuaugggcaugugauguggacagggcgggcaggaggauggaaguaacagguccaaaauguaucuuugguggcccggcagagcucuugcauggggugagaaugguaauuuaggaagagcaagucuucccaucugugaagcagaagaaaaaaguggacuuaaggagaaguucgggugcuguuuauuuagauaggaguaaggagagugcaguuggggaaaagcacuucagaggcuuuacuuagacuagcagaagucuguuuggcagggugggaagcaagugcaguugggagaaaaacguuuucaauaggcaguuucagaauuggaaauuggaggagggcaguccauuucaacauuuccaacaguauuaaagaaaauuugcggguuguuugucaaaaggggucauaugcuuuaaagauugagagaucuuuucggugaaguaggggagcuggggacaucgugaugugacaagagccgugggcucagaggcuggggaccuggguguuuaacccaacucuugugagugguguggcuuucauagcuuugguucucuggucuucacuuuaucugccaagugaagacauuugacuggaugucgugaucuugaguugcuuucagcuccagaauucgaagaccccuuccauugggcauucaucuaauuucaaagaugcucccuggcuccagcucugcagugaagcagaacaaacugauacagccuagcuuggggguggggagucggcccuccuuuuccccucccuucccagguccucugggugauugggggaaacugagaagccguucucuucuccagagcacuccauuuaacaagcauugcagagccuggcucgugcugcagugaacaaaugcugacuucagccuuuacccuggguuucaggucacacugauuguuugcaaaacauguucuuuuuuugucacuugccaguacuuguucucugugaguaaaacacaaacacauccucagggauguugcacaccaguuugcagccugcagcuucugcccucuggccugcccagguccucggcuccgggacgaggaugcuccgggauuucgggagacagcaguuguuuugacaugaaucucaaaguuccuacaaagcuuauuucuuugaagaaggccaaaaaaaaaaaugaaacauuuucagaucuuuguuuucagauuauucaaguccagaauguuggauaagauuuuugaagaagagauuuaugcuugagauuccuuuuaguuucuuucuuucuuuucuuuucuuuucuuuuuuuuuuuuuuuuaggugacuuggccaguuuggguuuuuacgguguucagggaaaggguuaagaaguuaauuugggaaguacagucauguguuguacaaguugcugucuacugaucccuucauugagcaaguaaacuucacacauucucgugucugcaaagcauguggaugcaugggcaguuauguguaugaacuuuuuuuuuuuuugagaauggcuuuaguguucagaccaaggauggaaugaaagaucacgugugcuuuccacuguagagcugcccugcuuguuuugauuuuauaguuauucuaaguguuaaguuccuucaucuuucaaagcaaauuccuuugaucccugaaaaucagcuaauguuugggaggcaauuaaaagaugaggcugugggguuggggugaaggcuuccccagcaggaagagaggagaagcccacuggaucugggagcacggugcuaggacucucuaagcgugaccuccuucaguuuggcccagaguggucagauaguuugccggggcauaggauggaugacaggccucauacgcaucacgucugaagggaaagcccuugaauuuuccacgcuacuuuuuaguaacaguaggcuuugucauaauuggcuucauguuccagcuuuccuaaaacuguaagugauguugggugggccagcagcaaaauaauucacuuuacaauuugcaugauagucuggaaugaaccgaauaccuaaaaccaggaaauaauaguagauauuuaaugguuuggggaucaaauaagaauuuacucccagauguuuccuaauuaauuggaaaaagcagaagguugcuggaaggccaucuccauugggcauuuacaggugaaauucacucuucaacuaggauuuuacucaugggaugccuguguucuucauuugaacccaauuuuaccuaucaucuacaaaaaaagaaaacuauuaagaguuaaaaaaaaaaaaagagagagagagucuugaacuuugaaauccuucauccacguuuuauaaaguguggggucagauuuuuucccuaguugaaauugaggaaaugagaguugccaauaugauuggauuuguacugccaagaugggguuuuagcacuucuaaugcauucuggcaaggcugguauacuuguaucaagugcacagccccacuaccaccagcucuaccacccacaaaaauaaaaacuagcaaaauaaaauaugagccaacagaauucugugggaauggcaaguguuuuguuuuuguuuuuaguaguaaucuuugcgagaacauuccaaagaugauaguuuuacauuuguauguuuuuuuccgaggcacuuuugaaucaucagauagauuaaauauaaguuccauguauuuuugaaggugggaguguucuuugguacaguucccccaaaaaacugguucucaugaggcuuaugugguaauucuguuaacgagaauguaugauuaucugggauacucuguucugcucuccauccuggauaagaguuuacuuugaaagucuaguugaucuuuugugauuucugcacaauguaaaagguacuuuaacuucaggagauagggccagcaaucagauuugaugauggaaaagaguaguguagcauuuaagcauaauguauacucuauaauaaauguuuacaaguccaaaagugugccaucagaaaguaaccagaucaaaggagaggugaccagagaagcuggaaagauaagaaauaaacaaguuucaagguuacugaucuguagcuguugcuguccaugcuucuuggcagcuuuaauuaugacagggagagggacccagagggagagagagagacugacuuacacauaaaggcauuuuaucacaaagccaucuaaaacaaaaguguuaaaggcacaaugcuguguuuaaaaagcauguacuucuuuaagagcucaaauuuaaauauauaauacaaacuuaagauccaaggaagaaaauggacccaggacacgaagagaaguuaacgccacagguaaugcagauggccaagagaugugugaaaaagauaauccagccucaccaacagccacagaauugaaaugagauaccuguuucugcuucuggcauugggaaagaaagaaaaauggcacuagcagccuuuuuuuuuuuuuuuuuuuuuuuuccccaaaaaauuugcuacucuugagguucugucaaagaaugugcuguggccucuagaagcauuuuuaaaaagagacuuucacaagugauugugcaaaauugugaggucacugaauagguguguauccuccuaaggagguagcguuggaggagcuguucuuguucaauuuacucagcaccugugaagaggcuucacugugauuugccuguacaggugugcagguaaaaaucuaaguuccacagguagugcaaaaaaaucuaccucccuagguaccucguacauuuaucacaguuuccugguaaacaguucugcuguuguugacaaaauuuuaucagaaacauugcauacucuucucuaaauaguaguuucccuacaaguggcugucuucaguuuagucguuuaaguuauguugacauaaaugauuauguguguggcaggggcuuuugcguagguuguugaaacauugcaccuuuuggacuaacaguuuuuaccaaaauaggcagaagugacauuugcagccacagcuguguggcauugagcgucuaagguauguguaauaggcaguguaucgguagcauugauaccuuggucaacaccaguaagccauguaauugcccagaagugggcucuaacacuaguuuuaggagaugcagccaaaacgacaaagcuggaggccucucccucugagcuuggccuccacuuggucaaaacaguccccaguuugucccuacgggacacaggccugccuuguuaggaaaucagcaacauuuaggagcccacaauaccucacauaacucuguguacaguaacagagaauggaaauagggcuguaagcaugaacaaccagucaaguuacaaauauagaauacucucucaauuccacuuuaguuagucauggagggacagugugaguuuuauaaacuuauaaggaauauacaaacaguuccaaauuuaaaauaacuugaaguaacuuuuaagugugugaaaagaauauuuuuuuccacccuguccauuuaagcaucugugacaggcaguauuaagugaugggugucuuuacguacacaugccuguugcucacaguacuggggaagaguugcaaaauagucacccauucugcagugauuucucucuucuuauuugugaaagacucaaaaaaaaaaaaaaaaaaaaaaaaaaaaaaaacaacaacaaaaaaaaggccaggcacgguggcucagaccuauaaucccagcaccuugggaggccaagucagguggaucacaaggucaggagagcgagaccauccuggcuaacacggugaaaccaaccccgucucuacuaaaaauacaaaaaauuagcugggcgugguggugggcgccuauaaucccagcuacucgggaagcugaggcaggagaauugcuugaacccgggagguggagguugcagugagccgaaauugugccauugcacucuagccugggcgccagagcaagacucugacucaaagaaaaaaaaaauaggggggauguggguugugagagcgacacuguguguccaugcgugaagaaacccggcucaugaugaccucgccccagaacgccgaagcagggccgguccagccuggauuucacaguguucuucauugccuuuguccuugauuuuuugucguuaccauuauaacuuaucucucuuucccaaauguauaaguaggcuuugaauaugaguuuaaaagaaagaauucggggaugauuucagaguacacuagaauauuuuuuaaaagaauauuuuauaaaaauacagugauaguaaaagaaguagaaggccaaauuccgcccccagccccuucuuaauauuggacuuuauuccuuugcuuuuuucccuugcugccaucuaaggaggcuuucugugcuauagcauccaguuccucugccaggcauuucuguaaagaugaggcaccuuccacuguuuuauucuccaucauuagagcacguguccugcugacucggagcagaggggaggcacacgggggugaacauucccugacagauuggaugucucuuaacucuuuuuuccugguaucaaagaauggcacaauuuaguugauuugauagcguuaccaaaucguuuuuccuuuagaaugaaucuagaaugcagauagauucugagguccagaugggccucucuccaccaaccugugaccaguguaccugugauuuuaucacugcacauucauagaaagguuacagggcuaaucuucccgugauaugaaucaugaaagucaaaauuuaugaaugaaaauaaaaaggaaugaaguacugauauaugccacaccagagauaaauauugaaaacauuaccuaugcuaaguaaaagaagccagucacaaaagacacuaccuauugucugauuccauucauguaaaauauccagaauaggcaaaucuauagcgacgaaaaguguaauagugauugccugggaaaggggcgugggaagcauggcuaacggguauuggguuuuucuuuggggugaugaaaauauuguuaagauuaauuguggugguguuuguacaacucucuaaauauacuaaaagcuaccaaauuguacacucuaaaugggugaguuauaggguaugugaauuagaucucaauaaagcuauuguaaaaaaugugugaaggaaggggaagcauccuauaaccuauaccaucccaacagcccagcuagaggacgauuccugagccuccuucucagccuuuguguuaauucuuugcauugaugacuucucucucuuuacccuuacuaauuagcucucaaaaccucuauuuaauaaugaugcuauuuauaacuuuccuccuucugguuucuugcuugcccuuuuugugguguuugcuuguuuuucuuuuuucucaauacucugcccagcguugcguguugguuccggagacuuaagugauccagugggcacugucaggcaauuauuucuuuugcucauuaauuaaguguucacagauacauucagcagccaaaccuuguggcaugccuucugucccagacagugagaaucuacuuggaacuuggauauuucugugagccuugauuauauacaccaccaaggggauggcauagaacuaaguuuuuucuucuucuccacaacagacuuuguucuuuaauuucacaagcuugacauagccuauaagacaucauagugguaccauagacaguuuucccuugaugcccaugggggauuuguucugggaccucccacagauaccaaaauccacagguuuaucagcaagggucacugcucaauugcaacaacugaagcagaagcuccucucaucagaggcaguuacugcagcauguucuguagggcaaauauaaccauauguaagugacugugcuaucaggagacagaacaacaagacccagaaagacucagugacccacagagccaguuccacccaaacaagucuuaguaaugagauuagauaaugagaguguauuuucuucaucaauucauguagcucagcaaggcuggaaacugcuugcacacuucugcagagaaaaaaaaaaguuccauuugcuggaacucaauaaauaaagaaggccuuaguggguacguguuaucuccuuagcaucaccuggaugccugacccuuuuccagagugucauguugccuggguuuuguccuucagucuaagugauacaccucuuaguguggcggagaaaagggugcuguauuucuuccugauggauacaugcuuaaauggaaaaguagcaugagaugaacucccauagccccuuccuuuuauuauuuuuaaaauauucauucauuuauuuauuuauuuuugagauggagucucacucugucacccaggcuggagcgcaguggcgcgaucucagcucacugcaaccuccgccucccggguucaagcaauucuccugccucggccucccgaguagcuaggacuacaggugugcccaccaccacaccuagcuaauuuuuguauuuuuaguagagaucggcuuucaccauguugaccaggcuggucuugaacucuugaccucaggugauccacccgucucggccuuccaaagugcugggauuacaggcgugagccacugugccuggccggcccuuccuuuuagacaauagaaacaugcugcaaccacauaccaccauaaacacggugggggaagaggcugcaaucaacagucaggaggaucuggguuccaagcccagguuugcaguguaacagcugugugcucuuggugugaacauuuggucauguacaaaugaggauaaugauacugcccccuugugaucauuagggggauuaaauuaaaugcagaaauauaugugagaugcuuaauguguuguaaggcgcauggaauauauuuagugaauauuaacuguauauuaauacaaaguccuguauucagaaucuccaguauaaauuacauuuauauaguagagauaugaauaguuuuugugaacaagaagaccuggaacuucaggugacuagaagcucagagugagccagcuauguuugaugauaguuauucuuaagaucacacagagaaacggcaagcaagcugcuuugggcaaaaaagagcauuucuacacuguucagacugccucuguacuguuagaauaggucuagggcguguugcgugaguggugacugaguaagauguucagagggaagccgugaccgucaucuuggaauauuguuugaaagucugaccuguacaaagcagcacucacuuccccugcgugucagacaccugcaugagggcuggggaggguccaguacaggaaagcgcauuuuuaauauguguauggaggaaguucgucaagaugggugccaucuggcaguggaguagcacuuccuggaaaguaaugagcucccuuggacuuuguuugaagagucacccagguuuuuguaaagaaguguuucagaucaguaugcaauggaugacuguaaauuucucuucagaucuaagaaucugugauuggaugaaagggagaaaggacugcauaagugcuuguugcuuguaaacugggccagguggaugucauggcccuaggagcuucuugccugccuuugcaugccauaaagcaguccugcaacccagugucaccucagagggaugggaauguagaagaagagagugaauagggacagugaugaggggugaaaauauguaacuccuugccccuucuguauacccuaguacauuaggaaguucacccuugucuaggcuuccuguuaggaagacagcagacucaaaauggagucucaaccccuuucaaagacugcaagaucuccuuguacacacuggacuugggagaaaaugagagcuuucaggccugcuaucuuaacagguucagaaaggugugguccagcccccugacuaaccagcccugcugugcacacugagaauucugcucagguguaccuuucugugugcuccugggugcacccccaaagugcugguucucuugaaaaccuuuuuauuuagguucagacagacaaacugugguaucuuccauucugaccauaaaguguuucuucugggucuaacuacuauagugggauauuuucucuagaacaagagguuguuucuuuuuggcauugagaaauguugccgaugugauuuucuuuugugaacguuuaagacacagcgcuugccacuugaacuuucuuuugccgugcguagcugauuccacauaauggcugcagcuccaggcagaaaccuguuuggaaguuguuuuaaacucuuccuggaaucucuaggcaguggcucagugggguuuuuuuccaaccauuccuuaggaugaccagaagcuugacagaauccucuugucuucauuuugagaaaauaugucuuuacuguguguaugugcagcauuugguuuuaccucgugggucuaagcauuuucaacuaagcuuccuuuuccaaccuagcagacuuguuuaaagaacuucaaacuaauagccaagcuguaauacgguggcucucucagccugagaagccugugcucaccgucacucucuucuucccuggggugauagggauggggaguagugugugugagaggacagaagcgaggauugauugaagauuauuuuacgaggcgagagcaugguggcacaccugucagcugaguggacucagcgccugccccggcuaggcuguccuccuccugugccagccguggguucccugagucccucugcagucauucaugggugcugaaaauaaagauacccuuucugucgaaaguguucgccgggcugccucugccucccuggaaaagcagcagggcacacaggcuuccuaggcagccccugagggaggggcucuuuuuauugucacucugguuaguuugaagaccagacagaaggcagcaaaaaccaacccuuuguugaaaacucuuugccuuuaggcccuugguaccauguucaugaggcuccagauaauuccacaaauacauuauuauuguuaccuagacuuggggacagagaagggugaaacaugggucugggaauucacagaugaauauacuguaauccccucgagcacauuucuuuuaaaggaauggggguauucuaaaggagugaacacuccacuggggggcugcuaggccccugugaacgguggcagccuuggccacggugugugcugugaucucuccugggucccccgggcauccucagaccucccccacacccaacccacagucccuucuccauccaucugcugaccacaccccaggauguuuccagcucagaucacgccugauugcauccacacaaacugcacgccaggcauuuccguuuggauguguacacaaaaacaacacgucccagacugagcugaucuuucuguaccccucaaaagaaaaguucuguacccggccaggccugguggcucacaccuguaaucccagcacuuugggaggccaaggcaggaggaucacgaggucaggagauugagaccauccuggguaacacggugaaacccugucucugcuaaaaauacaaaaaauuagcugggcaugguggcgggcgccuguagucccagcuacaggagaauggcaagaauccggaaggcaaagcuggagcuugcagugagcugagauugagccacugcacuccagccuggugacagagugacacuccgucucaaaaaaaaaaaaaaaaaaaaagaaauucuguacccuuccagaugguccuggacauaucuugaaucuacccugcuuuuccucaucugcacugcuguccucuugaucugggcuacugaggcuagaaugcacaucugaucaugugccuccugcuuaaaauaguauuuuuccucuuaagaguaguccaaacuccuauugcuggauuaaaaggcuguuccaggcucucccuaccucagggcacaccaucuuuccucccagucuccccuccccucugucuccagugcuuccauccuucagucaugcugagguugucuuuguuaccuuugcuucucuuggcccgcacucucuguuggcucugccagcaucccuaugcaccugcuagcuccuacucacuuguccagcuuuggccuggaagucccuuccccuggcaggcagcccuaagcuacccuuugcuugcuacuggcucauauucucacugcuuguccucaggcugugagcccugggagggcugggcugaguccccgaaccugccacgucuauaggguguaaccuaccugaggccugacugcuaaaaucaaaagaagccuuucucauuugcuuagcugagcuaaguccuuucuggagaagaaugcccacguccuggguggacuucuguucggccuggggcaggacgcugcaugucaguucaccuagagccccucgcuugcccucaccccucucccuuuccuucuccuccccguguugucucauggucaguuccucuccuggcaaggcaagagaaucauaaaaucucuuuggaccaugugucucucugaugcacuuuggagguugaagcucacuuucgugaaguuaggagcgguuaauccuccugcacgaggaugcaugccugcuagggaaagccucccugcguuuauauggaacagugguguguaccuuagggcaacccagaaacagcugagauggcccuaaacucuuccguauuuugauucagaagcuuuaccuuauuugaacaucugcagaauaaguucuuuccuuuagaaaugauuggggauaaaauuguuugcauuaugaaauauuguauggccagguggccccucuuucauguuuuguuccuugugaagagguugagucuccuauuuuuuuuuuuuuuuuggagauagaguuuuguucuugucccucaggcuggaguaaaauggugcaaucuuggcucacugcaaccuccgccuccuggguucaaacgauucuccugccucagccucccaaguagcugggaucacaggcacgugccaccacaccuggcuaauuuuuguauuuuuaguaagagaugggguuucgccauguugggcaggcuggucuugaacuccugaccucaguugaucugcccgccucggccucccaaagugcugggaucacaggcgugagccaccacgcccagccuaugguaugcuuuuaaaaaugguuucucugcacuaaugauuauuuaaaaaaaaaacucuggcaagaacaaaaacaaaugguuuuuuaaaaacucuagaaauaauuugauacauucgaggacucuggagagggagagaguuaaaggcugaugugugugacucuuuuuccucuccccccaaggaaaaaaaaugaagagaaggagcuuuuaagugcagugccucguuuuuaugugauugcaaaccugaaccaauccuuuuagugguggaugugggacauguuagcuuuuccaacaguuuagaugggccuuuguuuuuauuguuggucacuguaagaauuccaaggaauagaaggaucucaugggcaaaaucaguuugcuuuuuucucuguauauuuguuaguuuauagcagcuucuauuuuccuccuauuuuuaaaagcugaaaugccuuuaaucgcacucaguguguuuauucauggaagccagagaagagggucccuuccuuucccccauagcgccguaauuggaaauuugguaguacuaggugaaauucucaguuuuggcgcucgcauggaacagccauccaucugcuggcgagacacacugcccggggcuuuucaagaaaucccuuaaugguccugaacacuaauaauauuuauauacauugagaugagacaaaauuuacagcgggcucuggggcuggcuccaggacucucuaaucccacacuugcucacguucucuugcuugccuccuagaauccuuucagguugugcuucagugaggggagcaugguguccgucucugcagcaaugcuuauuuaugcaguucguccucuaacaaacagagcaacuuuccuuuugaccuuccccucuucuccccaucacauuccauugcugcccccgcauagagcaugugcuuaugcauaguuugcaucauuuaacacgaaggaaccccuugauuugugaucccuuuaagaaguugcucuguauauaaagaaaaugauuuuuccugguugguuuuacugaaguuccuucagaaauagcucccaccaccgaaacacaccugacuuccccagccuguguaucgguuguggcacggacugacugacuggaugguauaauuucacucacuccuuugggaaguuucgggggacuacugcucagaugugugggaaaugcggaauauaucuacagguacuuugucaguuuuuuuuuuucuuuucuuucucauccuggaaaaucccggcauugauauuuagguauaacuauuugcaagcaagugcagagggacauuuuucuguucuuuucaacguucuuauuacuacugcauuaauagcuacuugaucuuaaugucuauuacacaucauuuuauauaauguuuucuuuaaauugucagggaaagggauucugcaaguagauguugguccccccaguuagugucugaugaugaugguaagauucucagaguuuccuuccucuaaugacaaagcauggugauggugaugucugaagagcagccucggugcuccaagauggguguaugcuuaauacugcuggcacacgccugacgagcgggaaugugagcguuguuucuguaaccaguuuuacugaaccucacagauccauuauacgacgugaauuuugugggaauaacauaggcugggagucugcucucuuccagccuggucccucucuucuuucagcccuacccucucugaucaucaugucccuugcacugcggccagguaaccuuucugauacgaaggucugggcauguuguucccuugccuaaaacuuuccaugguuucguauuauccacaguugggcuaaacccucugggacaggccuucagugccuccccgggcaguggucccuggccuucuucaguaacacccaagcccuugcacccacagugaccucguugcuuuuacaagcauuuacaugugauguucuuuauuccucccuugcucaucuuuccacuuucaacuccacaaaaccguccucggcacccagaagcccaggaaacaccaggcagcuccacucacucccguacuugcugugucguccguucccuggggacaggauugucgcugauccugcgugcaucugucuggcacacaggugcagcacacauuaaauagcugcuaaaugaauaaaugaagaauagauggaauuauauucuguugugaccaguuuaaaaacaugaaauuggaauacccaauugcaguguuucuuuagaucuuggaccuugaggugaccucuguaauggauauauuugaaauuauuaacugucuucaaguggggguuugaugagagagagagagaguguguguguguguguguguguguguguuuacagaaaauaugcuagguuuguacauucaaauuuguguuauccucuucaagaaagucaccuugguagacagcauauauaucccaacauuuuaggaacucauaaaaugcauacuuuuuuggugugaucagagauggguaacuccuuauuacuuguggguuagauuaguuuuuggaaauagccuggagucauugagagccaauccuuaucaacaaaauggcauaaauggacaggaauggguuucuucuucacuuuagagauagcucugaagacaugucucaguugggauuaguucaguugcauauaugaauagcagucauugaaacaagauaaaaguguaugucucucacaucuaaagaagucuggaguaagcaguccaggguuagccuagcggccccacucucauaagggacuaaguuccuuuuaucucgcuucaccauucuugauguuucgccuugugguccaagguugguacuugagcuccaagcauuacuacugcauuccagccagcaaggaggaggauggccaugcccucuuuguucucaggagucuuccaggaaguuccagucacaacguuuguuuauaucucacuggccagaacuuaagucauauggccaccucuagcuacaaggaaggcugggagauguagucuguaacuggauggccauauuaucaacuaaaaauuacugaaaaugacaagaagaauaaauaauggaaggcaaccuguuguuucugucaaaggaugacuucaaaagagaaaguugcaaaaguauuucaagcuugacaguaucaugacaguuuucuucagaggugacgcuauucauuugcauguccaaguucugauaucuguuuucaaguucaccuauuugcagcgaaauaggaacucuuggaggcaacuaguggguguguaaaccgguacaaacuuucuagaggacaguuuaacccaacaagaugaauucuggaaauugauccuaaugaaauguuaagggugcucaugaagauugcuuugccgauugcaauaauaaaaaguaaagaaaauaucuuauaauuggggacagguguaacuuaugauacauuccacaauggaguguaauacugcuguuaaauguuuguggaauucacaaucuuuuaugccaaaagaaagcuuucagaauggcuugucuuuuuuguagauacuuguauuuauauguccaugcacauacauaagaaaggaccagggaaggucugcuugaagauauuaauaaaggggucacuuguggguagguggacuuacuuguucucuauauucucuuuacuuguuugugaucucugguuuuuuuaaucauguauuuuuauuacaagaaaaaacaaauucuagaaucuccacucaauauugcaugucagagucaaaaagauacacauuuaaauaauuuuguauuguuuuccaauuugaggauaaaguaggaaauguauaaugcaaaccagauuucauauuuuguugauuuagacuuaauuuacaaguaaggcugacagcccacagagugugaucacgacagcauuguuauggaaauaaaugccagcucaugcauuugggauguacaccauggaucugugguuauuagauacugauuucacuuuagcacacgaagaggcuuagcggagguggcuucuaauauccuaugguucugugggcucggagaugcuacucacccacuugucagaggcauugaaaccagagcaacugcaucuugaauaggagcuagguaaaaugaggccgaauucccagacaguuaagacauucugagucacaggaugagguuaaaggucagcacaaaauacaggucauaaagaccuugcugaucuagcagaugcaguuaaagaagccggcgcaaacccaccaaaaccaagaugguaacgagagugaccugugaucguccucacugcugcacucccaccagcgccaugaguguuuacaugucauagcaacaucaggaaguuacccuauauggucuaaaauggagagguaugaauaauccaccccuuguuuagcgugucauaaaaaugggcaaccagcagccuuccaggcugcucuguguauggaguagccauucuucuguuccuuuacuuuccuaaucagcuugcuuucaguuuacagacucacccugaauuauucuugcguaagaucuaagaacccucucuuggggucuggaucaggacuccuuuccuguaacacaccuauguucuuggacuuaagaaugacccucagacauggugacuucuuugucaucuaacagcuuuggcuuauuugagguaaaaccuuugauaucuaaggcagcagaaauuucccugaagucauuuugaaugguaucaucuuuacuauaguguaguuuaaucauuuucaaaguaagcauuucugcacacuaaggcuuuaaaagaguuuucaguaaggaacauauuugaaauggaaagugagcagagcacaaugccuuuuaaauuacugauaaaccauagaguuccuguagggcuuccacuggcugacccacgccugaggcaacccucaaauguggguauuaucccccucauuuuacagaugggaagagagaggaucaagaucacagaagcuaaugguuugucccagaccaaacaaggaguuccuaggagagacugaacuuuaaagauaucgacucucugcaggucuaaguggaugaaaggacaguggugggggugaggauuucguaguguguuuuugcauugucuccucaaugagugaucuggugcuggugguagcagugaaugacccagaaggaugcuggccaggcccagagaaggcggugccuccccugcccggucucaucuccgucucuccucucucuccacagugugcccaagcacgugugggaagcgggcgugcaccgagaacaaugagugcugccaccccgagugccugggcagcugcagcgcgccugacaacgacacggccuguguagcuugccgccacuacuacuaugccggugucugugugccugccugcccgcccaacaccuacagguuugagggcuggcgcuguguggaccgugacuucugcgccaacauccucagcgccgagagcagcgacuccgagggguuugugauccacgacggcgagugcaugcaggagugccccucgggcuucauccgcaacggcagccagaggucagucgcggccacacguguggucacuacccgccccaccucacccgccacccuagcacacaaagguagacucugucgguuguuucauccgggugcagcccucaggaaguucacugaggugggucauuuugagagggcuggcuuaccuuaaauguuuggugagauucuaggaacaauuggcauggcuuaccgccccccucaccaguuuguuuuauauuuuaagugcauacugccuggccauuugaaauuaaguacuugcuugcugguuucgauacccagaguucauagucucucuggguacuugccaagcugccaucuaagagacagggaacuguaguuuuggauuuuccuagucugggugcugcuagccaggugaggcuuuggaagugcaaaagaaaagacaugcuaagcccccaccaccauccuugagaccagcaagcggaccuaaacaucuuagugcaagagcuagcagcagcucagaguaggcaguagcuuaaaauaagggacauuuuuccaucagcacuuccuuccucucaucccccucuaccuugacccucccucagugcucaucauguccuucauuuuccuuccugaacuuugagacuucacuugggaagcaaagaaguuccuuauggccaggcauguggcucacaccuguaaucccaauacuuugggaggcugaggugcuuggaucacuugaggucagaguuugagaccagccuggccaacgugaugaaacccugucucuacuaaaaauacaaaaauuagcaccuguaguccuagcuacuccgaggcaggagaauugcuugaaccugggaggcagagguugcagugagccaagaucacacuacuucauuccauccugggagacagagucucacucugucuccaaaaaaaaaaaaaaaaaagagaaguucguuauaacaaaugccauaugcccuuuuguacaugucaacuggacuucuauaaauuugucauugguuuaugcuuuugaaaauaagauguuagcauuguuuaaaaaugugauaacuauaacuuugaaagcaaaagaagauuggagauuugggguugcuguucccuuuccuggagcagaguaaagaacuuuuaggggcucacgccuguaaucccaacacuuugggaggccaaggugggcagaucccuugaggccauggguucaagaccagccugggcaacaugcaaaccccaucuguacaaaagauuaaaaaaaaauuaguuuggcuugguggcacacaccuguagucucagcuccuugggaguugcaagugggaggaucaccugagcccuugaggucaaggccgaaauaagccaaaaucgccucacugcacuccagcacaggcaacagagacccugucucaaaaaaaagaacuuuuaggaaaguucuguuuuaguggacuaaaugccuccuucaugauuagcaccagggggccugucuuucugagucugucaaaaucuauucuacaaauauaaaaauaucguuagaaaaguagguguuaauuuuaaauauaauuuuugcugcagcuuaugaaguacauugaggaaguguuuauaaaggggauucuuuuucuaguguauuauuuggagacgcagcuucuacuguaggcuuaccuucaaaucaaagauaauacauucuuuuauaguauuagauguagagcaacuuucucccucuuauaaucuguauaaccauuagcauacuaacaacaagaagaaaauuacucugaauacuuuaaaaugauaaauaggccaaggacuucaaugagcuguagaggauacauauuacauccaaaaucagucuaccacauuguacucacauuuuguuggcagccuucgaguguaaaagggcuuuuacuggugcacaccucgggcccaggggcagugccuggaaccaaguugaggcucagacacuauucagacgucaccuuccuccuuggggugggguuaggggagugguagcuuguccaugaacucagugugcuaucgucuuuguuuugugaauacauuuucuuaaugacauuuggaggccuucagucguucugcagccaccagaguuguggcaaagugggaaugcuguccauuugacaguguuguuucuuccgcucuagugcacucuucagagaauugagccauuauuuccccuauucauucuuacaguccguuaaaaacuauacaucuaccuuuuuguuuaaaaauaaaacaccauaaagaauaauaaauucccuucucucagccuuugaggcuuauuuaacaauuacuuugaaauauuuaauuuuuucaucuuguuuauaccuucucuauaccauaguggauuugaggaagcuuaaucuauaaacauguuaucaaaacacuuccuuagaaaaacauuuuuuaagugcuugaugacuccuagacuuuuuaccaaagaugauugguuccauuuuuuuuuucuuuucuuuucucuuugauagacucuggcugugucacccaggcuggagugcaguggcacaaucauagcucacugcagccucaaacuccugggcucaagugauccuccugccucagccucccaaagugcugggauuacagaugugagccacuguacccagcuucagauuuuucuauuugagugaaagauggagagaaacuaaacauacacuuaugguacaacccagcaguuguaacccuggauauuuaucacagagaaaugaaauuuaugucaacacaaaaauauguacaccaucguccauagcagcuuuauuuguaauaaccccaaauuggaaauuacucagauguccuaugauagauaguuaguuaaacugugggacauccacaccauggaauauuauuacucagcaauaaaaaggaacaaaccauugaaguacacuacuuggauggaucucaaggacauuaugcucugugaaaaagccaaccucaaaagaucacauacuguauaauuccauuuaugcaacauccucaaaaugacagauuauagccaggcacggcggcucacgccugugaucccagcaauuugggaggcugagguggguggaucaccugaggucaagaguuugagaccagccuggccaacauggugaaaccgugucucuacuaaaauuacaaaguuuggccagucacaguggcucauaccuaucucagcaccuugggaggcugaggcaggcagauugcuugaggucaggaggccaacauggugaaaccccaucucuacuaaaaauacaaaaauuagccgggccuggugaugggugccuguauuuccagcuacucaggaggcugaggcaggagaaucacuugaacccaggagguggagguugcagugagcugagaucaugccgcugcacuguagccugggcgacagagugagacccugucucaaaaaaaaaaaaaaagacagauuguagacauggaaaacagauuagugguugccagguguuagggacauuggggacuagguugggcagggcagugaguaugaacagguggcauuagggagagcuugguggugacggaacaguucuguaucuugauuguaguugugauuacacaaaucuacacaagugaucagugacacagcaccacacacacacacacacacacacacacacacacacacacacacacagaguuaauuuccagguuugauacuuauaucauguaagauguaguaaacauuggaggaaguuggaugaaggcuaugugggaucucucuguaacuuucucguaaaucuuugcagcuuuuugugacucuauaauuauuuuaaaauaaaauuuuuuuuuuuaaauggaaaguuuauaggguauguagauaaauuagaaacaacagaaggccaaguaaaaaagugcugaaggaagccucuacccaggcuggaaaugagaauguugaaugcaaugguagaggaaggacucuccccaucuguggguggguccaguuccuguaggacccuuggggaagccaugacccccauucucccaaacacacaauaggaaaauaccagagaaguuuuguuuaccuguuagcuuuuaaacaaaacagaacccugcaucuuugucuuagauacaaaauaaccuucauggguagggggaagggacauuaauaaaaagagcuauaauuuacauuguuuuucuugaauguuuuuacuucacgaaauuugagagaugauuuaagaacaauaauguacauauaauggcuccccagcuuaccauccuauuacacacacaucgcauaaguucguauuauuugucuuguuuggaaaucaguccaacuuucugacccuuguucuauauauaacuauagaucccaaagguucagcugcugggcuagcauuuugucugcuauuuccuaaauaaugguagguaagcaggaaaagugccagucuuacuugucccugacucuuggugguucguggcauguucaggauaguauuugaaacaagagcucauuacaaaguaauggaaaccccuugcuuuuauuguguaugcagcaaaagcaacauuuggaucaauuuacaaguuucugcaaaacaccgucaagaaauaauuucgguugugcuuuagcaagaaaauaauggaucugugcuauaccacaugccuuuugguaucccucacugggcuuugccaaaacacugacugcaggagcuagacuacuguuaggcagagacacugcacucccuuugcugucccugccuucucuccuagcgacuccuccagguacacaggccagggucacaguaucagaaagcagcucuguuuuccuccagaaccccccaagcuuccuuucugcagcacugucucucccacauggaaccagcuggcucaccagucaacagccuaugacacacaaaugccuugaggaugcagcauguauuuugucuggaagcaagcaacacgcucuuccuuuguaggcuguuucuccuuuugcuugcaaugugaguggcuuaucuugggugggcuugggggugagauaccaugugaccacaugaacacuucaaaacaguugcuuuuucuaaugcaugcuguaauaacaaugaaaagcauauccuuaugguuuuuuuaaugcaagaagacagacucaauuauguguguuuuugauuuuuuuuuucuucuucaacagcauguacugcaucccuugugaagguccuugcccgaaggucugugaggaagaaaagaaaacaaagaccauugauucuguuacuucugcucagaugcuccaaggaugcaccaucuucaagggcaauuugcucauuaacauccgacgggggaguaaguauuccaucccccuggaaaaacggcuagaucucaugguuuucuuuuguugaugcuuuucaugcucccgucccugagucaccacuaaaauaugggcuuagauaaacaacaugguguguaagccucacgcaugacgucucuucuuugaguuucccugaaagauaaagaacagauugaaaggcaaucugucuuuuagccauuggcacgucauuuauuccuguaaagagggucaucgcucaucuuuuuguuagucacaucuugcauaggagaggcaagcccugacacauacaaaccccagaagagaccauuggaucagacgugugacucagcagacuccagcuguagccaaauccacacaucuuucaagucuaaagaguuuugguuacuugaauuuacugagaagacugagcaaagggaaguuuagugauaucacguuaaaauuuuaugaaguccaaaagaaugcuagauuuccaaauuuacuugugagagacaaaaggauacaagugugugucauuguguacauaaaguuucggucucaccccuguacaaugaccuuuauuugcaauagauggcauuccugguaaguugcuucugaguuggauuugugcaaaggauuucccacugacuuagccuaugaucucuucacuucuuugguuuuuuguguguuuguuuuuugguuuuguuuugagacagggucucacuguaucacccaggcuggagugcaauggcauaaucauagcucacuguaaccuggaacuccuagucucaaacaauccuucugcucagccucccacguugcugggaccacaggcacacacuaccaugucuggauaauuuuaaaaaucuuuucacuucugauuuuucauugccaagggcuucuaguaauggugccuuaaauucucugccacugggaccacuuggucaagguacugauaguuuuauaagcuagaauaaauaucguaaaauggcuuugaaguugaaaggaauuuuggggggggaauccuuuuaugaagaauuuuuuuuuuuuuuuacaguuugagaggaaaaauaauguauuuugagaauguguuuuccuuaauauuuguuaaaugaguagacuguauucuuaagguuuagaaaggacagaaacaaguuugugcuuaguucuucugaauuaguugauaucccuuguugcuguucacaauacacccacucccagcccuccgugauggagauaacucuguuccccacaacuagggcuugcccacucucaugguacuucugauguuuaauucuuuuggcugugucugcauuuccucauuuacuuuuaauuugcuuaucccuagaacauaccuuuugagugccuaaacuuuuuuaucuuccuguccugaagacaaaaauuuaaucugugaauuaaacccauggagaaguaucauuuaugaagggauugguacauauugaugcaugaugaugaaaugugucuucugguuuauguccauugcaggaaauagauuggauuuaggaugaugggacaucucauuagaggggaaauuuccugaucuugacuaaggcaugcuuccugccccacguuuaaaauucaggaucucuuccuuaaaacaucaacugcacgcaaccucucaucuuuccaacuugaacuucccuuuaauuuuucuuggaaagcuauuaaauuaaauuagauguagggcuuuauccuuuaguacccuuauuauuuuauuuguaucaacucaaagcaaaauagagcauuuuauuaaauaugucuucauaaauuacgcacaguaaaaucccauuaauuggaccacacccaguucauuauaguguuuauuauaauuuuagcauuaguugaacugaaaauugguuuuuguuuacuaugagaaaaagguagacuaaacaagaugaaaccuguuguuugcauauuauguuuguacaucuuuauuagcaacuauuuuuccaacuauuuucaacuauuuuuccaacuauuuucuaguuauaaaagcaauacauaaauacuauagaaaauuuagcaaugcagaaaugaauuuuuaaaaaucccucauagauagccauuguuaacauuuugguguauuuucuucaagucuuaguaaaauggaaccuuuaaauauagaucccuguaucuuaggaauuagaaaggcagcaaaggcaguuccuaaugagauggagaaaauguugauuuagucaugcccuuguacugugggggccauacugucuguugacagagcauauuaaaagacguucccuacauucgucagccuuagcuaauuggcagucugguauuuaugauuuuauauuuuguuaaucagcuugggagcugcaguaccccccagccuccuagaaacuuggcuuccccugccugggaggccucguuccaggagucguuguugagagucaagccagggaaguguguuuuugucagggagcagccaguccugugcugggagcaucucagggggcaccugccguugaauuguucucacuuguguuuguaagaauccaaguaugucacccuuacaccaagugagcacacagugacacaauccccuuucaauguagauaacauugcuucagagcuggagaacuucauggggcucaucgagguggugacgggcuacgugaagauccgccauucucaugccuuggucuccuuguccuuccuaaaaaaccuucgccucauccuaggagaggagcagcuagaaggguaagugccccaaauuucaugagcugacguucuauuacaaaauaagcagcgugcuuaugaaacuguguugcugagguaagagcccucccugccuuguuaaagagaagaaaggaggaagccgcaguauugccugugcugcucgaguaggucuuggguggagucaugguucuccauucuuaggagguugcuguuuggaaaacagagauguuaucacccuuacuggauuuugccucaucagucaaggguugcgugucugacugugaccagugagacggcagacgggggugcgcuuagggcuuuucugccaagaaugacagcaguuggucuggagugcucaccucccugugaaaucauuguucgcgcgacccucaucugccucaggaugcuguacucuacuacgcacaacugcuccaucuuuuaagauauuggaagugagagcacgggaggagcaugggcgguucguuuuguuagaaagaaacccggauucacgagaugguuuuuauugauuaguuuacaggauuugcacuauugauagaguuuuugccuuggcacaggccugcuuugugauagggguuuuaaaauaaccgugggcuuuucacuggaggauaaaagccggugcuuauugcaugcacaauugcuuuccagccgucagccuguguguaccuuugcauauguacuuuucucuuuaaacucucccuuuuaaauacgacucuugccaggcuuuaagugaaugcuucaaaauaaaaggaguuaucaauuaaagagugaauuccuuccaaagagaauuugggaaaauaauuuaggaaaagaagaggcgagaaggucaugggaaagguugucuuugcugauuuaucugccccaacuggauaaaguuacugcauaaggguuucuuuacagccucccuguuuuucucagacuaacucuuggucagucuuaaauucuuaaaauuccaucaucugauagagcuaacgagagcgggcagcucuucauuccauccuugaaaagcacaguguccuccccacuggggaacaccaauccuuaaaaaacuucuuucucauugcaaaucgaaggaggcugccgcugcacccagccccagacuccucagucacuuaccuggcaagcugaggcccuaccaguuuaaggugaugauuauuguuucuuguauuaaauuuuaaaaugaauuuuucuccgcuuuuuuuuuuucuaaguagguuuguguuucuggaaucucgggugucugugagcauuucuucuucagcagagcaguagcugucaaauuuucuuguugcuuaaugauauacuuuuuuguuucuagacuaagcaaaugauagacauagaggugaaugcugagaggagaguuuaauuaauuuccauuaggaauuauuaugugguuaccuuuucauggaguguuaacuaaguauugugcacuuaaauguaguuagaaauuaaagccugauuuuuauuugcaagaauauuuaugaugucuuucucauuaucugaaacuugcauaaaaccugaagcaucagcaaaaucuuuuuaagguugcgugcucagguguuugggaggcuuuccagguaagcccgggccccuggccugcucuuaccauuuuagaugcaggggagggcaagugggccuuggguuuucccugcugcugcugcuccccaguaguccugcagcuccaaggaugcuggcuccagccuuucauuccugcgugcagcuucuaagaggcucuuucuugagcuugggcucuuaagaaucuuuuaccucccgaugggaaguuuucucucacccugucuuccuggcccaugaccacaaagguauagcccauccucacgaugaugagcuccccaagagcucuguuugcuucagguguugagaccgcuagcaacaccucagcuguucauuucuccuuagacucagggacagaguuaggucuggccccuucacuagcugcccucacuucugcaagaagggaagagucagagcgagaaagagaaggacaggauacgauagucagauaaacaucagcagugcaaagcagaacucgcacagugauacaagggaaagaaagaaaugugcccuaggcauggagaagagccagauaccugagaagaucagacaggcuucugacaagagguggcauuugagaugggccuugaaggcuuucgggaaaaacuugaggaaagcagaggauugaagugaagaaaggcaauucaagguaggguggcaggagcaaaggcaacgaguuggggcauccuggggccuguugggcaacuaacacuggagaggugggugguacuagaguuauguaagauguuuugcacgcagguauaaaggguuauaauuuaggaagaccauggaacguauucaaggcuuuugaauagaggaguguuagcagagcugucugaaauuuuuauuucggugugcuuuugguuuaagccaagauagcuuucaucccaguguuucucaaacuuugcuacacauuauggaaucauugggggugggggcagggguggaguugagaaauccugauguccaaguugcacccccaccccaauucaauaggagcguuugggguuaggauccaggaaucagugcuugucuaaagaucccuaggcacuucagcaggcagcaaagauuggaaaccacugcuuuaucccuucauuucuucccaugugcauaucacaaagcacuuugacgguuuuuuuuccuaaauauuuuccccucacacugcugccuaauguuuuagagguucacccauguuguuaacacgugucacacuauuuucuugaacuuuuuuuuuuuuuuuuuuuugagauggaaucuugcugugucgcccaggcuggaguguaguggcgcugucucggcucacugcacccucugccuccuggguucaagcgauucuccugccucagccuccugaauagcugggauuacuggcacgcaccaccacgcccggcuuauuuuugcuuuuaguagagacggacuuucaccguguuguucaggcuggucucaaacuccugaccuugugauccgcccgccucagccucccaaugugcugggauuacaggcuugagccaccacgcccggccuucuugaacuucuuuuauagccagugauaacauaaauguuuccauuugguucaauaggaugaaaguucuguucuguagccuuuuguuuuugauggagaacagaacaauucaagguacagagauccuucaacucugacaaccuuggcuuuccaaaaugucacugagaucccccucaaaaagucuccugagccauccagaacagaaaauucaagcauuuuacauagaguagagcucuuauuccucacucagagccuguugacuuuuauaucgcacucggcgugagcugauuuuguaacccaguuacaaaagccauagccaugguuuccucaaggacaccauaggguguauuucuagaguaaugaccuuagacauuaagaaaaucaagaccgcucugcuguuuacaaaggaaacagguuuuguaauccacauguacacaauuuuuauaaaauagcuaauuuuuaagcucuugaguaagagaauauuuucacuaucuggaaaauccccuuguuuggacaaccuuguuuccugauggcaucagauaaauaaggaguuaaaguuucacauuauuuggugcuaccaaggauuguugccuugaaaagaagaaggaaaaaguagauggaggguggugaguuaaaagaauugaaauucgcggauaggcauuucuaugcuuuuguuccuaccacucgacugugcaacacgcagugcuuuguaauaccuucuuggagcucaaaggucaggcugaaacauggccgcuuuuucacauuucccugggacuuuuggaaaauauacaccaacccugugaccuagcaauuccgggauccacccaagagaaaugaaaacaugcccacacaagacuuguguaugaaugcugguagcaguauuacucauaauagccucccgggauucccccgacccccagcccaaaagaaagacccacuggaaaccauucagauguucaucagcagaugaguggauagaaagauaaauggauaaaugaaauguggcacaaaggacaacugacuacucaacaauaaaaagacgugaaguaugacacguguuacaacaugggugaaccucuaaaacauuaggcuaagugaaaagaaaaaauccagacacaaaagacuacauauuauaugacucauucguauguaauuugcagaaaaggcaaaacuauagagacagaaagcagaccagggauggcugcaaggaagagguggagauugaccaccaaugggaaugagggaacucuuggaugauggaaguguucuggaacugaguaguggugaugguuggacaguuguguaaauuuacggaagcucauggaaugaugggugaauuuuuuuuuuuuuuuuuuuuugagauggagucucacucugucacccaggcugcagugcaguggcgcugucucggaucacugcaagcuccgccuccggguucacaccauuccccugccucagccucccgaguagccgggacuacaggcgcucaccaccacgcccgacuaauuuuuuuguauuuuuaguagagacgggguuucaccauguuagccaguauggucucgaucaucugaccucgugaucugccugccucggccucugaaagugcugggauuacaggugugagccaccgugccuggccugaugggugaauauuugauaggcagguuauacuucagaaguaaagcuauuuuuaagaaacaccuaaacaaagaggaaacauugucugaauaucuguauggugccugguuccaccuagauagacauauccacccuugcugaaccccuaagguugauguaaauauuggauuugggggagaguggacaugauauaaaccagccuguuugcagauggauuggugggagcaucugcagaaaggcaaaaaaggccaaauacucuuaucaguugcagauggcucuguugcugaugacagccuguguccuggguucugaugcccccuagagacagccgugaagaggcaauuuucuccucgaaggaaggaacuggaaugauugguuguauaauugcagaauuguuuucaguaugucagcaagcacugaaaauggggaaacugucccuuccuaccucuguaggcuggagaccucggguucagcuccauuuaucagggcacaggaccuuccuguucugagacuuuguuccaggggacuuucacacuucagagaauagcacaugucauccugcacuuuuguggggugauuaaaagcucacgguauccuuuuauguuuagcccauccaauucuuccaacuggccucagccagaaaagcagggaaggcacccccaguuugcagcugagagacuccagccugggagagcugaauaaaucuuuugcccagagggguuccucaguaaaugcuggagaugaggcucagaccugaccuuuggauucccagauggagugcucugaaccguguaccuggggcugucuucaccacucaaauaucgauagagauaacauagagauguccucaggaagauaaccaacuguucccauccuguguggucuacagauugggagauagggccuacccaaguguagaaauaaacauuuuuuacaacauagagaaggcugagaaccaggauaccaauaucaauaaaaucuggauaucauagagcacauggaagcuaaagaaaaauaaguaacuggucaggugugguggcucacaccuguaaucccagcacuuuggaagaccauggcaaggcauugcuugagcccaggaguuugagaccagccagggcaacauagugagauaccagcuguuaaaaaaaaaaaagaaaagaaaaauuaaccaagcaugguggggcauaccuauggucccagcuacuugggaggcugagguaggaggguagcuugagccugggaaguugaggcugcagugcucugucauugcaccacugcaccccaaccuggauuacagagugagacccugucucaaggggaaaaaaaaaaaaaaaccuaauuuuuaaaagcauucuuugaauguaaaggcaguaagcuaagaaacaauuaggaaaucacauuuacugaauaauuuacuuaaguaaucuuuuucuucaggaaacaaugauaacuuuagcguaugcauauuuuaaagaugugcagacaggucucugccuuuuaccuucucuuaauucucaccuaaucauggaaggaauuuagcggggagccuugccccaagcuguggcucgaaaaacaagcaugguauugacaggcagcucaugaauggcuugauuauuauuuugacaaggguuuuauuuuuauuuuucuuuagcuuccacaggcuccauaaugccuggguuuuauugauauugguauccuggcucccagccucuucaaugauuguaaaaaauguuuguguuuacuguaaaaagauaaucuugcuuuucaaagugauuagucaaauacacagaauuucagugugccugccauucauuugucaaauuccugguuuauaauucaugcuuccucccgugggggagaagaauguuuuguucagaagguauuuuuggugugguuccguucccugcuagugaaauuaguuuaugaaaagaggccugguucuggguguagauggaaguuuggccugauuaauugguccuuaccggcagcccagagguuucuucaucaacaaggagauuuuguccuguaacuaacucagguaccuggaagcagcccgacauuugggggugcaucgcugcagucuccuuuggagcuggagaaaccuaugagcaagaaugggcuuaugacacauccauuuccacuccaucccuccuuccguuguaugacugcauggagccccucugaccuccagcagugucaccugcagccugguagugagaaacagcagguauggauggggucuacccccagcaacaguagcgccagcugggccauauccuggcacugcuccccaggaaacacaccuuguguugcauugaccagaucugggaucauuuggacaaugucuuaugcugcuuuuccaggauagcuguguguucaggagggagcccuuacugaaaggaaagaacuguugacuuacaaguuuuugcuaccgguuugguggucacuaauguguccagaggccugaagaugggcgugugaggagccugacuuagcuucagaggcucugucuuucgacucacuugugugcucacugcaccccugugcuggcaggacuccaaccuccacccccagcacuuguguggacagagagcccagugcucaggaaaggguugggcuucaggcuugugaugcagauuccgugguggcucugugacuccuucuggucguucuuaaaguagacagggagcuuagaugucaccugugcauuccccuuguuguccuacgagugaguaaacagggcuacagauagcacuaagggaucugcgcauggcugugcagcucauucauggcauuucugguccugggucccagucucugaacuccuuccuggucugacgucccuuugugaauguucaggaaaaugucacagggcugcuuggcagcauuguaaccauaauuugugcuuuacuguaaaugagaaucaggcugaggauugaccagcugguuagagguccugguuuggguguaaaugaagacccucaccagaugcagagagauccccaauggacauagccuccagggcagacgaagccuuagggguucuguuuuguccuggcuacgcuggcucugcagggagggcugggguucuuucuccuuuguguguuuauacauuagaucugugaguggaucuuagaagucacucaaaguacugcacugauucccaaacuuaguaagaagcagagcaggaagaggagaagaaggauucacgguccauggggaucaggcccaucagcacagaggacucagaagucaacccuggcauugucugcugccuuccuggggaagccagagagaaaggcccacugcggggaucuuucucuagaccuaagccguagcugucugcuuucuugccucuccagggauggacuuguccugccaccuggguagccagauagaacggcuuccugugcugguuggaucugcuacucgugugcacacccucuggggcagaagccacgucugguuuggugggcuuugguccuccaccaccucacuggaacucagccucuccuagauugcugguucuccacgugugguccagggaccacagcaggggucagcaccaccugggauuugugauaaaugcagauucuuugcccaccccagcugaaucagaagcucuggggguggggcccagcccuuugcaaacaagcuuugugcacacugaacuuggagaaccacuguguuggacuccgaguccucuugccuggaugagaggcccaagagcacugcauguuaguggcucuuccuccucccccacaccuccagggacuggagcuggggcugcucagaaugaaagaugaaugggggagggagaaggcccaggguugaccccccacaagcuugucucccugucucaugcugucuccuaucccaucaugcugcugauugggcaggauuuacuuccauggauaaugggagacuuuagagcaaaguguacgcuguuccgauuggguagcagagcaugucuguucucucauggacugcuuucaagcacguuguacauacuuggcugagaaaaauaaccaaaggcauuucuugggaaugauucuaguaacauccucugguacaagaagcauuauuugaugguaauaguggucauagaauuaauuagcaucuuaccgauuuugauauguuauccuugaaucauguugcugccauuguuaacagcaacugucuguucuccuauaguguuaauaacuaaaucucuuauuggcaaaggaaauguauuguggagcagguggcaaagaggaccuguguuacguggccagcaggcuagaggggacuguggccaagggcaggugcgcuaacaucgauuucugugcuucuaggaauuacuccuucuacguccucgacaaccagaacuugcagcaacugugggacugggaccaccgcaaccugaccaucaaagcagggaaaauguacuuugcuuucaaucccaaauuauguguuuccgaaauuuaccgcauggaggaagugacggggacuaaagggcgccaaagcaaaggggacauaaacaccaggaacaacggggagagagccuccugugagugacagcauccaaaacaccgugggcccaaccaucaugauaacagcagacccuccucccaugugugauggcagcuuuccucugcggccccuccugguuucacaugggggaccacuagaccaucuuaacuagcacuuugcuccuacuuauaugucaucacaaucaguagugggcagauacgugauguauucguauuuauaaauucuguacaucucugugagugugugaaacacuuauaaguagguucucaaacuuuaaagugcugcuuacagaaugcacaguuaaauguccuuuuauacacaggugcacaguuagauauuucucuuucuuuuuucuuuucuuuuuuuucuuuuuuuuucuuuuuuuuuuuuuuuuuugagauggagucucacucugucacccaggcuggggugcaguggcaugaucuuggcucacuguaaccuccaccucgguucaagcgguucucaugccucagccucccgagcagcugagauuacagacaccugccaccaugcccagcuaauuuuuggauuuuuaguagagacgggauuucaucauguuggccaggcuggccucaaacuccugaccucaaaugauccacgugccucagccucccaaagugcugggauuacaggcuugagccaccaugcccuguccgauuauuuuucagggaagagccagugugcuucagcccuaugagcucuacccuucugcucccacagaagggaagcacaggccugugggguggagggggcucugcccuaagcgcagccccugugggccacggguuuccugucccuuacacucggccgccuuguuucucccaccccaacaugaaaaagauggagugagccugcagcccugaguugauauugcuuuuuaaauugagaacaauauaauuacagccuuguacuguuuauaaaacuuuaaggucucauaucagagauacagcagugccuuucucaucuaacccuguguagaauacggcuguugagaauggcguggcucucuggcuggauaggguuauaaaaguaaaucgucuuuucaccuuuggcuuuuaauaagggaaggguauuagaaaaaaaguaauuuguaugaugaagggugauuugugcgugugugcagacagacacacaugcagggaggcaaaucagaaccgaugcguguuuggcuuuggcuuguuucgcuggugucuggauuuaccuggcgacacuuguugcucugggggaucuuagagggaagcacgcugacugaccuagggcugaacagcaggcugacgaccagcgccgccucccgcccccugcucacucuaucccugcaaagccccugccuugcucccuguucagaucauaguaaaaucggauguauccgaguauuucagagugcuugucuccuuagagucagccagucugaccugucagaucauaauacauaguagccguuuauuuucuuuugaaagcaaaaucaugguuuccucucuaaauaacacuucagcaggaacugugacauuucccaaucucaguugcgcacauuuuguccuaaagacuucuuagcucuuuuacugucuucagucccucugcuucaccucuugaguguguagugggauucaggcagauaagagggcgaaaggacaauucgucagagagcucugggucuccaugagggugggcagucaucagucuuucccugguccuuaucguaguuugaauuugguccaaggaauaagagagacacuuggcacagcuucccugccauacccgccagccaggcuacuucccauagagcacguuaggcuuggccaagugagaucuucuugucagugcuuaauccagccucccguuguuugucagcccuagcuggaggccucacaggaguuccuguguccuuccaguuugauaccaaguuuagaccaagaaaaguuccuuucuguggcacaccuguagucucuuaccugucuuuggugguuguacacgaacaggcagauauccacaacugcagaacaagugucaucgucucucuuaagaaguuucagggcagccuaaaggcucaccuucacccuaccaggcccccuuucauagccaggaucuuagggauggagaagaaagauaaguucaccucguucacugaagucgccccuuguuuucagguuaggaaacccagguucauguccaagucccugggcaaguagccagcguaacugauugaccuaaaacaaaggauggagcccuuggagcucugcauagugaaauguaugauuucuuaguggaaaacgagaaagccacugaggaagcccagaagggaacuuagcauauacagccagcuuuggggaagggggaagcagugccaagcaagacaggugcuuuucagagacacaugaaucucugucacucacggauguacucuuugccccaggugaaagugacguccugcauuucaccuccaccaccacgucgaagaaucgcaucaucauaaccuggcaccgguaccggcccccugacuacagggaucucaucagcuucaccguuuacuacaaggaagcgugaguuucugcuuugggugaugccauucuguugacagggcuacgaaugggagaggccagucuuucgauccuugaaugggcuggcugaauacagggggucagcagaguccccagggagagccacgccaaacaucccuacuucauccucaugcacccucucgggcugucccugugaugucagucacagccagugacagccaugauugggaaaguguuagcucgaggccugucauucuuuagugagugauuagagguguuugaauaaaauaaacccaaaauggggaaagcuugcuuuuuccagaauuaggucaguccagacucaugaacgaugaugggggacuucacugaaauaucguuucagccuccuuaccuacuaggccuacuccaggaacacccugcaggcacguggcucuuuuguaucaucuuauuccugucucucucucugugugccucucccaagcuguggcccucugcucuaggucaugagccuuccaaacaagcgaagaaaaguggagagagaacaaccuucaugucuugagccuuuugugacuucuccuagacucuguugggagcuuuuccugugugaucacaugacauucccccaucuaagcagccgaggcuuauuccucccgacugcagcccucuuugaucucccucuuccuuccuuugccuucuauauccagguggcuaccccggucuacuuagccaucccccuuacccaggucccauguuaaucccauaguucucucucccagauguguggcuuccaaagagcagcaaccagaggcaccuuaugacagcaucuuguacucuuuccuccugccagagcugggguccuaugaaugagaaauuggguacuuaggauuacuaggcuuucagaguuuguacacaggggagccccucaugaucucccaucccaugacagcagacgguguuuuguucauguuuguuucagaagccagcggccagcagcuguccagcccuuuuagcugauaaauauaaaauaccuacccaaccaugcaucugugcgaaguacuauauucucugauagucacaccagugcuuuggcaaugucagcugguaauuucacugaggacuugaugcugguuucuaaggcaaucuggaaacuaaauauuugaauauuauaagaugcuuaagcaucagaauuguuuaugagcaaucugaauuuuagaagcuacuucuguuugucuguaggaaagucauuuuucuccaacaguuaccuucuuucaauaucugauauuugcauuaacugacuaugcuuguuuuuuucuugaugaaaaaaugcugcaaucagaagagagaaaaauaguuuuugcauauguucuuaaggaauaguaacuauugaaucccaguaacuguugaaguggcucuuccugaggcagaccauucaauucuguaaugcccgacuggggaagcccagaguccagucacuucauuucuucuucuauaaaagucuaauugauuauuuguuuauuuagaccucccauuauagaaagugugacaugcugggccucuggggaagauuuuugaggguuuugaugucagagccccgaacuuucucugaacuuaauugucuuucagacccuuuaagaaugucacagaguaugaugggcaggaugccugcggcuccaacagcuggaacaugguggacguggaccucccgcccaacaaggacguggagcccggcaucuuacuacaugggcugaagcccuggacucaguacgccguuuacgucaaggcugugacccucaccaugguggagaacgaccauauccguggggccaagagugagaucuuguacauucgcaccaaugcuucagguauccaugccuagacaagcccccagcauccacacuucuucgcaagcucacuggccuugcuuguaccaggugucauuguaggguuagcagugagcuaugccuguugucuuucuugucaauagguaauacugugucauauucauuuccccacugcuaacacauuaggcucuucugugccauuuucuggccucgguacuaucuuccaucaucuccugcuuugugccugugagcccagguccuccagggugcugggcugguuucauuggaaggcccagccuggaaacagccgucuucagcugcccuuguuucuuguuuguuuugauguucaauccuccaggaacugaaaccaugcugaucuguguuccacuuaauucauguagcucacugguuuuccaucuucauucuggagcuuauagaguuccaaagaggucaacaaaaguugaaagccugcagauguaguauguuguggauauucagaguauucacugaugaugagguuccuccuuccuuuaucuuuagguucuaaaccaucucauuucucaacuccagaucuggaaacaguaaaagcaaacguuaauaguuuccaguauauaaaaacuaguuuagaaguaggaaaauccacuucaguuuuaaagacacugauuguuuuaguguauuggagcuucuaucacaaaaaaacaguguagccuggguggcuuauaagcaauagaaauguauuucucacaguuccagaagccacaaagugcaagaucaaggcgcuggcagauuuggugucuggugagggcccacucccuggcucauagauggcugucuuuucauuguguccuugcaugguggcagggaugcgggagcacucuccggggccucucauagaagggccuggauuccauucaugagggcuucacucccaugacccaaucaccucccaaaggccaugccuccuaauuccauccccuuagggguuaggauuuugacaugugaguuuugguaggggacacaggcauucacucuauagcacugauaaacauucuuugauaauagccauuauuuuaguggguaagguguuuuuaaauacccauaagcgagcacaaaaucaguuuaaauggcagagaggagggugagaagaaaaugcugguggggaaaaccuuuugcugugcacgccugcuccuuccuccacuccuaccccaucuccaugacccuguaaguggccacagucaugucacuggguaaagugcuuauugaaacaaaauuggcacaggcuucugauccugcguguggguugguguagcagagguucagugcaacagaagaaguuuuucaucuuaaaauuuggaaguaaccccuggccagcaauucacuguaguguuugggaaacauaggaauaucugcuuauugugacagauucucaagaaaccuguuuccuuuccacaaagauggaaaccaggcacuguaccaaugagucaguucacuacguuuuguccucuguccuuacacgcagcggagacagacgagaacuugguccucugccucugcuguuuggugacaccuaucguaagaauguaucuaggaaugagcuguuuguuuuugaaguacuuauuuuuggaaacccuaaaguggcugagcaucaagugguuguguuuucucugaaaacgccaguauuagucauaaccuuuuuccaaaguaucaucccuuaaagauguucagaaccuuguguguaucguauaaccuggagcacccucaagcuguccgcccuuuucaaguuuuaaaaauggcuuaggcaaacauauugcuuaagugauauccagugaaggugucuccugugcuuugaaaaaccaucaacauugaugcuuuuuugugacccaauaaggacaagauuucagugguucugggaugcauuugaucuuuaugcacacuucagcucuggguuucaguucaggggucagcauaaguaaagcuugaucagauaacuaugcuuugccuauaaucggcauucauucugcuggugacagaguccuuugcucaaaaugaggcuuccaugcguuugcaguucuaaacugcuuuucagagucaugccucagucauuguacugaaggaugccuguggaaaugguggacuuccguguucuuugcauugccucucccccaucccucuuacacacagcugugacaugggcaugcacacuccuucacacacacagacucuccaggccccuuuccacuuccucuuuccauuuggcuucaugacauuuuuaucagagauucaaaaucucagaugaaauccaagucagccuguuuuaccaguugucgaaauugccggagugcagcacuguggagaauggcaguuguaauaaaugagaaauaccagguguuugaauuagcuguagauuuucacauugucucuucuaacccugcuugugcccccgcagccuuuuuccauuuacaacucaguaauguuuguuuucacagagauuaccggaggaaauagauuauaaagggaaauguuggcauuuauaguaguacuauuucaaaauaagguucacuuuucacuuuguauuucauuguucauuguuauuuucuuauccaggucaaacuggcaguuuccuguuggcuugccagaguaucugauagccugacucuuaaguucauuucauuuucuagaauguucuuuguuccccucuccaguuccuuccauucccuuggacguucuuucagcaucgaacuccucuucucaguuaaucgugaaguggaacccucccucucugcccaacggcaaccugaguuacuacauugugcgcuggcagcggcagccucaggacggcuaccuuuaccggcacaauuacugcuccaaagguaagggugcagcagcggccuggacggagggugugaccguucauuccugugguuguaaugugccugagcccuaauauuacacguaucagacaacaguguaguucuccauuggaaaccagcuaucuucugguuuuuuuuuuuuuuuuuugagacagagucucacucuguugcccaggcuggagugcaguggcacgaucauggcucacugcaauuucugccucccagguucaagcauuucucauuccccagcauuccgaguagcugggauuacaggcaugcaccaccaugcccagcuaauuuuuguauuuuuaguagagacgggguuucaccauguugcccaggcuggucugaaacuccuaaccucaggugauuugcccgccucggccucccaaagugcugggauuauagccuugagccaccacaucuggccgagaccagcuaucuucuugauuaaagguacugagagcuauuauuuuuccuuacaagcauguauaacggcuuucauucccacucuuguuuuggcuuuucuuuuccgagaagacaaaauccccaucaggaaguaugccgacggcaccaucgacauugaggaggucacagagaaccccaagacugaggugugugguggggagaaagggccuugcugcgccugccccaaaacugaagccgagaagcaggccgagaaggaggaggcugaauaccgcaaagucuuugagaauuuccugcacaacuccaucuucgugcccagguacccagcucaugugaaauuucaguuggcaaaacccacugcucaggccgguucuguugccuuucuccccaccagguaguguguaagucagcagcugggggguacaauacaguagccacugagacggagccgaaaaagaugacagguucggugaagugagucccugcggaagccagucagcccugaagggaacagggaccagggcuuggguugcuggggccaccggugugacagguacugcugucucagccacaaccccccacagagagcaggugggcacccugugguagaggcagggaggggaaacucaaagaguauugacagcugcugccuggugagaggaaaggccaggauuuggguccaucucugcccuuccuaauuaucuuuacugccucucucagccucacagaggaggagugaagcaagagggaaaaaagucagagucugugcuggaaagggccugacuucaaaacauagccaggugccacaggcauccuguacaaguaaguuugggaagcaguguagggcgacagccugcauuggcuguuuauuccgugguuacucugucuuucaaagcaacacagccccugccccagggacucugcuccucugcuguggucuugguuucuggggaguggggacaaaagcagaggaaaguaaacguucauagcaggacuguucauaguagccaaaucuggaaacccaguguacaucaacaggugaguggcucaauaaaaugggcucgaaccuuacaguagaauauuauucagccauaaaaagggaggaaauuuugauccaugucacaacacagaugaaccuugaagacaccaugccaagugaaacaaggccagacacaaaaggacagauaguguaugauuuuauguugugugaaauauauggaaugggcaaauguauggugacagaaaguagauuugaauuuaccaggggauggggauagaguguggaggggaaugggaauuauuccauaaucgauagguuuucuauuuggagugaugaaaauuuuuggaaauagauaaugaugauagcuguaccauucugugaaugcaauuaaugccacugaauuguacccuuaaaaugauuaaaauggcaacuuuuuaucuuacauauauuuuguuuuguuuuaaaauuuuauuuuaacacaauaaaaaauguuaaacaauuuuuuuuuccuuucaaaaaaggauuagcccaguagugugugggaaaggagauggaagcacaguggugcucccuggcccccucuuccuguaagauuauagugcagauuuuggaaacgaccucaugccugaaaacuaggccaaggaguuggauuuaaaucagcauggcacccaugagcugcccauccgcaguccccacagcacccgcugccagcaccccacccagcacguucccuuccccucacugcccccgacccugagaggagccuguagcggcuauuuauuccacagugacucugcucuuacaggcuuucuuaggcuguaacaacaaaugguuuuuaaagugauuuuuuuuuucugccaagugaccuuuuugauauuugcaaaaugguugaaauagcuaucucacuucgagaaaucaguaaagugggaaauaaagacugguuagaacuggaggcauuauuuccuuuugagagugcgccucuucauugcuugguggcuuuuuucuccuccccuccucucucgaaguucaaaccaccagagcagccaggcgcgguggcucacgccuguaaucccagcacuuugggaggcugagguggguggaucacaagaucaggcguucgagaccagccgggcaucauggugaaacccugucucuacuaaagauacaaaaaauuagccaagcgugguggugcacaccuguaaucccagcuacuugggaagcugaggcaggauaaucgcuugaacccgggagguggagguugcagugagcugagaucgcaccguugcacuccagccuggacaacagaacgagacuccaucucaagaaaaaaaaaacaccagagcugugagaagggccugcgaggcccucauggccucuccuagccugccccgcugggggagucuucugccugcugguguguggcagggcuuugaaugugaaccuugagguucagugcccaaggccauuuucuuauccaggauaucuuuguaucacuggugguuccuagaaagcagaaaguuugaggacuagaaagauugcaaagagguuuggaaacuggaacucaaugagguuuggugacuucucugacauccuaauuaauuaagaauccguuugggaccugguccucauucccacacaccgacucuuuucccccucuucuccuccauugcguugcuucucgugguccuuuccaccuagaccagcagaggcuuagcucguggcagcuccugcugcccgccacacggaaggauggauuuagagugucccaaagcaggcugggcgggaaguuuguuuuucucuaucaugggcccuugguuacguugcugucuuguuccaccaaccagcaggagguucggguugugagucaagguuuuggaaagauuuugcugaaaggccccuugcuuucaguuguaguuacgaggcaagaccuguuuuuuucucaucagauguggagcacaaggugaagugacgugaaggcagagcugugauugacauguuauuaaugcacagcauuggugguguuggguucaaaacaaguuuccuguguucuacuggagaaguguguuuaucugucccccgaguccuuccuuucucucuccuaagacaaguccaacuugugauucucuguuuucauggauguauaugaagacaauauuuuguccguggugagaggccauaauuuuuaagaaguuaauauuuguuuuuuugccuccuacugaguucuggcagaguccaggugaaggaguguccagcagagagaaugacugaaucacagaggcuggcuuucuguuuuacacguggauuguccgaaaauggauuugauuucuuucaguucauucugagaacaauguauuugugggauaaaaccaguuaaguaagauuuaguuccuuauaaauuguccagaauauccuguauguuuugaaguacaguggaagcuagaguuuguaaaacuuacuaguuucugaagucaauauucgcaguaaaugccuuucuuugacuacugucuuuauuuuguaaaucacauaguuugguuuaacuagcuaaaauguugacagauguuggaaaguaaaagguuuuccaauagggcuagguuguauuaugggauggaguggggaaaguuggcaguaauguuugcuuuugggcguacgauuuggaaauguaguuguuuaccaaaaaaaaugauguaugggccauugugcuuccccuguuccugccuuccagauaauguucugugucaccucccuccccuugucacugccuugaugucaucagcauugagagcugugcagucccuaaaagugugauguugauaaacaaguaaacuacugaguauacuucaugaaguaaucccaguuaaaugggggugggcugagccgggagagggguuuugacagaauuauuuugcgguacaucaaaccuaagcaacuucugacagacacaaguguauguuguguugguuuugaagguaggcaggaaauuuguugaugauguguugacaaagauuucccugacaguaaaugugguuucuuguguuuuucccuuccgggaagcuugguuagcuaguugguugguuugcagagugugaggauuguggaugaucagccucauguccuuacccuuccucccccaguauugugaaagcaaauguacacgcccugaccuugugguuuucugcuuguuggaacgagcauaucuguguugggcaguucaugccuucgguaggacccccgugugccacuacacaaagaaggaccguguuuuccucaggggaauccaugggcugagaagacuggggagccucagaggcccuuucccaaagcccucugcucuccccuuccagguucugaccuaaggaccagccagaagccugccgagcgucagccgaaccugcaaguggcuucugggcuguuccguucccugcgugagcuuucccucucugcugcugcugccgcgcucuccccuccauggcacugaugagcuucccacauucuggacuuucucauuucccugggcagauagaauucaucccauuugcccccugccuuuugccuauuccuaagaccggugaccccagccgaaggccucagcccuguuuucucaccauucguccauggcugaccugaggguugcccuuucuccaucugggugcuccucucguauucuguuuguuuuuguugguuccuguaaacauuagaauucuguuuuaagguuucuagggggagccacaaagcccauuucuucauauuugaccaaagcagcaauuagagggucgcacccucaugccucaucugcccuuuuuggugagaauguccuuuuugugaugacuuuaugcacucccuuuugcuuuucgguuguuccaagccccauucaaauccaugacgaggacucugcucucugaugggcaggaccuugaugaggccacaggugcucacugcugagugggaggaagccugggugggcuccagggaccugcagaguguagcaagcacagacgcuugggguugggggugggcucgcagcaggagcccccaagaagagagagcccugggguccguggaacugcuugcugcuagacuccaggcaucuuuauuuccacagucagagcaaauccaaggagccaccaccacaggcuuucauaucccucugccccaggucucuggggccucugccacacaccucaccucuccccuccugcccuaauaaaucuuaaccacagcugauagguuugccaccuuuaaggcuuaaccauaaggucugugaccagauggccugaguguucugaugacacagccaggacugccuggccaagaguggcagagacacuauuugccucuagguaaaaucgaagaaccacucugagagccggggggugggggugagaguuugugugcccauucugacacuugcagaguagagaaagcaagauaaugaggaaggacaucccuguguuauucaugaguucuuaccuaagggggcucaauagcuccuucuauuccacgguuaagauucuucuguuacucuuacucaagucauagaaaagacaaaagagguaaaaguacuuaaaagccacauuucucuccuccuugcagaccugaaaggaagcggagagaugucaugcaaguggccaacaccaccauguccagccgaagcaggaacaccacggccgcagacaccuacaacaucaccgacccggaagagcuggagacagaguacccuuucuuugagagcagaguggauaacaaggagagaacugucauuucuaaccuucggccuuucacauuguaccgcaucgauauccacagcugcaaccacgaggcugagaagcugggcugcagcgccuccaacuucgucuuugcaaggacuaugcccgcagguaugguaugauccagcuggccccauugccaccuuccucacaaccuaguggagaagauguguuuuauggacacagggucugacacccagggccaugacccuuagacccaggccugccugcuaaauaacgugcagucauuggcagguggcguguagaccagcugcccagggaacagagcccacgcucuccuagugacaccacucccagcuuggucucuccauagaacgugcugggagcagggagcugucugcaggguccacccuccaccugcuacuuggugcacaucgugcauuccugcuguccuuugcccccucuugcgcacaaaucggguugcccccuccugagcucucacauguccagagaugucuccaguuaguugccuugauccagaguaaacauugccccucaagaucaacuccuggagcagccucuggucuugcuuauuuagucuuuggcuuucccuuguuguuagacacugccugucacucgggcauucauccaucuuugaaggugggugccuucaaagacagaacaagagcugcccuguccuuuaguaggccucaggugguagaaagagcacggaggugaccagagucuggggugugggguccuccugggugcaguucuggcacugaaguccauuguagcgugccuugaggcagucgucaggcucccugccucaguuuccuuagcccuccugggagagacauagccagcuaaccccucaagugccuuuuccggcuguaacuuuccaugaccuuugcuuaucacaacuuuguuuacugcuucaagaagcaaaagcaagaaaggaaccacugcaaggucagccagccgcuggaggaguuggugccggcagggagggcuugcccugcucuuagcaccagccuccuagcagcuuccucacaggccgggcucggggccauccuucgugccugcauaaaaauugcaguugccgcguguagacgcgggccacggagggucccugucacagccggcaggccccguguccugcuucugcuuacucagcaucuuuccagggcugcuuguguuugauggcuucacaaagcuuucuuuuuucaagugguaggcacaggguagaagaaaguuacuuagguugccaagauuuuccugcugugcuuggcagcaggcuuuuuuuguugagggacuggggagaaaggaggaucuuguggcaucuugagacgugcaaguuuugugguugguguauucugaacccuccgcugugugagcagcccgcucaggggcaguguacguggcugaucuccacuguccugcccgcguggaugggggcguuauucucaguguacguggcugaucuccacuguccugcccguguggauggggggguuauucucaggucagcccaguguuggccucccucccugggaacccaaauccaacuuugucaccuguuuaaauuguacagaaggagcagaugacauuccugggccagugaccugggagccaaggccugaaaacuccaucuuuuuaaaguggccggaaccugagaaucccaauggauugauucuaauguaugaaauaaaauacggaucacaaguugagguaggacuggggcaguggcccgugccugcauguacuuccauccauugacagcauaugcuaccugacugcacagguuaccuccugguuagcauaggacuuaaaacaauaaaauccaugccaaguuggugaggauuugggucuuucuacccacucuguacucuccaaggaguacugcauagugugcaaagagcuaggcugcuuuuugcccucaagaaacgauuucauuguguaagauaaccuuguggcauaggccaggucaguucuaauaacuuuuaauccuucuggaguucuugguuacaaaaauguuugguuaaagcuuuugggugugcuuaaagcuacuugaagacgaccuuuuaagauuugauuucuuugucuuuacugacacucaggaucauuguuaggugggaggucagaucaggcagcuggaguccccaguguggugaguuuaguuggcaggccccagauuucuccugcauucaugggaaauugacauguauguuuuauuuccccaggaucagcgagaauguguguccagacaggaauacaggaaguauggaggggccaagcuaaaccggcuaaacccggggaacuacacagcccggauucaggccacaucucucucugggaaugggucguggacagauccuguguucuucuauguccaggccaaaaguaaggcuuguggagggagaagaaacgugguaaaacugaaagcagggugguccaggaucaggacagcccgaguguucauggcugucuuauuuucuguuaaaauggaguuggccagcuuccagaagggucaugcuaaggugccggcacauaccggcacugugugugaaagguugggcagggcagaugccgagcuuugggcuccuaccucauguggcaggaagggagaggauccgagccucuccuuugagguuguguaaccacuggagagccagaggagacaguugcuuucaaccuggcuuacauucaaagacuuuuuuuuuuuuuuaaacaaaagacauuuuauaaagcauugaauugaccauuccaccuccuacuuggucaguaaagcuagauagggcucggauucagggcuugaaauccuaagggguguaaggaacuccagaggucaucugguucagccugcuacagggcaggaaucuccacgguagcaucgcagacccuccacuguccuuuuaaaguccccacaugcauuggaaauguacggugcucacccuuugguacagagacugaggaaugugaguuuaugcucaagucauuaacaagacagaauucuuaggcuguucugugugaugacuucagauuuuaaaacaaauuauaagauguauaagcgcaacaagggccacauacuuguuguuugaccaacaaaacuuaguauuuuggugaaauuaguucuguguugaguuucuguuauuucuuauuucaaacccaguuuuuaagauuauuucauguucauggaaugggaucaaauuuggcauaacacauaaaauagcaaugcagccucacuuagugguaacacuuuugggucuagugggcugaucuuuccugguguccacauuucugcuacucacaucuggaguuacguuaaaacaugcacuccgccgggugcaguggcucacgccugugaucccaacacuuugggaggccaagguggguggaucucuugaggucaggaguuugagacuagccuggccaacaugggugaaaccccgucucuacuaaaaauaaaaaaauuaguuggggguggugguacacgccuguaaucccagcuacuugggagguugaggcaagagaaucucuugaaccugggaggcagagguugcagugagccaagauaugucacugcacuccagccugggugacagagcagaacuccaucucaagaaaaaaggaaaaaaaacaaaaaacagcgcacucaauagguccagcaaucucacuucuaguauauuuccaaaggcaaugaaauagguaugucaaacagcucucugcacucccauguucacugcagcacuauucacaguggccaagacauggaauccaccugauguccaucacuauguauaugaauggauaaagaaaaccugguacauauacauuauagaauacuauucuaccauaaauuagaaaagaaaaaugucguuuguggcaaccuggaugaaccuggaggacaugauguuaaguuaaauaagccagacacagaaagagaaauaccacaugaucuuucugauaaugcggaaucuaagaaguuaagcucauggagaguagaauggagguuaccaggggcugagggugagggagcagauuuggggagauguuagucaaaggauacaaaauuucaguuagauaggaggaauaaguucaauagauauauuguacaugaugacaguaauaaugauguauucuuaaaaauugcugagacaauagauuuuaaguguucucaccacacacaaaaaaaugugauguaauacauauguuaauuaggcucauucagcuguucuacaauguaugcauauuucaaaacaauauguuguacaugauaaauauacaauuuuuauuuguauauuaaaauuaauuaauuuuaaaaaagaucuccaguagucaccuggucagcaccagauauucuaaucuguuugugauaucugaaaauccuaauacagacagcaaaagcaggauggggugaauagaacugcaaaucuugagccaacauuuuaugugccuggcacuguuccuggguucagguuuuuagggguaaauggauguuuaggcagauaauuuugucaauuaaaauagucugaauuguuccaucuaguccaguuaaccuagucucaccaguuagucuaugccaccuuugcagcacccagaagcuucauaauauuccugcagccuuguccaggguaguggcuugcuugcuuucuaucuuuccccagccuccuucccuccucuuuuuccuccccuccaucuccuagaaacagauccuaguuugggggucugugaucugugaaacagcaaccuuggcuucugggguugagugaacucagcuuguuuuggugacaugacauguuccugucuggcuuugcugcuccauuuuuaaccuuguaagugccaggaugccagugggaaaucgggaguccuucugauagaauuuuuccagcagauguuaucacguacugcagggaaauuggaucugcgugcuggccuuacuguugagaaauuuuuccuuaugucagacaagacucuguccugcuacaguuuagucucauuuccucuuauuuaauccucagaggagauggaagguuuggaagcuuucaggcaacugccuuccuuuuaggaacuccuugugugccugaauacuauuaaauuacuccucagacuucucuuuuccagaugaaauaaucucaggucuuuuggccuuuucuuguagcccaauaucauacaccaguuuccuagccauuuaaucauuuuuguuauucucuggauguguuccauuuucuccaugucccuguugaaaugugaaacucaaaaagaacacaguacagccugaccaguaguauaagugauauaaacagugauauaagggccuugggggaagaaagaaaaaucugccagcuuuccguugguaaugaucaccucugaguguuuuuaggaauugcaaaaugcuggagccugcauccauuuugagagcuacaauaucaauaaaaauauuucuuucuucgauuaaaauacuucuaauuuuaaaaauuaaaauagcuguaguagucuuuaaagaguaaccaugaucacaguuuuccauggcaaaauaaucauugauaggggacuuacgauuaauguuuacuugauccccagugauuccaggcccauuuccacauagacaucuguauuuggacgucccagagaggucucagauuccuugugccaaaaccaaaaucacaguuguugcccucgaaaggccucuucucuccuuugcuccuuagcucagucaguggucuuguaauccauuuguuacccaagccaggaaccucacagcauccuucacucuucuuucuguucagccaccccuuuuucauuccaacccaagccucauggauucugccucuuaaaugucucuggaauccagcccucugucaccaccagcaccgccacagcucagacuccaggucacucgccuuggggggaugguaugagcugucauacuguaugagccucauccuggggccaugacuuaccaagccagaucaucucugugagucugccugguguaaagacaaggaucagugacuucuuuguaggucugaacuggguaaugcagagcaugcccuggagacauggcauguccccccaauucuccaagacaugacagugccuucucuuacugccaggucccuccgucuguccucagcacagccauuucccuggaacgcgaaucugaucaguucacugcugggccugaaagcuuucgcugacuccuuuuaaucugcagaaugagggugaaacugcuuagcuugggcugggucccuugugagcuggcccugacuucucuccaguaucaucauuuucuaggaaagccauuuccccacaacccccaaggaaagcauaucauaaacaaguuuucccuuggggagguucccucgacucccuucucuccucucccuuccucucugaauuguugccauaugugaaguccacuuuucuaguugucaugcuaccuguugacacuaauuucccaugucccacagaauguuccaggguauggguccaugugccuggugcccagccuagcaucugccauacaagugcugguucugaugaucaguggcuucuguggucuuagacuuguagcaggacucaaaugucugcagcggcauuggaaaggggugccguccagugugugcauguguguguguguuuauuuuaaauugucuguggaacuaucucaaagauugaggccagcaggacuugaccuauacauagauguagacuguacauagauguaagaauuucuauucauuuuaugaaaaugaauagaaauuuucauucuauuuauuagaaauagaaugcuugcugcugcaagcauuugaguccuuuuacaggugugagaucacaaagaccgcuuaccaacagaaccaacacuuguauggcagaugcuaggcuggguaccggggacauggaccaaacccuggaacauucuguggaaugugggaaauuagugucaaauguaugcauuuucacuaacagucauuaaacugcguacaaagauuauuuuucuucagucuaucauugaaacuauugcaccagaauauacuguacuuuaaaaaaugaguauaugccucagucugcacauauuuacucuuuuuucaaauaauuguuuguuugccguguucuauuucugacaccauuuaccuucaggaauucuuacuguaugauggggaguaaacgaauauacagguauuuuuuucauacuuccaacugaaugugaagaaaugaaaugagcaaauuguucaccuggugauauuuuaucauuuccuccucuuugcugcagcaggauaugaaaacuucauccaucugaucaucgcucugcccgucgcuguccuguugaucgugggaggguuggugauuaugcuguacgucuuccauagaaagaggucagugaugugcaaaguuaugacacuuucuguggcugagugguuugaugauuugaaugugagugaaggugauauuuuugaagauuucaaggaaauauuuuauggacuggaaaaccugauuuucccaucaaauguucuuccaggaaaagagaaccuuuucuaaugauuuuaacaacagccaaaauaauuuuucgaugguacagaccuuccccuggcuggcuuuucugguauacagauacugcugcuggugcauacuuuuccaaacgcgaugcgcuagccuucccaaucaaauaagccuuuuuauuuccaaugaaguaaagaaacagauguuucuuaaaaagcgcuaaucucaggcuacugaggaagccagaagauguguuagcaaaugucugcuggcucacccaggccugaauugggaguguagacaagagcugcuguagacaguaagcucuccccauucuguucugauaccgugugagagaggauaaaugaaacuguuguagcgaagaugaaaguauauacaggaauguauggaggugggguuuuguuaacgugaauuuaaucuuuuugacagaaauaacagcaggcuggggaauggagugcuguaugccucugugaacccggaguacuucagcgcugcugaugguaagaguccgggccaccagcacugccagcgugcagggcagguagaucgggagcuuucaggaggguugcuaauuugggaaaggaaggagguuugcauuauuuugagcuaccuuuggccuuggaucugucuucauuaauauuucuuucuuucuuuuuuuuuuuaaucaaaguuuuuagcaguucagugaauaugucaaaacuugugggacuguauggggugccccaaggaaacacaggcuuuagagaugaauguggccagcgcaguaaucaauuuauuuaauugcuugagauguuaugcuagaaugaaaacagcuuuuuaauuguuaacaucuagucagaggauaugcugcagcugacaaaacaguccuuuuaaacuaguuucagcuugaguaucaucucauuauaauugucuuugaugaauuacagcucugcuuuuuuuuuuaucauggaauuuuucugucauucccuuccgacuagggucauacgcucguggcucauucacauuccccuugguaauaacuaaugagggccauucaguuaaguggcugggaaggucugacauggaaguugggugauccucaaugguuauuuccuuuuuugcucuuucuagcauuuuuauauccagaccuuuugagugagucggauuagggugagggguuggucacugaguccagugauacuaggacccuuaacuggcacuuugcuaggggcuuuuacaaacaccaucccauuuguuucuuaaaccccugcaaugugcguuuucuuaaugcccaucugcaggugaggaaaugaacucugggaaaaaacuugugcaggcucacaugguuagacaguugagaagucaggaggagaauggaaucacuguggaaagggcugugaggucccccgggcaggcaaggaaacagcccucaggaggggcuggaccggauucaucaaaugaauaauaaauaagugcaugauguugagugaguacauuuagaaaaaguguuugcugucuucuugccucgggagaagugaaaguagaugcaggagaugugaaauaaagagacaugauuauucuaauuauugugaucaaauaagaaaacauaagaaaauacuuuaauaaugugaaaacaccguuauacuauguaggguuuuacuaugguuucuuuaauaauuucuaauucaguuuauaguaaagucaaucaaaagcagccuccucugaaugggaaucaggugcagaauaaugacuuuauuucuaucuacauaaaggucucacaaaguugguuuuuuaauaguaauauauauauacauacuucuguaguguguguauauaaggcagagagaacauucuggacggaugcacaccacacuuacaagaguuguuacuuguggagaggaucuuucccuuuaaaaaaaaaaaaaaaaaaaaagccagauguggucgaaggcaccuguagucccagcuacucgggagacugaggugaaaggauuaccugagcccaagagcugcagugagcuagaaucccaccacugcacuacagccuauagagcgagacuggcucuuaaaauccagcaagaagauagauaugcauuguuuguaugaauaauagcuucuaaaaagaaaaucaguaaggaagggagucaucccagaugauggaauugauagaacaaggcaagaccacuuucucccucugugaggguggacugugacucuacgagagaagcuauucugcuuugaaaugcggcacuagagguugguguguguagcuuuugacugugaaguguccaggaagagaaagcaucaauacaacaaauucagauucucagggcucucauggugacuugaauucacauuuuguguccuucuagaaugcuuucaugauacgucuugguacuucauuacaacaaaaacaaacuuauugccacccaggucgacaggugggaacagugucaccuuauuugaacuuaauuuauucggccuuugagaagcacuuauagccaguuuccucgaggggcaacaaaaugacauugcaguucaaaagugcuuuaaaaacuucuuuuucccaaagcuauaaucugcaugucaccauucuccagaguacauugaaaauccccuacaggaaagugcugauaacauugugcacagaaaccgcuccuggcugguggcacuggggacgccugcuuaaagucggagccguuggguugaaucgagagaaaaggauugagcguauugacuucagggaccucccagggaaugaaugugauugguuucaacuccauguuuuauggcaggcuaaacaguuaauucugauuaaaagcaagccuggauucucagagauaaauggcuggagacagugaacucuuuacacuuucugaggcgcauugugaagagccuuaucuccuggguugucuugcauacuuacucuccucugacaagcacccgccucuucuucaggggugcaagccaccuaugccagcuggagggcagaguuccauucgugaaacccuugaaacauacguacuaugaaauacaaaaauguguaggaaagaaaacaagauuauuaaugaaguucauauuggacaccccucagaggucuaaaaugauggugccccuccugggccuaauuuauaauaaacaucucuccuuugagacaucacuuaaagguugauaguugggauauggagauguuaggauacaguugucagccucucacauccagccacaggcccagggucagcaucugaaagcaugaaagcaaaaacaggcaccuucuccaccuccuuucugagccaggaccaccuccuucccacagucagugugugguagagccugguggcaggucccgucaggcaaggacauuagcacacagcgucagaggaauuacugacauuucauauggaucuuauggaacagguugauuuuauuuucguuuuuacccuacccauuuggagguguagaauugagccuguguuugguuuuguuuucuuucuuuccaaccuuuuuccuuucuuucucuuuguuuugccuuccuuccugcauagaaauauuuauuuauucauucauucauuuuuuugagacagguucucacucuguugcccaggcuggagugcaguggugcagucucagcucccaguagccucaaccuccugggcucaggcgauucuccugccucagcccccugaguagcugggauuccaggugugugccaucacaccuggcuaauuuuuuaauagagacaguguuuugccauguugcccaggcuggucucaaauuccugggcucaagcgauccucccaacuuggccuacgauuacaggcaugagccaccgcacacggcccauuuauuuucuuaaaccagaucgaaucuaaacagaaacagaaacuggagaagaaauccuauucaggcuugguaucuacugugcauuccucccaaaucucuacccauuggucaaggucccugaguucacagagcccaggccagagcccuggaaacgccucugcccguccgcugccuaauugccuguccacgcugggcaccaccgggucucucccucagucucagagcucaguugcuucugcaccucaucagggauccagccaucaaagccaaggcugggggacacuuggacuagaguaauccuaccaauaaugcaguucagcuuuguaaccgcaaauuuucuaguagccguauuuuuuaaaaguaaaaagaaacagaucaaaugcauuuuaauaguuuuuuaguuccaauaauacguuucguguaacccaguauauccaaaauauccauuuuaacauggagucaguauuaaaguuaccuaaauauuucacuuuuuuuuuuuuuuuugucuaaucuuugaaaucccaugugcaugucucaaauuggacuggccacauggaaugcucaggagucccauguagggaccagcugccauguuagauagcccaggcauagcaucuguguugagggcccugacaccucuuuuggauucauccaagaaguaggaccuuacgugcaccaucaucaccucucauaugugacucuggccuuuuucccgacccagcauaagaacucuucccucucccuacuacucuccuccuuuuuacauuugcguuuuaaucuguuggugaagauggguaaaauccugcuugaccauuucauucaguuucucaauccccugugguuaauuuguuuuuuucaaaaauguguuuuuaugugaugaaaagaaauuuuuaaaaaccaacugcuuucuuuccuauacuagacuuccuugcuuuguucugguccuucuaucuguuaguauccucaaauuaucuugaaauccucagagaucugaaauacuaguacugacuguacaguuuucuuacucaaaucuauagcauguggaaaguugacaucaagccaugccaucgccuccugguauucucuguggguuuaaggaagcagcaucuuauauucuuuggcuuagaguucccccaaagcacguucugucuaagggcuuguuucuguaccugcuuuaauuacgguuucuucuccaguguacguuccugaugagugggagguggcucgggagaagaucaccaugagccgggaacuugggcaggggucguuugggauggucuaugaaggaguugccaaggguguggugaaagaugaaccugaaaccagaguggccauuaaaacagugaacgaggccgcaagcaugcgugagaggauugaguuucucaacgaagcuucugugaugaaggaguucaauugucaccaugugguaagagaaaguuccugaaaagccaaaaugcagcacagggagaggguaucacacaagccucccaguauguucuuggcugcauguacccguggguuuggugucuugccuuugccuucuggauaguuaccccauuaccucacugcuaccuucagaccccugugcucagaccaggccgcagcaccacagagacaguuccagacaacacaggcaucagcaagggccaccugacccucugagucuuucucuuuuugauuccucccaggugcgauugcuggguguggugucccaaggccagccaacacuggucaucauggaacugaugacacggggcgaucucaaaaguuaucuccggucucugaggccagaaauggaggucaguuuucauuuccaccgguauugcauguugccuggccugcucucuuuuccuuuauaaucucccugcaaggaaaugcugugucuuuaaaucaguuuacuuuccagcauccaguguuucuuacugcaugcucaguuguaggucauuuaugcaaaggauuuccccaacuagagucagacucugaucuucgugaggggaacuuccuguuccuuggauccccucugcuaagccccucugugccuuuguuccugcauucccuccacccccaguccccuccccacaucaguguccaccugccaagccaggccagcgccacucccuccccgaagcuuuccugccccacuccaguagcuaucuucucugcuaacuucucgaugcgcuugacucacauccucguauguguucucucucguuauguuguguugugcuguuguuggaguguguccccccuccaccccguuguguuuagcuuuucaucucaguccaaguguguggcucagggccgcauuuguggcaggcacucugucaauaaauguauguuacaguucaagguuaagcugccuggauucuugcccuugcaucugggaaguugcugggugauuucccacccagcuccgugcgcaagaugugcacucauucauaaacccccuccccacacacaguccccuuccccggcauuguuggcgguccuugucuuugccacugggaaucugguuuccucagacucuacguccacguuucaggauugauccagagucaguguccugcuuacgcuuuugaaugaaugaucccaccucagcugcaggauuucugcuuaguuuccuaaaaauuucacuuuggguuaugagcuuccaauucuaaaccugcuaaaguccuaugcaauuuuucauuaaaagucaccguggugucuccccccucuguaguauuaacccacaggccagcuuuuuaacauaugcgggcaugacuuuugaguaauuaauucuacaaauaaacugggagauaaaugcugagacauaaagccagcaagaacugaguuuucauuugguugccuccgugggucugaagucuuugacccuuacuuugcugcuuacuggguaagcagugugucugcuuuuauuccuuagaagcagugacuuccccuucucggccccuuuggaaauucuuuugcuguucuucauuugggcuuaauuuuuuuuuuuuuuuaauguucuuugaaucggcaacuuaaucaucucccaagugacaguuucuuaauuuuaguuccaaacaccuguucacauaugacuucauguauuugcagcacaugguguuuggggccaaguguggacuggggcuucaagcaggaugguuuacaaaacucccacccucuguucugccaagcauugguccccagcaccccuggguguuagugccucuuccugguucacucacucacuuucucuggcccucucugugucucugucacucucuuucuuucgagauggaguuuugcucuguugcccaggcuggggugcaguggcaugaucucagcucacugcaaccuccaccaccuggguucaagcgauucuccugccucagucucccaaguagcugggauuacagguguguaccaccacgcccaccuaauuuuuguauuuuuaguagagacgggguuucaccauguuggccaggcuggucuugaacuccugaccucaggugauccacccaccucagccucccaaagugcugggauuacaggugugagccgcugcgccuggcccuugguucacuuuaauacacaaaacagcaugaaggagaaaagcuugaugaaauaggugacuggagaucuggcagaguauuucuugccagcaucgauugaggcaccucugaaaaguccaaaacucacucccuuccuccccaguuucaggcacagaauaaaaauucagaacacauggccuugguccuggcucugcggcuggcugccugugguccucagacagccgcugcagguuccugggccucaguguccucaauauaaaauaagagggugggacaagauuacugaagucccuuucagaacuaaaauucaccuuuagauuggucagauuuaaacuuuuucuuucuagcucaugucaaguauuaaaaugugugcacuuacccugcaguuucauuauauucaaccugcucccccgaccaaguuucacuuacguaucucacuacgaguagguguauauguauacuugucuuaaauagcucuaaccaaauuaaaggaaagaauggcaguguaacaccaugaacugacaaaauuucagcccucugucuuucuccaugcuuaaaguugagugcuuuuguugauucuguugcucacggcaauuauaaaugaccacuucauaacacauauaggucauacuguaauauuuaagaauugugagcauaaacuuuacauuucaugugcauauuuccucaugcaucacacguaucuaaagcccugaaaaguagugauuuggacuuacccccagugacuuaauguugcuuccccagauaaccacgugauaaguguuuuaagucaccaagagacagcuuugacagccuguucagaauucaaagguuugugucaccaaguguagagaaccaacccagaaguaccgaggaguuguuauaaugauuccaaauacuagcuuucaguagaaacuagcaccucacagggcagcagccagcauccacugggcauugacuaugugccacgcaccacugggcacuuucugugcguggccccaggucaucuucucgucagugaaaccacugugauaccccauguggaaaagccugggcaugcucagcugguggccggccugcaagugugggaccugucagagcccuauggcuuugcagugcugugugagaugcuuuguggucaagaaaaccaagguguagagucuguugcacuuguauaugcaaaaguaaaagguaacauuaaaauuagggacuagugauuguuuuaggauggagagacuugggcauguguuuuauauaaaacuuuuuucuaaauggauguauuauuuaaggguaauucuuuuuaauuccaaagccagcacguugcuguccucugcaaagaggaaugcuuaucccuguuacuuauuccugguuuccuccaagacuaguuucagcuggacuucaguugccaaggacuugucuuccguaaugccgacagaaaauaauaaugccacauuguaaggugaaaacaguaauccugguauuuuuguauuuuagaagaagguugaagggaaagaaaaggauuaaauaauuuauaacgaugcucuuaugggaaauaaaauauaccauguccauuuggaaacacauuugcuuacuuccacacagccuuuguaacgugcucuccuuccucuuaccuguacuucggugauggaaauaaaaggaacauauaaacaaauaggaauuugaguaacugagaauccuuacuaccaaaaauggcuuguuucacuuuaaaaaaauguugcccuacccaaaauagaaaauguugguccuaaagagugcaaauugguguuucccucaccagcucugauguggucagggagcaagugcaaauaagcuugcggggagcaagcaggugccaugcucuccaugaugguuuguuccuuccgagcaaguccugguuucuuagcauaaacaacccacggugcccagauugaacaaagaugauaugcaaaccucgaaagaaauuggcauggaaaaaaaaaauccaaaauucucaugugaauuuuuuuaaaucuccaacagaauaauccaguccuagcaccuccaagccugagcaagaugauucagauggccggagagauugcagacggcauggcauaccucaacgccaauaaguucguccacagagaccuugcugcccggaauugcaugguagccgaagauuucacagucaaaaucggagguguguccuuagcuuuccaggucugggcaagaacuaaacucagguguuuugaggacuuuguuggcauuagucugccccuggagagguuuucuagugugucccuugagugcacggacuccuucuugggaaugaugugauugucuccaguugauggucacaaaccuggcacggucggucccaaugcugauagcucauggacauggugguucagauacugggcacggucccugaggcuggcucuccagacguuugaggcauuucuugguagaacaccucuuagcauugguuacagaaauaauuaagacaaugucuucaggagauuuugacuugggaauaaaacucacuguccaaccuugcauucaucccuccaauuuuccuagcuuuuaaggagcauugcuccccuuccagggacccacauugguuucuaagaggcaagcugcccuaaugacgaagccucugcacggagcaggagcaguggcaggagcuggcauggcagucccuuaggugagggacgaucacugcucacuggguuucacggcuggggcuggccagccuccaagcucucgaccacucucucacaacacuuacuguccugcucuuagcucaccagccuacugguuagacucccuuguugccaccacccacugucacaccagaaaaaaggguuggauugaauuucugagcaaugguuaaaacccacuucagccuuuagguuuguguuuuuacuucggucuuuuaaucugccuaauaaaaacacacauaacaucagggcugcucaggaaaccaccugcuuuuaccaggauucucaucuucccacuaugauacaaugauaguuuagaaaaauaccaaauauuuauccugagaaacugcaggggagauuuaacacccaaaagaagcuauuucaaauggaccucugugucuaguucuugaacugccuuuucuggaaguguucaccuuccuuuaguaacauauuuuuuuccuuuaguagugauguuuuaaugaaauguuuuagccccuuuggugaacaaugagaaucuuuuagagaacgguuucuuuuuuugagacagaguuuugcucuuguuuuccaagcuggagugcaguggcacaaucuuggcucaccacaaccuccaccucccagguucaagugauucuccugccucagccuccugacuaguugggauuacaggcgcgugccaccacacccagcugauuuuuuauauuuuuaguagaaacagguuuucaucauguuagccaggauggucuugaacuccugaccucaggugauccacgcaccucggccucccaaagugcugagauuacaggcgugagccaccacacccagcugagaaugguuucuaaaguaggggugagugucuuucuuuuuacucuguaggagcuagagguauugaaauggaaccauaucccagagcccacaucccuccgucaucagaguuccucauucaggauccaccagugugucccuagguuuggcacguugagacguccucacguuuggugcucugugaagcugggcagcccucagagaggcaaagaagucccaagaggccguccugccucagggcucucaggaaagagccgcccgcgucccuggcugggcuuccuuggugcacccagcucauuucuccuucccucucuguagaacucacauuguccccguggaaaugccagccagcuccccuuucccagugcaggggggagccaggugggccugaggugggccaguucugccgcuaaugggugagagacuugggccaggugccuuacauccgggagccucaguuuccucaccucggaaauagggugauaauguaacagaccccaugggguuaugagaaggacuuggugcaggaaagcagcagcacgugccuggcacagggcagggccucuccagauggcaguuccugucugugucuuauucccacccuccgggcacauggggggaacucaguuucuccccacugcgcgucacccugggagagguguuuuuugugccaauugccauuuuaaauccaaaucagcagggaucauguuugcuguucaaccauguggcauauuuauagugauuuuuuuuguaaucaugguuuuucuuucuggaauuucaaguuuuucauuugugcugaggaaggucguuuguguuuuuuaauaggauuccuucuuuuccaccuugugcaaguaaaggcaaauccccuauuugcaugucacuguauuaauucacagauaacacuuucacacuucauuuuuauucuucucaagggcucaagauguuuucccaaugcccagcgucucauggaugacaaauaugacaaguaauuuuaccagaggcaguuugagggcucuuagcauagcacaaguaaauuauguugguucaaguccaaggaacuuuguucucuuuguguuugcuuuuguagccuuaccucuuuggggcaugaguuagagacauacaugagcauuuuaaaguggagcagcccuuucuccugggaaggagaacggaagaguccacuuaagaaaagguuguaugauugagugcaaaaucaaaaucugacaaagcagcaauaauuuaggauuauaaagcgagccugccaucaaacauaauuauguggcaucuucuggagacauggaaaauggaagaaauuuucaaaaaugagugggaggauuauguugaaaaacaguauugaguaauagcuucaggggccucguaaauagcaucuuuucggcaucuuacuggguacuuuugucaucaugaauuguuacccugaauauuuucccccuuauuaagcagugaaauuauuuacuuuucuccagugguggggcagugcuaccaaguuaaguaagcaucuguacucuccuguuuauuuggucagguuuuaaaaccauguguaaaugaccaguggucucugcaguacuauauauuuucuuaaauugugggacucuaauuuuuacaccgcuuccuuuuuucuuauuuuuauuuucaagacagguucucacucugucacccaagcuggagugcaguguugugaucauggcucacugcagccucaaccuccagggcucaagugauucuuccaccuuagccucccaaguaccuaggaacacaggcgcacaccaccacucacaacugacuaauuuuuaaaauuuuuuauacagacagggucuugcuguguugcccaggcugaucuugaauuccugggcacaggcgaucuuccugucguggccucccaaagugcugggauuacaggcguugagucacugcgcucagccugccucucauuuaaaugcaauaagggcauuaacuuccuaagggaaucaaauuguaaauauauuaaaaguggagauugcuugguauuugcucaucaugugauuaaucaucccuuacugucuccaccuuauaaaauugcaaacccuaauauuuggccaccuuaaagugggacgugucugugucuugccuugcgucucuccacacauaaugaguguaggguccucugcugugacagcaguggugccugcuccagcgugugacucugcgcccucucuucccuuacagauuuugguaugacgcgagauaucuaugagacagacuauuaccggaaaggagggaaagggcugcugcccgugcgcuggaugucuccugagucccucaaggauggagucuucaccacuuacucggacgucugguaugagaaccuuuacugcauugccagccuggagcccccagccucugcacuuuccaccagcucagucucuagggcuuuaucuuucucuguucauuguuacccguugccagcuuuagcucaguguugugugagccacacuucuucaucauugagguguuccuguugucagugggcuagcuaagggcagaagggcauucgugggauuuuaaagaauuuaugggaccaacauucuuuccgccuucagcagauaccgauuauguuuccaggaggugggaugugccagaagccgucaccucuuuuuguuucuccccugccugccuucuuucucuuuuccucuuucucaauaaacagauacugucugugugucugccucaccuaaucuaacccucagauugcagacagugcuuuauuuagacccaaagcuuaugaguccugauuguguuuuccugcuggucccaucugcugucugucuuucagugggcauccaccguuguggacccagggaugguuaugggaagcaaaacgucucccuuaaucauaaacagugucuaccaguggaagcccaucgaccgagggaucagaggccucucaguaguauuguuuauugcaguuccuuggcaacauugcagagaggcagucagguucugaaauacaacugagguuauuggcaggcugaggcccuggcacaggcaccuucuagaauaucagcuagugucuuggcuuuccucuggggggaucccguugcuguuguguuacagaaaugguaguuguuuacuccaacagucuggaugaccgcauagaggaacuauuucaauagugacugacaucauuuuuuuuuuaaccucguaaaccuuucacaguucaggggccuuggaucuuauuuugaagacaggugcaaauuggaaauagcauuugaauaugacccggcaaagcaugauugcuucuuaagcucaaguaugagaucuguuuugcaaucagcuuguccaagaugguuaucucuucacugucaaaucaaagugcucugcaugguguuuagagauugggauggugaggagagagcaagccuggguaugugcaugcaucuguuuauucuaggcuucgugccuccaggagcuuggaggucagcuuguaguauaauaaaauagaaaacuauacagccggggagaacagaagcagaauagaaggauaaaguguuguucauaucucucgggcaaauuuuacccaaauucugacgagcaguuacugcacaagcaacaacaaagggaccuagaguguguucauugccaauucuguccauuuggcuacauaacuacugugaaccaauacaaaaagauauguauaaacaugaauaggcguuugguauucauuccaugaaaugcucaggcauugacagcgcuucagguuuuguuugcuuuuuaacacaggcuuugaggauagcacaggucaggaaggcuagggcguuggagcagguuucucagcgguccaggcucuaaacuaaagcugucccucucaaaagaauggaaaugauuucagauuguauucagcagcacgaagcaaugauuccuaaauaguuaaaaaucuagaaagaaacacuaagaauuguauugggcuuuguagaagagaccccagaauuuuaggauuugggauguaucccugcagucaggcccaguccccagugcaccugcagaucuuugacagcugcugguugagcuucugcuaagagguuuccuuccagggacuccauguucacugccucacaaaggcaggccagccucaugcuuuagacauccuugcucuuagcaaaucuuucguguucugcuacgucagccucugugugacacccauuggaccuucucucuguagcacaauugcauaccuugcucuguucuugauaagauaggucuaggagucaucgaagaggugugucuguucuagccagaacaccuccaaguuuccugcugucuuccaggacuucauucccaggcccuugggcacuguggcugcucucccugcagcucccuguagcaccaugucccucugaaaugacaagggugcccucuaggcauggaggaaaccagacgaaggacuggggagcugcaccccacagccuagagcugugcuucuucccgagcaucuggaucacccaacacauaaucuuuauuuuuuauuaagaagcuuuccaaauagucacaaauagccaagguuauuugcuucuuucaugacuaauuaccaucuguggggaauguggauuucucuguagguuuuaauuugcuggugagugggccauugcuaccauccccuccugguguggggaaguauaguuacugaaugcugccuccagccagcacgggcauugcagggggacucacagccgccggucuucccccuggggaaacaacgucaagguuccuaauuagaaagggcuuuacacagagacauguaucuacuguuugaagauuaaaucuguccaugaaauggaagacuugauuuuauaugaagucaugaagagccaacaccacauaguaaaauaccggcuuugaaaaacacagagguguugcauauuucucggugcuucugacuggcuguguggccuugguuaaaccucagagcuucucuggccuucgguugcuccaucuguaaggcaaggucugucucgagaagucugcgguaccugaauagauguugaaauggcuccuguggcaacugguauuguguagagaugguucaguguccacaccuugcaguugucacauuaagcugugaaggacgacugacucuagcacucagugguccucaguggcaggugauguugaccucagacaagaguugcucaggagauaggcuuugcaguucaccucgacaagcguuuguggagagcuaggucugcuaccuccuguaucguugccugugggugaugguaaggcucuuggggguguggaagaugcggggaugaugaugaugacgaugaugacgaugacgacgaugacagcgucgucgucguccugguccuggaaggauaaagucuuguggagaagaggaggcaauucugacaguuugggguugcaucaucuucuucacagaagagaugaaguuguguaggcacccuaaguauggauugucacaaaaagagcacuaggaagcggggcggggcggggcaggggugggggguuccuggcagugggaaugcugggcaggcauggcaguagggagcaccugcugcaggugggguuggugagguuuccucgugggacuuaggcugcagagagaucaagacaggccucagcuguuguauuaggcauccuggacuaauucuuuaagcccuguuaagguuucugaaccagagggugauuagagcugugcuugaaguucuuguuagccggaguauacagcugcauugagcaagauguuguaaccaaaggagaggugguggugggccaggcaagcaggauccugcacacucagggagcucugagggacggaaggagggugccagaccuuggacagaugugagccuggguggacaguucgcagugggacuccgaggaggccaagggcaugggugacagcaggcagacugcucggguggaaugggcaucagcugcagggaagccgggggaagaacagggcacaaaucggaguucagugugagacgcagugaguuuguggguagcccaguaacugggaacuuggaauggagcaguugggccgggagggccagggugggagccgugccgugagaacuggcugccugcaagccgcugacacagccaggaagggcacguggggcaagaggagaagugggucugggagggagccacauccucaggccauuucccagaccagccugcagucagcaaaagcagagagcuagucauuucuucuuauuuuauuuuuaauuuuuuguuguuggagagcuagucauuucuuguaccaagcugcauuucagauguguggguacuacugccacuggcaucugaggcaugcugccuguauggcugggcugguuguggaaggcagagcuucccgcacaaagcugauggagagccccuucuccccugggcccaggccucucuaaacugcacuuuuggccucugggugucuuguacaacaugaagacgacagcauuucuuggucacuuguaauuaaaaaggaccuuggguuggucuguccucugauugcuaagauucuauuucugucuaacaucuacuuuuaguaucaauuuguacaaaaaucuuugauucaccgaaaguagcugaagcagcgaauaaaacguucucauacagucaggagcacugugggcuugggcacaaggucaaggucccaagagcucuugguuggaaaucuccugccccagguuuuuccauguggcuugaccagcaccugcagcccaggacagguccagcuagaaucccugcuccccacccugcucccgccccuacuuggugaugaguagccuauuuuacuccaccaaagugaaccacauggaaaggcacacaggucagggagaauuugugaauuacggaauuugcccugggagggcacauuuguuuugcagauuccagcauugucuuuuuuaacauucugucugaaaguuguguguguacucucuguuuuguuuuccagugguuugaucuucuaaacuggcaaagcugcaugcauauggcagaauugcucacuacaaaguuauuccucagccaacuucucugcuuaaggauucuuuguccaugauacccccucccagccagugcagcccacccugguccccccaccugugacacagaggcccugcaggccagcagcuccccagcucuguugugggugggggagcagcaggaguucucuucucccuuggcccaacuggaccucaagaucccuauagaucuucuaaacauuccaggucccaggcccucaccccagaccaaucaaaucagaguuucuauugggugcccagcccucuguuuaaaaaccuccccaggagauucuccugugcagccggcagugagaaccaccuggguagagguuuccaaaauugucugauuguaaaaaucaccugaggagcuugguaaagcuugacugucccaggccucauuugaggcuacuaagucaauguccaggcuggggcuuggacaagaaugucauucuuuuugggucaaagccagguuaggugauaccgccuugccagauaaauggccgggacuagguagaugcugaacccaguaugcucugcguucaaagcacagaucaggggcuuccugaccgugcaagggaugccggaagcgcccucaccaccuuccuuagcuccaccaccggggcugaauuuaguuuacggggaacauuagcagcaacagagggaggaugauaucccgcacuuagcccagggccuggcucgcugucugacaagcacugucaccauaguaaggacaguuuaucugcucgggauguaagaagugcuggaaaggagggggcagcauuguucaguccaucccuuuccaagcuccucacaguuuuuuucucccuguagguccuucggggucguccucugggagaucgccacacuggccgagcagcccuaccagggcuuguccaacgagcaaguccuucgcuucgucauggagggcggccuucuggacaagccagacaacuguccugacaugcuguacguacuuccugggcccuccgugcucuucugaguucucuucucaaauaccuguuuucuugggucacaggagauuaggagauuaaagccauucucucugguccugcgccucccuugccaggcguggcuaagagguuuguccuuguggaaggagcugaguggguuggucgaccugugcuuuuccguggguaccuuaauucuaccccauauuccguaaugcuuucguuccgauuugcaguucacacuguaguuucucaggccaaaugucucugugaaauguuuggccagaguaauccauccuuacucauccucuccaugugagguuuuuguuucuuuuuaaagaaggcuacaacacaacacauacuacucugaagucgaauucaagagccccgcgccccaccuguggcaggccugagggagccgccgcagugagugugcacacagcugcauggccaggacuccggcaugcaccacguagggucagcuuggugucuucugaacccugccccacaugucuucucuguuaaguguuuacaaaagucauaaaccaucuaaguaacaugcucuccggagcuucauccgcugaccaauguggaccuggagcgugugugagcugacaucccugcggacagaaggaugccagugcuggugaauuugucuucucacugcacuuuuuuuuuuuuuuuuugagauggagucucgcucugucgcccaggcuggagugcauuggcgugaucuuggcucacugcaaccucugccucccggguucaagcaauucuccugccucacccuccaaaauagcuaggauuacaggcacccaccaccacucccagcuaauuuuuaguagagaugggguuuuaccauauuggccaggcuggucuugaacuccugaccucagaugaucuccccgccucagccucccaaagugcugggauuacaggcaugagccaucgcaccuggcaaccccacuuauuuugaaaaaacacuuugcagcuuuuaguccuaaguuuugucagaugacgagagagaguuugugaugccucacaguguuggugaggccucucugcucagcgcccccuggagaagccccccuuuugguggaggacuugcucuguguccguggacggugcuguuuuguggcucaguggaggucagagcugcuggagcagggaggccuuguuguccuuccuggaaugaguuugaggagggggugaagguguuccaguucagucaucaggcgcacaacagguacagguugggagcaguggccuugcuuuugacaugcacuuuaaggcaggcuucagagauugaucuggaucuccauagcugaacaggaaggugggcucccacuaguaucucaagaccaauucaggagauuuccagaaaugcuuuucaggacagguuuggcuucauuuuggaaaggauccugaggaauugcugggcuguuaugucugcaugaaggcacccagcuccuaucucucacccauccaccccccuggagccagcacagacucaggcugggcccacaguggcgggauaauagauagauaugaaccagacaugugucagguggacaggagggaaugagggcuccagcagccacaaaaguuuugcucauuuggucuccuacagugucugugggccaggaauccagaugcagguguucuugcucucagcucagagucacaggaggcagaaaucaagaugucaguggggcugcagucucaccugaggcucagggacaucuucaggcuccuucaggguucugcacuugcaggacugagguccccauauucuuggcaccugucagcuggggacugcuuucaacucuuggaggccaaggccacucacaguccuugccauauacagccuccauaggcccucucauaacagcagccuauuucuucaagacugauaagaggacagcucucuacugcuucuacugguuuuuuaccugauaaagucagaucuacccaggauacucucucccuuuuaagugauucacagucaauugaugagaagccugauuagaggagugaaguauccucucauguucacaagucccacccguacucaagugaggggauuauaugggauauuuacaccaggggcaacgaucuuggggggcaucuuagaauuccauagucucagaaaucauugucccuaaucaaacaaucaaggugcuauuuuuguuucaaagcacuuugaguguugcuacaaauacugaaucccuaagcuccuuguaaauggccggccagcggagggcaugggguggggaagacuggauacacaccccugugcucugggaguacguuggcugggcggcaugcucauuagcugcugcuuccgaacauagguucagcugaaguguaucccaggcaguggacacuucguguggaauucagaaagguggcgcaggaaggauaccagggaaagccagagugaaggcaucacccuugcacagcuagcacaugugggggcucccauugucccaucaaggcagggccagaaccagaaagucggcuggugcccugggccugggccagugaugggaggcuccucuucucugaggguggcaccuacagaugcaguggcacuggguuuccuggagcccucaucaaggaaacuucccagcauggccucuucagaacuccacaauccaaacuuggaagagacucgaaagaccacuuaguaccuuuucuugcccaguauagaaauucuucuucuccccuucuguguuaguuuuuuaucgcaguauaacaaacuacccaaaaccuacuaguuaagagcaacaguaaacauguauuaucucucagagguuucugaaggcgaggaacgcaggagcggcauagcuggcuggcucuggcuuggagcccuucucgcgguugcagcccagcuguccgccggggcugcagucaucugaaggcuugccugggggaggcagacccacuuccaagguguugcugcauagguaguaugcccugcaugaaucgcccuguucuacgugggccucuccguagcacugcccaagugucucaggauguguagcuggcuucucugagugcagaguucggcacacucuuucucuaaaaggccggcuaaaaaaauguuuuuggcucugugggcccauacgaccuugacugugacuacuggacucugccacuguggagcaaacacagcugugggcgucacauaagcuagcguggcuguguuccaauacagcuuuauuuuuaauacuggaauuugaauuccacaucaucccuguguugucacaaaauauucuuauuuugaauuucuuuuagccauuuacaugaaaaccauucuuagcucauagaccuuggaaaacuaggcagcaggccagauuuuacccacagguacauaguuugccugcugugcccuagaguaaaagauccaggaccugagcagaaggcacgacguccuuucugaccaaaccucagaagucacacugaggcucucaccuucuccuucagguuacaccaugugagagucaaucacguggggaugugagcuccaggacacaggggagaggaccacuggggauccgggagccuggcuaccccccaguaccccaccaacacacacacacacacacacacacacacugccccucacaggugaccaucugcuccacacuuugagcagcgcagccacuguuuucuugccagccauuaugagaaaaaucaugcuuucaagucugaauauaagccauggaguaagaggucugaugaccacugaaucugcauaaagguacagugcuagaaucuaggcuaauacuagaacuggugguauuuuagcaagcuuagaaacagcccaugaaagcaggugugaguucugcuucugugguuuagggugggugagggagagcgguauuguucugugcuuucucuuugacucggguaaacguuuaucuacaagagacuugugggauucuuacuugguccaccuccaggugacugggcuuuuacuauuaauguaaacugccugggacgcagccccugccaugggaaacgcagggcacuuccuguucucagcauagagugacaaggaaauuuacucagagcgguuacucugacauucaauguuuaguucaggaggcauuucugcuuugccaucgagaauuuuucucccuucuaagaaaauguuuucuccugagaaaauuuuucucccuuccaagaaaagaguagaaugaaaggaggcaacuugguuucauagggagugucauguuguccuucugaguuuacugaugagcuuaccugagaaaggaggguucuagcaugggaguucuguugcuacaagacaugaaagaauggccuccguuuaucccggagaggagagucccugagcccuugggaguugccuugaaaccucugccgggucccaggugagaaagugugugaguugugugguucugagaucugaacaggcaccaucuggugacacuaggggcugaaggagcucgguggcugcagguggacuggagcucaccaucaggaaguagccagauucucaccccucagugucaccgaguguucuggcuuuagaggaaggacuccgugguccccaagccacaaggugucgaggucugagucucaacgccaugacucagugugaauuaacuuagcagguaucacaacaucagauuuggguugugguucccugcugggucuguacuuuagauugaugacaaagcccguccucagccuuauuucagcccagaucucgguauuuaugccacagauacuguugagcuccucugggugcgugcugacccugaggucacacagaugagccaggaguggcccuggcuuucaggaaacguagugacguaaaaggucccggcugcugcgggauaagggccagggcagaggugugaacgcagccguggaagacuugggccaggaagccauuuguucugcugcuaacacuuccacagcuccacguguccagacuguugccagagacgucuuuggucuacaggauucaggagggaaucugaacuuuagccuggagcauuaucaacucauagaugagucugaaacaaacuuagugaaaucugauguuuuuuguaguuuuccaguacaguuuuucccaucgcuggaauccugguuugguucugcgggaaucgagugcuugagugggacccagacagacaggaagggcgcuccugcucaguuagccccaguaagcucacugaggcacacaggccccauguccacagccgcuccuggcugaggcgugguuccuaagacgacccuuacuguugagggcugccaggagggagagacacauucagccccgcagguccucugggaauccggugagcgucggcaccgggcuggggccgugcugauucccggcagcgugugggaaugugcgggugccucguggccugcugacaucgcacacaggucacagccuguccaguucaggacaucagggccaagagugaagugagaauacggaggcaccucugugugcucacccugcugaccgucacccagccuccggggggggucacagcuggcccccaggaagcugcuucccagcagggcaggaauuccauuugagucuugucccuguuccaggagaagggcuggguaugugucccccaaaggggagagcauucgagaaggauggcgccagccuccccagaacugaccugugguuaaaaaaaaaaaaaaaauugugcuuuuuaaaagaugaguuuuaucagcucacacauccuucuagagucuaauggagauuuuuuguguguguggaaauaguaaacaaggucuugaaucccacagagcaaaaaagacuuccuuucaugggcagcacuggaaggguuguuacucuggaaugguuuaaaagaggcgucacauggcuuguuugugcugaugucacugccucgcugcucuccuguggcaccuccucggucccuggccacagggcacagagccaagcacaucucaugcucuuggcccaguuacgcuucugcccagggguaagucagcuggagaggaauucacagcccaggcauuucaugucguuauggccuauuuuaauuuuuuuaaccccaaucauuuuucuuaggaagugauggggaguuuggaaaggcaggcuuauuugucaucaagcugccagcuuuuaucaaugcaaaccacaucccugugacaucugugacuguuccuuggacaguuaggugagggagggucuccugguggccccaggguuacucuuauuuagguugagaaaaauuccuuuuuccaggaucguuggugaucaaaguguagucauucuguugcgcagagaacuccaucccagcuccacccucaugaauuuuguaaucuuggacaaauuauuuaguaucuuagugcuucuguucccucaucuguaacauggggguauauuauagucaguagcaccugcuucacaaacucgugaggacuucagcaguucacacacauaacugccucgcugccuggcaccuagcgugcacauggcauucuaccgugggguagacuuuuaaaauucuggcuacagagauacuuuuccauaaaaguggccacauggaacucuccaaaucuaagaagcauacugugggggccuucauauuuugucuaauucuuuucuccccagaacaggaaccugcacccuuccuucuuuuaaagggcgacgugguaaauaaacauuuuuagacuugcaggccacagucucuguccuaauguccucagcugguaguuguagcuggaaagcagcugcagcccacauggaaaugagggagcguggccccaugccagugcagcugauguagaggcgggcagccccggguuaggcccuguggagacgcaggcccccgggcucuagaacgcugaauucuagugaauucuggauggcucucccucacacccaggcccacccucccucaagguugcaccuucuccaccugaaggaagcugccagguggccauaggagcccuucucuuggcaggccagcuuccaggcccaguggcuucucuuacaucaggggccuccccuuggaauguucccugaaggccagacacgggcagguagucuguggucaagcagccacccugacaggaggcuagaugccacugggugugcuuugaguuuccuagauguggagaguucuguguggccacuuuuauggaaaagcaucucuuuagccagaauuuuaaaauaaagaggauaacuuccuggugagaacagacguggaaaggaaggcacuuugguuucacgcucauguaagagagggcuguuggcggucacuccucagaacuauggccagcccuggaugguagccagcugcuuuuugccccaaaagucuguuuagcugggucucugcauucuggaagcuugucaaagcccgggccuuuccugggucagggcagccggcuuuccuuguccacguguggccggcuguuuucuuggggagccccggccacagccggcaggacucccuuugcuccaugugacucugagggccucacagguauuugcagcccaggugcugucggagcccagccgaugcgaccgacacacagcacaagcgucauccuguucugccugucccuugcguguggaggggacucgugcccagggcucuccuugcuggcuuguuggaaucuggcuucaggucuacacggggccucucguuugguccagaacagccuggcucaucggcuggggcuugcuugugcagggcuggagcgagcacgugcuagauggagacagcagacucggagugugcauuucuucguguugcaagccuggccucacagugccuucuuccuuugguugucugccagggguagcccugcaccaggaggaagcuuagaaauagcacaggugggaaccggagagagagcacuguuggggaagcugcggucacucaucagccuuccuggugagaaaccagggguuuccugcuaauucuggaaaggauguuucagcagugccugcaugagacgccucagauagaaaacugguuauuuuuguuucuuagcacugccaccauagauaacagcugucacgauggacaguguggaccuggauuaguccuucuugggaaaggagaguuuggguuuuguaccguggugguucuggguucugggggaagagaauggaaccguacgagguaaaacaggagacucugaaggccacuuggccauccaggcagaaagccagggauggagaggggcagcagggcuguguucagugcucccgccguacgcuuguaugcgggaaaccacugcaggcggcccaugaagccuccuggccaugugcgcccucccgguuuggacccccucccgugugucuuggcugcagguuugaacugaugcgcaugugcuggcaguauaaccccaagaugaggccuuccuuccuggagaucaucagcagcaucaaagaggagauggagccuggcuuccgggaggucuccuucuacuacagcgaggagaacaagcugcccgagccggaggagcuggaccuggagccagagaacauggagagcgucccccuggaccccucggccuccucguccucccugccacugcccgacagacacucaggacacaaggccgagaacggccccggcccuggggugcugguccuccgcgccagcuucgacgagagacagccuuacgcccacaugaacgggggccgcaagaacgagcgggccuugccgcugccccagucuucgaccugcugauccuuggauccugaaucugugcaaacaguaacgugugcgcacgcgcagcgggguggggggggagagagaguuuuaacaauccauucacaagccuccuguaccucaguggaucuucagaacugcccuugcugcccgcgggagacagcuucucugcaguaaaacacauuugggauguuccuuuuuucaauaugcaagcagcuuuuuauucccugcccaaacccuuaacugacaugggccuuuaagaaccuuaaugacaacacuuaauagcaacagagcacuugagaaccagucuccucacucugucccuguccuucccuguucucccuuucucucuccucucugcuucauaacggaaaaauaauugccacaaguccagcugggaagcccuuuuuaucaguuugaggaaguggcugucccuguggccccauccaaccacuguacacacccgccugacaccgugggucauuacaaaaaaacacguggagauggaaauuuuuaccuuuaucuuucaccuuucuagggacaugaaauuuacaaagggccaucguucauccaaggcuguuaccauuuuaacgcugccuaauuuugccaaaauccugaacuuucucccucaucggcccggcgcugauuccucguguccggaggcaugggugagcauggcagcugguugcuccauuugagagacacgcuggcgacacacuccguccauccgacugccccugcugugcugcucaaggccacaggcacacaggucucauugcuucugacuagauuauuauuugggggaacuggacacaauaggucuuucucucagugaagguggggagaagcugaaccggcuucccugcccugccuccccagcccccugcccaacccccaagaaucugguggccaugggccccgaagcagccuggcggacaggcuuggagucaaggggccccaugccugcuucucucccagccccagcucccccgcccgcccccaaggacacagaugggaagggguuuccagggacucagccccacuguugaugcagguuugcaaggaaagaaauucaaacaccacaacagcaguaagaagaaaagcagucaauggauucaagcauucuaagcuuuguugacauuuucucuguuccuaggacuucuucaugggucuuacaguucuauguuagaccaugaaacauuugcauacacaucgucuuuaaugucacuuuuauaacuuuuuuacgguucagauauucaucuauacgucuguacagaaaaaaaaaagcugcuauuuuuuuuguucuugaucuuuguggauuuaaucuaugaaaaccuucagguccacccucuccccuuucugcucacuccaagaaacuucuuaugcuuuguacuagagugcgugacuuucuuccucuuuucccgguaauggauacuucuaucacauaauuugccaugaacuguuggaugccuuuuuauaaauacaucccccaucccugcucccaccugccccuuuaguuguuuucuaacccguaggcucucugggcacgaggcagaaagcaggccgggcacccauccugagagggccgcgcuccucuccccagccugcccucacagcauuggagccuguuacagugcaagacaugauacaaacucaggucagaaaaacaaagguuaaauauuucacacgucuuuguucaguguuuccacucaccgugguugagaagccucacccucucuuucccuugccuuugcuuagguugugacacacauauauauauauuuuuuuaauucuuggguacaacagcaguguuaaccgcagacacuaggcauuuggauuacuauuuuucuuaauggcuauuuaauccuuccaucccacgaaaaacagcugcugaguccaagggagcagcagagcgugguccggcagggccuguuguggcccucgccaccccccucaccggaccgacugaccugucuuuggaaccagaacaucccaagggaacuccuucgcacuggcguugagugggaccccgggauccaggcuggcccagggcggcacccucagggcugugcccgcuggagugcuagguggaggcagcacagacgccacgguggcccaagagccccuuugcuucuugcugggggaccagggcuguggugcuggcccacuuucccucggccaggaauccagguccuuggggcccaggggucuugucuuguuucauuuuuagcacuucucaccagagagaugacagcacaagaguugcuucugggauagaaauguuuaggaguaagaacaaagcugggauacggugauugcuaguugugacugaagauucaacacagaaaagaaaguuuauacggcuuuuuugcuggucagcaguuugucccacugcuuucucuagucucuaucccauagcguguucccuuuaaaaaaaaaaaaaagguauuauauguaggaguuuucuuuuaauuuauuuugugauaaauuaccaguuucaaucacuguagaaaagccccauuaugaauuuaaauuucaaggaaaggguguguguguguguauguguggggugugugugugugagagugaugggacaguucuugauuuuuuggguuuuuuuucccccaaacauuuaucuaccucacucuuauuuuuuauauguguauauagacaaaagaauacaucucaccuuucucagcaccugacaauaggccguugauacugguaaccucauccacgccacaggcgccacacccaggugaugcagggggaagccaggcuguauuccggggucaaagcaacacuaacucaccucucugcucauuucagacagcuugccuuuuucugagauguccuguuuuguguugcuuuuuuuguuuuguuuucuaucuugguuuccaccaagguguuagauuucuccuccuccuagccagguggcccugugaggccaacgagggcaccagagcacaccugggggagccaccaggcugucccuggcugguugucuuuggaacaaacugcuucugugcagauggaaugaccaacacauuucguccuuaagagagcagugguuccucagguucugaggagaggaagguguccaggcagcaccaucucugugcgaauccccaggguaaaggcguggggcauuggguuugcuccccuugcugcugcuccaucccugcaggaggcucgcgcugaggcaggaccgugcggccauggcugcugcauucauugagcacaaaggugcagcugcagcagcagcuggagagcaagagucacccagccugugcgccagaaugcagaggcuccugaccucacagccagucccugauagaacacacgcaggagcagaguccccucccccuccaggcugcccucucaacuucucccucaccuccuucccuagggguagacagagauguaccaaaccuuccggcuggaaagcccaguggccggcgccgaggcucguggcgucacgccccccccgccagggcuguaccuccgucucccugguccugcugcucacaggacagacggcucgcuccccucuuccagcagcugcucuuacaggcacugaugauuucgcugggaaguguggcgggcagcuuugccuaagcguggauggcuccucggcaauuccagccuaagugaaggcgcucaggagccuccugcuggaacgcgacccaucucucccaggaccccggggaucuuaaggucauugagaaauacuguuggaucaggguuuuguucuuccacacuguaggugaccccuuggaauaacggccucuccucucgugcacauaccuaccgguuuccacaacuggauuucuacagaucauucagcugguuauaaggguuuuguuuaaacuguccgaguuacugaugucauuuuguuuuuguuuuauguagguagcuuuuaaguagaaaacacuaacaguguagugcccaucauagcaaaugcuucagaaacaccucaauaaaagagaaaacuuggcuugugugauggugcagucacuuuacuggaccaacccacccaccuugacuauaccaaggcaucaucuauccacaguucuagccuaacuucaugcugauuucucugccucuugauuuuucucuguguguuccaaauaaucuuaagcugaguuguggcauuuuccaugcaaccuccuucugccagcagcucacacugcuugaagucauaugaaccacugaggcacaucauggaauugaugugagcauuaagacguucucccacacagcccuucccugaggcagcaggagcugguguguacuggagacacuguugaacuugaucaagacccagaccaccccaggucuccuucgugggaugucaugacguuugacauaccuuuggaacgagccuccuccuuggaagauggaagaccguguucguggccgaccuggccucuccuggccuguuucuuaagaugcggagucacauuucaaugguacgaaaaguggcuucguaaaauagaagagcagucacuguggaacuaccaaauggcgagaugcucggugcacauuggggugcuuugggauaaaagauuuaugagccaacuauucucuggcaccagauucuaggccaguuuguuccacugaagcuuuucccacagcaguccaccucugcaggcuggcagccgaauggcuugccaguggcucuguggcaagaucacacugagaucgaugggugagaaggcuaggaugcuugucuaguguucuuagcugucacguuggcuccuuccaggguggccagacgguguuggccacucccuucuaaaacacaggcgcccuccuggugacagugacccgccgugguaugccuuggcccauuccagcagucccaguuaugcauuucaaguuugggguuuguucuuuucguuaauguuccucuguguugucagcugucuucauuuccugggcuaagcagcauugggagauguggaccagagauccacuccuuaagaaccaguggcgaaagacacuuucuuucuucacucugaaguagcuggugguacaaaugagaacuucaagagaggauguuauuuagacugaaccucuguugccagagaugcugaagauacagaccuuggacaggucagaggguuucauuuuuggccuucaucuuagaugacugguugcgucauuuggagaagugagugcuccuugaugguggaaugaccgggugguggguacagaaccauugucacagggauccuggcacagagaagaguuacgagcagcagggugcagggcuuggaaggaaugugggcaagguuuugaacuugauuguucuugaagcuaucagaccacaucgaggcucagcagucauccgugggcauuugguuucaacaaagaaaccuaacauccuacucuggaaacugaucucggaguuaaggcgaauuguucaagaacacaaacuacaucgcacucgucaguugucaguucuggggcaugacuuuagcguuuuguuucugcgagaacauaacgaucacucauuuuuaugucccacguguguguguccgcaucuuucuggucaacauuguuuuaacuagucacucauuagcguuuucaauagggcucuuaaguccaguagauuacggguagucaguugacgaagaucugguuuacaagaacuaauuaaauguuucauugcauuuuuguaagaacagaauaauuuuauaaaauguuuguaguuuauaauugccgaaaauaauuuaaagacacuuuuuuuuucucugugugugcaaauguguguuugugauccauuuuuuuuuuuuuuuuuuaggacaccuguuuacuagcuagcuuuacaauaugccaaaaaaggauuucucccugaccccauccgugguucacccucuuuuccccccaugcuuuuugcccuaguuuauaacaaaggaaugaugaugauuuaaaaaguaguucuguaucuucaguaucuuggucuuccagaacccucugguugggaaggggaucauuuuuuacuggucauuucccuuuggaguguagcuacuuuaacagauggaaagaaccucauuggccauggaaacagccgagguguuggagcccagcagugcauggcaccguucggcaucuggcuugauuggucuggcugccgucauugucagcacagugccauggacaugggaagacuugacugcacagccaaugguuuucaugaugauuacagcauacacagugaucacauaaacgaugacagcuauggggcacacaggccauuugcuuacaugccucguaucaugacugauuacugcuuuguuagaacacagaagagacccuauuuuauuuaaggcagaaccccgaagauacguauuuccaauacagaaaagaauuuuuaauaaaaacuauaacauacacaaaaauugguuuuaaaguugacuccacuuccucuaacuccaguggauuguuggccaugucuccccaacuccacaauaucucuaucaugggaaacaccugggguuuuugcgcuacauaggagaaagaucuggaaacuauuuggguuuuguuuucaacuuuucauuuggauguuuggcguugcacacacacauccaccgguggaagagacgcccggugaaaacaccugucugcuuucuaagccagugagguugaggugagagguuugccagaguuugucuaccucuggguaucccuuugucugggauaaaaaaaaucaaaccagaaggcgggauggaauggaugcaccgcaaauaaugcauuuucugaguuuucuuguuaaaaaaaaauuuuuuuaaguaagaaaaaaaaagguaauaacauggccaauuuguuacauaaaaugacuuucuguguauaaauuauuccuaaaaaauccuguuuauauaaaaaaucaguagaugaaaaaaauuucaaaauguuuuuguauauucuguuguaagaauuuauuccuguuauugcgauauacucuggauucuuuacauaauggaaaaaagaaacugucuauuuugaauggcugaagcuaaggcaacguuaguuucucuuacucugcuuuuuucuaguaaaguacuacaugguuuaaguuaaauaaaauaauucuguaugc

SEQ ID NO: 21425 - RNA, 315595 nt, Homo sapiens
gcauacagaauuauuuuauuuaacuuaaaccauguaguacuuuacuagaaaaaagcagaguaagagaaacuaacguugccuuagcuucagccauucaaaauagacaguuucuuuuuuccauuauguaaagaauccagaguauaucgcaauaacaggaauaaauucuuacaacagaauauacaaaaacauuuugaaauuuuuuucaucuacugauuuuuuauauaaacaggauuuuuuaggaauaauuuauacacagaaagucauuuuauguaacaaauuggccauguuauuaccuuuuuuuuucuuacuuaaaaaaauuuuuuuuuaacaagaaaacucagaaaaugcauuauuugcggugcauccauuccaucccgccuucugguuugauuuuuuuuaucccagacaaagggauacccagagguagacaaacucuggcaaaccucucaccucaaccucacuggcuuagaaagcagacagguguuuucaccgggcgucucuuccaccgguggaugugugugugcaacgccaaacauccaaaugaaaaguugaaaacaaaacccaaauaguuuccagaucuuucuccuauguagcgcaaaaaccccagguguuucccaugauagagauauuguggaguuggggagacauggccaacaauccacuggaguuagaggaaguggagucaacuuuaaaaccaauuuuuguguauguuauaguuuuuauuaaaaauucuuuucuguauuggaaauacguaucuucgggguucugccuuaaauaaaauagggucucuucuguguucuaacaaagcaguaaucagucaugauacgaggcauguaagcaaauggccugugugccccauagcugucaucguuuaugugaucacuguguaugcuguaaucaucaugaaaaccauuggcugugcagucaagucuucccauguccauggcacugugcugacaaugacggcagccagaccaaucaagccagaugccgaacggugccaugcacugcugggcuccaacaccucggcuguuuccauggccaaugagguucuuuccaucuguuaaaguagcuacacuccaaagggaaaugaccaguaaaaaaugauccccuucccaaccagaggguucuggaagaccaagauacugaagauacagaacuacuuuuuaaaucaucaucauuccuuuguuauaaacuagggcaaaaagcauggggggaaaagagggugaaccacggauggggucagggagaaauccuuuuuuggcauauuguaaagcuagcuaguaaacagguguccuaaaaaaaaaaaaaaaaaauggaucacaaacacacauuugcacacacagagaaaaaaaaagugucuuuaaauuauuuucggcaauuauaaacuacaaacauuuuauaaaauuauucuguucuuacaaaaaugcaaugaaacauuuaauuaguucuuguaaaccagaucuucgucaacugacuacccguaaucuacuggacuuaagagcccuauugaaaacgcuaaugagugacuaguuaaaacaauguugaccagaaagaugcggacacacacacgugggacauaaaaaugagugaucguuauguucucgcagaaacaaaacgcuaaagucaugccccagaacugacaacugacgagugcgauguaguuuguguucuugaacaauucgccuuaacuccgagaucaguuuccagaguaggauguuagguuucuuuguugaaaccaaaugcccacggaugacugcugagccucgauguggucugauagcuucaagaacaaucaaguucaaaaccuugcccacauuccuuccaagcccugcacccugcugcucguaacucuucucugugccaggaucccugugacaaugguucuguacccaccacccggucauuccaccaucaaggagcacucacuucuccaaaugacgcaaccagucaucuaagaugaaggccaaaaaugaaacccucugaccuguccaaggucuguaucuucagcaucucuggcaacagagguucagucuaaauaacauccucucuugaaguucucauuuguaccaccagcuacuucagagugaagaaagaaagugucuuucgccacugguucuuaaggaguggaucucugguccacaucucccaaugcugcuuagcccaggaaaugaagacagcugacaacacagaggaacauuaacgaaaagaacaaaccccaaacuugaaaugcauaacugggacugcuggaaugggccaaggcauaccacggcgggucacugucaccaggagggcgccuguguuuuagaagggaguggccaacaccgucuggccacccuggaaggagccaacgugacagcuaagaacacuagacaagcauccuagccuucucacccaucgaucucagugugaucuugccacagagccacuggcaagccauucggcugccagccugcagagguggacugcugugggaaaagcuucaguggaacaaacuggccuagaaucuggugccagagaauaguuggcucauaaaucuuuuaucccaaagcaccccaaugugcaccgagcaucucgccauuugguaguuccacagugacugcucuucuauuuuacgaagccacuuuucguaccauugaaaugugacuccgcaucuuaagaaacaggccaggagaggccaggucggccacgaacacggucuuccaucuuccaaggaggaggcucguuccaaagguaugucaaacgucaugacaucccacgaaggagaccugggguggucugggucuugaucaaguucaacagugucuccaguacacaccagcuccugcugccucagggaagggcugugugggagaacgucuuaaugcucacaucaauuccaugaugugccucagugguucauaugacuucaagcagugugagcugcuggcagaaggagguugcauggaaaaugccacaacucagcuuaagauuauuuggaacacacagagaaaaaucaagaggcagagaaaucagcaugaaguuaggcuagaacuguggauagaugaugccuugguauagucaagguggguggguugguccaguaaagugacugcaccaucacacaagccaaguuuucucuuuuauugagguguuucugaagcauuugcuaugaugggcacuacacuguuaguguuuucuacuuaaaagcuaccuacauaaaacaaaaacaaaaugacaucaguaacucggacaguuuaaacaaaacccuuauaaccagcugaaugaucuguagaaauccaguuguggaaaccgguagguaugugcacgagaggagaggccguuauuccaaggggucaccuacaguguggaagaacaaaacccugauccaacaguauuucucaaugaccuuaagauccccgggguccugggagagaugggucgcguuccagcaggaggcuccugagcgccuucacuuaggcuggaauugccgaggagccauccacgcuuaggcaaagcugcccgccacacuucccagcgaaaucaucagugccuguaagagcagcugcuggaagaggggagcgagccgucuguccugugagcagcaggaccagggagacggagguacagcccuggcggggggggcgugacgccacgagccucggcgccggccacugggcuuuccagccggaagguuugguacaucucugucuaccccuagggaaggaggugagggagaaguugagagggcagccuggagggggaggggacucugcuccugcguguguucuaucagggacuggcugugaggucaggagccucugcauucuggcgcacaggcugggugacucuugcucuccagcugcugcugcagcugcaccuuugugcucaaugaaugcagcagccauggccgcacgguccugccucagcgcgagccuccugcagggauggagcagcagcaaggggagcaaacccaaugccccacgccuuuacccuggggauucgcacagagauggugcugccuggacaccuuccucuccucagaaccugaggaaccacugcucucuuaaggacgaaauguguuggucauuccaucugcacagaagcaguuuguuccaaagacaaccagccagggacagccugguggcucccccaggugugcucuggugcccucguuggccucacagggccaccuggcuaggaggaggagaaaucuaacaccuugguggaaaccaagauagaaaacaaaacaaaaaaagcaacacaaaacaggacaucucagaaaaaggcaagcugucugaaaugagcagagaggugaguuaguguugcuuugaccccggaauacagccuggcuucccccugcaucaccuggguguggcgccuguggcguggaugagguuaccaguaucaacggccuauugucaggugcugagaaaggugagauguauucuuuugucuauauacacauauaaaaaauaagagugagguagauaaauguuugggggaaaaaaaacccaaaaaaucaagaacugucccaucacucucacacacacacaccccacacauacacacacacacacccuuuccuugaaauuuaaauucauaauggggcuuuucuacagugauugaaacugguaauuuaucacaaaauaaauuaaaagaaaacuccuacauauaauaccuuuuuuuuuuuuuuaaagggaacacgcuaugggauagagacuagagaaagcagugggacaaacugcugaccagcaaaaaagccguauaaacuuucuuuucuguguugaaucuucagucacaacuagcaaucaccguaucccagcuuuguucuuacuccuaaacauuucuaucccagaagcaacucuugugcugucaucucucuggugagaagugcuaaaaaugaaacaagacaagaccccugggccccaaggaccuggauuccuggccgagggaaagugggccagcaccacagcccuggucccccagcaagaagcaaaggggcucuugggccaccguggcgucugugcugccuccaccuagcacuccagcgggcacagcccugagggugccgcccugggccagccuggaucccggggucccacucaacgccagugcgaaggaguucccuugggauguucugguuccaaagacaggucagucgguccggugagggggguggcgagggccacaacaggcccugccggaccacgcucugcugcucccuuggacucagcagcuguuuuucgugggauggaaggauuaaauagccauuaagaaaaauaguaauccaaaugccuagugucugcgguuaacacugcuguuguacccaagaauuaaaaaaauauauauauaugugugucacaaccuaagcaaaggcaagggaaagagagggugaggcuucucaaccacggugaguggaaacacugaacaaagacgugugaaauauuuaaccuuuguuuuucugaccugaguuuguaucaugucuugcacuguaacaggcuccaaugcugugagggcaggcuggggagaggagcgcggcccucucaggaugggugcccggccugcuuucugccucgugcccagagagccuacggguuagaaaacaacuaaaggggcaggugggagcagggaugggggauguauuuauaaaaaggcauccaacaguucauggcaaauuaugugauagaaguauccauuaccgggaaaagaggaagaaagucacgcacucuaguacaaagcauaagaaguuucuuggagugagcagaaaggggagaggguggaccugaagguuuucauagauuaaauccacaaagaucaagaacaaaaaaaauagcagcuuuuuuuuuucuguacagacguauagaugaauaucugaaccguaaaaaaguuauaaaagugacauuaaagacgauguguaugcaaauguuucauggucuaacauagaacuguaagacccaugaagaaguccuaggaacagagaaaaugucaacaaagcuuagaaugcuugaauccauugacugcuuuucuucuuacugcuguugugguguuugaauuucuuuccuugcaaaccugcaucaacaguggggcugagucccuggaaaccccuucccaucuguguccuugggggcgggcgggggagcuggggcugggagagaagcaggcauggggccccuugacuccaagccuguccgccaggcugcuucggggcccauggccaccagauucuuggggguugggcagggggcuggggaggcagggcagggaagccgguucagcuucuccccaccuucacugagagaaagaccuauuguguccaguucccccaaauaauaaucuagucagaagcaaugagaccugugugccuguggccuugagcagcacagcaggggcagucggauggacggagugugucgccagcgugucucucaaauggagcaaccagcugccaugcucacccaugccuccggacacgaggaaucagcgccgggccgaugagggagaaaguucaggauuuuggcaaaauuaggcagcguuaaaaugguaacagccuuggaugaacgauggcccuuuguaaauuucaugucccuagaaaggugaaagauaaagguaaaaauuuccaucuccacguguuuuuuuguaaugacccacggugucaggcggguguguacagugguuggauggggccacagggacagccacuuccucaaacugauaaaaagggcuucccagcuggacuuguggcaauuauuuuuccguuaugaagcagagaggagagagaaagggagaacagggaaggacagggacagagugaggagacugguucucaagugcucuguugcuauuaaguguugucauuaagguucuuaaaggcccaugucaguuaaggguuugggcagggaauaaaaagcugcuugcauauugaaaaaaggaacaucccaaauguguuuuacugcagagaagcugucucccgcgggcagcaagggcaguucugaagauccacugagguacaggaggcuugugaauggauuguuaaaacucucucuccccccccaccccgcugcgcgugcgcacacguuacuguuugcacagauucaggauccaaggaucagcaggucgaagacuggggcagcggcaaggcccgcucguucuugcggcccccguucaugugggcguaaggcugucucucgucgaagcuggcgcggaggaccagcaccccagggccggggccguucucggccuuguguccugagugucugucgggcaguggcagggaggacgaggaggccgagggguccagggggacgcucuccauguucucuggcuccagguccagcuccuccggcucgggcagcuuguucuccucgcuguaguagaaggagaccucccggaagccaggcuccaucuccucuuugaugcugcugaugaucuccaggaaggaaggccucaucuugggguuauacugccagcacaugcgcaucaguucaaaccugcagccaagacacacgggaggggguccaaaccgggagggcgcacauggccaggaggcuucaugggccgccugcagugguuucccgcauacaagcguacggcgggagcacugaacacagcccugcugccccucuccaucccuggcuuucugccuggauggccaaguggccuucagagucuccuguuuuaccucguacgguuccauucucuucccccagaacccagaaccaccacgguacaaaacccaaacucuccuuucccaagaaggacuaauccagguccacacuguccaucgugacagcuguuaucuaugguggcagugcuaagaaacaaaaauaaccaguuuucuaucugaggcgucucaugcaggcacugcugaaacauccuuuccagaauuagcaggaaaccccugguuucucaccaggaaggcugaugagugaccgcagcuuccccaacagugcucucucuccgguucccaccugugcuauuucuaagcuuccuccuggugcagggcuaccccuggcagacaaccaaaggaagaaggcacugugaggccaggcuugcaacacgaagaaaugcacacuccgagucugcugucuccaucuagcacgugcucgcuccagcccugcacaagcaagccccagccgaugagccaggcuguucuggaccaaacgagaggccccguguagaccugaagccagauuccaacaagccagcaaggagagcccugggcacgaguccccuccacacgcaagggacaggcagaacaggaugacgcuugugcugugugucggucgcaucggcugggcuccgacagcaccugggcugcaaauaccugugaggcccucagagucacauggagcaaagggaguccugccggcuguggccggggcuccccaagaaaacagccggccacacguggacaaggaaagccggcugcccugacccaggaaaggcccgggcuuugacaagcuuccagaaugcagagacccagcuaaacagacuuuuggggcaaaaagcagcuggcuaccauccagggcuggccauaguucugaggagugaccgccaacagcccucucuuacaugagcgugaaaccaaagugccuuccuuuccacgucuguucucaccaggaaguuauccucuuuauuuuaaaauucuggcuaaagagaugcuuuuccauaaaaguggccacacagaacucuccacaucuaggaaacucaaagcacacccaguggcaucuagccuccugucaggguggcugcuugaccacagacuaccugcccgugucuggccuucagggaacauuccaaggggaggccccugauguaagagaagccacugggccuggaagcuggccugccaagagaagggcuccuauggccaccuggcagcuuccuucagguggagaaggugcaaccuugagggagggugggccugggugugagggagagccauccagaauucacuagaauucagcguucuagagcccgggggccugcgucuccacagggccuaacccggggcugcccgccucuacaucagcugcacuggcauggggccacgcucccucauuuccaugugggcugcagcugcuuuccagcuacaacuaccagcugaggacauuaggacagagacuguggccugcaagucuaaaaauguuuauuuaccacgucgcccuuuaaaagaaggaagggugcagguuccuguucuggggagaaaagaauuagacaaaauaugaaggcccccacaguaugcuucuuagauuuggagaguuccauguggccacuuuuauggaaaaguaucucuguagccagaauuuuaaaagucuaccccacgguagaaugccaugugcacgcuaggugccaggcagcgaggcaguuaugugugugaacugcugaaguccucacgaguuugugaagcaggugcuacugacuauaauauacccccauguuacagaugagggaacagaagcacuaagauacuaaauaauuuguccaagauuacaaaauucaugaggguggagcugggauggaguucucugcgcaacagaaugacuacacuuugaucaccaacgauccuggaaaaaggaauuuuucucaaccuaaauaagaguaacccuggggccaccaggagacccucccucaccuaacuguccaaggaacagucacagaugucacagggaugugguuugcauugauaaaagcuggcagcuugaugacaaauaagccugccuuuccaaacuccccaucacuuccuaagaaaaaugauugggguuaaaaaaauuaaaauaggccauaacgacaugaaaugccugggcugugaauuccucuccagcugacuuaccccugggcagaagcguaacugggccaagagcaugagaugugcuuggcucugugcccuguggccagggaccgaggaggugccacaggagagcagcgaggcagugacaucagcacaaacaagccaugugacgccucuuuuaaaccauuccagaguaacaacccuuccagugcugcccaugaaaggaagucuuuuuugcucugugggauucaagaccuuguuuacuauuuccacacacacaaaaaaucuccauuagacucuagaaggaugugugagcugauaaaacucaucuuuuaaaaagcacaauuuuuuuuuuuuuuuuaaccacaggucaguucuggggaggcuggcgccauccuucucgaaugcucuccccuuugggggacacauacccagcccuucuccuggaacagggacaagacucaaauggaauuccugcccugcugggaagcagcuuccugggggccagcugugaccccccccggaggcugggugacggucagcagggugagcacacagaggugccuccguauucucacuucacucuuggcccugauguccugaacuggacaggcugugaccugugugcgaugucagcaggccacgaggcacccgcacauucccacacgcugccgggaaucagcacggccccagcccggugccgacgcucaccggauucccagaggaccugcggggcugaaugugucucucccuccuggcagcccucaacaguaagggucgucuuaggaaccacgccucagccaggagcggcuguggacauggggccugugugccucagugagcuuacuggggcuaacugagcaggagcgcccuuccugucugucugggucccacucaagcacucgauucccgcagaaccaaaccaggauuccagcgaugggaaaaacuguacuggaaaacuacaaaaaacaucagauuucacuaaguuuguuucagacucaucuaugaguugauaaugcuccaggcuaaaguucagauucccuccugaauccuguagaccaaagacgucucuggcaacagucuggacacguggagcuguggaaguguuagcagcagaacaaauggcuuccuggcccaagucuuccacggcugcguucacaccucugcccuggcccuuaucccgcagcagccgggaccuuuuacgucacuacguuuccugaaagccagggccacuccuggcucaucugugugaccucagggucagcacgcacccagaggagcucaacaguaucuguggcauaaauaccgagaucugggcugaaauaaggcugaggacgggcuuugucaucaaucuaaaguacagacccagcagggaaccacaacccaaaucugauguugugauaccugcuaaguuaauucacacugagucauggcguugagacucagaccucgacaccuuguggcuuggggaccacggaguccuuccucuaaagccagaacacucggugacacugaggggugagaaucuggcuacuuccugauggugagcuccaguccaccugcagccaccgagcuccuucagccccuagugucaccagauggugccuguucagaucucagaaccacacaacucacacacuuucucaccugggacccggcagagguuucaaggcaacucccaagggcucagggacucuccucuccgggauaaacggaggccauucuuucaugucuuguagcaacagaacucccaugcuagaacccuccuuucucagguaagcucaucaguaaacucagaaggacaacaugacacucccuaugaaaccaaguugccuccuuucauucuacucuuuucuuggaagggagaaaaauuuucucaggagaaaacauuuucuuagaagggagaaaaauucucgauggcaaagcagaaaugccuccugaacuaaacauugaaugucagaguaaccgcucugaguaaauuuccuugucacucuaugcugagaacaggaagugcccugcguuucccauggcaggggcugcgucccaggcaguuuacauuaauaguaaaagcccagucaccuggagguggaccaaguaagaaucccacaagucucuuguagauaaacguuuacccgagucaaagagaaagcacagaacaauaccgcucucccucacccacccuaaaccacagaagcagaacucacaccugcuuucaugggcuguuucuaagcuugcuaaaauaccaccaguucuaguauuagccuagauucuagcacuguaccuuuaugcagauucaguggucaucagaccucuuacuccauggcuuauauucagacuugaaagcaugauuuuucucauaauggcuggcaagaaaacaguggcugcgcugcucaaaguguggagcagauggucaccugugaggggcaguguguguguguguguguguguguguguuggugggguacugggggguagccaggcucccggauccccagugguccucuccccuguguccuggagcucacauccccacgugauugacucucacaugguguaaccugaaggagaaggugagagccucagugugacuucugagguuuggucagaaaggacgucgugccuucugcucagguccuggaucuuuuacucuagggcacagcaggcaaacuauguaccuguggguaaaaucuggccugcugccuaguuuuccaaggucuaugagcuaagaaugguuuucauguaaauggcuaaaagaaauucaaaauaagaauauuuugugacaacacagggaugauguggaauucaaauuccaguauuaaaaauaaagcuguauuggaacacagccacgcuagcuuaugugacgcccacagcuguguuugcuccacaguggcagaguccaguagucacagucaaggucguaugggcccacagagccaaaaacauuuuuuuagccggccuuuuagagaaagagugugccgaacucugcacucagagaagccagcuacacauccugagacacuugggcagugcuacggagaggcccacguagaacagggcgauucaugcagggcauacuaccuaugcagcaacaccuuggaagugggucugccucccccaggcaagccuucagaugacugcagccccggcggacagcugggcugcaaccgcgagaagggcuccaagccagagccagccagcuaugccgcuccugcguuccucgccuucagaaaccucugagagauaauacauguuuacuguugcucuuaacuaguagguuuuggguaguuuguuauacugcgauaaaaaacuaacacagaaggggagaagaagaauuucuauacugggcaagaaaagguacuaaguggucuuucgagucucuuccaaguuuggauuguggaguucugaagaggccaugcugggaaguuuccuugaugagggcuccaggaaacccagugccacugcaucuguaggugccacccucagagaagaggagccucccaucacuggcccaggcccagggcaccagccgacuuucugguucuggcccugccuugaugggacaaugggagcccccacaugugcuagcugugcaagggugaugccuucacucuggcuuucccugguauccuuccugcgccaccuuucugaauuccacacgaaguguccacugccugggauacacuucagcugaaccuauguucggaagcagcagcuaaugagcaugccgcccagccaacguacucccagagcacagggguguguauccagucuuccccaccccaugcccuccgcuggccggccauuuacaaggagcuuagggauucaguauuuguagcaacacucaaagugcuuugaaacaaaaauagcaccuugauuguuugauuagggacaaugauuucugagacuauggaauucuaagaugccccccaagaucguugccccugguguaaauaucccauauaauccccucacuugaguacgggugggacuugugaacaugagaggauacuucacuccucuaaucaggcuucucaucaauugacugugaaucacuuaaaagggagagaguauccuggguagaucugacuuuaucagguaaaaaaccaguagaagcaguagagagcuguccucuuaucagucuugaagaaauaggcugcuguuaugagagggccuauggaggcuguauauggcaaggacugugaguggccuuggccuccaagaguugaaagcaguccccagcugacaggugccaagaauauggggaccucaguccugcaagugcagaacccugaaggagccugaagaugucccugagccucaggugagacugcagccccacugacaucuugauuucugccuccugugacucugagcugagagcaagaacaccugcaucuggauuccuggcccacagacacuguaggagaccaaaugagcaaaacuuuuguggcugcuggagcccucauucccuccuguccaccugacacaugucugguucauaucuaucuauuaucccgccacugugggcccagccugagucugugcuggcuccagggggguggaugggugagagauaggagcugggugccuucaugcagacauaacagcccagcaauuccucaggauccuuuccaaaaugaagccaaaccuguccugaaaagcauuucuggaaaucuccugaauuggucuugagauacuagugggagcccaccuuccuguucagcuauggagauccagaucaaucucugaagccugccuuaaagugcaugucaaaagcaaggccacugcucccaaccuguaccuguugugcgccugaugacugaacuggaacaccuucacccccuccucaaacucauuccaggaaggacaacaaggccucccugcuccagcagcucugaccuccacugagccacaaaacagcaccguccacggacacagagcaaguccuccaccaaaaggggggcuucuccagggggcgcugagcagagaggccucaccaacacugugaggcaucacaaacucucucucgucaucugacaaaacuuaggacuaaaagcugcaaaguguuuuuucaaaauaagugggguugccaggugcgauggcucaugccuguaaucccagcacuuugggaggcugaggcggggagaucaucugaggucaggaguucaagaccagccuggccaauaugguaaaaccccaucucuacuaaaaauuagcugggagugguggugggugccuguaauccuagcuauuuuggagggugaggcaggagaauugcuugaacccgggaggcagagguugcagugagccaagaucacgccaaugcacuccagccugggcgacagagcgagacuccaucucaaaaaaaaaaaaaaaaagugcagugagaagacaaauucaccagcacuggcauccuucuguccgcagggaugucagcucacacacgcuccagguccacauuggucagcggaugaagcuccggagagcauguuacuuagaugguuuaugacuuuuguaaacacuuaacagagaagacauguggggcaggguucagaagacaccaagcugacccuacguggugcaugccggaguccuggccaugcagcugugugcacacucacugcggcggcucccucaggccugccacagguggggcgcggggcucuugaauucgacuucagaguaguauguguuguguuguagccuucuuuaaaaagaaacaaaaaccucacauggagaggaugaguaaggauggauuacucuggccaaacauuucacagagacauuuggccugagaaacuacagugugaacugcaaaucggaacgaaagcauuacggaauaugggguagaauuaagguacccacggaaaagcacaggucgaccaacccacucagcuccuuccacaaggacaaaccucuuagccacgccuggcaagggaggcgcaggaccagagagaauggcuuuaaucuccuaaucuccugugacccaagaaaacagguauuugagaagagaacucagaagagcacggagggcccaggaaguacguacagcaugucaggacaguugucuggcuuguccagaaggccgcccuccaugacgaagcgaaggacuugcucguuggacaagcccugguagggcugcucggccaguguggcgaucucccagaggacgaccccgaaggaccuacagggagaaaaaaacugugaggagcuuggaaagggauggacugaacaaugcugcccccuccuuuccagcacuucuuacaucccgagcagauaaacuguccuuacuauggugacagugcuugucagacagcgagccaggcccugggcuaagugcgggauaucauccucccucuguugcugcuaauguuccccguaaacuaaauucagccccggugguggagcuaaggaagguggugagggcgcuuccggcaucccuugcacggucaggaagccccugaucugugcuuugaacgcagagcauacuggguucagcaucuaccuagucccggccauuuaucuggcaaggcgguaucaccuaaccuggcuuugacccaaaaagaaugacauucuuguccaagccccagccuggacauugacuuaguagccucaaaugaggccugggacagucaagcuuuaccaagcuccucaggugauuuuuacaaucagacaauuuuggaaaccucuacccaggugguucucacugccggcugcacaggagaaucuccuggggagguuuuuaaacagagggcugggcacccaauagaaacucugauuugauuggucuggggugagggccugggaccuggaauguuuagaagaucuauagggaucuugagguccaguugggccaagggagaagagaacuccugcugcucccccacccacaacagagcuggggagcugcuggccugcagggccucugugucacagguggggggaccagggugggcugcacuggcugggaggggguaucauggacaaagaauccuuaagcagagaaguuggcugaggaauaacuuuguagugagcaauucugccauaugcaugcagcuuugccaguuuagaagaucaaaccacuggaaaacaaaacagagaguacacacacaacuuucagacagaauguuaaaaaagacaaugcuggaaucugcaaaacaaaugugcccucccagggcaaauuccguaauucacaaauucucccugaccugugugccuuuccaugugguucacuuugguggaguaaaauaggcuacucaucaccaaguaggggcgggagcaggguggggagcagggauucuagcuggaccuguccugggcugcaggugcuggucaagccacauggaaaaaccuggggcaggagauuuccaaccaagagcucuugggaccuugaccuugugcccaagcccacagugcuccugacuguaugagaacguuuuauucgcugcuucagcuacuuucggugaaucaaagauuuuuguacaaauugauacuaaaaguagauguuagacagaaauagaaucuuagcaaucagaggacagaccaacccaagguccuuuuuaauuacaagugaccaagaaaugcugucgucuucauguuguacaagacacccagaggccaaaagugcaguuuagagaggccugggcccaggggagaaggggcucuccaucagcuuugugcgggaagcucugccuuccacaaccagcccagccauacaggcagcaugccucagaugccaguggcaguaguacccacacaucugaaaugcagcuugguacaagaaaugacuagcucuccaacaacaaaaaauuaaaaauaaaauaagaagaaaugacuagcucucugcuuuugcugacugcaggcuggucugggaaauggccugaggauguggcucccucccagacccacuucuccucuugccccacgugcccuuccuggcugugucagcggcuugcaggcagccaguucucacggcacggcucccacccuggcccucccggcccaacugcuccauuccaaguucccaguuacugggcuacccacaaacucacugcgucucacacugaacuccgauuugugcccuguucuucccccggcuucccugcagcugaugcccauuccacccgagcagucugccugcugucacccaugcccuuggccuccucggagucccacugcgaacuguccacccaggcucacaucuguccaaggucuggcacccuccuuccgucccucagagcucccugagugugcaggauccugcuugccuggcccaccaccaccucuccuuugguuacaacaucuugcucaaugcagcuguauacuccggcuaacaagaacuucaagcacagcucuaaucacccucugguucagaaaccuuaacagggcuuaaagaauuaguccaggaugccuaauacaacagcugaggccugucuugaucucucugcagccuaagucccacgaggaaaccucaccaaccccaccugcagcaggugcucccuacugccaugccugcccagcauucccacugccaggaaccccccaccccugccccgccccgccccgcuuccuagugcucuuuuugugacaauccauacuuagggugccuacacaacuucaucucuucugugaagaagaugaugcaaccccaaacugucagaauugccuccucuucuccacaagacuuuauccuuccaggaccaggacgacgacgacgcugucaucgucgucaucgucaucaucgucaucaucaucauccccgcaucuuccacacccccaagagccuuaccaucacccacaggcaacgauacaggagguagcagaccuagcucuccacaaacgcuugucgaggugaacugcaaagccuaucuccugagcaacucuugucugaggucaacaucaccugccacugaggaccacugagugcuagagucagucguccuucacagcuuaaugugacaacugcaagguguggacacugaaccaucucuacacaauaccaguugccacaggagccauuucaacaucuauucagguaccgcagacuucucgagacagaccuugccuuacagauggagcaaccgaaggccagagaagcucugagguuuaaccaaggccacacagccagucagaagcaccgagaaauaugcaacaccucuguguuuuucaaagccgguauuuuacuaugugguguuggcucuucaugacuucauauaaaaucaagucuuccauuucauggacagauuuaaucuucaaacaguagauacaugucucuguguaaagcccuuucuaauuaggaaccuugacguuguuuccccagggggaagaccggcggcugugagucccccugcaaugcccgugcuggcuggaggcagcauucaguaacuauacuuccccacaccaggaggggaugguagcaauggcccacucaccagcaaauuaaaaccuacagagaaauccacauuccccacagaugguaauuagucaugaaagaagcaaauaaccuuggcuauuugugacuauuuggaaagcuucuuaauaaaaaauaaagauuauguguugggugauccagaugcucgggaagaagcacagcucuaggcuguggggugcagcuccccaguccuucgucugguuuccuccaugccuagagggcacccuugucauuucagagggacauggugcuacagggagcugcagggagagcagccacagugcccaagggccugggaaugaaguccuggaagacagcaggaaacuuggagguguucuggcuagaacagacacaccucuucgaugacuccuagaccuaucuuaucaagaacagagcaagguaugcaauugugcuacagagagaagguccaaugggugucacacagaggcugacguagcagaacacgaaagauuugcuaagagcaaggaugucuaaagcaugaggcuggccugccuuugugaggcagugaacauggagucccuggaaggaaaccucuuagcagaagcucaaccagcagcugucaaagaucugcaggugcacuggggacugggccugacugcagggauacaucccaaauccuaaaauucuggggucucuucuacaaagcccaauacaauucuuaguguuucuuucuagauuuuuaacuauuuaggaaucauugcuucgugcugcugaauacaaucugaaaucauuuccauucuuuugagagggacagcuuuaguuuagagccuggaccgcugagaaaccugcuccaacgcccuagccuuccugaccugugcuauccucaaagccuguguuaaaaagcaaacaaaaccugaagcgcugucaaugccugagcauuucauggaaugaauaccaaacgccuauucauguuuauacauaucuuuuuguauugguucacaguaguuauguagccaaauggacagaauuggcaaugaacacacucuaggucccuuuguuguugcuugugcaguaacugcucgucagaauuuggguaaaauuugcccgagagauaugaacaacacuuuauccuucuauucugcuucuguucuccccggcuguauaguuuucuauuuuauuauacuacaagcugaccuccaagcuccuggaggcacgaagccuagaauaaacagaugcaugcacauacccaggcuugcucucuccucaccaucccaaucucuaaacaccaugcagagcacuuugauuugacagugaagagauaaccaucuuggacaagcugauugcaaaacagaucucauacuugagcuuaagaagcaaucaugcuuugccgggucauauucaaaugcuauuuccaauuugcaccugucuucaaaauaagauccaaggccccugaacugugaaagguuuacgagguuaaaaaaaaaaugaugucagucacuauugaaauaguuccucuaugcggucauccagacuguuggaguaaacaacuaccauuucuguaacacaacagcaacgggauccccccagaggaaagccaagacacuagcugauauucuagaaggugccugugccagggccucagccugccaauaaccucaguuguauuucagaaccugacugccucucugcaauguugccaaggaacugcaauaaacaauacuacugagaggccucugaucccucggucgaugggcuuccacugguagacacuguuuaugauuaagggagacguuuugcuucccauaaccaucccuggguccacaacgguggaugcccacugaaagacagacagcagaugggaccagcaggaaaacacaaucaggacucauaagcuuugggucuaaauaaagcacugucugcaaucugaggguuagauuaggugaggcagacacacagacaguaucuguuuauugagaaagaggaaaagagaaagaaggcaggcaggggagaaacaaaaagaggugacggcuucuggcacaucccaccuccuggaaacauaaucgguaucugcugaaggcggaaagaauguuggucccauaaauucuuuaaaaucccacgaaugcccuucugcccuuagcuagcccacugacaacaggaacaccucaaugaugaagaaguguggcucacacaacacugagcuaaagcuggcaacggguaacaaugaacagagaaagauaaagcccuagagacugagcugguggaaagugcagaggcugggggcuccaggcuggcaaugcaguaaagguucucauaccagacguccgaguaaguggugaagacuccauccuugagggacucaggagacauccagcgcacgggcagcagcccuuucccuccuuuccgguaauagucugucucauagauaucucgcgucauaccaaaaucuguaagggaagagagggcgcagagucacacgcuggagcaggcaccacugcugucacagcagaggacccuacacucauuauguguggagagacgcaaggcaagacacagacacgucccacuuuaagguggccaaauauuaggguuugcaauuuuauaagguggagacaguaagggaugauuaaucacaugaugagcaaauaccaagcaaucuccacuuuuaauauauuuacaauuugauucccuuaggaaguuaaugcccuuauugcauuuaaaugagaggcaggcugagcgcagugacucaacgccuguaaucccagcacuuugggaggccacgacaggaagaucgccugugcccaggaauucaagaucagccugggcaacacagcaagacccugucuguauaaaaaauuuuaaaaauuagucaguugugagugguggugugcgccuguguuccuagguacuugggaggcuaagguggaagaaucacuugagcccuggagguugaggcugcagugagccaugaucacaacacugcacuccagcuugggugacagagugagaaccugucuugaaaauaaaaauaagaaaaaaggaagcgguguaaaaauuagagucccacaauuuaagaaaauauauaguacugcagagaccacuggucauuuacacaugguuuuaaaaccugaccaaauaaacaggagaguacagaugcuuacuuaacuugguagcacugccccaccacuggagaaaaguaaauaauuucacugcuuaauaagggggaaaauauucaggguaacaauucaugaugacaaaaguacccaguaagaugccgaaaagaugcuauuuacgaggccccugaagcuauuacucaauacuguuuuucaacauaauccucccacucauuuuugaaaauuucuuccauuuuccaugucuccagaagaugccacauaauuauguuugauggcaggcucgcuuuauaauccuaaauuauugcugcuuugucagauuuugauuuugcacucaaucauacaaccuuuucuuaaguggacucuuccguucuccuucccaggagaaagggcugcuccacuuuaaaaugcucauguaugucucuaacucaugccccaaagagguaaggcuacaaaagcaaacacaaagagaacaaaguuccuuggacuugaaccaacauaauuuacuugugcuaugcuaagagcccucaaacugccucugguaaaauuacuugucauauuugucauccaugagacgcugggcauugggaaaacaucuugagcccuugagaagaauaaaaaugaagugugaaaguguuaucugugaauuaauacagugacaugcaaauaggggauuugccuuuacuugcacaagguggaaaagaaggaauccuauuaaaaaacacaaacgaccuuccucagcacaaaugaaaaacuugaaauuccagaaagaaaaaccaugauuacaaaaaaaaucacuauaaauaugccacaugguugaacagcaaacaugaucccugcugauuuggauuuaaaauggcaauuggcacaaaaaacaccucucccagggugacgcgcaguggggagaaacugaguuccccccaugugcccggagggugggaauaagacacagacaggaacugccaucuggagaggcccugcccugugccaggcacgugcugcugcuuuccugcaccaaguccuucucauaaccccauggggucuguuacauuaucacccuauuuccgaggugaggaaacugaggcucccggauguaaggcaccuggcccaagucucucacccauuagcggcagaacuggcccaccucaggcccaccuggcuccccccugcacugggaaaggggagcuggcuggcauuuccacggggacaaugugaguucuacagagagggaaggagaaaugagcugggugcaccaaggaagcccagccagggacgcgggcggcucuuuccugagagcccugaggcaggacggccucuugggacuucuuugccucucugagggcugcccagcuucacagagcaccaaacgugaggacgucucaacgugccaaaccuagggacacacugguggauccugaaugaggaacucugaugacggagggaugugggcucugggauaugguuccauuucaauaccucuagcuccuacagaguaaaaagaaagacacucaccccuacuuuagaaaccauucucagcugggugugguggcucacgccuguaaucucagcacuuugggaggccgaggugcguggaucaccugaggucaggaguucaagaccauccuggcuaacaugaugaaaaccuguuucuacuaaaaauauaaaaaaucagcugggugugguggcacgcgccuguaaucccaacuagucaggaggcugaggcaggagaaucacuugaaccugggagguggagguuguggugagccaagauugugccacugcacuccagcuuggaaaacaagagcaaaacucugucucaaaaaaagaaaccguucucuaaaagauucucauuguucaccaaaggggcuaaaacauuucauuaaaacaucacuacuaaaggaaaaaaauauguuacuaaaggaaggugaacacuuccagaaaaggcaguucaagaacuagacacagagguccauuugaaauagcuucuuuuggguguuaaaucuccccugcaguuucucaggauaaauauuugguauuuuucuaaacuaucauuguaucauagugggaagaugagaauccugguaaaagcaggugguuuccugagcagcccugauguuauguguguuuuuauuaggcagauuaaaagaccgaaguaaaaacacaaaccuaaaggcugaaguggguuuuaaccauugcucagaaauucaauccaacccuuuuuucuggugugacagugggugguggcaacaagggagucuaaccaguaggcuggugagcuaagagcaggacaguaaguguugugagagaguggucgagagcuuggaggcuggccagccccagccgugaaacccagugagcagugaucgucccucaccuaagggacugccaugccagcuccugccacugcuccugcuccgugcagaggcuucgucauuagggcagcuugccucuuagaaaccaaugugggucccuggaaggggagcaaugcuccuuaaaagcuaggaaaauuggagggaugaaugcaagguuggacagugaguuuuauucccaagucaaaaucuccugaagacauugucuuaauuauuucuguaaccaaugcuaagagguguucuaccaagaaaugccucaaacgucuggagagccagccucagggaccgugcccaguaucugaaccaccauguccaugagcuaucagcauugggaccgaccgugccagguuugugaccaucaacuggagacaaucacaucauucccaagaaggaguccgugcacucaagggacacacuagaaaaccucuccaggggcagacuaaugccaacaaaguccucaaaacaccugaguuuaguucuugcccagaccuggaaagcuaaggacacaccuccgauuuugacugugaaaucuucggcuaccaugcaauuccgggcagcaaggucucuguggacgaacuuauuggcguugagguaugccaugccgucugcaaucucuccggccaucugaaucaucuugcucaggcuuggaggugcuaggacuggauuauucuguuggagauuuaaaaaaauucacaugagaauuuuggauuuuuuuuuuccaugccaauuucuuucgagguuugcauaucaucuuuguucaaucugggcaccguggguuguuuaugcuaagaaaccaggacuugcucggaaggaacaaaccaucauggagagcauggcaccugcuugcuccccgcaagcuuauuugcacuugcucccugaccacaucagagcuggugagggaaacaccaauuugcacucuuuaggaccaacauuuucuauuuuggguagggcaacauuuuuuuaaagugaaacaagccauuuuugguaguaaggauucucaguuacucaaauuccuauuuguuuauauguuccuuuuauuuccaucaccgaaguacagguaagaggaaggagagcacguuacaaaggcuguguggaaguaagcaaauguguuuccaaauggacaugguauauuuuauuucccauaagagcaucguuauaaauuauuuaauccuuuucuuucccuucaaccuucuucuaaaauacaaaaauaccaggauuacuguuuucaccuuacaauguggcauuauuauuuucugucggcauuacggaagacaaguccuuggcaacugaaguccagcugaaacuagucuuggaggaaaccaggaauaaguaacagggauaagcauuccucuuugcagaggacagcaacgugcuggcuuuggaauuaaaaagaauuacccuuaaauaauacauccauuuagaaaaaaguuuuauauaaaacacaugcccaagucucuccauccuaaaacaaucacuagucccuaauuuuaauguuaccuuuuacuuuugcauauacaagugcaacagacucuacaccuugguuuucuugaccacaaagcaucucacacagcacugcaaagccauagggcucugacaggucccacacuugcaggccggccaccagcugagcaugcccaggcuuuuccacaugggguaucacagugguuucacugacgagaagaugaccuggggccacgcacagaaagugcccaguggugcguggcacauagucaaugcccaguggaugcuggcugcugcccugugaggugcuaguuucuacugaaagcuaguauuuggaaucauuauaacaacuccucgguacuucuggguugguucucuacacuuggugacacaaaccuuugaauucugaacaggcugucaaagcugucucuuggugacuuaaaacacuuaucacgugguuaucuggggaagcaacauuaagucacuggggguaaguccaaaucacuacuuuucagggcuuuagauacgugugaugcaugaggaaauaugcacaugaaauguaaaguuuaugcucacaauucuuaaauauuacaguaugaccuauauguguuaugaaguggucauuuauaauugccgugagcaacagaaucaacaaaagcacucaacuuuaagcauggagaaagacagagggcugaaauuuugucaguucaugguguuacacugccauucuuuccuuuaauuugguuagagcuauuuaagacaaguauacauauacaccuacucguagugagauacguaagugaaacuuggucgggggagcagguugaauauaaugaaacugcaggguaagugcacacauuuuaauacuugacaugagcuagaaagaaaaaguuuaaaucugaccaaucuaaaggugaauuuuaguucugaaagggacuucaguaaucuugucccacccucuuauuuuauauugaggacacugaggcccaggaaccugcagcggcugucugaggaccacaggcagccagccgcagagccaggaccaaggccauguguucugaauuuuuauucugugccugaaacuggggaggaagggagugaguuuuggacuuuucagaggugccucaaucgaugcuggcaagaaauacucugccagaucuccagucaccuauuucaucaagcuuuucuccuucaugcuguuuuguguauuaaagugaaccaagggccaggcgcagcggcucacaccuguaaucccagcacuuugggaggcugagguggguggaucaccugaggucaggaguucaagaccagccuggccaacauggugaaaccccgucucuacuaaaaauacaaaaauuaggugggcguggugguacacaccuguaaucccagcuacuugggagacugaggcaggagaaucgcuugaacccaggugguggagguugcagugagcugagaucaugccacugcaccccagccugggcaacagagcaaaacuccaucucgaaagaaagagagugacagagacacagagagggccagagaaagugagugagugaaccaggaagaggcacuaacacccaggggugcuggggaccaaugcuuggcagaacagagggugggaguuuuguaaaccauccugcuugaagccccaguccacacuuggccccaaacaccaugugcugcaaauacaugaagucauaugugaacagguguuuggaacuaaaauuaagaaacugucacuugggagaugauuaaguugccgauucaaagaacauuaaaaaaaaaaaaaaauuaagcccaaaugaagaacagcaaaagaauuuccaaaggggccgagaaggggaagucacugcuucuaaggaauaaaagcagacacacugcuuacccaguaagcagcaaaguaagggucaaagacuucagacccacggaggcaaccaaaugaaaacucaguucuugcuggcuuuaugucucagcauuuaucucccaguuuauuuguagaauuaauuacucaaaagucaugcccgcauauguuaaaaagcuggccuguggguuaauacuacagaggggggagacaccacggugacuuuuaaugaaaaauugcauaggacuuuagcagguuuagaauuggaagcucauaacccaaagugaaauuuuuaggaaacuaagcagaaauccugcagcugaggugggaucauucauucaaaagcguaagcaggacacugacucuggaucaauccugaaacguggacguagagucugaggaaaccagauucccaguggcaaagacaaggaccgccaacaaugccggggaaggggacuguguguggggaggggguuuaugaaugagugcacaucuugcgcacggagcugggugggaaaucacccagcaacuucccagaugcaagggcaagaauccaggcagcuuaaccuugaacuguaacauacauuuauugacagagugccugccacaaaugcggcccugagccacacacuuggacugagaugaaaagcuaaacacaacgggguggaggggggacacacuccaacaacagcacaacacaacauaacgagagagaacacauacgaggaugugagucaagcgcaucgagaaguuagcagagaagauagcuacuggaguggggcaggaaagcuucggggagggaguggcgcuggccuggcuuggcagguggacacugauguggggaggggacuggggguggagggaaugcaggaacaaaggcacagaggggcuuagcagaggggauccaaggaacaggaaguuccccucacgaagaucagagucugacucuaguuggggaaauccuuugcauaaaugaccuacaacugagcaugcaguaagaaacacuggaugcuggaaaguaaacugauuuaaagacacagcauuuccuugcagggagauuauaaaggaaaagagagcaggccaggcaacaugcaauaccgguggaaaugaaaacugaccuccauuucuggccucagagaccggagauaacuuuugagaucgccccgugucaucaguuccaugaugaccaguguuggcuggccuugggacaccacacccagcaaucgcaccugggaggaaucaaaaagagaaagacucagagggucagguggcccuugcugaugccuguguugucuggaacugucucuguggugcugcggccuggucugagcacaggggucugaagguagcagugagguaaugggguaacuauccagaaggcaaaggcaagacaccaaacccacggguacaugcagccaagaacauacugggaggcuugugugauacccucucccugugcugcauuuuggcuuuucaggaacuuucucuuaccacauggugacaauugaacuccuucaucacagaagcuucguugagaaacucaauccucucacgcaugcuugcggccucguucacuguuuuaauggccacucugguuucagguucaucuuucaccacacccuuggcaacuccuucauagaccaucccaaacgaccccugcccaaguucccggcucauggugaucuucucccgagccaccucccacucaucaggaacguacacuggagaagaaaccguaauuaaagcagguacagaaacaagcccuuagacagaacgugcuuugggggaacucuaagccaaagaauauaagaugcugcuuccuuaaacccacagagaauaccaggaggcgauggcauggcuugaugucaacuuuccacaugcuauagauuugaguaagaaaacuguacagucaguacuaguauuucagaucucugaggauuucaagauaauuugaggauacuaacagauagaaggaccagaacaaagcaaggaagucuaguauaggaaagaaagcaguugguuuuuaaaaauuucuuuucaucacauaaaaacacauuuuugaaaaaaacaaauuaaccacaggggauugagaaacugaaugaaauggucaagcaggauuuuacccaucuucaccaacagauuaaaacgcaaauguaaaaaggaggagaguaguagggagagggaagaguucuuaugcugggucgggaaaaaggccagagucacauaugagaggugaugauggugcacguaagguccuacuucuuggaugaauccaaaagaggugucagggcccucaacacagaugcuaugccugggcuaucuaacauggcagcuggucccuacaugggacuccugagcauuccauguggccaguccaauuugagacaugcacaugggauuucaaagauuagacaaaaaaaaaaaaaaaagugaaauauuuagguaacuuuaauacugacuccauguuaaaauggauauuuuggauauacuggguuacacgaaacguauuauuggaacuaaaaaacuauuaaaaugcauuugaucuguuucuuuuuacuuuuaaaaaauacggcuacuagaaaauuugcgguuacaaagcugaacugcauuauugguaggauuacucuaguccaagugucccccagccuuggcuuugauggcuggaucccugaugaggugcagaagcaacugagcucugagacugagggagagacccgguggugcccagcguggacaggcaauuaggcagcggacgggcagaggcguuuccagggcucuggccugggcucugugaacucagggaccuugaccaauggguagagauuugggaggaaugcacaguagauaccaagccugaauaggauuucuucuccaguuucuguuucuguuuagauucgaucugguuuaagaaaauaaaugggccgugugcgguggcucaugccuguaaucguaggccaaguugggaggaucgcuugagcccaggaauuugagaccagccugggcaacauggcaaaacacugucucuauuaaaaaauuagccaggugugauggcacacaccuggaaucccagcuacucagggggcugaggcaggagaaucgccugagcccaggagguugaggcuacugggagcugagacugcaccacugcacuccagccugggcaacagagugagaaccugucucaaaaaaaugaaugaaugaauaaauaaauauuucuaugcaggaaggaaggcaaaacaaagagaaagaaaggaaaaagguuggaaagaaagaaaacaaaaccaaacacaggcucaauucuacaccuccaaauggguaggguaaaaacgaaaauaaaaucaaccuguuccauaagauccauaugaaaugucaguaauuccucugacgcugugugcuaauguccuugccugacgggaccugccaccaggcucuaccacacacugacugugggaaggaggugguccuggcucagaaaggagguggagaaggugccuguuuuugcuuucaugcuuucagaugcugacccugggccuguggcuggaugugagaggcugacaacuguauccuaacaucuccauaucccaacuaucaaccuuuaagugaugucucaaaggagagauguuuauuauaaauuaggcccaggaggggcaccaucauuuuagaccucugagggguguccaauaugaacuucauuaauaaucuuguuuucuuuccuacacauuuuuguauuucauaguacguauguuucaaggguuucacgaauggaacucugcccuccagcuggcauagguggcuugcaccccugaagaagaggcgggugcuugucagaggagaguaaguaugcaagacaacccaggagauaaggcucuucacaaugcgccucagaaaguguaaagaguucacugucuccagccauuuaucucugagaauccaggcuugcuuuuaaucagaauuaacuguuuagccugccauaaaacauggaguugaaaccaaucacauucauucccugggaggucccugaagucaauacgcucaauccuuuucucucgauucaacccaacggcuccgacuuuaagcaggcguccccagugccaccagccaggagcgguuucugugcacaauguuaucagcacuuuccuguaggggauuuucaauguacucuggagaauggugacaugcagauuauagcuuugggaaaaagaaguuuuuaaagcacuuuugaacugcaaugucauuuuguugccccucgaggaaacuggcuauaagugcuucucaaaggccgaauaaauuaaguucaaauaaggugacacuguucccaccugucgaccuggguggcaauaaguuuguuuuuguuguaaugaaguaccaagacguaucaugaaagcauucuagaaggacacaaaaugugaauucaagucaccaugagagcccugagaaucugaauuuguuguauugaugcuuucucuuccuggacacuucacagucaaaagcuacacacaccaaccucuagugccgcauuucaaagcagaauagcuucucucguagagucacaguccacccucacagagggagaaaguggucuugccuuguucuaucaauuccaucaucugggaugacucccuuccuuacugauuuucuuuuuagaagcuauuauucauacaaacaaugcauaucuaucuucuugcuggauuuuaagagccagucucgcucuauaggcuguagugcaguggugggauucuagcucacugcagcucuugggcucagguaauccuuucaccucagucucccgaguagcugggacuacaggugccuucgaccacaucuggcuuuuuuuuuuuuuuuuuuuuuaaagggaaagauccucuccacaaguaacaacucuuguaaguguggugugcauccguccagaauguucucucugccuuauauacacacacuacagaaguauguauauauauauuacuauuaaaaaaccaacuuugugagaccuuuauguagauagaaauaaagucauuauucugcaccugauucccauucagaggaggcugcuuuugauugacuuuacuauaaacugaauuagaaauuauuaaagaaaccauaguaaaacccuacauaguauaacgguguuuucacauuauuaaaguauuuucuuauguuuucuuauuugaucacaauaauuagaauaaucaugucucuuuauuucacaucuccugcaucuacuuucacuucucccgaggcaagaagacagcaaacacuuuuucuaaauguacucacucaacaucaugcacuuauuuauuauucauuugaugaauccgguccagccccuccugagggcuguuuccuugccugcccgggggaccucacagcccuuuccacagugauuccauucuccuccugacuucucaacugucuaaccaugugagccugcacaaguuuuuucccagaguucauuuccucaccugcagaugggcauuaagaaaacgcacauugcagggguuuaagaaacaaaugggaugguguuuguaaaagccccuagcaaagugccaguuaaggguccuaguaucacuggacucagugaccaaccccucacccuaauccgacucacucaaaaggucuggauauaaaaaugcuagaaagagcaaaaaaggaaauaaccauugaggaucacccaacuuccaugucagaccuucccagccacuuaacugaauggcccucauuaguuauuaccaaggggaaugugaaugagccacgagcguaugacccuagucggaagggaaugacagaaaaauuccaugauaaaaaaaaaagcagagcuguaauucaucaaagacaauuauaaugagaugauacucaagcugaaacuaguuuaaaaggacuguuuugucagcugcagcauauccucugacuagauguuaacaauuaaaaagcuguuuucauucuagcauaacaucucaagcaauuaaauaaauugauuacugcgcuggccacauucaucucuaaagccuguguuuccuuggggcaccccauacagucccacaaguuuugacauauucacugaacugcuaaaaacuuugauuaaaaaaaaaaagaaagaaagaaauauuaaugaagacagauccaaggccaaagguagcucaaaauaaugcaaaccuccuuccuuucccaaauuagcaacccuccugaaagcucccgaucuaccugcccugcacgcuggcagugcugguggcccggacucuuaccaucagcagcgcugaaguacuccggguucacagaggcauacagcacuccauuccccagccugcuguuauuucugucaaaaagauuaaauucacguuaacaaaaccccaccuccauacauuccuguauauacuuucaucuucgcuacaacaguuucauuuauccucucucacacgguaucagaacagaauggggagagcuuacugucuacagcagcucuugucuacacucccaauucaggccugggugagccagcagacauuugcuaacacaucuucuggcuuccucaguagccugagauuagcgcuuuuuaagaaacaucuguuucuuuacuucauuggaaauaaaaaggcuuauuugauugggaaggcuagcgcaucgcguuuggaaaaguaugcaccagcagcaguaucuguauaccagaaaagccagccaggggaaggucuguaccaucgaaaaauuauuuuggcuguuguuaaaaucauuagaaaagguucucuuuuccuggaagaacauuugaugggaaaaucagguuuuccaguccauaaaauauuuccuugaaaucuucaaaaauaucaccuucacucacauucaaaucaucaaaccacucagccacagaaagugucauaacuuugcacaucacugaccucuuucuauggaagacguacagcauaaucaccaacccucccacgaucaacaggacagcgacgggcagagcgaugaucagauggaugaaguuuucauauccugcugcagcaaagaggaggaaaugauaaaauaucaccaggugaacaauuugcucauuucauuucuucacauucaguuggaaguaugaaaaaaauaccuguauauucguuuacuccccaucauacaguaagaauuccugaagguaaauggugucagaaauagaacacggcaaacaaacaauuauuugaaaaaagaguaaauaugugcagacugaggcauauacucauuuuuuaaaguacaguauauucuggugcaauaguuucaaugauagacugaagaaaaauaaucuuuguacgcaguuuaaugacuguuagugaaaaugcauacauuugacacuaauuucccacauuccacagaauguuccaggguuugguccauguccccgguacccagccuagcaucugccauacaaguguugguucuguugguaagcggucuuugugaucucacaccuguaaaaggacucaaaugcuugcagcagcaagcauucuauuucuaauaaauagaaugaaaauuucuauucauuuucauaaaaugaauagaaauucuuacaucuauguacagucuacaucuauguauaggucaaguccugcuggccucaaucuuugagauaguuccacagacaauuuaaaauaaacacacacacacaugcacacacuggacggcaccccuuuccaaugccgcugcagacauuugaguccugcuacaagucuaagaccacagaagccacugaucaucagaaccagcacuuguauggcagaugcuaggcugggcaccaggcacauggacccauacccuggaacauucugugggacaugggaaauuagugucaacagguagcaugacaacuagaaaaguggacuucacauauggcaacaauucagagaggaagggagaggagagaagggagucgagggaaccuccccaagggaaaacuuguuuaugauaugcuuuccuuggggguuguggggaaauggcuuuccuagaaaaugaugauacuggagagaagucagggccagcucacaagggacccagcccaagcuaagcaguuucacccucauucugcagauuaaaaggagucagcgaaagcuuucaggcccagcagugaacugaucagauucgcguuccagggaaauggcugugcugaggacagacggagggaccuggcaguaagagaaggcacugucaugucuuggagaauuggggggacaugccaugucuccagggcaugcucugcauuacccaguucagaccuacaaagaagucacugauccuugucuuuacaccaggcagacucacagagaugaucuggcuugguaagucauggccccaggaugaggcucauacaguaugacagcucauaccauccccccaaggcgagugaccuggagucugagcuguggcggugcugguggugacagagggcuggauuccagagacauuuaagaggcagaauccaugaggcuuggguuggaaugaaaaagggguggcugaacagaaagaagagugaaggaugcugugagguuccuggcuuggguaacaaauggauuacaagaccacugacugagcuaaggagcaaaggagagaagaggccuuucgagggcaacaacugugauuuugguuuuggcacaaggaaucugagaccucucugggacguccaaauacagaugucuauguggaaaugggccuggaaucacuggggaucaaguaaacauuaaucguaaguccccuaucaaugauuauuuugccauggaaaacugugaucaugguuacucuuuaaagacuacuacagcuauuuuaauuuuuaaaauuagaaguauuuuaaucgaagaaagaaauauuuuuauugauauuguagcucucaaaauggaugcaggcuccagcauuuugcaauuccuaaaaacacucagaggugaucauuaccaacggaaagcuggcagauuuuucuuucuucccccaaggcccuuauaucacuguuuauaucacuuauacuacuggucaggcuguacuguguucuuuuugaguuucacauuucaacagggacauggagaaaauggaacacauccagagaauaacaaaaaugauuaaauggcuaggaaacugguguaugauauugggcuacaagaaaaggccaaaagaccugagauuauuucaucuggaaaagagaagucugaggaguaauuuaauaguauucaggcacacaaggaguuccuaaaaggaaggcaguugccugaaagcuuccaaaccuuccaucuccucugaggauuaaauaagaggaaaugagacuaaacuguagcaggacagagucuugucugacauaaggaaaaauuucucaacaguaaggccagcacgcagauccaauuucccugcaguacgugauaacaucugcuggaaaaauucuaucagaaggacucccgauuucccacuggcauccuggcacuuacaagguuaaaaauggagcagcaaagccagacaggaacaugucaugucaccaaaacaagcugaguucacucaaccccagaagccaagguugcuguuucacagaucacagacccccaaacuaggaucuguuucuaggagauggaggggaggaaaaagaggagggaaggaggcuggggaaagauagaaagcaagcaagccacuacccuggacaaggcugcaggaauauuaugaagcuucugggugcugcaaagguggcauagacuaacuggugagacuagguuaacuggacuagauggaacaauucagacuauuuuaauugacaaaauuaucugccuaaacauccauuuaccccuaaaaaccugaacccaggaacagugccaggcacauaaaauguuggcucaagauuugcaguucuauucaccccauccugcuuuugcugucuguauuaggauuuucagauaucacaaacagauuagaauaucuggugcugaccaggugacuacuggagaucuuuuuuaaaauuaauuaauuuuaauauacaaauaaaaauuguauauuuaucauguacaacauauuguuuugaaauaugcauacauuguagaacagcugaaugagccuaauuaacauauguauuacaucacauuuuuuuguguguggugagaacacuuaaaaucuauugucucagcaauuuuuaagaauacaucauuauuacugucaucauguacaauauaucuauugaacuuauuccuccuaucuaacugaaauuuuguauccuuugacuaacaucuccccaaaucugcucccucacccucagccccugguaaccuccauucuacucuccaugagcuuaacuucuuagauuccgcauuaucagaaagaucaugugguauuucucuuucugugucuggcuuauuuaacuuaacaucauguccuccagguucauccagguugccacaaacgacauuuuucuuuucuaauuuaugguagaauaguauucuauaauguauauguaccagguuuucuuuauccauucauauacauagugauggacaucagguggauuccaugucuuggccacugugaauagugcugcagugaacaugggagugcagagagcuguuugacauaccuauuucauugccuuuggaaauauacuagaagugagauugcuggaccuauugagugcgcuguuuuuuguuuuuuuuccuuuuuucuugagauggaguucugcucugucacccaggcuggagugcagugacauaucuuggcucacugcaaccucugccucccagguucaagagauucucuugccucaaccucccaaguagcugggauuacaggcguguaccaccacccccaacuaauuuuuuuauuuuuaguagagacgggguuucacccauguuggccaggcuagucucaaacuccugaccucaagagauccacccaccuuggccucccaaaguguugggaucacaggcgugagccacugcacccggcggagugcauguuuuaacguaacuccagaugugaguagcagaaauguggacaccaggaaagaucagcccacuagacccaaaaguguuaccacuaagugaggcugcauugcuauuuuauguguuaugccaaauuugaucccauuccaugaacaugaaauaaucuuaaaaacuggguuugaaauaagaaauaacagaaacucaacacagaacuaauuucaccaaaauacuaaguuuuguuggucaaacaacaaguauguggcccuuguugcgcuuauacaucuuauaauuuguuuuaaaaucugaagucaucacacagaacagccuaagaauucugucuuguuaaugacuugagcauaaacucacauuccucagucucuguaccaaagggugagcaccguacauuuccaaugcauguggggacuuuaaaaggacaguggagggucugcgaugcuaccguggagauuccugcccuguagcaggcugaaccagaugaccucuggaguuccuuacaccccuuaggauuucaagcccugaauccgagcccuaucuagcuuuacugaccaaguaggagguggaauggucaauucaaugcuuuauaaaaugucuuuuguuuaaaaaaaaaaaaaagucuuugaauguaagccagguugaaagcaacugucuccucuggcucuccagugguuacacaaccucaaaggagaggcucggauccucucccuuccugccacaugagguaggagcccaaagcucggcaucugcccugcccaaccuuucacacacagugccgguaugugccggcaccuuagcaugacccuucuggaagcuggccaacuccauuuuaacagaaaauaagacagccaugaacacucgggcuguccugauccuggaccacccugcuuucaguuuuaccacguuucuucucccuccacaagccuuacuuuuggccuggacauagaagaacacaggaucuguccacgacccauucccagagagagauguggccugaauccgggcuguguaguuccccggguuuagccgguuuagcuuggccccuccauacuuccuguauuccugucuggacacacauucucgcugauccuggggaaauaaaacauacaugucaauuucccaugaaugcaggagaaaucuggggccugccaacuaaacucaccacacuggggacuccagcugccugaucugaccucccaccuaacaaugauccugagugucaguaaagacaaagaaaucaaaucuuaaaaggucgucuucaaguagcuuuaagcacacccaaaagcuuuaaccaaacauuuuuguaaccaagaacuccagaaggauuaaaaguuauuagaacugaccuggccuaugccacaagguuaucuuacacaaugaaaucguuucuugagggcaaaaagcagccuagcucuuugcacacuaugcaguacuccuuggagaguacagaguggguagaaagacccaaauccucaccaacuuggcauggauuuuauuguuuuaaguccuaugcuaaccaggagguaaccugugcagucagguagcauaugcugucaauggauggaaguacaugcaggcacgggccacugccccaguccuaccucaacuugugauccguauuuuauuucauacauuagaaucaauccauugggauucucagguuccggccacuuuaaaaagauggaguuuucaggccuuggcucccaggucacuggcccaggaaugucaucugcuccuucuguacaauuuaaacaggugacaaaguuggauuuggguucccagggagggaggccaacacugggcugaccugagaauaacccccccauccacacgggcaggacaguggagaucagccacguacacugagaauaacgcccccauccacgcgggcaggacaguggagaucagccacguacacugccccugagcgggcugcucacacagcggaggguucagaauacaccaaccacaaaacuugcacgucucaagaugccacaagauccuccuuucuccccagucccucaacaaaaaaagccugcugccaagcacagcaggaaaaucuuggcaaccuaaguaacuuucuucuacccugugccuaccacuugaaaaaagaaagcuuugugaagccaucaaacacaagcagcccuggaaagaugcugaguaagcagaagcaggacacggggccugccggcugugacagggacccuccguggcccgcgucuacacgcggcaacugcaauuuuuaugcaggcacgaaggauggccccgagcccggccugugaggaagcugcuaggaggcuggugcuaagagcagggcaagcccucccugccggcaccaacuccuccagcggcuggcugaccuugcagugguuccuuucuugcuuuugcuucuugaagcaguaaacaaaguugugauaagcaaaggucauggaaaguuacagccggaaaaggcacuugagggguuagcuggcuaugucucucccaggagggcuaaggaaacugaggcagggagccugacgacugccucaaggcacgcuacaauggacuucagugccagaacugcacccaggaggaccccacaccccagacucuggucaccuccgugcucuuucuaccaccugaggccuacuaaaggacagggcagcucuuguucugucuuugaaggcacccaccuucaaagauggaugaaugcccgagugacaggcagugucuaacaacaagggaaagccaaagacuaaauaagcaagaccagaggcugcuccaggaguugaucuugaggggcaauguuuacucuggaucaaggcaacuaacuggagacaucucuggacaugugagagcucaggagggggcaacccgauuugugcgcaagagggggcaaaggacagcaggaaugcacgaugugcaccaaguagcagguggaggguggacccugcagacagcucccugcucccagcacguucuauggagagaccaagcugggaguggugucacuaggagagcgugggcucuguucccugggcagcuggucuacacgccaccugccaaugacugcacguuauuuagcaggcaggccugggucuaagggucauggcccugggugucagacccuguguccauaaaacacaucuucuccacuagguugugaggaagguggcaauggggccagcuggaucauaccauaccugcgggcauaguccuugcaaagacgaaguuggaggcgcugcagcccagcuucucagccucgugguugcagcuguggauaucgaugcgguacaaugugaaaggccgaagguuagaaaugacaguucucuccuuguuauccacucugcucucaaagaaaggguacucugucuccagcucuuccgggucggugauguuguaggugucugcggccgugguguuccugcuucggcuggacauggugguguuggccacuugcaugacaucucuccgcuuccuuucaggucugcaaggaggagagaaauguggcuuuuaaguacuuuuaccucuuuugucuuuucuaugacuugaguaagaguaacagaagaaucuuaaccguggaauagaaggagcuauugagcccccuuagguaagaacucaugaauaacacagggauguccuuccucauuaucuugcuuucucuacucugcaagugucagaaugggcacacaaacucucacccccaccccccggcucucagagugguucuucgauuuuaccuagaggcaaauagugucucugccacucuuggccaggcaguccuggcugugucaucagaacacucaggccaucuggucacagaccuuaugguuaagccuuaaagguggcaaaccuaucagcugugguuaagauuuauuagggcaggaggggagaggugagguguguggcagaggccccagagaccuggggcagagggauaugaaagccuguggugguggcuccuuggauuugcucugacuguggaaauaaagaugccuggagucuagcagcaagcaguuccacggaccccagggcucucucuucuugggggcuccugcugcgagcccacccccaaccccaagcgucugugcuugcuacacucugcaggucccuggagcccacccaggcuuccucccacucagcagugagcaccuguggccucaucaagguccugcccaucagagagcagaguccucgucauggauuugaauggggcuuggaacaaccgaaaagcaaaagggagugcauaaagucaucacaaaaaggacauucucaccaaaaagggcagaugaggcaugagggugcgacccucuaauugcugcuuuggucaaauaugaagaaaugggcuuuguggcucccccuagaaaccuuaaaacagaauucuaauguuuacaggaaccaacaaaaacaaacagaauacgagaggagcacccagauggagaaagggcaacccucaggucagccauggacgaauggugagaaaacagggcugaggccuucggcuggggucaccggucuuaggaauaggcaaaaggcagggggcaaaugggaugaauucuaucugcccagggaaaugagaaaguccagaaugugggaagcucaucagugccauggaggggagagcgcggcagcagcagcagagagggaaagcucacgcagggaacggaacagcccagaagccacuugcagguucggcugacgcucggcaggcuucuggcugguccuuaggucagaaccuggaaggggagagcagagggcuuugggaaagggccucugaggcuccccagucuucucagcccauggauuccccugaggaaaacacgguccuucuuuguguaguggcacacggggguccuaccgaaggcaugaacugcccaacacagauaugcucguuccaacaagcagaaaaccacaaggucagggcguguacauuugcuuucacaauacugggggaggaaggguaaggacaugaggcugaucauccacaauccucacacucugcaaaccaaccaacuagcuaaccaagcuucccggaagggaaaaacacaagaaaccacauuuacugucagggaaaucuuugucaacacaucaucaacaaauuuccugccuaccuucaaaaccaacacaacauacacuugugucugucagaaguugcuuagguuugauguaccgcaaaauaauucugucaaaaccccucucccggcucagcccacccccauuuaacugggauuacuucaugaaguauacucaguaguuuacuuguuuaucaacaucacacuuuuagggacugcacagcucucaaugcugaugacaucaaggcagugacaaggggagggaggugacacagaacauuaucuggaaggcaggaacaggggaagcacaauggcccauacaucauuuuuuuugguaaacaacuacauuuccaaaucguacgcccaaaagcaaacauuacugccaacuuuccccacuccaucccauaauacaaccuagcccuauuggaaaaccuuuuacuuuccaacaucugucaacauuuuagcuaguuaaaccaaacuaugugauuuacaaaauaaagacaguagucaaagaaaggcauuuacugcgaauauugacuucagaaacuaguaaguuuuacaaacucuagcuuccacuguacuucaaaacauacaggauauucuggacaauuuauaaggaacuaaaucuuacuuaacugguuuuaucccacaaauacauuguucucagaaugaacugaaagaaaucaaauccauuuucggacaauccacguguaaaacagaaagccagccucugugauucagucauucucucugcuggacacuccuucaccuggacucugccagaacucaguaggaggcaaaaaaacaaauauuaacuucuuaaaaauuauggccucucaccacggacaaaauauugucuucauauacauccaugaaaacagagaaucacaaguuggacuugucuuaggagagagaaaggaaggacucgggggacagauaaacacacuucuccaguagaacacaggaaacuuguuuugaacccaacaccaccaaugcugugcauuaauaacaugucaaucacagcucugccuucacgucacuucaccuugugcuccacaucugaugagaaaaaaacaggucuugccucguaacuacaacugaaagcaaggggccuuucagcaaaaucuuuccaaaaccuugacucacaacccgaaccuccugcugguugguggaacaagacagcaacguaaccaagggcccaugauagagaaaaacaaacuucccgcccagccugcuuugggacacucuaaauccauccuuccguguggcgggcagcaggagcugccacgagcuaagccucugcuggucuagguggaaaggaccacgagaagcaacgcaauggaggagaagagggggaaaagagucggugugugggaaugaggaccaggucccaaacggauucuuaauuaauuaggaugucagagaagucaccaaaccucauugaguuccaguuuccaaaccucuuugcaaucuuucuaguccucaaacuuucugcuuucuaggaaccaccagugauacaaagauauccuggauaagaaaauggccuugggcacugaaccucaagguucacauucaaagcccugccacacaccagcaggcagaagacucccccagcggggcaggcuaggagaggccaugagggccucgcaggcccuucucacagcucugguguuuuuuuuuucuugagauggagucucguucuguuguccaggcuggagugcaacggugcgaucucagcucacugcaaccuccaccucccggguucaagcgauuauccugccucagcuucccaaguagcugggauuacaggugugcaccaccacgcuuggcuaauuuuuuguaucuuuaguagagacaggguuucaccaugaugcccggcuggucucgaacgccugaucuugugauccacccaccucagccucccaaagugcugggauuacaggcgugagccaccgcgccuggcugcucuggugguuugaacuucgagagaggaggggaggagaaaaaagccaccaagcaaugaagaggcgcacucucaaaaggaaauaaugccuccaguucuaaccagucuuuauuucccacuuuacugauuucucgaagugagauagcuauuucaaccauuuugcaaauaucaaaaaggucacuuggcagaaaaaaaaaaucacuuuaaaaaccauuuguuguuacagccuaagaaagccuguaagagcagagucacuguggaauaaauagccgcuacaggcuccucucagggucgggggcagugaggggaagggaacgugcuggguggggugcuggcagcgggugcuguggggacugcggaugggcagcucaugggugccaugcugauuuaaauccaacuccuuggccuaguuuucaggcaugaggucguuuccaaaaucugcacuauaaucuuacaggaagagggggccagggagcaccacugugcuuccaucuccuuucccacacacuacugggcuaauccuuuuuugaaaggaaaaaaaaauuguuuaacauuuuuuauuguguuaaaauaaaauuuuaaaacaaaacaaaauauauguaagauaaaaaguugccauuuuaaucauuuuaaggguacaauucaguggcauuaauugcauucacagaaugguacagcuaucaucauuaucuauuuccaaaaauuuucaucacuccaaauagaaaaccuaucgauuauggaauaauucccauuccccuccacacucuauccccauccccugguaaauucaaaucuacuuucugucaccauacauuugcccauuccauauauuucacacaacauaaaaucauacacuaucuguccuuuugugucuggccuuguuucacuuggcauggugucuucaagguucaucuguguugugacauggaucaaaauuuccucccuuuuuauggcugaauaauauucuacuguaagguucgagcccauuuuauugagccacucaccuguugauguacacuggguuuccagauuuggcuacuaugaacaguccugcuaugaacguuuacuuuccucugcuuuuguccccacuccccagaaaccaagaccacagcagaggagcagagucccuggggcaggggcuguguugcuuugaaagacagaguaaccacggaauaaacagccaaugcaggcugucgcccuacacugcuucccaaacuuacuuguacaggaugccuguggcaccuggcuauguuuugaagucaggcccuuuccagcacagacucugacuuuuuucccucuugcuucacuccuccucugugaggcugagagaggcaguaaagauaauuaggaagggcagagauggacccaaauccuggccuuuccucucaccaggcagcagcugucaauacucuuugaguuuccccucccugccucuaccacagggugcccaccugcucucugugggggguuguggcugagacagcaguaccugucacaccgguggccccagcaacccaagcccuggucccuguucccuucagggcugacuggcuuccgcagggacucacuucaccgaaccugucaucuuuuucggcuccgucucaguggcuacuguauuguaccccccagcugcugacuuacacacuaccugguggggagaaaggcaacagaaccggccugagcaguggguuuugccaacugaaauuucacaugagcuggguaccugggcacgaagauggaguugugcaggaaauucucaaagacuuugcgguauucagccuccuccuucucggccugcuucucggcuucaguuuuggggcaggcgcagcaaggcccuuucuccccaccacacaccucagucuugggguucucugugaccuccucaaugucgauggugccgucggcauacuuccugauggggauuuugucuucucggaaaagaaaagccaaaacaagagugggaaugaaagccguuauacaugcuuguaaggaaaaauaauagcucucaguaccuuuaaucaagaagauagcuggucucggccagaugugguggcucaaggcuauaaucccagcacuuugggaggccgaggcgggcaaaucaccugagguuaggaguuucagaccagccugggcaacauggugaaaccccgucucuacuaaaaauacaaaaauuagcugggcaugguggugcaugccuguaaucccagcuacucggaaugcuggggaaugagaaaugcuugaaccugggaggcagaaauugcagugagccaugaucgugccacugcacuccagccugggcaacagagugagacucugucucaaaaaaaaaaaaaaaaaaccagaagauagcugguuuccaauggagaacuacacuguugucugauacguguaauauuagggcucaggcacauuacaaccacaggaaugaacggucacacccuccguccaggccgcugcugcacccuuaccuuuggagcaguaauugugccgguaaagguagccguccugaggcugccgcugccagcgcacaauguaguaacucagguugccguugggcagagagggaggguuccacuucacgauuaacugagaagaggaguucgaugcugaaagaacguccaagggaauggaaggaacuggagaggggaacaaagaacauucuagaaaaugaaaugaacuuaagagucaggcuaucagauacucuggcaagccaacaggaaacugccaguuugaccuggauaagaaaauaacaaugaacaaugaaauacaaagugaaaagugaaccuuauuuugaaauaguacuacuauaaaugccaacauuucccuuuauaaucuauuuccuccgguaaucucugugaaaacaaacauuacugaguuguaaauggaaaaaggcugcgggggcacaagcaggguuagaagagacaaugugaaaaucuacagcuaauucaaacaccugguauuucucauuuauuacaacugccauucuccacagugcugcacuccggcaauuucgacaacugguaaaacaggcugacuuggauuucaucugagauuuugaaucucugauaaaaaugucaugaagccaaauggaaagaggaaguggaaaggggccuggagagucugugugugugaaggagugugcaugcccaugucacagcuguguguaagagggaugggggagaggcaaugcaaagaacacggaaguccaccauuuccacaggcauccuucaguacaaugacugaggcaugacucugaaaagcaguuuagaacugcaaacgcauggaagccucauuuugagcaaaggacucugucaccagcagaaugaaugccgauuauaggcaaagcauaguuaucugaucaagcuuuacuuaugcugaccccugaacugaaacccagagcugaagugugcauaaagaucaaaugcaucccagaaccacugaaaucuuguccuuauugggucacaaaaaagcaucaauguugaugguuuuucaaagcacaggagacaccuucacuggauaucacuuaagcaauauguuugccuaagccauuuuuaaaacuugaaaagggcggacagcuugagggugcuccagguuauacgauacacacaagguucugaacaucuuuaagggaugauacuuuggaaaaagguuaugacuaauacuggcguuuucagagaaaacacaaccacuugaugcucagccacuuuaggguuuccaaaaauaaguacuucaaaaacaaacagcucauuccuagauacauucuuacgauaggugucaccaaacagcagaggcagaggaccaaguucucgucugucuccgcugcguguaaggacagaggacaaaacguagugaacugacucauugguacagugccugguuuccaucuuuguggaaaggaaacagguuucuugagaaucugucacaauaagcagauauuccuauguuucccaaacacuacagugaauugcuggccagggguuacuuccaaauuuuaagaugaaaaacuucuucuguugcacugaaccucugcuacaccaacccacacgcaggaucagaagccugugccaauuuuguuucaauaagcacuuuacccagugacaugacuguggccacuuacagggucauggagaugggguaggaguggaggaaggagcaggcgugcacagcaaaagguuuuccccaccagcauuuucuucucacccuccucucugccauuuaaacugauuuugugcucgcuuauggguauuuaaaaacaccuuacccacuaaaauaauggcuauuaucaaagaauguuuaucagugcuauagagugaaugccuguguccccuaccaaaacucacaugucaaaauccuaaccccuaaggggauggaauuaggaggcauggccuuugggaggugauugggucaugggagugaagcccucaugaauggaauccaggcccuucuaugagaggccccggagagugcucccgcaucccugccaccaugcaaggacacaaugaaaagacagccaucuaugagccagggagugggcccucaccagacaccaaaucugccagcgccuugaucuugcacuuuguggcuucuggaacugugagaaauacauuucuauugcuuauaagccacccaggcuacacuguuuuuuugugauagaagcuccaauacacuaaaacaaucagugucuuuaaaacugaaguggauuuuccuacuucuaaacuaguuuuuauauacuggaaacuauuaacguuugcuuuuacuguuuccagaucuggaguugagaaaugagaugguuuagaaccuaaagauaaaggaaggaggaaccucaucaucagugaauacucugaauauccacaacauacuacaucugcaggcuuucaacuuuuguugaccucuuuggaacucuauaagcuccagaaugaagauggaaaaccagugagcuacaugaauuaaguggaacacagaucagcaugguuucaguuccuggaggauugaacaucaaaacaaacaagaaacaagggcagcugaagacggcuguuuccaggcugggccuuccaaugaaaccagcccagcacccuggaggaccugggcucacaggcacaaagcaggagaugauggaagauaguaccgaggccagaaaauggcacagaagagccuaauguguuagcaguggggaaaugaauaugacacaguauuaccuauugacaagaaagacaacaggcauagcucacugcuaacccuacaaugacaccugguacaagcaaggccagugagcuugcgaagaaguguggaugcugggggcuugucuaggcauggauaccugaagcauuggugcgaauguacaagaucucacucuuggccccacggauauggucguucuccaccauggugagggucacagccuugacguaaacggcguacugaguccagggcuucagcccauguaguaagaugccgggcuccacguccuuguugggcgggagguccacguccaccauguuccagcuguuggagccgcaggcauccugcccaucauacucugugacauucuuaaagggucugaaagacaauuaaguucagagaaaguucggggcucugacaucaaaacccucaaaaaucuuccccagaggcccagcaugucacacuuucuauaaugggaggucuaaauaaacaaauaaucaauuagacuuuuauagaagaagaaaugaagugacuggacucugggcuuccccagucgggcauuacagaauugaauggucugccucaggaagagccacuucaacaguuacugggauucaauaguuacuauuccuuaagaacauaugcaaaaacuauuuuucucucuucugauugcagcauuuuuucaucaagaaaaaaacaagcauagucaguuaaugcaaauaucagauauugaaagaagguaacuguuggagaaaaaugacuuuccuacagacaaacagaaguagcuucuaaaauucagauugcucauaaacaauucugaugcuuaagcaucuuauaauauucaaauauuuaguuuccagauugccuuagaaaccagcaucaaguccucagugaaauuaccagcugacauugccaaagcacuggugugacuaucagagaauauaguacuucgcacagaugcaugguuggguagguauuuuauauuuaucagcuaaaagggcuggacagcugcuggccgcuggcuucugaaacaaacaugaacaaaacaccgucugcugucaugggaugggagaucaugaggggcuccccuguguacaaacucugaaagccuaguaauccuaaguacccaauuucucauucauaggaccccagcucuggcaggaggaaagaguacaagaugcugucauaaggugccucugguugcugcucuuuggaagccacacaucugggagagagaacuaugggauuaacaugggaccuggguaagggggauggcuaaguagaccgggguagccaccuggauauagaaggcaaaggaaggaagagggagaucaaagagggcugcagucgggaggaauaagccucggcugcuuagaugggggaaugucaugugaucacacaggaaaagcucccaacagagucuaggagaagucacaaaaggcucaagacaugaagguuguucucucuccacuuuucuucgcuuguuuggaaggcucaugaccuagagcagagggccacagcuugggagaggcacacagagagagagacaggaauaagaugauacaaaagagccacgugccugcaggguguuccuggaguaggccuaguagguaaggaggcugaaacgauauuucagugaagucccccaucaucguucaugagucuggacugaccuaauucuggaaaaagcaagcuuuccccauuuuggguuuauuuuauucaaacaccucuaaucacucacuaaagaaugacaggccucgagcuaacacuuucccaaucauggcugucacuggcugugacugacaucacagggacagcccgagagggugcaugaggaugaaguagggauguuuggcguggcucucccuggggacucugcugacccccuguauucagccagcccauucaaggaucgaaagacuggccucucccauucguagcccugucaacagaauggcaucacccaaagcagaaacucacgcuuccuuguaguaaacggugaagcugaugagaucccuguagucagggggccgguaccggugccagguuaugaugaugcgauucuucgacguggugguggaggugaaaugcaggacgucacuuucaccuggggcaaagaguacauccgugagugacagagauucaugugucucugaaaagcaccugucuugcuuggcacugcuucccccuuccccaaagcuggcuguauaugcuaaguucccuucugggcuuccucaguggcuuucucguuuuccacuaagaaaucauacauuucacuaugcagagcuccaagggcuccauccuuuguuuuaggucaaucaguuacgcuggcuacuugcccagggacuuggacaugaaccuggguuuccuaaccugaaaacaaggggcgacuucagugaacgaggugaacuuaucuuucuucuccaucccuaagauccuggcuaugaaagggggccugguagggugaaggugagccuuuaggcugcccugaaacuucuuaagagagacgaugacacuuguucugcaguuguggauaucugccuguucguguacaaccaccaaagacagguaagagacuacaggugugccacagaaaggaacuuuucuuggucuaaacuugguaucaaacuggaaggacacaggaacuccugugaggccuccagcuagggcugacaaacaacgggaggcuggauuaagcacugacaagaagaucucacuuggccaagccuaacgugcucuaugggaaguagccuggcuggcggguauggcagggaagcugugccaagugucucucuuauuccuuggaccaaauucaaacuacgauaaggaccagggaaagacugaugacugcccacccucauggagacccagagcucucugacgaauuguccuuucgcccucuuaucugccugaaucccacuacacacucaagaggugaagcagagggacugaagacaguaaaagagcuaagaagucuuuaggacaaaaugugcgcaacugagauugggaaaugucacaguuccugcugaaguguuauuuagagaggaaaccaugauuuugcuuucaaaagaaaauaaacggcuacuauguauuaugaucugacaggucagacuggcugacucuaaggagacaagcacucugaaauacucggauacauccgauuuuacuaugaucugaacagggagcaaggcaggggcuuugcagggauagagugagcagggggcgggaggcggcgcuggucgucagccugcuguucagcccuaggucagucagcgugcuucccucuaagaucccccagagcaacaagugucgccagguaaauccagacaccagcgaaacaagccaaagccaaacacgcaucgguucugauuugccucccugcaugugugucugucugcacacacgcacaaaucacccuucaucauacaaauuacuuuuuuucuaauacccuucccuuauuaaaagccaaaggugaaaagacgauuuacuuuuauaacccuauccagccagagagccacgccauucucaacagccguauucuacacaggguuagaugagaaaggcacugcuguaucucugauaugagaccuuaaaguuuuauaaacaguacaaggcuguaauuauauuguucucaauuuaaaaagcaauaucaacucagggcugcaggcucacuccaucuuuuucauguuggggugggagaaacaaggcggccgaguguaagggacaggaaacccguggcccacaggggcugcgcuuagggcagagcccccuccaccccacaggccugugcuucccuucugugggagcagaaggguagagcucauagggcugaagcacacuggcucuucccugaaaaauaaucggacagggcaugguggcucaagccuguaaucccagcacuuugggaggcugaggcacguggaucauuugaggucaggaguuugaggccagccuggccaacaugaugaaaucccgucucuacuaaaaauccaaaaauuagcugggcaugguggcaggugucuguaaucucagcugcucgggaggcugaggcaugagaaccgcuugaaccgagguggagguuacagugagccaagaucaugccacugcaccccagccugggugacagagugagacuccaucucaaaaaaaaaaaaaaaaaagaaaaaaaaagaaaaaaaagaaaagaaaaaagaaagagaaauaucuaacugugcaccuguguauaaaaggacauuuaacugugcauucuguaagcagcacuuuaaaguuugagaaccuacuuauaaguguuucacacacucacagagauguacagaauuuauaaauacgaauacaucacguaucugcccacuacugauugugaugacauauaaguaggagcaaagugcuaguuaagauggucuaguggucccccaugugaaaccaggaggggccgcagaggaaagcugccaucacacaugggaggagggucugcuguuaucaugaugguugggcccacgguguuuuggaugcugucacucacaggaggcucucuccccguuguuccugguguuuauguccccuuugcuuuggcgcccuuuaguccccgucacuuccuccaugcgguaaauuucggaaacacauaauuugggauugaaagcaaaguacauuuucccugcuuugauggucagguugcgguggucccagucccacaguugcugcaaguucugguugucgaggacguagaaggaguaauuccuagaagcacagaaaucgauguuagcgcaccugcccuuggccacaguccccucuagccugcuggccacguaacacagguccucuuugccaccugcuccacaauacauuuccuuugccaauaagagauuuaguuauuaacacuauaggagaacagacaguugcuguuaacaauggcagcaacaugauucaaggauaacauaucaaaaucgguaagaugcuaauuaauucuaugaccacuauuaccaucaaauaaugcuucuuguaccagaggauguuacuagaaucauucccaagaaaugccuuugguuauuuuucucagccaaguauguacaacgugcuugaaagcaguccaugagagaacagacaugcucugcuacccaaucggaacagcguacacuuugcucuaaagucucccauuauccauggaaguaaauccugcccaaucagcagcaugaugggauaggagacagcaugagacagggagacaagcuuguggggggucaacccugggccuucucccucccccauucaucuuucauucugagcagccccagcuccagucccuggaggugugggggaggaggaagagccacuaacaugcagugcucuugggccucucauccaggcaagaggacucggaguccaacacagugguucuccaaguucagugugcacaaagcuuguuugcaaagggcugggccccacccccagagcuucugauucagcuggggugggcaaagaaucugcauuuaucacaaaucccagguggugcugaccccugcuguggucccuggaccacacguggagaaccagcaaucuaggagaggcugaguuccagugaggugguggaggaccaaagcccaccaaaccagacguggcuucugccccagagggugugcacacgaguagcagauccaaccagcacaggaagccguucuaucuggcuacccagguggcaggacaaguccaucccuggagaggcaagaaagcagacagcuacggcuuaggucuagagaaagauccccgcagugggccuuucucucuggcuuccccaggaaggcagcagacaaugccaggguugacuucugaguccucugugcugaugggccugauccccauggaccgugaauccuucuucuccucuuccugcucugcuucuuacuaaguuugggaaucagugcaguacuuugagugacuucuaagauccacucacagaucuaauguauaaacacacaaaggagaaagaaccccagcccucccugcagagccagcguagccaggacaaaacagaaccccuaaggcuucgucugcccuggaggcuauguccauuggggaucucucugcaucuggugagggucuucauuuacacccaaaccaggaccucuaaccagcuggucaauccucagccugauucucauuuacaguaaagcacaaauuaugguuacaaugcugccaagcagcccugugacauuuuccugaacauucacaaagggacgucagaccaggaaggaguucagagacugggacccaggaccagaaaugccaugaaugagcugcacagccaugcgcagaucccuuagugcuaucuguagcccuguuuacucacucguaggacaacaaggggaaugcacaggugacaucuaagcucccugucuacuuuaagaacgaccagaaggagucacagagccaccacggaaucugcaucacaagccugaagcccaacccuuuccugagcacugggcucucuguccacacaagugcuggggguggagguuggaguccugccagcacaggggugcagugagcacacaagugagucgaaagacagagccucugaagcuaagucaggcuccucacacgcccaucuucaggccucuggacacauuagugaccaccaaaccgguagcaaaaacuuguaagucaacaguucuuuccuuucaguaagggcucccuccugaacacacagcuauccuggaaaagcagcauaagacauuguccaaaugaucccagaucuggucaaugcaacacaagguguguuuccuggggagcagugccaggauauggcccagcuggcgcuacuguugcuggggguagaccccauccauaccugcuguuucucacuaccaggcugcaggugacacugcuggaggucagaggggcuccaugcagucauacaacggaaggagggauggaguggaaauggaugugucauaagcccauucuugcucauagguuucuccagcuccaaaggagacugcagcgaugcacccccaaaugucgggcugcuuccagguaccugaguuaguuacaggacaaaaucuccuuguugaugaagaaaccucugggcugccgguaaggaccaauuaaucaggccaaacuuccaucuacacccagaaccaggccucuuuucauaaacuaauuucacuagcagggaacggaaccacaccaaaaauaccuucugaacaaaacauucuucucccccacgggaggaagcaugaauuauaaaccaggaauuugacaaaugaauggcaggcacacugaaauucuguguauuugacuaaucacuuugaaaagcaagauuaucuuuuuacaguaaacacaaacauuuuuuacaaucauugaagaggcugggagccaggauaccaauaucaauaaaacccaggcauuauggagccuguggaagcuaaagaaaaauaaaaauaaaacccuugucaaaauaauaaucaagccauucaugagcugccugucaauaccaugcuuguuuuucgagccacagcuuggggcaaggcuccccgcuaaauuccuuccaugauuaggugagaauuaagagaagguaaaaggcagagaccugucugcacaucuuuaaaauaugcauacgcuaaaguuaucauuguuuccugaagaaaaagauuacuuaaguaaauuauucaguaaaugugauuuccuaauuguuucuuagcuuacugccuuuacauucaaagaaugcuuuuaaaaauuagguuuuuuuuuuuuuuuccccuugagacagggucucacucuguaauccagguuggggugcaguggugcaaugacagagcacugcagccucaacuucccaggcucaagcuacccuccuaccucagccucccaaguagcugggaccauagguaugccccaccaugcuugguuaauuuuucuuuucuuuuuuuuuuuuaacagcugguaucucacuauguugcccuggcuggucucaaacuccugggcucaagcaaugccuugccauggucuuccaaagugcugggauuacaggugugagccaccacaccugaccaguuacuuauuuuucuuuagcuuccaugugcucuaugauauccagauuuuauugauauugguauccugguucucagccuucucuauguuguaaaaaauguuuauuucuacacuuggguaggcccuaucucccaaucuguagaccacacaggaugggaacaguugguuaucuuccugaggacaucucuauguuaucucuaucgauauuugaguggugaagacagccccagguacacgguucagagcacuccaucugggaauccaaaggucaggucugagccucaucuccagcauuuacugaggaaccccucugggcaaaagauuuauucagcucucccaggcuggagucucucagcugcaaacugggggugccuucccugcuuuucuggcugaggccaguuggaagaauuggaugggcuaaacauaaaaggauaccgugagcuuuuaaucaccccacaaaagugcaggaugacaugugcuauucucugaagugugaaaguccccuggaacaaagucucagaacaggaagguccugugcccugauaaauggagcugaacccgaggucuccagccuacagagguaggaagggacaguuuccccauuuucagugcuugcugacauacugaaaacaauucugcaauuauacaaccaaucauuccaguuccuuccuucgaggagaaaauugccucuucacggcugucucuagggggcaucagaacccaggacacaggcugucaucagcaacagagccaucugcaacugauaagaguauuuggccuuuuuugccuuucugcagaugcucccaccaauccaucugcaaacaggcugguuuauaucauguccacucucccccaaauccaauauuuacaucaaccuuagggguucagcaaggguggauaugucuaucuagguggaaccaggcaccauacagauauucagacaauguuuccucuuuguuuagguguuucuuaaaaauagcuuuacuucugaaguauaaccugccuaucaaauauucacccaucaggccaggcacgguggcucacaccuguaaucccagcacuuucagaggccgaggcaggcagaucacgaggucagaugaucgagaccauacuggcuaacauggugaaaccccgucucuacuaaaaauacaaaaaaauuagucgggcgugguggugagcgccuguagucccggcuacucgggaggcugaggcaggggaauggugugaacccggaggcggagcuugcagugauccgagacagcgccacugcacugcagccugggugacagagugagacuccaucucaaaaaaaaaaaaaaaaaaaaauucacccaucauuccaugagcuuccguaaauuuacacaacuguccaaccaucaccacuacucaguuccagaacacuuccaucauccaagaguucccucauucccauugguggucaaucuccaccucuuccuugcagccaucccuggucugcuuucugucucuauaguuuugccuuuucugcaaauuacauacgaaugagucauauaauauguagucuuuugugucuggauuuuuucuuuucacuuagccuaauguuuuagagguucacccauguuguaacacgugucauacuucacgucuuuuuauuguugaguagucaguuguccuuugugccacauuucauuuauccauuuaucuuucuauccacucaucugcugaugaacaucugaaugguuuccagugggucuuucuuuugggcugggggucgggggaaucccgggaggcuauuaugaguaauacugcuaccagcauucauacacaagucuugugugggcauguuuucauuucucuuggguggaucccggaauugcuaggucacaggguugguguauauuuuccaaaagucccagggaaaugugaaaaagcggccauguuucagccugaccuuugagcuccaagaagguauuacaaagcacugcguguugcacagucgagugguaggaacaaaagcauagaaaugccuauccgcgaauuucaauucuuuuaacucaccacccuccaucuacuuuuuccuucuucuuuucaaggcaacaauccuugguagcaccaaauaaugugaaacuuuaacuccuuauuuaucugaugccaucaggaaacaagguuguccaaacaaggggauuuuccagauagugaaaauauucucuuacucaagagcuuaaaaauuagcuauuuuauaaaaauuguguacauguggauuacaaaaccuguuuccuuuguaaacagcagagcggucuugauuuucuuaaugucuaaggucauuacucuagaaauacacccuaugguguccuugaggaaaccauggcuauggcuuuuguaacuggguuacaaaaucagcucacgccgagugcgauauaaaagucaacaggcucugagugaggaauaagagcucuacucuauguaaaaugcuugaauuuucuguucuggauggcucaggagacuuuuugagggggaucucagugacauuuuggaaagccaagguugucagaguugaaggaucucuguaccuugaauuguucuguucuccaucaaaaacaaaaggcuacagaacagaacuuucauccuauugaaccaaauggaaacauuuauguuaucacuggcuauaaaagaaguucaagaaggccgggcgugguggcucaagccuguaaucccagcacauugggaggcugaggcgggcggaucacaaggucaggaguuugagaccagccugaacaacacggugaaaguccgucucuacuaaaagcaaaaauaagccgggcgugguggugcgugccaguaaucccagcuauucaggaggcugaggcaggagaaucgcuugaacccaggaggcagagggugcagugagccgagacagcgccacuacacuccagccugggcgacacagcaagauuccaucucaaaaaaaaaaaaaaaaaaaaguucaagaaaauagugugacacguguuaacaacaugggugaaccucuaaaacauuaggcagcagugugaggggaaaauauuuaggaaaaaaaaccgucaaagugcuuugugauaugcacaugggaagaaaugaagggauaaagcagugguuuccaaucuuugcugccugcugaagugccuagggaucuuuagacaagcacugauuccuggauccuaaccccaaacgcuccuauugaauuggggugggggugcaacuuggacaucaggauuucucaacuccaccccugcccccacccccaaugauuccauaauguguagcaaaguuugagaaacacugggaugaaagcuaucuuggcuuaaaccaaaagcacaccgaaauaaaaauuucagacagcucugcuaacacuccucuauucaaaagccuugaauacguuccauggucuuccuaaauuauaacccuuuauaccugcgugcaaaacaucuuacauaacucuaguaccacccaccucuccaguguuaguugcccaacaggccccaggaugccccaacucguugccuuugcuccugccacccuaccuugaauugccuuucuucacuucaauccucugcuuuccucaaguuuuucccgaaagccuucaaggcccaucucaaaugccaccucuugucagaagccugucugaucuucucagguaucuggcucuucuccaugccuagggcacauuucuuucuuucccuuguaucacugugcgaguucugcuuugcacugcugauguuuaucugacuaucguauccuguccuucucuuucucgcucugacucuucccuucuugcagaagugagggcagcuagugaaggggccagaccuaacucugucccugagucuaaggagaaaugaacagcugagguguugcuagcggucucaacaccugaagcaaacagagcucuuggggagcucaucaucgugaggaugggcuauaccuuuguggucaugggccaggaagacagggugagagaaaacuucccaucgggagguaaaagauucuuaagagcccaagcucaagaaagagccucuuagaagcugcacgcaggaaugaaaggcuggagccagcauccuuggagcugcaggacuacuggggagcagcagcagcagggaaaacccaaggcccacuugcccuccccugcaucuaaaaugguaagagcaggccaggggcccgggcuuaccuggaaagccucccaaacaccugagcacgcaaccuuaaaaagauuuugcugaugcuucagguuuuaugcaaguuucagauaaugagaaagacaucauaaauauucuugcaaauaaaaaucaggcuuuaauuucuaacuacauuuaagugcacaauacuuaguuaacacuccaugaaaagguaaccacauaauaauuccuaauggaaauuaauuaaacucuccucucagcauucaccucuaugucuaucauuugcuuagucuagaaacaaaaaaguauaucauuaagcaacaagaaaauuugacagcuacugcucugcugaagaagaaaugcucacagacacccgagauuccagaaacacaaaccuacuuagaaaaaaaaaaagcggagaaaaauucauuuuaaaauuuaauacaagaaacaauaaucaucaccuuaaacugguagggccucagcuugccagguaagugacugaggagucuggggcugggugcagcggcagccuccuucgauuugcaaugagaaagaaguuuuuuaaggauugguguuccccaguggggaggacacugugcuuuucaaggauggaaugaagagcugcccgcucucguuagcucuaucagaugauggaauuuuaagaauuuaagacugaccaagaguuagucugagaaaaacagggaggcuguaaagaaacccuuaugcaguaacuuuauccaguuggggcagauaaaucagcaaagacaaccuuucccaugaccuucucgccucuucuuuuccuaaauuauuuucccaaauucucuuuggaaggaauucacucuuuaauugauaacuccuuuuauuuugaagcauucacuuaaagccuggcaagagucguauuuaaaagggagaguuuaaagagaaaaguacauaugcaaagguacacacaggcugacggcuggaaagcaauugugcaugcaauaagcaccggcuuuuauccuccagugaaaagcccacgguuauuuuaaaaccccuaucacaaagcaggccugugccaaggcaaaaacucuaucaauagugcaaauccuguaaacuaaucaauaaaaaccaucucgugaauccggguuucuuucuaacaaaacgaaccgcccaugcuccucccgugcucucacuuccaauaucuuaaaagauggagcaguugugcguaguagaguacagcauccugaggcagaugagggucgcgcgaacaaugauuucacagggaggugagcacuccagaccaacugcugucauucuuggcagaaaagcccuaagcgcacccccgucugccgucucacuggucacagucagacacgcaacccuugacugaugaggcaaaauccaguaagggugauaacaucucuguuuuccaaacagcaaccuccuaagaauggagaaccaugacuccacccaagaccuacucgagcagcacaggcaauacugcggcuuccuccuuucuucucuuuaacaaggcagggagggcucuuaccucagcaacacaguuucauaagcacgcugcuuauuuuguaauagaacgucagcucaugaaauuuggggcacuuacccuucuagcugcuccucuccuaggaugaggcgaagguuuuuuaggaaggacaaggagaccaaggcaugagaauggcggaucuucacguagcccgucaccaccucgaugagccccaugaaguucuccagcucugaagcaauguuaucuacauugaaaggggauugugucacugugugcucacuugguguaagggugacauacuuggauucuuacaaacacaagugagaacaauucaacggcaggugcccccugagaugcucccagcacaggacuggcugcucccugacaaaaacacacuucccuggcuugacucucaacaacgacuccuggaacgaggccucccaggcaggggaagccaaguuucuaggaggcugggggguacugcagcucccaagcugauuaacaaaauauaaaaucauaaauaccagacugccaauuagcuaaggcugacgaauguagggaacgucuuuuaauaugcucugucaacagacaguauggcccccacaguacaagggcaugacuaaaucaacauuuucuccaucucauuaggaacugccuuugcugccuuucuaauuccuaagauacagggaucuauauuuaaagguuccauuuuacuaagacuugaagaaaauacaccaaaauguuaacaauggcuaucuaugagggauuuuuaaaaauucauuucugcauugcuaaauuuucuauaguauuuauguauugcuuuuauaacuagaaaauaguuggaaaaauaguugaaaauaguuggaaaaauaguugcuaauaaagauguacaaacauaauaugcaaacaacagguuucaucuuguuuagucuaccuuuuucucauaguaaacaaaaaccaauuuucaguucaacuaaugcuaaaauuauaauaaacacuauaaugaacugggugugguccaauuaaugggauuuuacugugcguaauuuaugaagacauauuuaauaaaaugcucuauuuugcuuugaguugauacaaauaaaauaauaaggguacuaaaggauaaagcccuacaucuaauuuaauuuaauagcuuuccaagaaaaauuaaagggaaguucaaguuggaaagaugagagguugcgugcaguugauguuuuaaggaagagauccugaauuuuaaacguggggcaggaagcaugccuuagucaagaucaggaaauuuccccucuaaugagaugucccaucauccuaaauccaaucuauuuccugcaauggacauaaaccagaagacacauuucaucaucaugcaucaauauguaccaaucccuucauaaaugauacuucuccauggguuuaauucacagauuaaauuuuugucuucaggacaggaagauaaaaaaguuuaggcacucaaaagguauguucuagggauaagcaaauuaaaaguaaaugaggaaaugcagacacagccaaaagaauuaaacaucagaaguaccaugagagugggcaagcccuaguuguggggaacagaguuaucuccaucacggagggcugggaguggguguauugugaacagcaacaagggauaucaacuaauucagaagaacuaagcacaaacuuguuucuguccuuucuaaaccuuaagaauacagucuacucauuuaacaaauauuaaggaaaacacauucucaaaauacauuauuuuuccucucaaacuguaaaaaaaaaaaaaaauucuucauaaaaggauuccccccccaaaauuccuuucaacuucaaagccauuuuacgauauuuauucuagcuuauaaaacuaucaguaccuugaccaaguggucccaguggcagagaauuuaaggcaccauuacuagaagcccuuggcaaugaaaaaucagaagugaaaagauuuuuaaaauuauccagacaugguagugugugccuguggucccagcaacgugggaggcugagcagaaggauuguuugagacuaggaguuccagguuacagugagcuaugauuaugccauugcacuccagccugggugauacagugagacccugucucaaaacaaaaccaaaaaacaaacacacaaaaaaccaaagaagugaagagaucauaggcuaagucagugggaaauccuuugcacaaauccaacucagaagcaacuuaccaggaaugccaucuauugcaaauaaaggucauuguacaggggugagaccgaaacuuuauguacacaaugacacacacuuguauccuuuugucucucacaaguaaauuuggaaaucuagcauucuuuuggacuucauaaaauuuuaacgugauaucacuaaacuucccuuugcucagucuucucaguaaauucaaguaaccaaaacucuuuagacuugaaagauguguggauuuggcuacagcuggagucugcugagucacacgucugauccaauggucucuucugggguuuguaugugucagggcuugccucuccuaugcaagaugugacuaacaaaaagaugagcgaugacccucuuuacaggaauaaaugacgugccaauggcuaaaagacagauugccuuucaaucuguucuuuaucuuucagggaaacucaaagaagagacgucaugcgugaggcuuacacaccauguuguuuaucuaagcccauauuuuaguggugacucagggacgggagcaugaaaagcaucaacaaaagaaaaccaugagaucuagccguuuuuccagggggauggaauacuuacucccccgucggauguuaaugagcaaauugcccuugaagauggugcauccuuggagcaucugagcagaaguaacagaaucaauggucuuuguuuucuuuucuuccucacagaccuucgggcaaggaccuucacaagggaugcaguacaugcuguugaagaagaaaaaaaaaaucaaaaacacacauaauugagucugucuucuugcauuaaaaaaaccauaaggauaugcuuuucauuguuauuacagcaugcauuagaaaaagcaacuguuuugaaguguucauguggucacaugguaucucacccccaagcccacccaagauaagccacucacauugcaagcaaaaggagaaacagccuacaaaggaagagcguguugcuugcuuccagacaaaauacaugcugcauccucaaggcauuugugugucauaggcuguugacuggugagccagcugguuccaugugggagagacagugcugcagaaaggaagcuugggggguucuggaggaaaacagagcugcuuucugauacugugacccuggccuguguaccuggaggagucgcuaggagagaaggcagggacagcaaagggagugcagugucucugccuaacaguagucuagcuccugcagucaguguuuuggcaaagcccagugagggauaccaaaaggcaugugguauagcacagauccauuauuuucuugcuaaagcacaaccgaaauuauuucuugacgguguuuugcagaaacuuguaaauugauccaaauguugcuuuugcugcauacacaauaaaagcaagggguuuccauuacuuuguaaugagcucuuguuucaaauacuauccugaacaugccacgaaccaccaagagucagggacaaguaagacuggcacuuuuccugcuuaccuaccauuauuuaggaaauagcagacaaaaugcuagcccagcagcugaaccuuugggaucuauaguuauauauagaacaagggucagaaaguuggacugauuuccaaacaagacaaauaauacgaacuuaugcgauguguguguaauaggaugguaagcuggggagccauuauauguacauuauuguucuuaaaucaucucucaaauuucgugaaguaaaaacauucaagaaaaacaauguaaauuauagcucuuuuuauuaaugucccuucccccuacccaugaagguuauuuuguaucuaagacaaagaugcaggguucuguuuuguuuaaaagcuaacagguaaacaaaacuucucugguauuuuccuauuguguguuugggagaaugggggucauggcuuccccaaggguccuacaggaacuggacccacccacagauggggagaguccuuccucuaccauugcauucaacauucucauuuccagccuggguagaggcuuccuucagcacuuuuuuacuuggccuucuguuguuucuaauuuaucuacauacccuauaaacuuuccauuuaaaaaaaaaaauuuuauuuuaaaauaauuauagagucacaaaaagcugcaaagauuuacgagaaaguuacagagagaucccacauagccuucauccaacuuccuccaauguuuacuacaucuuacaugauauaaguaucaaaccuggaaauuaacucuguguguguguguguguguguguguguguguguguguguguguguggugcugugucacugaucacuuguguagauuuguguaaucacaacuacaaucaagauacagaacuguuccgucaccaccaagcucucccuaaugccaccuguucauacucacugcccugcccaaccuaguccccaaugucccuaacaccuggcaaccacuaaucuguuuuccaugucuacaaucugucuuuuuuuuuuuuuuugagacagggucucacucugucgcccaggcuacagugcagcggcaugaucucagcucacugcaaccuccaccuccuggguucaagugauucuccugccucagccuccugaguagcuggaaauacaggcacccaucaccaggcccggcuaauuuuuguauuuuuaguagagaugggguuucaccauguuggccuccugaccucaagcaaucugccugccucagccucccaaggugcugagauagguaugagccacugugacuggccaaacuuuguaauuuuaguagagacacgguuucaccauguuggccaggcuggucucaaacucuugaccucaggugauccacccaccucagccucccaaauugcugggaucacaggcgugagccgccgugccuggcuauaaucugucauuuugaggauguugcauaaauggaauuauacaguaugugaucuuuugagguuggcuuuuucacagagcauaauguccuugagauccauccaaguaguguacuucaaugguuuguuccuuuuuauugcugaguaauaauauuccaugguguggaugucccacaguuuaacuaacuaucuaucauaggacaucugaguaauuuccaauuugggguuauuacaaauaaagcugcuauggacgaugguguacauauuuuuguguugacauaaauuucauuucucugugauaaauauccaggguuacaacugcuggguuguaccauaaguguauguuuaguuucucuccaucuuucacucaaauagaaaaaucugaagcuggguacaguggcucacaucuguaaucccagcacuuugggaggcugaggcaggaggaucacuugagcccaggaguuugaggcugcagugagcuaugauugugccacugcacuccagccugggugacacagccagagucuaucaaagagaaaagaaaagaaaaaaaaaauggaaccaaucaucuuugguaaaaagucuaggagucaucaagcacuuaaaaaauguuuuucuaaggaaguguuuugauaacauguuuauagauuaagcuuccucaaauccacuaugguauagagaagguauaaacaagaugaaaaaauuaaauauuucaaaguaauuguuaaauaagccucaaaggcugagagaagggaauuuauuauucuuuaugguguuuuauuuuuaaacaaaaagguagauguauaguuuuuaacggacuguaagaaugaauaggggaaauaauggcucaauucucugaagagugcacuagagcggaagaaacaacacugucaaauggacagcauucccacuuugccacaacucugguggcugcagaacgacugaaggccuccaaaugucauuaagaaaauguauucacaaaacaaagacgauagcacacugaguucauggacaagcuaccacuccccuaaccccaccccaaggaggaaggugacgucugaauagugucugagccucaacuugguuccaggcacugccccugggcccgaggugugcaccaguaaaagcccuuuuacacucgaaggcugccaacaaaaugugaguacaaugugguagacugauuuuggauguaauauguauccucuacagcucauugaaguccuuggccuauuuaucauuuuaaaguauucagaguaauuuucuucuuguuguuaguaugcuaaugguuauacagauuauaagagggagaaaguugcucuacaucuaauacuauaaaagaauguauuaucuuugauuugaagguaagccuacaguagaagcugcgucuccaaauaauacacuagaaaaagaauccccuuuauaaacacuuccucaauguacuucauaagcugcagcaaaaauuauauuuaaaauuaacaccuacuuuucuaacgauauuuuuauauuuguagaauagauuuugacagacucagaaagacaggcccccuggugcuaaucaugaaggaggcauuuaguccacuaaaacagaacuuuccuaaaaguucuuuuuuuugagacagggucucuguugccugugcuggagugcagugaggcgauuuuggcuuauuucggccuugaccucaagggcucaggugauccucccacuugcaacucccaaggagcugagacuacaggugugugccaccaagccaaacuaauuuuuuuuuaaucuuuuguacagaugggguuugcauguugcccaggcuggucuugaacccauggccucaagggaucugcccaccuuggccucccaaaguguugggauuacaggcgugagccccuaaaaguucuuuacucugcuccaggaaagggaacagcaaccccaaaucuccaaucuucuuuugcuuucaaaguuauaguuaucacauuuuuaaacaaugcuaacaucuuauuuucaaaagcauaaaccaaugacaaauuuauagaaguccaguugacauguacaaaagggcauauggcauuuguuauaacgaacuucucuuuuuuuuuuuuuuuuuuggagacagagugagacucugucucccaggauggaaugaaguagugugaucuuggcucacugcaaccucugccucccagguucaagcaauucuccugccucggaguagcuaggacuacaggugcuaauuuuuguauuuuuaguagagacaggguuucaucacguuggccaggcuggucucaaacucugaccucaagugauccaagcaccucagccucccaaaguauugggauuacaggugugagccacaugccuggccauaaggaacuucuuugcuucccaagugaagucucaaaguucaggaaggaaaaugaaggacaugaugagcacugagggagggucaagguagagggggaugagaggaaggaagugcugauggaaaaaugucccuuauuuuaagcuacugccuacucugagcugcugcuagcucuugcacuaagauguuuagguccgcuugcuggucucaaggaugguggugggggcuuagcaugucuuuucuuuugcacuuccaaagccucaccuggcuagcagcacccagacuaggaaaauccaaaacuacaguucccugucucuuagauggcagcuuggcaaguacccagagagacuaugaacucuggguaucgaaaccagcaagcaaguacuuaauuucaaauggccaggcaguaugcacuuaaaauauaaaacaaacuggugaggggggcgguaagccaugccaauuguuccuagaaucucaccaaacauuuaagguaagccagcccucucaaaaugacccaccucagugaacuuccugagggcugcacccggaugaaacaaccgacagagucuaccuuugugugcuaggguggcgggugagguggggcggguagugaccacacguguggccgcgacugaccucuggcugccguugcggaugaagcccgaggggcacuccugcaugcacucgccgucguggaucacaaaccccucggagucgcugcucucggcgcugaggauguuggcgcagaagucacgguccacacagcgccagcccucaaaccuguagguguugggcgggcaggcaggcacacagacaccggcauaguaguaguggcggcaagcuacacaggccgugucguugucaggcgcgcugcagcugcccaggcacucgggguggcagcacucauuguucucggugcacgcccgcuucccacacgugcuugggcacacuguggagagagaggagagacggagaugagaccgggcaggggaggcaccgccuucucugggccuggccagcauccuucugggucauucacugcuaccaccagcaccagaucacucauugaggagacaaugcaaaaacacacuacgaaauccucacccccaccacuguccuuucauccacuuagaccugcagagagucgauaucuuuaaaguucagucucuccuaggaacuccuuguuuggucugggacaaaccauuagcuucugugaucuugauccucucucuucccaucuguaaaaugagggggauaauacccacauuugaggguugccucaggcgugggucagccaguggaagcccuacaggaacucuaugguuuaucaguaauuuaaaaggcauugugcucugcucacuuuccauuucaaauauguuccuuacugaaaacucuuuuaaagccuuagugugcagaaaugcuuacuuugaaaaugauuaaacuacacuauaguaaagaugauaccauucaaaaugacuucagggaaauuucugcugccuuagauaucaaagguuuuaccucaaauaagccaaagcuguuagaugacaaagaagucaccaugucugagggucauucuuaaguccaagaacauagguguguuacaggaaaggaguccugauccagaccccaagagaggguucuuagaucuuacgcaagaauaauucagggugagucuguaaacugaaagcaagcugauuaggaaaguaaaggaacagaagaauggcuacuccauacacagagcagccuggaaggcugcugguugcccauuuuuaugacacgcuaaacaagggguggauuauucauaccucuccauuuuagaccauauaggguaacuuccugauguugcuaugacauguaaacacucauggcgcuggugggagugcagcagugaggacgaucacaggucacucucguuaccaucuugguuuugguggguuugcgccggcuucuuuaacugcaucugcuagaucagcaaggucuuuaugaccuguauuuugugcugaccuuuaaccucauccugugacucagaaugucuuaacugucugggaauucggccucauuuuaccuagcuccuauucaagaugcaguugcucugguuucaaugccucugacaagugggugaguagcaucuccgagcccacagaaccauaggauauuagaagccaccuccgcuaagccucuucgugugcuaaagugaaaucaguaucuaauaaccacagauccaugguguacaucccaaaugcaugagcuggcauuuauuuccauaacaaugcugucgugaucacacucugugggcugucagccuuacuuguaaauuaagucuaaaucaacaaaauaugaaaucugguuugcauuauacauuuccuacuuuauccucaaauuggaaaacaauacaaaauuauuuaaauguguaucuuuuugacucugacaugcaauauugaguggagauucuagaauuuguuuuuucuuguaauaaaaauacaugauuaaaaaaaccagagaucacaaacaaguaaagagaauauagagaacaaguaaguccaccuacccacaagugaccccuuuauuaauaucuucaagcagaccuucccugguccuuucuuauguaugugcauggacauauaaauacaaguaucuacaaaaaagacaagccauucugaaagcuuucuuuuggcauaaaagauugugaauuccacaaacauuuaacagcaguauuacacuccauuguggaauguaucauaaguuacaccuguccccaauuauaagauauuuucuuuacuuuuuauuauugcaaucggcaaagcaaucuucaugagcacccuuaacauuucauuaggaucaauuuccagaauucaucuuguuggguuaaacuguccucuagaaaguuuguaccgguuuacacacccacuaguugccuccaagaguuccuauuucgcugcaaauaggugaacuugaaaacagauaucagaacuuggacaugcaaaugaauagcgucaccucugaagaaaacugucaugauacugucaagcuugaaauacuuuugcaacuuucucuuuugaagucauccuuugacagaaacaacagguugccuuccauuauuuauucuucuugucauuuucaguaauuuuuaguugauaauauggccauccaguuacagacuacaucucccagccuuccuuguagcuagagguggccauaugacuuaaguucuggccagugagauauaaacaaacguugugacuggaacuuccuggaagacuccugagaacaaagagggcauggccauccuccuccuugcuggcuggaaugcaguaguaaugcuuggagcucaaguaccaaccuuggaccacaaggcgaaacaucaagaauggugaagcgagauaaaaggaacuuagucccuuaugagaguggggccgcuaggcuaacccuggacugcuuacuccagacuucuuuagaugugagagacauacacuuuuaucuuguuucaaugacugcuauucauauaugcaacugaacuaaucccaacugagacaugucuucagagcuaucucuaaagugaagaagaaacccauuccuguccauuuaugccauuuuguugauaaggauuggcucucaaugacuccaggcuauuuccaaaaacuaaucuaacccacaaguaauaaggaguuacccaucucugaucacaccaaaaaaguaugcauuuuaugaguuccuaaaauguugggauauauaugcugucuaccaaggugacuuucuugaagaggauaacacaaauuugaauguacaaaccuagcauauuuucuguaaacacacacacacacacacacacacacacucucucucucucucaucaaacccccacuugaagacaguuaauaauuucaaauauauccauuacagaggucaccucaagguccaagaucuaaagaaacacugcaauuggguauuccaauuucauguuuuuaaacuggucacaacagaauauaauuccaucuauucuucauuuauucauuuagcagcuauuuaaugugugcugcaccugugugccagacagaugcacgcaggaucagcgacaauccuguccccagggaacggacgacacagcaaguacgggagugaguggagcugccugguguuuccugggcuucugggugccgaggacgguuuuguggaguugaaaguggaaagaugagcaagggaggaauaaagaacaucacauguaaaugcuuguaaaagcaacgaggucacugugggugcaagggcuuggguguuacugaagaaggccagggaccacugcccggggaggcacugaaggccugucccagaggguuuagcccaacuguggauaauacgaaaccauggaaaguuuuaggcaagggaacaacaugcccagaccuucguaucagaaagguuaccuggccgcagugcaagggacaugaugaucagagaggguagggcugaaagaagagagggaccaggcuggaagagagcagacucccagccuauguuauucccacaaaauucacgucguauaauggaucugugagguucaguaaaacugguuacagaaacaacgcucacauucccgcucgucaggcgugugccagcaguauuaagcauacacccaucuuggagcaccgaggcugcucuucagacaucaccaucaccaugcuuugucauuagaggaaggaaacucugagaaucuuaccaucaucaucagacacuaacuggggggaccaacaucuacuugcagaaucccuuucccugacaauuuaaagaaaacauuauauaaaaugauguguaauagacauuaagaucaaguagcuauuaaugcaguaguaauaagaacguugaaaagaacagaaaaaugucccucugcacuugcuugcaaauaguuauaccuaaauaucaaugccgggauuuuccaggaugagaaagaaaagaaaaaaaaaaacugacaaaguaccuguagauauauuccgcauuucccacacaucugagcaguagucccccgaaacuucccaaaggagugagugaaauuauaccauccagucagucaguccgugccacaaccgauacacaggcuggggaagucagguguguuucgguggugggagcuauuucugaaggaacuucaguaaaaccaaccaggaaaaaucauuuucuuuauauacagagcaacuucuuaaagggaucacaaaucaagggguuccuucguguuaaaugaugcaaacuaugcauaagcacaugcucuaugcgggggcagcaauggaaugugauggggagaagaggggaaggucaaaaggaaaguugcucuguuuguuagaggacgaacugcauaaauaagcauugcugcagagacggacaccaugcuccccucacugaagcacaaccugaaaggauucuaggaggcaagcaagagaacgugagcaagugugggauuagagaguccuggagccagccccagagcccgcuguaaauuuugucucaucucaauguauauaaauauuauuaguguucaggaccauuaagggauuucuugaaaagccccgggcagugugucucgccagcagauggauggcuguuccaugcgagcgccaaaacugagaauuucaccuaguacuaccaaauuuccaauuacggcgcuaugggggaaaggaagggacccucuucucuggcuuccaugaauaaacacacugagugcgauuaaaggcauuucagcuuuuaaaaauaggaggaaaauagaagcugcuauaaacuaacaaauauacagagaaaaaagcaaacugauuuugcccaugagauccuucuauuccuuggaauucuuacagugaccaacaauaaaaacaaaggcccaucuaaacuguuggaaaagcuaacaugucccacauccaccacuaaaaggauugguucagguuugcaaucacauaaaaacgaggcacugcacuuaaaagcuccuucucuucauuuuuuuuccuuggggggagaggaaaaagagucacacacaucagccuuuaacucucucccucuccagaguccucgaauguaucaaauuauuucuagaguuuuuaaaaaaccauuuguuuuuguucuugccagaguuuuuuuuuuaaauaaucauuagugcagagaaaccauuuuuaaaagcauaccauaggcugggcgugguggcucacgccugugaucccagcacuuugggaggccgaggcgggcagaucaacugaggucaggaguucaagaccagccugcccaacauggcgaaaccccaucucuuacuaaaaauacaaaaauuagccaggugugguggcacgugccugugaucccagcuacuugggaggcugaggcaggagaaucguuugaacccaggaggcggagguugcagugagccaagauugcaccauuuuacuccagccugagggacaagaacaaaacucuaucuccaaaaaaaaaaaaaaaauaggagacucaaccucuucacaaggaacaaaacaugaaagaggggccaccuggccauacaauauuucauaaugcaaacaauuuuauccccaaucauuucuaaaggaaagaacuuauucugcagauguucaaauaagguaaagcuucugaaucaaaauacggaagaguuuagggccaucucagcuguuucuggguugcccuaagguacacaccacuguuccauauaaacgcagggaggcuuucccuagcaggcaugcauccucgugcaggaggauuaaccgcuccuaacuucacgaaagugagcuucaaccuccaaagugcaucagagagacacaugguccaaagagauuuuaugauucucuugccuugccaggagaggaacugaccaugagacaacacggggaggagaaggaaagggagaggggugagggcaagcgaggggcucuaggugaacugacaugcagcguccugccccaggccgaacagaaguccacccaggacgugggcauucuucuccagaaaggacuuagcucagcuaagcaaaugagaaaggcuucuuuugauuuuagcagucaggccucagguagguuacacccuauagacguggcagguucggggacucagcccagcccucccagggcucacagccugaggacaagcagugagaauaugagccaguagcaagcaaaggguagcuuagggcugccugccaggggaagggacuuccaggccaaagcuggacaagugaguaggagcuagcaggugcauagggaugcuggcagagccaacagagagugcgggccaagagaagcaaagguaacaaagacaaccucagcaugacugaaggauggaagcacuggagacagaggggaggggagacugggaggaaagauggugugcccugagguagggagagccuggaacagccuuuuaauccagcaauaggaguuuggacuacucuuaagaggaaaaauacuauuuuaagcaggaggcacaugaucagaugugcauucuagccucaguagcccagaucaagaggacagcagugcagaugaggaaaagcaggguagauucaagauauguccaggaccaucuggaaggguacagaauuucuuuuuuuuuuuuuuuuuuuuugagacggagugucacucugucaccaggcuggagugcaguggcucaaucucagcucacugcaagcuccagcuuugccuuccggauucuugccauucuccuguagcugggacuacaggcgcccgccaccaugcccagcuaauuuuuuguauuuuuagcagagacaggguuucaccguguuacccaggauggucucaaucuccugaccucgugauccuccugccuuggccucccaaagugcugggauuacaggugugagccaccaggccuggccggguacagaacuuuucuuuugagggguacagaaagaucagcucagucugggacguguuguuuuuguguacacauccaaacggaaaugccuggcgugcaguuuguguggaugcaaucaggcgugaucugagcuggaaacauccugggguguggucagcagauggauggagaagggacuguggguugggugugggggaggucugaggaugcccgggggacccaggagagaucacagcacacaccguggccaaggcugccaccguucacaggggccuagcagccccccaguggaguguucacuccuuuagaauacccccauuccuuuaaaagaaaugugcucgaggggauuacaguauauucaucugugaauucccagacccauguuucacccuucucuguccccaagucuagguaacaauaauaauguauuuguggaauuaucuggagccucaugaacaugguaccaagggccuaaaggcaaagaguuuucaacaaaggguugguuuuugcugccuucugucuggucuucaaacuaaccagagugacaauaaaaagagccccucccucaggggcugccuaggaagccugugugcccugcugcuuuuccagggaggcagaggcagcccggcgaacacuuucgacagaaaggguaucuuuauuuucagcacccaugaaugacugcagagggacucagggaacccacggcuggcacaggaggaggacagccuagccggggcaggcgcugaguccacucagcugacaggugugccaccaugcucucgccucguaaaauaaucuucaaucaauccucgcuucuguccucucacacacacuacuccccaucccuaucaccccagggaagaagagagugacggugagcacaggcuucucaggcugagagagccaccguauuacagcuuggcuauuaguuugaaguucuuuaaacaagucugcuagguuggaaaaggaagcuuaguugaaaaugcuuagacccacgagguaaaaccaaaugcugcacauacacacaguaaagacauauuuucucaaaaugaagacaagaggauucugucaagcuucuggucauccuaaggaaugguuggaaaaaaaccccacugagccacugccuagagauuccaggaagaguuuaaaacaacuuccaaacagguuucugccuggagcugcagccauuauguggaaucagcuacgcacggcaaaagaaaguucaaguggcaagcgcugugucuuaaacguucacaaaagaaaaucacaucggcaacauuucucaaugccaaaaagaaacaaccucuuguucuagagaaaauaucccacuauaguaguuagacccagaagaaacacuuuauggucagaauggaagauaccacaguuugucugucugaaccuaaauaaaaagguuuucaagagaaccagcacuuugggggugcacccaggagcacacagaaagguacaccugagcagaauucucagugugcacagcagggcugguuagucagggggcuggaccacaccuuucugaaccuguuaagauagcaggccugaaagcucucauuuucucccaaguccaguguguacaaggagaucuugcagucuuugaaagggguugagacuccauuuugagucugcugucuuccuaacaggaagccuagacaagggugaacuuccuaauguacuaggguauacagaaggggcaaggaguuacauauuuucaccccucaucacugucccuauucacucucuucuucuacauucccaucccucugaggugacacuggguugcaggacugcuuuauggcaugcaaaggcaggcaagaagcuccuagggccaugacauccaccuggcccaguuuacaagcaacaagcacuuaugcaguccuuucucccuuucauccaaucacagauucuuagaucugaagagaaauuuacagucauccauugcauacugaucugaaacacuucuuuacaaaaaccugggugacucuucaaacaaaguccaagggagcucauuacuuuccaggaagugcuacuccacugccagauggcacccaucuugacgaacuuccuccauacacauauuaaaaaugcgcuuuccuguacuggacccuccccagcccucaugcaggugucugacacgcaggggaagugagugcugcuuuguacaggucagacuuucaaacaauauuccaagaugacggucacggcuucccucugaacaucuuacucagucaccacucacgcaacacgcccuagaccuauucuaacaguacagaggcagucugaacaguguagaaaugcucuuuuuugcccaaagcagcuugcuugccguuucucugugugaucuuaagaauaacuaucaucaaacauagcuggcucacucugagcuucuagucaccugaaguuccaggucuucuuguucacaaaaacuauucauaucucuacuauauaaauguaauuuauacuggagauucugaauacaggacuuuguauuaauauacaguuaauauucacuaaauauauuccaugcgccuuacaacacauuaagcaucucacauauauuucugcauuuaauuuaaucccccuaaugaucacaagggggcaguaucauuauccucauuuguacaugaccaaauguucacaccaagagcacacagcuguuacacugcaaaccugggcuuggaacccagauccuccugacuguugauugcagccucuucccccaccguguuuauggugguaugugguugcagcauguuucuauugucuaaaaggaagggccggccaggcacaguggcucacgccuguaaucccagcacuuuggaaggccgagacggguggaucaccugaggucaagaguucaagaccagccuggucaacauggugaaagccgaucucuacuaaaaauacaaaaauuagcuaggugugguggugggcacaccuguaguccuagcuacucgggaggccgaggcaggagaauugcuugaacccgggaggcggagguugcagugagcugagaucgcgccacugcgcuccagccugggugacagagugagacuccaucucaaaaauaaauaaauaaaugaaugaauauuuuaaaaauaauaaaaggaaggggcuaugggaguucaucucaugcuacuuuuccauuuaagcauguauccaucaggaagaaauacagcacccuuuucuccgccacacuaagagguguaucacuuagacugaaggacaaaacccaggcaacaugacacucuggaaaagggucaggcauccaggugaugcuaaggagauaacacguacccacuaaggccuucuuuauuuauugaguuccagcaaauggaacuuuuuuuuuucucugcagaagugugcaagcaguuuccagccuugcugagcuacaugaauugaugaagaaaauacacucucauuaucuaaucucauuacuaagacuuguuuggguggaacuggcucugugggucacugagucuuucugggucuuguuguucugucuccugauagcacagucacuuacauaugguuauauuugcccuacagaacaugcugcaguaacugccucugaugagaggagcuucugcuucaguuguugcaauugagcagugacccuugcugauaaaccuguggauuuugguaucugugggaggucccagaacaaaucccccaugggcaucaagggaaaacugucuaugguaccacuaugaugucuuauaggcuaugucaagcuugugaaauuaaagaacaaagucuguuguggagaagaagaaaaaacuuaguucuaugccauccccuuggugguguauauaaucaaggcucacagaaauauccaaguuccaaguagauucucacugucugggacagaaggcaugccacaagguuuggcugcugaauguaucugugaacacuuaauuaaugagcaaaagaaauaauugccugacagugcccacuggaucacuuaagucuccggaaccaacacgcaacgcugggcagaguauugagaaaaaagaaaaacaagcaaacaccacaaaaagggcaagcaagaaaccagaaggaggaaaguuauaaauagcaucauuauuaaauagagguuuugagagcuaauuaguaaggguaaagagagagaagucaucaaugcaaagaauuaacacaaaggcugagaaggaggcucaggaaucguccucuagcugggcuguugggaugguauagguuauaggaugcuuccccuuccuucacacauuuuuuacaauagcuuuauugagaucuaauucacauacccuauaacucacccauuuagaguguacaauuugguagcuuuuaguauauuuagagaguuguacaaacaccaccacaauuaaucuuaacaauauuuucaucaccccaaagaaaaacccaauacccguuagccaugcuucccacgccccuuucccaggcaaucacuauuacacuuuucgucgcuauagauuugccuauucuggauauuuuacaugaauggaaucagacaauagguagugucuuuugugacuggcuucuuuuacuuagcauagguaauguuuucaauauuuaucucugguguggcauauaucaguacuucauuccuuuuuauuuucauucauaaauuuugacuuucaugauucauaucacgggaagauuagcccuguaaccuuucuaugaaugugcagugauaaaaucacagguacacuggucacagguugguggagagaggcccaucuggaccucagaaucuaucugcauucuagauucauucuaaaggaaaaacgauuugguaacgcuaucaaaucaacuaaauugugccauucuuugauaccaggaaaaaagaguuaagagacauccaaucugucagggaauguucacccccgugugccuccccucugcuccgagucagcaggacacgugcucuaaugauggagaauaaaacaguggaaggugccucaucuuuacagaaaugccuggcagaggaacuggaugcuauagcacagaaagccuccuuagauggcagcaagggaaaaaagcaaaggaauaaaguccaauauuaagaaggggcugggggcggaauuuggccuucuacuucuuuuacuaucacuguauuuuuauaaaauauucuuuuaaaaaauauucuaguguacucugaaaucauccccgaauucuuucuuuuaaacucauauucaaagccuacuuauacauuugggaaagagagauaaguuauaaugguaacgacaaaaaaucaaggacaaaggcaaugaagaacacugugaaauccaggcuggaccggcccugcuucggcguucuggggcgaggucaucaugagccggguuucuucacgcauggacacacagugucgcucucacaacccacauccccccuauuuuuuuuuucuuugagucagagucuugcucuggcgcccaggcuagagugcaauggcacaauuucggcucacugcaaccuccaccucccggguucaagcaauucuccugccucagcuucccgaguagcugggauuauaggcgcccaccaccacgcccagcuaauuuuuuguauuuuuaguagagacgggguugguuucaccguguuagccaggauggucucgcucuccugaccuugugauccaccugacuuggccucccaaggugcugggauuauaggucugagccaccgugccuggccuuuuuuuuguuguuguuuuuuuuuuuuuuuuuuuuuuuuuuuuuuuugagucuuucacaaauaagaagagagaaaucacugcagaaugggugacuauuuugcaacucuuccccaguacugugagcaacaggcauguguacguaaagacacccaucacuuaauacugccugucacagaugcuuaaauggacaggguggaaaaaaauauucuuuucacacacuuaaaaguuacuucaaguuauuuuaaauuuggaacuguuuguauauuccuuauaaguuuauaaaacucacacugucccuccaugacuaacuaaaguggaauugagagaguauucuauauuuguaacuugacugguuguucaugcuuacagcccuauuuccauucucuguuacuguacacagaguuaugugagguauugugggcuccuaaauguugcugauuuccuaacaaggcaggccugugucccguagggacaaacuggggacuguuuugaccaaguggaggccaagcucagagggagaggccuccagcuuugucguuuuggcugcaucuccuaaaacuaguguuagagcccacuucugggcaauuacauggcuuacugguguugaccaagguaucaaugcuaccgauacacugccuauuacacauaccuuagacgcucaaugccacacagcuguggcugcaaaugucacuucugccuauuuugguaaaaacuguuaguccaaaaggugcaauguuucaacaaccuacgcaaaagccccugccacacacauaaucauuuaugucaacauaacuuaaacgacuaaacugaagacagccacuuguagggaaacuacuauuuagagaagaguaugcaauguuucugauaaaauuuugucaacaacagcagaacuguuuaccaggaaacugugauaaauguacgagguaccuagggagguagauuuuuuugcacuaccuguggaacuuagauuuuuaccugcacaccuguacaggcaaaucacagugaagccucuucacaggugcugaguaaauugaacaagaacagcuccuccaacgcuaccuccuuaggaggauacacaccuauucagugaccucacaauuuugcacaaucacuugugaaagucucuuuuuaaaaaugcuucuagaggccacagcacauucuuugacagaaccucaagaguagcaaauuuuuuggggaaaaaaaaaaaaaaaaaaaaaaaaggcugcuagugccauuuuucuuucuuucccaaugccagaagcagaaacagguaucucauuucaauucuguggcuguuggugaggcuggauuaucuuuuucacacaucucuuggccaucugcauuaccuguggcguuaacuucucuucguguccuggguccauuuucuuccuuggaucuuaaguuuguauuauauauuuaaauuugagcucuuaaagaaguacaugcuuuuuaaacacagcauugugccuuuaacacuuuuguuuuagauggcuuugugauaaaaugccuuuauguguaagucagucucucucucucccucugggucccucucccugucauaauuaaagcugccaagaagcauggacagcaacagcuacagaucaguaaccuugaaacuuguuuauuucuuaucuuuccagcuucucuggucaccucuccuuugaucugguuacuuucugauggcacacuuuuggacuuguaaacauuuauuauagaguauacauuaugcuuaaaugcuacacuacucuuuuccaucaucaaaucugauugcuggcccuaucuccugaaguuaaaguaccuuuuacauugugcagaaaucacaaaagaucaacuagacuuucaaaguaaacucuuauccaggauggagagcagaacagaguaucccagauaaucauacauucucguuaacagaauuaccacauaagccucaugagaaccaguuuuuugggggaacuguaccaaagaacacucccaccuucaaaaauacauggaacuuauauuuaaucuaucugaugauucaaaagugccucggaaaaaaacauacaaauguaaaacuaucaucuuuggaauguucucgcaaagauuacuacuaaaaacaaaaacaaaacacuugccauucccacagaauucuguuggcucauauuuuauuuugcuaguuuuuauuuuugugggugguagagcuggugguaguggggcugugcacuugauacaaguauaccagccuugccagaaugcauuagaagugcuaaaaccccaucuuggcaguacaaauccaaucauauuggcaacucucauuuccucaauuucaacuagggaaaaaaucugaccccacacuuuauaaaacguggaugaaggauuucaaaguucaagacucucucucucuuuuuuuuuuuuuaacucuuaauaguuuucuuuuuuuguagaugauagguaaaauuggguucaaaugaagaacacaggcaucccaugaguaaaauccuaguugaagagugaauuucaccuguaaaugcccaauggagauggccuuccagcaaccuucugcuuuuuccaauuaauuaggaaacaucugggaguaaauucuuauuugauccccaaaccauuaaauaucuacuauuauuuccugguuuuagguauucgguucauuccagacuaucaugcaaauuguaaagugaauuauuuugcugcuggcccacccaacaucacuuacaguuuuaggaaagcuggaacaugaagccaauuaugacaaagccuacuguuacuaaaaaguagcguggaaaauucaagggcuuucccuucagacgugaugcguaugaggccugucauccauccuaugccccggcaaacuaucugaccacucugggccaaacugaaggaggucacgcuuagagaguccuagcaccgugcucccagauccagugggcuucuccucucuuccugcuggggaagccuucaccccaaccccacagccucaucuuuuaauugccucccaaacauuagcugauuuucagggaucaaaggaauuugcuuugaaagaugaaggaacuuaacacuuagaauaacuauaaaaucaaaacaagcagggcagcucuacaguggaaagcacacgugaucuuucauuccauccuuggucugaacacuaaagccauucucaaaaaaaaaaaaaguucauacacauaacugcccaugcauccacaugcuuugcagacacgagaaugugugaaguuuacuugcucaaugaagggaucaguagacagcaacuuguacaacacaugacuguacuucccaaauuaacuucuuaacccuuucccugaacaccguaaaaacccaaacuggccaagucaccuaaaaaaaaaaaaaaaagaaaagaaaagaaaagaaagaaagaaacuaaaaggaaucucaagcauaaaucucuucuucaaaaaucuuauccaacauucuggacuugaauaaucugaaaacaaagaucugaaaauguuucauuuuuuuuuuuggccuucuucaaagaaauaagcuuuguaggaacuuugagauucaugucaaaacaacugcugucucccgaaaucccggagcauccucgucccggagccgaggaccugggcaggccagagggcagaagcugcaggcugcaaacuggugugcaacaucccugaggauguguuuguguuuuacucacagagaacaaguacuggcaagugacaaaaaaagaacauguuuugcaaacaaucagugugaccugaaacccaggguaaaggcugaagucagcauuuguucacugcagcacgagccaggcucugcaaugcuuguuaaauggagugcucuggagaagagaacggcuucucaguuucccccaaucacccagaggaccugggaagggaggggaaaaggagggccgacuccccacccccaagcuaggcuguaucaguuuguucugcuucacugcagagcuggagccagggagcaucuuugaaauuagaugaaugcccaauggaaggggucuucgaauucuggagcugaaagcaacucaagaucacgacauccagucaaaugucuucacuuggcagauaaagugaagaccagagaaccaaagcuaugaaagccacaccacucacaagaguuggguuaaacacccagguccccagccucugagcccacggcucuugucacaucacgauguccccagcuccccuacuucaccgaaaagaucucucaaucuuuaaagcauaugaccccuuuugacaaacaacccgcaaauuuucuuuaauacuguuggaaauguugaaauggacugcccuccuccaauuuccaauucugaaacugccuauugaaaacguuuuucucccaacugcacuugcuucccacccugccaaacagacuucugcuagucuaaguaaagccucugaagugcuuuuccccaacugcacucuccuuacuccuaucuaaauaaacagcacccgaacuucuccuuaaguccacuuuuuucuucugcuucacagaugggaagacuugcucuuccuaaauuaccauucucaccccaugcaagagcucugccgggccaccaaagauacauuuuggaccuguuacuuccauccuccugcccgcccuguccacaucacaugcccauaacuccucccucccucaacccccauccuuugaaauuucuaaacccccggcagaggaagcgccgcagggcucuuaauaagcucagucaugcucgaaauaucuguuucacccacgaggugugguaggcagcaguucugaccggagcauacauuuagggaaaagauuaucuacuuccaagacucaguauuuggaauuccuaaaaaugccacuuauucauuuucauuaacauaccugugaacuugcaacaauuuugaggguugaaaggauaccaucuguaauagccagcauccaccuacacacaugguaacugcagcagguuaagaaaucgcccuuucuguuggugugaccacagaaagauauugcauauugcaacucucuuugcccuggaacuugcaaaacuuacaggaaaucuuccaccaccuacauagaaaauccacugccagaaaaaugaaguguaaacacuuuauauuaaauuagccagaggcuuaaagaaaucacaucccaauccgauauuuucaaauucuggcucacuuucaaguuuuauggugcacacaggagcagaggcacagcggacacaugacugcccucugcagaauguuuuguuuuuucgaugaagagaaauaaucuacaaauuaguauacaacucaagcuaccuagagaaagcagccagcgaucuugcuuccuuuaugugggguuucuuguccauaucuuuacacuggacuaggauggccaucaaaaauacaaaucuauuuaccuaaagagaaaucuugaagcugauccuaaacuuauuggagauuuuuuugaaaaaaaguaucagugaaaauacagaaagaauaggaaaaaguggaaaauguugaugugccucagguuauuacguauaacaugcaucaauaagucuugugagauaucccauguaaaaaaauuuaccagcugcuaacauugucauuuaccccaaccccucccacuggagcagcuuuaccuucagggugcacauccccugaaguggccccuugacauccuuggcuugccuucagggaggaggacaugaugacgcgagguagcauuccucuguacacagugucaaaaauauauuaaaaagcaaacaaaacuaccaguccagaagcuaugcuggcaaaauuuaaagcaaaaaauuuagaaacagccuacgcccauuuauaugccagccuggcugcauuuuuaagggcacaagucaugucugucugucuguuuuguuuuuuuuuuuaauugguuuuagggaaagucaauguuuaaaauuuuaagaugcuuaaguucauccucugcuuaggaggcagagcauggggauggcaggcugugcccaugcaagaacagggacucucggguuagaaugaaguaaguuucuaucccagcuuugucauuuauuggcugcuguguaucagagggacuuguuuuccucaguauacacauaagacaaauuucaccugugcuacugguauaagaugaaauguggcaaaccacggaacuauacugaguaugucuccuggcggaucuuagguacucuuuaaacauuagcuacuauuauuauuugaucccuagacugaacuucuaguccugacucugcuaauucugccugcucagcugaaguguacaugggguaggagagauguccagucucgcauuaugacccgcuggucucucauccuuggagguguccaguggauuauaacgugcugggaaguggguaaauggggagaccccaagccaugucucugaucaguucauauacuaguaauccacagauuuaauuuccaggggagggcuauguggcaaagaaagaaaaaaaaucauaagacaagauucuaaaauauuucaaauuucaccucugcucaaaugaaaauauuacaaauucuaguuuuucagcacuguucuucaauccauucgcucgaaaauaaucuucauuuagugcagguuggacauggguuuacccaagacaucauuugaaggcccaguauaguucagaugcuauugugaagggucuucaggaugcagguacccacuggggugguggagguagggugggggcugaggcugccaagaaagcuuucaacuuccacuaggaaggaguuccuuuuagacagggaaaaaaguuucccaugcuuccaaugacuuuacuuggcucuucaacaaacaaacaaacucccaauacaaugugcuccuaaauaacuuuauucaacuuuuacacagugauaugguuuggcucuguguccccacccaaaucucaucuuguagcuccuauaauucccacauguugugggagggacccgccgggagcuaacugaaucaugggguggguuuuucccuugcuguuauuaguuaauaugucucacaagaucugaugguuuuuaaaauggaaguuucccugcacaagcucuucuucucuuggcugcugccaugugagauguaccuuucacuuuccgccaugauuuugaggccucuccagucacaugaaacugugaguccaauaaacuucuuucuuuuguaaauugcccagucuugaguaugucuuuaucagcagugugaaaauggacuaauacacccagauuagaugaaaacucucuggacguagcaaagggauccagaagcuccuuccucugugguaaggaaaagacuuccuacaaccaauaaagaaacaggugaagaagcaagucccuuguuauuaauuacugggcugagauggaggugagugagagguaaauaccauuaugauaccaaauuuuaggacaggcauccugaaaugcucuaacaaauggacgaugcuaaacaauucuauucaacaagguucugcaccuaguuccuacucucugguucaaucagagguuacucaaaguuacggguucaccggaacaacuuggaugcuugcuugagagcugggucuaaauaucugccauuaugacuucccaggucaaaggaaucucuuccuggaucagugggcuggauaucugaguugcaagcaagaacauacgcaggcuguuuucugauugaaaagagcacuggcuuugugcaugcgcgcccugggccagcuccugggcauggagguggaaaggacagccaacuggcuggugcagccgucagacugcccaguucucaugccucccgcaccuccacuaucuaagaccaacugcucugcuucacaaaaagucauccuggugccagugccaugggaacauuccuucacucuugcuccaucacucaaggccauugcaacggaagggaguaugucaggaguacauugcccaccugcuuuucucagauuuccccucucugacccuguaucaaggaaguugcauucacucauccauuuggcaaagauuucuguaauuuccugguaugggcacucuugagcuucugggaugcggcugugucugccuguacuccagguucagaacacagaagcgcugacaguacuaaaucaugauggggauacacaaacacacacacacaugcacaucuuuucucuccuagccccugcuccaaccacacuggcuguuuucuuuuccuuggaaggaagcagaccauuuccugacucugggccuucacacacgcuguuccaccugccuggcuuaugccuccuugcacucuggaccugccuagagaugccuuaaugaccugccugcuggaugucaucauucccaagaggucucuccugaccgcccucucugaguaggugccauuccugcagccccaucauuuuaugauaacauccuucccaucuccuucaaagcacugaucguguuuacaaucaaagacuuauuuuuguuuuuggccagggccuagguggaagagagaaugaggaguuacuguuuaauagguacaacuucaguugugcgagaugaaaagaguucugaauauaaaugauggucacggcugcaaaacaaugugaauguucuuacugucacugaacuguacacauaaaaacgguuggaugguaaauuuuauguuaugugcauuuuaccacaguuuuuaaaagacuuacuuuuagguuuacugccucucucucuuccacuaguguacacuguacuagggcaggaauccuguuuuuucacuguguucccagggccaugcucaguauauacuuguaaugcacacauuguaagcuccuugcgggacaccauuccuuauuuuuauuugccucacagcuccucccagagagccuuacacacagauagagacagguguuaauuuagcccuggacgacuacauaggcaaacuuuccaaaagcaaagcccuugaauuguauauaaaauggggggaggcaggugugcacauacagacuuuaagaugucucuucuucugccuuggcuuacaagaaucucaagggagugcggugguucaugccuguaaucccagcacuuugggagggugaggcgcguggaucaccugaggaugggaguucgagaccacccugaccaacauggagaaaccccaucucuacuaaaaacacaaaauuagccgagugugguggcacaugccuguaaucccagcuacucgggaggcugaggcaggagaaucgcuugaacccgagagguggagguugcggugagccggagaucgugccauugcacuccagccugggcaacaagggcgaaacgccgucuaaaaaaaaaaaaaaaaaagaaucucaagggagccagguuccaggaagaauaaucuuccuucucaugugguguggucguugccaauuugaccauacagguccuguguaauacccaugcgguaugugguguuuuuuuuuguuguuguuguuguuuguuuuuuuuaauugaaagcugucucgaaaucucuuuggaauuagacaacauauaaauggaaagcaaguaaguccaauaauagaagggaguuuccuggcggauaaguacuuuccuauguuucaacagucaacuguuauuaaauaaauagacgaugacaagaauaauaugaaaaaauauuuccuugccccuuccucgaaaaagagaaaaaaaggauaaaaaucugagaaaccacuuuuaggagaugagcaguaaaaugaaccagaggccucuggcugcauuucuuugcagguuuccccaggaauaacccaaagaaauaaucuaaccuaugcacaagcccagcucucucacagguaacacuugcuucugggcagaccaaaaacuuuuuaaugaagauaauccucucucaagggugugagaugagucagagcugcagguacuagcagggaagggaagaaugaauguuuaguaguaguaggaagguaccuaacauuuacggggcacucacugcuacccgugcuaagcgcuuggcauacgcugucagauuucaucugugcaacaagccaaagagggagggccugccguucccaucuucagaaccagagccugaggcacaaagagagagugugugugacuucccagagucacacagcuugaagaaggcagagcuggaauuccaaccugggcgaccugacuucagggucagugcuucuaaccaacaggcuacagggcaccuguaugcgccacagaguuuucuagcguaauucucguaacucguaggagaaaucagcauuauuuccccagacugagggucuaagaggcuguaucuugccaaggagacagaacucacauacugauugccaggagcuugcauaaggcucauuuccaugccuuaaagaucugucagggccauucuaaaggaccccccccccaaaaaaaaaaacccaacagauuuggcuuuuuuuuuuuuuuuuuggagacaaggucuuacucuguuguccaggcuggagugcaguggugccaucauggcucacugaagccuugaccuccaucucagccucccaaguaucugggacuacaggugugcaccaccacgcucugauuuuuuuuuggagacagaguuucacucauucuuuugccccagcuggagugcaguggugaaaucucaacucacugcaacccccaacucccggguucaaacacuucucugaguagcugggauuacaggcaugcaccaccacaaccaucuaauuuuuguauuuuuagcagagacgggguuucgucacguuggccaggcuagucucgaacucccgaccucaagcgaucugcccgcccuggccucccaaagugcugacauuggagacacgagccacugcgccuggccuggauuuggcuauuuuaaaaaguggaaacuuuacugcuaugcuuaaccuaacuucaaaauauuucucaauuauuccuacuuuaaaaauacuacaauucacacaguugauaaagcacagaauuagcaccacaucaaacauaguguuuaaucacaauggcuuuaaaaauauauaaagucaaaaagcuuuuaaguucuuauuaaauauuuguucauuuaacacuuggucuacccguuuguaaggcaugucaggcaauugugagggcuaagagacauacacaaggcacacagucagaugcaggugaugagauguacacacagauaauaauuagagguaaggauucacgucauaaaagauaccuaacgggaggacaagaacacuuccagccaagaggcccacacgauggcaaggcauaugcaaggcaggagugugcaagcagugacuuuagaccuaggcaaaggagccguggggacucaagacuggcaagugguagggguggggcuucucgaauuuauguauuucaacagaaaauuauaaaucacuacucauauuaauauauaacuuaaaauucuuaaaaauuagcucagugcuuuuugccuuuaagaaauauuuuaauuaaacaaacccaauuuguuuuaaaacuucacagaacgagguucagaaaguggcuuuuguugcugcgcaaaguugaugccuacggaucaucuauuccuaaaguuguuuagaauggguuauuucucucucucucucucucucucucucucucccccuuucucuccuggcacaaggaaguuuuacaccaucuacaaucccuccguuagauuaaaaaaaaauaaaccuccauugugagaggcgccauuggugucugccuccuugucuuccagucacaaauggagaggcgggcugaagaacagcuucacugcucaggaugucaugaauuuaaaaaaguguagcaauggugcuuggccagacagaguggaaaacaaagccucagucauuuguuuaaacaaauucacaaaaacaaaaacacuuccuccacguacccguacccagugaauucuaaaaaggaucacacauuuaguaugacuuuuaaaacuuucacuuucacacauuaaaaacaacaugaugggagcaaacaagcggacaucaccccucacucgugcuuaucuauuucugguuucauuaagcugccgaaacgaccgccagcgcuuccucucaucccaacaggaaaauuucauggcuccugaaggucugagucagacuggaaagcucaugaauauucugaguuucuggagcugaugcaaggacgucacuauaauugaugaccaggcagagcuaucuacuacacguuugaaccacuccucugaaauaauuuaucagaaguuagauuuucguuucuaaagcuauuaauaacaagagucuguuucugauuuuuaagaugaaguucaaucuuucaagccauucugcuuuucaauaaauucccucuauuugcagaggcccgcauuaauauacuccuugcuuuacugcauuuuaauaaaggugaugagaaaauaaaccgaagagaaccugaagcuucccacaugcaaugggaagaaagcagcgugcugcagauuuaaaucaggaucugcauuuacuggguacacggaagugaagagaguacgugcaucugugugguggcggcgggggacagagacagaggcgucuuccuguggacggcaggagcguccugggcuguuccgcugagauuugggcucugagucauggggugcucgcguggaacaguaagaccgaguucaacugagaacgcccgcacguauccuauguuaauuuuucuuuugcaaacacauuugcaucuuuuacuuucauuuuaaacugcgccccgugcauaugugcacuaccaacccauccgggugacgggcaaguuguaucuacucugggagccuccuccugccugcgaggcaaguggcgaccccagagcgggaggugggagcccccuuuucuuacgguucucggaccgcagauuuuccaucaacacucaauuagguuuaaagauacacuaggguguguacugagauaguucaaaaugauuuccuuccaacauaaaauggaucgugaaccacgggaauccugagcccuccacuucccagcgaggcagcaugacuggugcugugagacggauccaccagugaucgaaaccgcguucugcuagggaaauugagguuuggaccacguggucaaggacaaaugaaaaaccuuuuacgcauuuccaaauaucaaaauuaaagaauuaaaagagaaaaaaaccccaaggaguucauaucuucccaaaccacaaagccacgcccgggccccacucccuuuucuauccacuuuagcacaugccgaagcccagcguggccugggaccacgugagggacggugggcguggccggggcgcagucacguggccgcuaugcacgccgagccccaccuccagccagccccuccuuggcggcugcaggagcccagccagcgauccaggcggcguuuccaaacccagauccacgccuguaccugcaaugacuuacaggauauuuuaggaauuaguccaacauauccuuugggauauccuuuggggucuguaaguaauacucaaauagauuuuaccuaucucgcuguauucugcagccaacuuuaaaacauucaucuggaaacugcaaacacaaaauaacccuuagugcaugauauugugaauucugugcccgucuccccuucaaaagcuauauaguauauacuuaguacacaaacuaacucagaaucauguauccuacuguaaggaguccucuuugguccagcaagcaugugugaucugauaccuagccuacugagaugccuacgauucuuuucuucacaucucccaaauauaacagcuacauuucagacuccuaaaauuuaauuuggaaugaguuacaaauaucagugaggaaaaacgagggccacaggaagcuuaguauagcuugcacgcucuugugugagggccauaauaaaauuacaaacugggauggauugcaugauauuuaaaaaauuuagccauucgguuucaucaaacagaagcaugagauuugauaaaauguuacacuugaggaguauaaaucuuuuuuauuuuaaaaauaauagaaaagaccacauagaguaaaaucaaagaauacaacagacaauuuuuuaaaacuuucuuuuggcuaaagaguuauuuuuaggcugagcgcuguggcucccgccuguaaucacagcccuuugggaggccgacuggagaagauagcuugaggccaggaguucaagagggaccugggcaacacagaccccaucucuacgaaaaauuaaaaaauuagcugggcaugguggcacacgccuguaguggcaguuacucaggaggcugaggugggagcauuaacuuaaaccugggagguugaggcuccugcuccagugagcuaugagagcaacacugcacuccagccugggugacaggccaagaugucucaaacaacaagugauuuuaguauuucagugauggaaaauucugaauaaugauuucuucauaccaauuagauuugggacugcugaaauuuaauuaaauagggggccuccuccaacuuguuugccauguugguaauguuugccuauuuauuugagacagugucuugcucuguuguccaggcuggagagcaggggcaugaucacaccucacugcagcuuugaccuccugaacucaggugauccucccaccucagccucccaaguaagugggaccacaggugcaugcuaccaugacaggcuaauuuuuuuuuuuguagugaugugguuucccuauguugcccaagcuggucccaaacuccuggcucaagcaauccucuugccuauggccucccaaagugcugggauaacaggcaugaggcaccacacccagccacguuuauucuaaaagaggaaagcaacacuuugaacacuucuuuuaauuacagcuuuaaaaacucagaaauaaaaugucacaugauaaauuaaauucaugguguugauguaaaccuucccaacccaucucaagcaucugggcugugcuucagagucaguuccccaauagcauucucuugaguaucaaaaacgagagauuugcagccaggaccaaaacuaugagacuauuuuggcaauuaacaucuccugucaucuucuucaccuccuuuguagggagaaagggcaagaacauuucaaauaacauucauaugugggauuucuuaagcuucugcauauuuuuucuucuucaugugacuaguaauuguccucccaaauaaaaguggacuugccacugcuaguuaaaaaguuuaugucccucacuguuaaaaaauacauaaaauccugagaguagaauccaauuacuaaguguagaaaacagaaauagaaaaucaccauuuggcaaacaucacaguaauggauguuaaaauuagugggugaaagaauaaugaggaacagaaugcuuguuuagauagucucaaguaucuaccuccaaaagauucuuccuaauuacaaagagaaaaauaguaaugauaauggaggaagccacagagaccaccuuaacuaagggaucaaagcuaacagcaccaggaaaggaaacaucacgcaucuccugacaggaugcgcaaagacacaaacagcagcaccucugugaucuccaaguuaaaaauguaccccccaaauuuaaucaggaggaaacauccacaaacucuaacagaaagauauucuacaaaauaacuggccccauguucuccaaaagugcgaacuucgugaaugacuaaagaaaacccaggaaaacgucccagaauuagaaaaacugaacacaauaaaugccagguaggaucgucucuuggaucuggaaccaaaaaaagggacaucagugggaaaauagugaaauccgaauucagucuggagauuaacagcacuggaguauggagugaacacuguuuugauaaccguauuacgguuauguaagauguuaacaucuguggaagcuggguggaggguguuccagaacuccugguacucuuuguaaccuuuaugcaagucugaaauuauuucaaauuaaaaaguuaauaaacguuuuuaaaaguugauaaagcaaaagaaaacaacuuacagcaugaucaucaacuaaguugagaaaaagaccuuugaacuauaaggauacaugcaaaucaauaaaugacugacaaacucaaaaaucccaccuccaaugauacacuuaacuuugcauuccuugcacuugaaccagaguuacuaaaagccgugcaccucaagauaaagucacugauagcuuaauaaauaaggugaaucccuaguuuagagauaugacaaaccucuacuuuuuacagaugauuccuagagaaauacuguugcuggaguuuauucaggcugguagagaaccgggcaucccaaguugagggcccuuuccauucugacauauugccuagcauuuaauuuagcuuagauuugucuuccagcgaggugcaagugggaaguuaagaugguugaaggaugcaaagaggaacagucaacaaaaugcacgacagaaaauuaugugcgacucuccuggauccuugugacaacuccuuguccuuuuucuucaaauguagugagaacuguguuuuucuaacuugcccauauacccugcucuaucaucugcuacagauaauauaugcuucugcucucugcauguuauacauaaaacagaucaaauucuuucaacagcaaaaaucuuuauugcauuagcagaaauuucccagcaucauaagcccuacaguuuccugauccaccacuaugugguagggaaggcaauaaaaagaguuugucaggguuucacccaaaucucaucugaaaagcuugaucuacuuuuuuccggagaccagccccaaaugaaaugauccucauuggggaauaacaaaaaauugaggccaaaagugaaugugaaaagcuaccauuuuuauuuuguguucccagcauuaugggauaugcaacagaagaugagaauucugcugucaaggaauguacaaaauccuuuuagguacaugugcccuauuuaggcaguauuacugaaaggaaaggagugagcguaccauggauuugguccgugccuuguaccaagagccaugcuaaggcuucucugauuacauccccauaagcuccuuuuuacagaaaggagacuaaggugcaaagacuugcugacuuguccagcaucagaggcucagaggugguaaagacgggauacaaacccagaaugucuucaccccaggaucuaggcucugucagaccaugcugucucccaaaugaaaacaaguuuugcuugcaaaggcugcaacaacuaggaaguauguaguagaggguggaaagcuaauguccccuagaagcagggccuaaccugagaacugcgagagaggccauggagguugggguuaugaacacuaaggagcaccagcgcugcaugcagaggguguaaggguccucccuacgcgggucagcauggugaaagagaaggacuaggagggcggagcuaauaguaggaggggagaagaccgauaacaaacuucuucagaaugucccugcauguauauuuaucugagaggaagguguaaggaggcccuucuaaaauacuaugucauugaacuaggugugccaaggucuuguauauagcacaucaaggggaaagugcauucauuuggaagauuuguuuuuucacuacugaguugggcuucgauguggguaaaugaguuacauucauuuaaauuauuccagcaacuaucaugagagagacagacugagacggagagauguucagagaaagacagagacauagauggagggagggagggagggaagaaaaagaaaaaaaaaucaugcaaaggaauaaauuuaucacacauuuauaccucaccuuuccagaacucaacuauucagcaaauaaacauuucugggguagucaagcaccaggaagaagcuugguuucacuuacugccuauuuacucuuaacacauaacucuaacaagcuuagaaaucuguuuucaaagcacucacagcaaaaaggaaguggcaaauaaucaccuacagaggggcugauggagacggcuuucucuucuuacugaaauaagucuauuaaacagaaauggagacauaaaaaugguaaaaccaaaccauaagaacacaauaagcacaagaaaccuucagcagagggcaaacugccucccacucagccuugaggguaucacuguauuaugcauaauacaacaauuuaugcucgcugauguccucaaguuggccagaaaugacuaaauuauauucacuggaguaagaagcaaagaaguacagaauacauguuggaaagauuuccagcaugauagugcacaaaaacuggugcaguagucucaguucucccuaaggcuuuaauguauuucaucaucuggucauugcucgaucugacaaauauuuacugagcauauuggagagacuugcugugagaggccuggcuccugcuuucacggaguucaaaaucuacuaagaagcugagauacucaagauccacauuucuacuaggauggucuguacaaggguuuggauuguuguacuaagugcugcgcacugacuccgaaaaucaugacuuauuuuuggauaugagcaacugaaauuggccuaaauguuaagaaacggugugccauuucaaaagucuuugaucauacaguucagagucaaggaucagucaauacuucaagaaacuccagccuggccaacauggcgaaaccccgucucuacuaaaaauacaaaaauuagccagguaugguggcacaugccuguaauuccagcuacucgggaggcugaggcaggagaauugcuugaacccgggaggugaagguugcagugagccgagaucgcgucacugcacuccagccugggugacagagcaagacuccaucucaaaagaaaaaacuucaagaaacuacccauguggucaugaaaccaagaagcaaggcaugcugcuuuggcugcacaaaaauauacaguacagaagaccaacagaaccacaauuccugaauuucuuucucuuuauugaagaaauuaauucuaacacauacaccuucuuauauuuaggcuaggacaucuuauaacuaaaucaaucuauacaguuaaucaugcauuuaagaauguguguguuuguuuuuuaaagugauauuuauuaaaaggaaaaauccuggcuaucuggacacugagaaaugcacaagcuugcaaaaaccguaauuuaaucagaaaacccagauacaguaaaguuacuuuucauuuucuuuuuguuucagaaaccuugcaagaaguucuuucccuucuugagggcaaagcuuacgaacuggaaaguuucauuuuaauggguucuuucuuggggcaaaaacaugcaacaccaaauauucuagagugucugagugcaaacaucgcagaugcaguagugcaaaggaaaagcaaacacuuuaaaaucaaguaugucuuaguucaaauccuguguuuaccaccugcgaagugugugagguagacaauuuauuuuuccaggcuuccauuuguucuuccguaaaacaauguugguagaaucuaccucaucggcuguugcaaaacuaaaugaaaugugcuuucaauacacuggucauaauuaugcagguggacaugcugaauuuuuacaccgaucucaauauacaugggcuuuguaacugcaaugauagcucaguggagcucaaacuggauguguuucuaaaaguccaaaaaaaguuuggacuuuuuuuuuuuuuuccuccauuaugacauuuuacuucuugcuuagaugagaagcuaaacccuccccggaggcugggcuuccuaaugagcagaauaaaguucuaaggaacaaccacaacagaaccaaaggguagacugaaaguagaauucugccauugaggaggcuuacuggccuuccucccuuaaaagcgugagccacuauguggcauguucagacuccuucaaacauagcuggucccagaugucacacgaaguuuggaaagaggaaguuuggcuguucaaaaauaaaagcagggugcugauaaggaugaugaugcuacuaaaacagagugagagauuucuccccgcaaacccuggccacggagugcugugcugguuugcugcgcugaacaauggaggaggaagcccaggcgagaccucguccacguuuauuagcauccugaaagguggagucugugccuccgaagcccagaguucucuaagccuuuauaucucgauuaaauggcugagauuguccuuguguacuuggguggauugauguuauuuccaaagcaugcaauucauuucaagaggggagagggaggauuaaguuggaaauauuuuucuauucaaggaggaaaauuaaauauaacuggaaauguuuucaggaaaauguuuuuauauuucaauguuuccccagagcacugugaucccaauacaucacaggacugugcuagauuaaaaggaaugaagacaaaaugaauuuaaauaaaaacugaaacugaccagccaggcuuuauucuccauaucugaggaaacaacgaagcggggggaaacuacaaaugaaccaaaacaagaaauaaaaaucaacucaacuaaaauuuuaaacucaaaugaguguuucaauuuuguuuuagaauuuuuucaaucuaguuuauuuucauagccacaaaagcuuuugaauagccaugaauugauagccacuugauugacagaaccauuaagacuuuuuugguuguuuucucuuaaucauuuuccuuaacgcuugaauccgcugauacucaguuacagaagacgacuugcuugucuuauaguucuuaggucauuacaaguacuuaguauuugcuaauaaucaacaccaacagcuccaggaaauguguacaauuagacagcugguuuaacugguuguguugcauuuuuuaaaacgugcauaccacccccuuuaugagcccuaaauaugacaggaaaaauggaauguacaggucucaguuauccuuaucaaaauaaacacauauuuuuaagaggaaagaauuuugucaguuaauccuguguuagaucugugauguccaguagccauuagccacauguagcuauucaaauuuaaauuaaaacuuuaaaaaaauccaaaauccaguuccuccguagcacuagccacauuucaagugcuccauagccacauguggcuagcggcuccuguacuggacagggcauccacagaacaguccaucaugguggaaacuuccacuggacggugcuagacuagauggaagaacggaacugugagccuuggguauuuacauuuauuuuuaaagacguaggcugggcgugguggcucacgccuguaaucccagcacuuuggaaagccgagguggguggaucacuugaggucaggaguucaagaccagcccggccaacauggcaaaaccccgucucuacugaaaauacaaaaauuagccgggugugguggcacaugccuguaaucucagauacucaggaagcugaggcagaagaauugcucgaaccugggagguggagguugcaaugagccgagaucgcaccacugcacuccagcuugggcgaaagggugagacucugucucaauuaaaaaauaaauaaauaaauaaauaaagauguacacaaaacaguuuaauuguggggucacuuuauagaagcuucuuuaaagcaucagcuuuccaacugcacacaacuguuuccccuaagcaacuuccaaggcacaaacccaguauacauucucuccuaagcauuaucucaguuguacauucgauuguagaauaucuuucuuccuuaaaaaaaaaaaaucucucacccaaaacuuaagagaaaggggucauuuacaggagaaagggcaaaucauuauuuuuagauggaaagaccucccuaagucaacauuuaaauauuaaaacauguagcagguaguaccaaaggguuucuccuucaucacacuuguauuucuuuacugucgaaauucucugcccaggagucagcucugugugagcugaaagcaaguguucuguuugcuauugcacauccauuacaagcacagugccugccugggacaaaacagaugcuuaaauuuuuguggaaugauugaaugaaacuuaagaagaaugguauuuugcuaaagaacagcaaacauccuuuuagagccugguuccaauucuuuauauuuggauagcaauccacccuuuauuuucaaaugcaaacuuaaaauaacuuagcagacugauucaugcaaguaugcaugcuacagcucaguaucuuuaauacucagcaaaaggcauacagcaucuaugucacaguaaaauaugagcuaacauuuauugcaguuaaacaccaggcccaacgcuaaguguuuuacauaugcuauugcaucugccccucacucugauagucucucugcuaccaggaggaggaaaccaaagcucaggggaaauuaagugacuggcucaagccacagggcuagagauguauagucagaaaagcuccccuggugaagacuauggacgaugcccgucauauagccugauuggacaauuccugcuuuaaucaggaaggcuacgauuguccucgucuacaaggaccugccuccaaggaggggcauggcucuggaucuuugcagccccagagcuuaguugagcaccugcccugcaggccucccacauauuuuuguggagaaagacucagcaguccuaauggcuuaaggcuacucagacuuggagaaggccccuucuacagaagcaggcacagcucagcacaccccgucucccucuaaaccgaggcuguggggaaaucacugugaccuugccacuauacagcagcuucaugcuuuggccaccguguugcagccucuacggccacucugcucuaguaacuggccuccuucugcaaacugaccagcugcaccagcaucacggggcuggcagcacuuccauuauucuuuuucuugcuauucagaauuucaaccuaauaacuccacuguuuuaaaaacacagugcuuuagcaagaaccuguugugcuccaaguacuggucagacaacugccuuuaaggggcucacuuuccuauuuggcccaauucccucagauuaggguuuccagaagucugaccuauaagcauucauuuucauaaaaaccacuacugacaaagcaacagguucuaaacguauacauuaaagagcuaauuuuuuguuggaucaauauuugucaagggcuugccaagcggggguacaaaaguauaauaaaggacaucaauccaugugggggaaagguaaacaaauauuaaucaagucccuagugauucuacauaauucucuguaauucuuucugcaguccuauagcauagauaacaucuccaucuauggaugauaaaaagcacugcuuguaauaacucacuuccuaaguaccugcaaggcacgaauucagggccaggcacaguuaauccucauaacucccucaaggaaaagguauuacuacuuccuucuccagaaagacaggcucggggcgucugucuggguccgaggugcccacgcuggcugagagcgcugaaguggagucagacacacaggccugccuggcuccacagaccauggugccauuaaaugagacuguccucacucucauggggggacacagagaaagcuccccaccccaaccacaggaggaaaagaugacugugggagaacacaucaccauacagcaucagugucccauuagcgcggaaggcaagauugacaggaaaaacaaacaaggaaauaguacagugggaugcgcaggggcuguaugaaggugguucuagaaaaugggguggccuggcacaggggcagccauuccagaacuaggaaggcaggguaagguacuccacauguguuggggggggcagggguggagggagugagaggggaacaaagaccaaggcaggcuaaagucagaccguguagaacccaaagccaggccaggguacucguacugccucaugcaggaaagggggaaccagaacacuggggcagggauuaaaguagugaugggagauucacugggugucacucaaagcuugucucaagucacagggcucuucuauucccccgacuuaucugaacaggagaaauccucuuggcucccagacccgccugcccuggcauucucccgcagggaaacaugcuuugguuguucagacgugacuuacuggcacuuagaggcuguuggcauggaaaaaaugaacaggcugaccuggccagaaaggagcaggugaugcagaaacccagcaaaagaugaauucacccugccacccugaguaaauuacaaagcucauaugaagggccgcagaagaaagaaugggagagaugauuuaccagacagagaaggggaagucucagcccuaggcaccucaugagcccaggagagugccaggcaaaaucccuaaggcacuucacugaguccuacaaccucgcauagacaucacugugcucaucucaggcaggggacacccaggcucacuguggcgaaagcaccuggcccagaugaguaagggagagaagccggagcacacaucacuggagcacacuuuauuacagugucuuucugccuucaaucacuugcccaguuuuguaacuucauaagagagucaugaugcccagaaccucauggccccggggcaaaacucugcaccagcucugacacucuccuuaaccugcugucaccacacgauacacaagaaccauuccucucaaaucacgaaacaaagguuaaacauauuccaccaauaauaccacgauaugcauuaauuccaucaguguggaaaacuauuccuugugggagagggcgcacagacagacaacuggaagagaaaaaaacagagagaaauccaagucagauguugugccuaacuugaggcaggacuuuuccugggauuuaaguaggucuggaggcugcucuggcacauccuggccacccaggccacgccuuacauuucuauuugcaaugcaccuuccccuccuccuccacuccccgcacuucuccccaagugccccaucacugaaaaaguucaggggccgcaggggcugagacggggcgcagggcaccgacccuuucaagcggccacggcuuugcaacauguuccugaaauuccuacaaaccaaaaagcaauucagaaucgcaggagggaggcuuauccuccacuccgcaaaccagacccucaagaucaucuuuuuuaugcugaaaaggcuuuucacaaaauauuccaaaccaucuucauagauuauuuuuccuuucucuuaaaaaacuaagcaagacuggaugucauuuagaauaccgacuucuaaaaaagggcauuuuugaacugaaugccacaugcuguauuuugccauuuugccugcgcuuccugcuuggagccugugacacagagaagccucagacacuggagcugcuccgggccacgcaaacuccgcuccgcaucuuccaggcagcccugucgcaaauaauucauguccacuacgccccuaucacacugaauacaaccacauuguacugcuggaaaugggaaaccugauucagaucacaggagaagguagaaaaacauuugguucaacacaauacugccccccuucuuuuuuuuaaagggaggaaacauauuucaaaccuaggaauagggaaaggauucaagacccaucguggaauaaaacacagaauuuaaaauagcauccgaugugacccaaaccagcaacaauaacgagaaaaccacccaguccuuccagagaugcaccuuguuucugcugcaguguugcuaaucaaaaucgaucugcccauccaagcaauuuaaagaggaagggcggcauuuguagaaaaugguacauguugauaaagcaugaccugucccacauggagagcaauaaaaggaaaacaagccugagaacaguaugcugugcucaccaggagauggaagagaagaaagccagaauaagggcagggaugccgggggaagggaggacggggugucaaaggccugcaggauuuuuguaaacagcagcccguaauggccacggugagagagaagggaaaacagacauggagggaaacguguuuacaacugcagcgacggcgggaggcggagggagggauuccccgacucugcacucugcgcucggcccgcuucgcuccgguggggccccggggcugggauguguuuuggcuccuccacccuccacccgcuuucuuaguggggggaacacaucuuguuuauggggaagguuacuccuccucugcucuggugaucgccucccuaauacuccugcugcauccuugcgggaugcccacuugacugacagacacuccagccagucgcugcccgggccccgcggaaagguggaauuucccaacgcagcgauuggccggcggggagggugggcccuggugauuggcguguuauucggaguggaaaguaguaaacaaccuugguccacggcggcggcgcgggcgcggggugcccgcucccucuucccucacccggggcgggguggggcgcgcgcgccagacaaaaggagccucagccccucggaggggagagcaggaagggcgcacaccacagccggcggagcgggcgucccccggagccccugcgccagaacugcugacuugcagcuucacaucauuuuuguucuguggaaaaccgcaaagguuuuguuuccauaauucggcuccucuucuucgucuuagguuuuagaaagucuccaaagagaauggcaauuuaguuccuccucuuuccugcccuccaccccaacccuccaccuuuuaagauuaauuuuuaguucugucuuugcagaaguuguuuuaaaucccuguacuaaaaauuguugcuuuauucacacaauacgccauuaagggcacacgggugaaucagaugccccguuagucccuuuccuugcaaguuccuggagcugugaucucacugggaggggcugaguuugggagcaggcauaaaaagaaacaugaugauauuaggcucacuugacaagaaauaagcaguuacaccuugccuuuuccacacaggauguaguucacccaggcuaucaucugacauugcuaaguccccuucugguuggucuugacucacaacccauuccucauucuggccucuccauccucacaggacccccagccaggggaaacuucccagcuuccagcgggaagugcugcuuccccaaauugggcagcaccuggggaugccucuagaugcauaaucaccucagagguccugagccagaguccagagauucuuucugagauucuggcaaggccccgggguacugauggaggacugggaagguaggagaaggccacggggagggggaggcuggacacaggagggaucuccacuucauuuaugugcucuuuggugcuucgcucugaugguaagucacguugucacucuuggccagacagccagacuguccaagcugaaaacguaaacaaaagcuccuugcaggaagcaacagggugcaaacuugccaccuggggggccucucugccaccccuuggccagcccucuccuccagcaucuggccccaccccggcccugcccgccuggcauguaaagcacccccuccucuccaagcauccguuccucagccgcuguguuccugucgcaggucccuggaugggccacacacaaaccuucacucagcuuauucuuucuaggccuuacccugccugcccgggagaggccacuguucuccacggcuucccuugcccuggccagcccacuuccugcaggagugcuccgaaaucgguuuugguagcacuguguuaagguugcagaugguguuuucaacacuguacuccgacucuacuugcagguuucuccaccucaguagacccugagcauaccagggcaagguguuauauucuaauuugugucuccaguggagacacagguccacaauaugcacucaaucaagucuugccaaacauuugcagcacucaguucucgucuuguccaacacucacaccugcuucugcugcccccaagucaaguaccccuaccuaguuucuugcuaacauguuaacaugguacccccccccaccaagugccaagcccuuguccaucacucagugauucccuguacacaugcaguuacuuguaacguaugcugcuuccucugccaguuaugcuuuucugacuucucuucuuggcaaauuccuauucugucuaaaaaucacuucuucccuuggcaacaugccacaaguuccaccugacuccucugugcucccagagcaccucagagaggccucguugcaaccucugccaucuuccgaggacauggcuacagagccacagcuggcaugguuugcuggaagaaccaagagcugaaaggcagauuuaccagguggugccccccccaggugucugcagaacccacauauuccagucuccagaccauggaagcagugcuguuuccagcuugucucugccacaggguccuucucugcucucucagccugaaggccuccucugugucugugaguggcuggcuccuucucaaccuucauucaggucuccgcucaaacaccacccucaccaccaugcccaccugccagcuacuaucacacagaccuucauuuucuucaugaggugauucugaagagaaaauaagcuugggagcuaucacccuaacuuacuuauucccucagugauggaauuugggggacauuuucaucuuuugccauuugaaacacuacaaugaacaacugcacaacugucauuucacaugugugcaagucuaugggguaaaugcccccucuaagauuggugggucaaagaauacguguuuauaaccugagagauauugccaaauucuccucuauagaugugcuauucugccguccucccagccaugugggguuguuuuccaaagaguguguuaucaaauauuuuggauuuuuuccaauaugagaagugaaaaaaugguaucuugguguaguuuuaauuugcauuucucguaugagugaaaucaaacuuuuuuucuaugcuuagcuauuuguguuucuucuucugugagcuaucuguucaauacuucaucccaaauccuauugaacuguuagccucuuccuuaacaauuucuaggagcucuguuuuacuuuguuuuuuuaaacaagggagauuagcucuuugugauagaaguuucagauauuuuucucaguuuggcaucugucuuugcuuaugguuuuuggccaugcagaaaguuuuuuuguaauuuaaauucaauuuuuaugaauguuuucuuuucuggcuucuggauuuugaguugaaacuagaaaggcuuucucugcuccaagguuauaaaaaggaacucgcuauguguucuuccaggacuuucauaguuuuguuuacacuuuuaccuuggauucacuuggagucuagccugguacaugguauaauguaugaaccuaauuuacuuucuuuuccagagaaaagaaacauggcaugauugggccauaauuuacaugccccaauccaguaaaucaagaguuuaucuuagucccaaugauuugugaagcuaccuuuaucgaauaacuaaauuuccacagguacuugcaucuacauuuggacuuucuauucuguuccauuggucugucucuucaucuauugguaucucacuauuuuaauuauuuaggcacuauggaaguuuuuaauaccugguaaggacuccuugcucuuguucaguuuuuuguuuguuuguuuuuguuuuaaugauaaccucagaaucuaacuaaaagaaaaaaaucuguuguauuuggauuuauauuaaauugaaaaacuuacggagaacugacaucuugccaucuugcuaaugaugauuauuccugucuaauaaaugugguaugucuuuccauuuauuccaguugucuucuguaucuuuuaauaguaugguuaucuuaagguguuuucucuuuuuauuuuaauuggauguagaaucuucaguaauaucaucuagcaaguuauuugcauauuguacaguuguaugaugauaaauuuguauguuauuucuggcagaagauguucuauucugugccuuuagaaggacacaaugggaugggggggaaucaaagggugauagucuuaacaauaaauagagguugagauccuaaucaagaaucaaagcaauacauucugaguuggcauucacaaaugaguaagucaaaugguguggggcauaaugcugggguggccauggaagaauucugcccaacagaggaugauguuccuuaagcuuccaacacagcagguucagagagguuaggaaaaauaagcaagggaaagaaacaaguacugaucuaacaaugacggaagcugacuccaugccuuaguggaugcuugcggaggauggcacuaucuuggcugggcugacuguauuagcaaugcauguaucuaaaucagcucuaaaacccauagagagacuggcacuuuagugugaacacguaaacugugggugauggucuguauuucacauaaguugugaucacugcaaggcucugcugguauuuuacaagucaaaaacaaguuuccucuuccacagccauauguuugaaagauaugucccuuuaagaauaaucaaacucucacccaaaacauguauuuuucaaaccuagagguuccaacuugaaauacuggaccacagggauacucagcucagauccucuuucagaaaggacuugcuguccagcuccagagugucacuagcagaugcccuccagcugcuagcucuucuaggguccacuucaacuuuuggccuaggucacacucuuccuaggcagcuccuggccaguaacugagcccagcaauggucccagggcccgguuauauccaucuaacagggggcucugcaaaugagcucccggagggcuggcagagugucuguccuaucagaguccuggucaaaccgcuccccacacccaucaucuuccuccucucuuccuuucauugguguuauccucaguaaaccuuucacaucccuaacuucaucucaguaugucuccuaaaaaacucaaauagcaaugaaaauguuuagcaaauuuugggaaaguaaaggggggaauaaacauucccacauaauguagauccagacgauucuggaacuagaaguagaaaggccucaucacacaagccaacuaaaaugcaccucaaagguuaaugucaucgaauuucaaaaguccucgaaacuuccaugguuauaaacgagcauuuccugcaugcuggacucuucaucguuggucuggauuaauccucacuuccauucuaggugguggguacaaggacuuccauuuuauagacaaggaaaaccugauguaaguaagugguagaaagcagauucaaaugcaggcaggacuaccuggcuccaaagccuuuuccuuuccagaugguacacugcccacaucucuuaguuuaucggcacagggucaagaagguggugaggguauggacugacacggcaucuacggagcuuuccauacuuauaccaagacgccccccuguaaagaguggacuguccgguagccgggcaagguggcucauaccuuaaucccagcacuuugggaguccaaggcagaaggaucacuugaggucaggaguucgagaccagccuagccaacaugguaaaacccugucuuuacuaaaaaugcaaauaauagccaggcauggugguacgugccugaaaucccagcuacuugggaaacugagggaugagaaucacuugaacccaggagguagagguugcagugagccgagaucaugcuacugcacucugaccugggugagggagugagaauuuguguccaaaaaaaagaaaaagagugaacuguuccgccuuugucugaugaaggaauauaauaauuggcagccauacacuauauucccgggucaaggaauuccugggucauuuucagcaagccuaaaacaagguguucacacauuuauuuaaaaauaucccaacaaaguguugcaaaauuucccuugauugcaaugauucuuuaagcuguuaacauuaaucuuggguggaugcaggaguuguccacuggcuuuccaaaaggcauccaaugccuuuaaggcagcauaagagaaacacugccccucucgaugaacugggucccugagucuggcaguacugcccuguucuccacugugucaccuauacagggaccccugagaagaccagugugcaugaaccagagacuggacagugccucuguuaccaucaccgugugguaucaugaagagguaaccaucccgaagucacccaacuugucagcagaacuacugggaaaagagcuuaacuuuuccuguacuuaaauucuuccauauguaguuggaguuacaggccccaaaguaaagaccuauuaagcuugccuauauugcuccuaaauucucuacucgucuguucauuauuuccaaauuuaauaaggccauacuguugugucuucauccuggucaaugcauccaaugauaccuugauaacuuuaucagagcaguagcuagcagaagcacagaggcacggaggauguuaaaacugcucaacaccacgguacaaaugcauugucagcuuauguaggagucugcuuuuuaugcaggcuuaugcaacugguguaauuuuaaaauuuuauaagccauuugaaagagcaacuuugauauuaaugaaauggggagaaauguauauacagucaaagaaaagugucuuuccuuuagcugaugucagagacucccuagaaaugaaaaauuauuacugucuuuuagaaaaacaaagguuaaauggaaauagcacuggcaggagucauaucacaacagcaaaauauaacagggccaggcaaaccaaggauauuguugcaaaugcagagccuugaucaggcucauaucucgaaccuuuuauuuuguaaagcugccaauuuuauagcacaaaaauuuuaguuagggcaccuuuaagauucacugcaucuacuaugagaagagagaaugucuuagaagaguuuuuaaaaauacuacuuugaaacacuuaugggcaaacaagaauuggaacacuaaucacuguaauuuccccaccaggaucacuagguaagacauucagagaacugguggaagcaagugaugauucagaugcaguaguagaacagaagauugccaaucaacugcaaacaaagugccgcacaggcccaucucaacugacagcaaugguagagagagaagagagaaagaagagagagaagagaaacgagagaagaggagagaggagggggaggaggaggaaggagggggaggaggaaggaggaggagggaggaggagaaggaaggaggaggagggaggaggagggggcaggagaaggaaggaggggaggaggaggagggaggggaggaagagggagggggaggaggagggaggcgaggaggagggaggggaggaggaggagagagaagaauaugagaagggaaguugggagagacacagcccgacugacucagauuccaaauuacauaugcacaaagccccucaaagguuaucaugcccuaucugauccaggguaaaugaaaacuaaauacugaggcgcaauucacaaggaaagucagagugucuacacuguuaacaacauacauugaauaaaguauuagaaacauauuuacucuucucccuacucucggugcuacugaccgucuacugaauacaagguacaagaagaguuugcuaaguuuuggguacugcccaggucguuccacggcuaacaaggcaaaaacacucauguaaacuccuuggugggccugguauguuguguguggagagggugccugaugaugucuuugaacuucacuuuuugguuucucagcuaucucagaggucuggcuguagaauuacuaauauuuuaaacaaugcaaauguaauuauaguugaagcauacucuuuaacagaaggagggaaagauuggcauuuagaagcuucauucaacuuuuggccuuuucaaggcuaaaugaaucuuagggaagaaauaaaaaguucccauugauucacuuaaaaaaagauuucuugcaauuaacagaucuaaaucuaugaaaaagggagcauuuaugguaauuuccauaaucucucacuuucucuagacauuucaaaucaaauuguaauaauuauaaaaucccuccuucucucuaaauacacacacacacacacacacacaaauauaguuaaucagcaaaacuuuuucugaucucaaggaaaugucaguuacauuuacacaagccuaacuaguuuaagcaauuuauuuguaaguagacaugccuccuagauuaggaaaaaaguguauuuagcuguauggcaugacacgcccccuaccccaaaccguaaauaguuuuuuuggcagggagucagcagaagagcuauaaaaacaucuucaggguauagaaagauguucaggacuuagaauauaccuuuucucaugguucucuuaucccaacguauaaauugugacaauuuguuuaaaagauugaacuaaacuaugauauucucuuugucuuccaaauuuauuuagacuugguauccuguucuuucucuggaauuuccuuugcuuuucuuuuugucaguaagcuaaauuacuucuccucccacaugcauaaaagcauuaauuuauaaaacacauagccauaugucauaucucauguaauucuauuuuacauuccacugccgcccagacuuaucuaacaugaacaaauagauauuauuuacuguagucagaaugagaauuaucuaaugccacuuacauagccauaaauugauuuuugauuaauguuuaagcaaaaagcaaacaagcccaucugcucugaaaacaaacaaacaaaaggaagcagcaaacgcauaguucacaggaauuucugcaguauuacuauguuucagcggcuggugaggauggaauuuuuucauugcuaucgugaaaauauacugcuugacaagaagagaacugcauauauagaugcagcuucuucucuagcaacuguuaauuuaauagacuacuacuuauggugaaacaaaaaacaaucccacucugaagaaagcacugaagaccuauaaccagcggugaauuucuuccguauugcucaguggaaacaaaagaaagcucaaaugggugaguuuuucuucuuucaggguugcuuucucuauggaucaagguaagaaggaagaaaagcuaggucuccuaucuaucucacacagcagauuuuaaaauauuuuaaaaauauuuuaaauacuuucaauuuuuuaauauuuuaaaaacuuuuaaaacuaacuacuguaucguguaccuaugaaauuucguuuucagugcaauucaaaauugcuaagacaaaccaauaagagaaguagaaacacgaccagaaggcccuguccuguuuauugguaucaucucugaggcuuccucaguaucucgcacaguaucugucaguugacagcucuaauccguuuagaguuaauuuguucugcgucuauuaugcagguaagagaaaaaaacugcugcauuaggugggaauuucacuaauaccaaugaauucccaauauucuaacuuucuggggaaaaaagaugccaaaaagagugaaugcauuuucaacaaaaacagcauguuaggauuguagcacagcagguugaaggaugaaagaaugguaagagcaauuucacagcaaccaaaaugacacaaggacacacaugccggugagcaaacaagaggcacaacuuaaugacgcaagaggaagcaguuugacuugcaacuuucaaaauuaaauucuaaccgugguaauauaaagacagcuuuacaucccauucaccacguuacacauauugccauuuauuugcuaacagcaaaaauucaaaugaguguacuugagucucuaaauauuuucuacaaacgcucacccccagacuaagauagacacugccaaagugaacgagucacugcauggcuagauuuccauguugaaaaucuuaggcucauagcagaauacuugcacaaauccuacugcaucuccuuaaaaaucacucuacaaguugcauccuaagaguucuugucaaaauuguucuuuaaagcauuacacacauaugcacacuggccuagagaacaaggaucuuugucuuucuuugccaaaagacaguguuuccccaggccuguuuuagccuucgacugaugguucugauuuugguucagaaaaauaauugcaugacuguccuaaaguggaaagagaaaaaccucaaaaauuguuaacacaucaauuacaucaaccuuuucuaauuacaacucugcauuucauuauucugcaggcaaaaugaguaccuuaagucuagagccccagguaaacaaagccuuucccuguccucauuucaaaacuuuguuuuuauaaacauuccccguccccuaaacugaacuacagcagcacaaugauccuguugugagcacugccuugaccucuauaggacaacagauuguuguucacuuagccccucagaguuaaaucaguuuuaauacagaaguuucugucuuaucaaaggaaguaaagaaguaaaaacaaaaaaugaacguauacaagcacagauuuuugagcuucgauuguagagaaaugguaguuauguggcuugccaagaaagugcaucaccuacuucugcuucuggggacagaggugaaggggucuguucuggaacuuucuaaggaggccaucuucguuauuacaucagggaaguuucuagucaaaauguuauuccugucuacagggaaaaacaaaagcaaaacacaaaagaacacugcuucuaauggcaucauagcaaggaguuuaucuagaaagaugaugccagcagucaccucuuuuccaggaagacagaaacaaaaaccguucuccucgagaggccaacaguguagaagccccuuuuccagaacuuuccaaggaguaggugaacuucuuuguaaguguaucagcacaggggagaguggugcuccauguuccaaggaagaaaagcaacccacagcuccuccugcccgugcagcagaugaccagaaagacgagaaagggaaacaaacucccauucauggugaggcugcuuguuucucaaacacacuuuuccaaugccuccacaaguuguuuguuucuguauuuugaaagcacucaacaugcagaguauuugcuaaccacaggcagaguacccagucaggauguaccaacucaaacuccucccuggggcaggcaaggauaaacagggaacagguaagagaggccuaaaaagccagguggacagagaccacaugugaccccaaacagaaacaggcugcuggaaacuaacucucucucucucuagcugauacuuauucagcacuuacuguaugucagguacuauucuaaaaacuuuacguauaguaacucaguuuucacacagaugcaauuauuuuccauacuuuagagaugagaacauugaggcauagagagguuaaguaauuugaccaaggaagcacagccaguaaauggcaggccaaggauuugaacccaaucaguauuuuuuuuuguagcucaucuccauggaguuaguuggagucucaucagcacuuccucguacagggcuccauuuuacugauuucuaucaaccacaggacauacuuuucuuuuuucuucguacccugaagaagaaaugcacuagguaacuucaauaugauggcaguaagauuguuuuucaacacauacacacacacuuucaaaaaaaacuuagagaccagaugcgguggcucacgccuguaauuccagcacuucgggaggcuacaagcgaaaggaagucaagaccagccuggacggccaggcgcagugucucacgccuguaaucccagcacuuugggaggccgaggcgggcggaucaccugaggucaggaguuugagaccagccuggccaacauggugaaaccccgucucuacuaaaaauacaaaaguuagccaggcgugguggcacgcagcuguaaucccagcuagucuacucgggagguugaggcaggagaauugcuggaaccugggagggagaggcugcagugagcugagauugcaccacugcacuccaaccucggugacagagcaagacuccaccucaaaaaaaaaaaaaaaacaaaacaaaaaacaaaaaccccgccuggacaacaaaaugagaccccaucucuauaaauaauuagccaguugugguggcauacaccuguaguccccagccacuugggaggcugaggcaggaggacugcaugaacccaggaguuggagguugcagugagccacgacugcacuacugcgcuccagccggggugacagagugagacuccaucuuaacaacuuaaugguaaagcaggccuccaguacacuuucuccucccugucuuuucuucuuuucugaagauuacuacuuacucaccguuccccauugguuuagaugauaacagaagaaacaggacacuauaaaaaccuuauuuugcaccacagaaagcaagaugugaaggcagucagguuugauaacagugcgcacuguuuuugcaguaucuuucaucacgaggcucucacaucaugugcucugagcucauguaacacacucugcuggaaugcccccauucaagaggggagagaguccgugacaguccucccugcacucacugugcuagcaaagauguccgggaaggacagaaaagaauguaaugugcaauuaaaacaagggagagugauuaauguaggcaaaaauuaaucacaagggcagugucaaaguuuggugggacaacugcguguucagaagacaccugaaaaaaguaaucccaugauaaauaacaugguaaaaagcuuagauugugccauuaaguuuucuuaauauuauggauaaaaugacaacaggcaaauuauuuucuuucccaggugaaaugaagaaccaaggaucaucugagcaaagacucaaggaccauuugaacaaagacauccacaucuauaccacagaugacuuggcaucuauggaggaguggaggugagcaccacucuaccauguagaggaagcagccacuguggaggcugggcuuguggagauuccuucuggaugcccucagaucugucauuaauggggacaaagcagaaucaagggacugcucuaucucaucuaccacuaccagcuccaccauccaggguacuguucuugccacugcaucuagaaagaagaggaaugcaaucuugcaguuagaaaaggcugucucgcugaauauuuauucucauuccucuacccaaaacuaaugaaaaugugaagucugaguggugucugaaccuaauauuuucguguccgaggcacacaagguugagcugccacuucuagccaucugaaccacccagugugagcauauauguggcugggaggguggguggugaugguggugguagggaggugggggagacuucuaaugagaggcaguagagaguagggucuaagaguagguacucuagagucacacugauuucgguucaaaccccaggucugccauuuacuagcugcacuuccuuggccaaauuacuuaaccuuucugugccucaauuuuuugucucuaaaguggggauaaauaguuguaucugugggacaacugaguauauggcaaguguuuagaauaguaccuggcauagaguaagggcugaaugagugucagcuccagcugucaucuagguguaagcucacuggcagcaggugcaagauucuuuuggauggcuaacaagcuacagcuuuggcugacagugcuguuugugaaacccaguggccucuucacuccauagucagccuuccagugcuccugcccuugguggccuuggcaggagccugggguugaguggggacucagacaacugaagcucucccagcaaaagcaggauccccacgucucccacugacacuaaaaaacaaauucuugaauuuuucccgggucugcugagugaucacaagaggacagcuggggcuggaugacagagccucagcagugacagggaagccugcuuacuucccucaugcucagagugccuuuuggccacgggcuuauuucagcugucuuguguuccauuucugaggcucuaaagggaugcucugggaacugggaucuaggaauaaaucaagaugaguggggcaagguuaauacccugauuagaucagccuggcccaacgcccuuugaccuuagaguacuggaaaagucuugacaggcaagggcaugaaaaggucaugugcuccaggggcacugucuucaaagaggagccuuccugggguaaacaggcgcaucuaccuucucaauaacagguucaaaauucaagaaagcaaacagcauucccuaacuaucaauauuccacuaaguccuagaauaguuuuaguuuuuaacaucccagauagcauuuucaauuguaaugccuggaaugagaggcagaggaucuucagggucacgugcuauuuuuuauggguuuacaugaaggaugcagaugucauuuuaauuuuuaucuuucuaaacauaguuuggccaccaucccugcugaagaccacagugaguccaaagaacaugguuaacugaaauacacagauaaucacagaaauuacuuuuaggcaaugaugucaacuuugucccacugauggaagaaaauaaaaaagcugaaauuagaaaaucuaaguuuuuucucauaaaggugaaccccaaaccuguccaauaauacucuacuaaauaaagucuguuaguaaagaagggaugaaaaaaaucaguaccuaaaagacucucaggccgugaaaaugauuuuguaaauucucaaaugggcuuugcaagccaacagauccaaaucacaacuguggucaaggcauucugcagagucucaaugcuaggugaagaaggcaucuugggaaccagcagacugccacucucucaacauugaaaagauaucuccauucuuugaaagucacuuucagccacccagaaaguuaccuggagaaaaguauggugaaugaaacuguuuagaguuugagaaggagcaggucuuuccuauguaaaaauuccaaugaauaaaugacaauaagauagaaaauugccauuaaagcauggcaguaauaauuauuguagauaagcuccaccaaagcaugacaagaucagugagugacaaugugaugagaaacaggaccuuggccaguugugguugggaggcugaggugggaggccaggaguucgagaccagacugggcaacauagugaguuucuacaaaaaauuuaaaaauuggugaaggccaggcaugguagcucaugccuguaaucccagcacucugggaggccgaggugggcggucaggagaucaagaccaaccuggccaacaugugaaaccccgucucuacuaaaaauacaaaaauuagcugggugugguggugccugccuguaaucccagcuacuugggaggaggcugaggcaggagaacugcuugaaccagggaguuggagguugcagugagccgagauugcgccacugcacuccagucuggcgacugagcgagauucugcccaaacaaaaaaacaaacaaacaaaacugguggggcacuaauuagugauggugcacacuagcuacuugggaaacugagaugggaggauugcucaaacccagaagucugaggcugcacuccccugccugggcaacagagcaagacugucucaaaaaaagaaaaaagaaaagaaauaugaaaaaagagaaacgagacaucugcauacugugaguaucagcccuaagauaucaguaacaaugcgaaaagcagaaaauuuacacuggagaaaccuggcaggcaccaccucaaucaaguguucaaggcuaagagaucaucagugguaagaugcugacaucacacagaugugacgcacugagaugcaaugucaaucuuguaguagucuuccccaaaauguauaaaaaugaguuuaaugaugagaaacauuagaaccaauuuggagcauucuaugcaacaaccuguccauacuauucaaaaauaucaaggucaugaaaaacaagcaaagauagacacauuuuuacagacuggagaagacuagauauaguaaguaaacacaaugaaggauguugggacugaaaaaggauauuagugggaaaacuggugaaauucaaauaguccaugguuaacaguauugugucauuguuaauuucuuggcugugagaauugguguauagauuauguaaaaugcuaacguuagggaaaacugggugauauuuuacaaacuuuuuuuuuuuuuuuuuuuaaagagacagggucuuaaucugucuccaagacuguugugcaguggcaugaucauaguucacugcagccuggaacuccuggcucaugcgauccucccaccucagccucccaaguagcugagacuacagccacgugccaccacugcuggcuacuuaauuucuuuuuuuuuguagagauagucucacagcuuggucucaaacuccuggcuuuaagagauuugucuugguuucccagagcacugggauuauagguauaagccaccaugccuggaugcuuuuucaacuuuuuuguaagucuaaaauuauuucaaaauaaaaagcugagagagagagaaaaaaaaaaaucaguucaguuucuccccggccaguggggucauccucacuacaaaguugcugguuugggcucuagcucugcggauuuuccucacuggacgaauuucauaauugucgcuaccacugauauuacacaauugagauucuaacugaauggagagugauggaagaacaugaaugaagaagucaugcugacauuggggaaagagaacuuacugaaaauuuuuaaaauguuaaauauuuuacauuaucuucacaaucccuguacccccaacaccuuccacagcaaaucucccucaacaauacuucaguaaucuggcuagagcccaaaacaaauacuucuuauucagaacuuggcuuugaagaaaaugcagcccuaacaaaauuuuaaguaaguuacugaaggaugcagaggcuucauuuuacaggaguuaguuccagaggugauuuugggaccagcauuauucccagaccccaaccacaucuaaagcugccaggagggucuggcuuuugauuccucugugacuccuuuccagacuaaaucaaugucacuugguuccaacaacugcagcucuucccuacucuuugaccugcugugccuaaaauuuaacuuucccaaauugaggaggguucauccuccuugccugggucaauccuugggguggacaaaagguauuaagacaacuauggaagccuauccacucugucgagagaaacaauuacuccuaaagaaaaucucuacuuaaagccacgauuaaagucacucuccucuucaucccucaacaacuugcuuugaaaggguaagaagggaaagaagaugagugcuuccacuucgcugguaggggugaaugguagguaguccuaucugcacucuuuccaucuaguccccuacacauaauagcaacaagugugcuaguuguaugcuacaguuguuguagccucuuagcagagccuucaaauccugguguguggguguaggucugugugggaagguguguggguguagguuugugugggaagguguguggguguagggguggguguguguggguguagggguggguguguguggguguagggguguguguguguguguguguguguguguguaggggggguguucucuugcccuggccaccuaaaaagccuaaguuacuacugacaaaggauccuauuccuuuucacucaauauaagccuauaagacaucucaacacucgccaucuuacaaacauagagaagcaucugggugucugggcgugcccuggacccacaaaaaucccuaaccaaaacuguuagcucugacaacgguuuaagcagaaguaauagcauauaccucugaaggcagagguuugguuuuuauugcuagguuuacuccugcucguuuauaaggaugcccuaaaugccaucucccaaugaaaacccuuccauguccaggggcaaaggaugcucuggacccucaaugcuugagccuacugaaccauccaggaccacuucgcuuggcucgucuagugaugcagagcuguuacaugguucugcaaaggauucucagagagauucccaccucacagucacugcuuugcuuucagauauuucugguaacccccagaguucagugucuuucuagcuugauuugucccaacagaauggagccuuauugaaccuauggaucaauucuggugaaaugucaaauaaggcaaaauaaaacagaaguaagugugaaggcaagaguuuuuaccagaaucugacccuuuggugagauaacucacgugacggaaagcucugaugauauugcugaagcuggaguguuuaaugaccuccauuuucucaagagcauuuucccuguaaacaaagaugacaacuguuacagccagagaaagugacagcuucugagguuuccaccauaaacacuugcugaggcuccacugaugccaggcaccauggugaugcuggugaucuaaagacaagagucaggcuuaaaagcuuugcaaacucuuucccaaaaaagguacagucuaggcaaaguucaagcuguaaacuuguaacuucaacaucagcuguuacaugcuccagcaauagaauggauuaauuucuuggggacagaggagaggauauuaaggguaaagaaggauuuuaauuaggagaugacaucuggcaaguccucauaaacccagcagcacagagcuggccacauaaaucaaacccuuguauucaggguccauacuauuacucaacaaggguaauucgaguaauuaccagaguuaucaugauccaacacauaaguucauuugaggacccugacuaugcaagcaugaauauuuuuuuggcugccucuagauagcauguuuaugaaaaacagguuaaguuacuggcuccaaauuacuuuuuaauaaaaaaagcaaacaauaaaagcuuaagcuuuuaagauuuuucuuuuuuguuuuuaaccuggaaaauaaaucucccugucaaaaacaugcaaaaugaaugauuuaugugauauaagcuuggguaucuguguuauuauuacaugacauuuccuaacagcuuauaauugccuuaaagauuguuuuggaaagguuauaccuucucccuauucccauucccuuuaaauaaacccuuguguaaucucuggaaauuuuuagacuacaacuaucaaugggccauucaaaaauggagccauugucaagucacccacaugaaauagugaagguuuacaaccaaaagagaaucgcucacuuccacaaaauagcugauggaaauacugugcuccgggggcuuacguggaacaaacauuaggaaggugucuaccugcaaacccgcucuaaggcuggaccaaaccaggggguccaggucaaucacaaguacugaaucaaccaggaaaguccacagaauacugagagccaucaaugacaccacuuuagaauuuaacuguuccaaacccuuuguuuggcagauggggaaaggagagguagagggagaucagaagagucaauacaagaaucuuggcugauuggcugguuuuucuaauaugguucauucaccacaucauguuauucuauugaaguucaggagaggguaccaggggauaccucaacccaaaaugacuucuucacaguuuuaagucuagggggaaaggcccauaauguaguccucaccacuuuuuccuaggaauggcuagcaucagacaugaccuaaaucuguagagcuaguucaacauucagguuaccaaacaaagucaugaaagaauguaauuacuaucacagacauagacugucuagguucuaaagcaauuaagcugguaacguacuauuuacaauaaaaaaauugguuucacaaaccuguaacagagaccagguaaaugugccagaaauuguauaaaccauggcauaccuuguaucaauuuuuauguagacacagcaagcaaacacaguuuuggaagauaauuccuauauuccaacuuagcauaagguaauuaacugugucuuaaaagaggaaaagaaaggagccuagagcuuuauuaggugucccaccuaacuuaaauuuguuuuucuagaaaaaaaccaugcacucaagaaaggcaaucaagaucuacauacuuaauucacauucacagaaacuugugaauauaucuguaaaaggauuaucauuaauccuucaagcuccuagaguaggaauacaauacccgggcagugguucaagaaaucuaacucgugagaagguuacacaucucagggguaaucuaauaauguaaacuuuuacaaacuuuccuuccuggucucuugccuucaguaggucauucauuuaaaaacauaaugagcuccuggaauaugcuggggacccuguggggaauaaggcacuugugauuccugcacccaagaguguagcuggggcuacaggaauguuuuaagacaccucuuaacuguuuaaccgcuaguguuuuaagacauaauuccugcccuccuggaguuuacagucuccuugggcacacagaaucugugcauaauaauagaauuacauagaaguagagggacagaagacaaaaacaaugugaguuuggggcaaaaggaagaauuucuuggagucuaaagaaaaggauccagacccaagaagcagaggaaugaaggcuauuuccaguguugaggcgucccaaacauggcacucuugacaugcugaagcagccucaaggucccugaccccccuuccucauccuuugucucucgcaaagcacaggacaaggcuguucucugaaguucccuuacccaccuagaaaccagauccccaaagaggaacacuacggccugcaauugcacccugccauccaccagcucaagacugaggaaugcaaccauacccagacagacuuuuucacaagacaauuucugccucuggagcguguucaaauucuaaagagcaucauuuacaaguaaauugcugucucagggaaauauucauuuucccugaaaaucauuuacuccuacacccccaauaccuucucaccaauaaauaaagcauuuaaggaucaaccaucuggccauuuucuugaguuuucauauuuuguaugacucccaugcacacauauaauaaauuuguuagguuuuucucuuauuaaucuaucuuuuguuuuaggaguguuggcaugaccuuuuaugaucauggggaaggaagggaucaacccuccaccgucaaagagaagagaaccagagucaucaagaucggaauguggauggcacaagccagggcaagagggugaagaugucacacagggugggaagcugggcgugagguucuacaacagauaacagugggcuauauucaugcuagagcagggucuaugcaaggaguaugccacuggcagguggguggugagauggauucugguggagagaaagugaaaaugggugcaagaaauucauuuuagaacacguugaaauccuagggucagaugugggugaaauaaauggaaaagaaagcauuuaaguagaaaggaauuaggaaaauuuggucguagauauaguuugaauguuuguucccuccaaaucucauguugaaaugugauucccauuguuggagguggggccuggugggagguguuugggucaugggguggaucccuuaugaagggcuuggugcccuccccacaguaaagagugaguucucacucuguuaguuaucuaccaggagaucuggcgucucucuuucucuucuugccaugauacaacugcucccccuucaccuucugccaugaauaaaagcucccugaggccuccuagaaaaugaucagauccuggccgggcguggugguucacaccuguaaucccagcacuuugggaagccaggguggggggaucaccugaggucaggaguucaagaucagccuggccaacauggcaaaaccccaucuuuacuaaaaauacaaaaauuagcugggugugguggcgcacaccuguaauccuagcuacuugggaggcugacgcaggagaauugcuugaacccagaagugggagguugcagugagccaagauggcgccacuguacuccagccugggugacagaaugagacuccaucuaaaaaaaaaaaaaaaaagaugaugaucagauguuggaaccaugcuugaacagccugaagaaccaugagccggaaaaaaaaaagcuaacccucuuuucuuuauaaauuacccagucuuggguauuccuauggacuacaauagucacugaugacagauuucaagauuuucggcuuaggcuagugcacaaacuguagaguccagaaagcagguuuguuuuucacacacccugagucugagacgaugggaggcuuccccagugccagugucuggcagaaaugaaaacacauggcaaaggagaagaaagcucagggaaaaggaugguccagacagaaccuaucuguguggcugugauggauaaagccauaaaggagaugaguucucugagaacucccaccccauuuagaaaggaaaagggcaggaacacugcucuagaaaucuagaagacaguccagguagacaggaaaguuucucuaaggcagugaagcuuaagcugaucucgaagggucugcugaaggaagaagaaagagauuccagguugggacacagcagggacaaacaacaagacuucaguggauaggcugcuccaucccuguugucucaguauuagaaaaccguauuuuaacauacuaaugguggacauuugauaaucaguuuguuacaacuauauggaacugcccccuaaauucaaucauacuuugccuuucacacucucauuuucauaauuaaauaguuuuacaaugaaaaacaagguacacggagaaaagcaagguuaucagguuucaccaaaacauagcaguggucaauucuaguccauuucugagaugaccuggucucuggcauuugcacauuaaaauuauuuuuaggcaaugaaugccaguauuagagucacccauuuuuaaggucauaauugcugcauauaaaaagauuuagaguuacagacuguccccaaacagcaggagcccucguggccugccucuccuggauccgagagccacaguguucuccugcuucuauuuagaguaucaugaaugcuaaauagaaauguuaaaaauuauuccacaaaacgaagcaaagcagacaucaucccccacagacccgcacucugaagugguucaccacucuuuuggcuugcaaaugcauucuuagaaguagacuccuuguuugucaucugaacccccaaacaucuuaauuacauauuuguauaacacccggauagagggggaaagaaaccaaaccucaaguuuuuuuuuuuuuaaaguaauagcagcuuucacucuggaaaaaaacaucagagcaauuccaucgcagcaguacuuugguuacuuagcaucaugucaucucagacauguguaacacgaaaggugugaaggggaaaaggacaucagaaacggcugcagcaacaaggaaucuagcaaaaauagucuucugccauucuacaugccagaugugguaagaagcucuuucagccggacuugguaaaaugccuuguuugaaucgaagucugaauuggcgguuauuuuuaaauuaauaaaguuuuucuauuuggaaggacuucuaauaacauagagcaguauccuaagaagcccuuggggacuuuuuuaaugaauuagaauaaugugcaauuagaccgacaguuguaacugagugcuucggagggcuugaaaguaguuguucucaaguaguucacguagcaucaaguucacagaaaggauucuaaggcacugaauugcucgauuuuacaaugcacugggauauaaaugaacaaaugcacuccacaguacauauuaggcauucccuaggcuuaaaaaacccaaaaacuccaaaauaggaaaaaaaaaaaaaaaaaaaccaugcucagcaaauauauuaggauaaauauguaucagaaaaauauucguuucaggauuccuuuaaauaguaaguccgccucaugucugugugucuucacagaucauuaauuucuuggcaaagaaguuggggugcagacacccuguggccacagcacuggaacugaaggucagugggaacgugaugagagggguuuugaaaagucugcgcuccucugaaaacauucugacuaugccuuuucucucuccacgguuucccaaggccacuacucuaucuuccucuguuugaauccaaacagaaguacaaggagucagauccacaaaugagucguuuuaucuugcccuaccucucugugcagucaauggccaaccauccuauggauggacagucacaggggcccaaccaaggugucuuauacgagcaggcagagggcuugcaguggcuuuuuguagguuuuuggcuggagcugaacuaacugcaaacuaaaaaaaaaguucccaacagcagcccuuccugaagcugacggucugacuguggaaguuuagcccgaguauuuagggugcugggaagacaugagaacuaccuuauguccuuuguuuucuuccuaagcaaacugggcagucuuguucaugcaaaaccacuauggagugaucacuguaacaggcacgcuggaccagagggugaaugcccccagcgggaaucucucccuaaagccuugcuuuuucacaucacgccaccuccccucuuccaaauuuuggaggcguacuaccaauaggaacucacuaucugacugauuaaucagcuuucaguagacaggagcgggacaggugugggagaaaacauuucuuuccaacucccauucuccacugcagaauaccacaauaagaaaucuuaggccgggcgcgguggcucaugccuguaaucccagcacuuugggaggccgaggcagguggaucaugacgucaggaguuugagaccagccuaaccaacauggugaaaccccaucucuacuaaaaauacaaaaauuagccgggugugguggcgugcgcauguaaucccagcuacucaggaggcugaggcaggagaaucgcuugaacccggaaggcagagguugcagugagcugagauugcgccacugcacuuccgauuguuaacuagcaguuuaaaugaccacauuuaaucagcuaagugagaguugguuuaaaaggccaauuacaaaagaagugguaaauggccuuuuaaaccaauucauaguaucuccaaaugccuugguuuaccaagucugaggguuuccuagaacucuccuuauaagcauuagaaugaaaucuaguccuggcucuuuucccaugaccacuuccucuuugguucauuaagaauauaaacauuacuuaaauagagcaaagcucccugagcuaaggggucuucaugguauacauucaaacggcaugugaacgagguuacagggcauagugcagaaucccuccucggauuccaagguggcuaaaaaugccuaugucaguggauuugccuguuuuccaagucauuugcucugaaacuccuaaauacaaauaugaaaacaacagcaugagacuucauugucauguuuauuuguuauucauucucugauucggaguuggggggcaggggaaggauuagacacaauuuuaagccaaccagccucuaaacagaaauaugguuuauucucgguacucaaauucaaaucuuaguaacauagcaauuacauuuuaaaauaaacuaucuccuugugcuugcuucuaaggagaguguuuagugggauaugaaaagagucuaauccuaggcagccguauggccagaccaauuauaaaccccguagacuuuucacacgucacagagagcaaacugcuccaggagcagcucuuaauacuuuauugccuauucaggugcaccugcacuuuuaagauauacuugucagcaacaaaauacagcacuucccucugucuuuaucacauugguugccagacaacugcacagagcuaaaguagguaauguuacaguaaacagcucccuaaaacauuuacauaugucacugauaaacaauagaaaauuuaaaagagauacaaauguacucuuggaaccuuaaaucuucuucccacugaggccuaagaacuuaaaaucuucauacaccuggcugagaaaaaggaaacaaauuccaaaggaagucuagauuuauagccuaaauaugucuuccucuagaauauuuaauacacuuaagcuuuagucauucuauacacuuugaaaaugcccuucaacgauaaauuacagucguugcauuuuucauugcaguucacuuaaauaucauuuugcuuucaggaaaacaauuauaggacaguaaaucacuuuuacauugcauuccaaaaauauuuaaguugcaacauggacaauguguagaaucacaagaaaaauacagcuuauauauucuaucauucagucuucuacagcaaacguuaaaucccugaggaaaguccuaccguuaguuugguuuuuaaauauuuagauuauuucagcguaugcacauaaguauuagugcaacaaauauuuacugaacucccgcaauaugcagucauccagauuugggguagaaauuugggaaucccccugauuucaagauaucaaccacuacuaccauaauuaccugcuucaugggcauuuaacauggcaggccccagccuaacaacucuacacacacagacuauaccauuucauccccacaacuuuccugagagguggagaucaucauucugauugaaaaguauggaaaggucaccaaggccacauggcuggugacacuggaggaucugcccaacauucacacccauaggggugaucaguauagcaugcccuccauaucugagggcuccacacccauggauucaaccaacugcagaucaaaaauauucaggaaaaaaaauaggaugcuuguguauuaaacauguauggacuuuucuccuugucauuauucccuaauaauacaugauaacaacuauuuacauuguauuagguguuauaaguaaucuacagauggucuaacguagugguccccaaccuuuuuggcaccagggaucgguuccguagaagacaauuuuuccacagaugggugggggagagggaugguuuugggaugaaacuguuccaccucagaucaucaggcauuacugagauucccugcauguucaguucacaauaggguucucacuccuaugagaaucuaggaccucugcugaucugacaggaggcggagcucaugcaguuaaugcuaguuggccugccacucaccuccugcugugcagccugguuccuaacaggccauggaccgggacuggucuguggcccagggguuggggaucccugguuuaaaguauacggaaagaugagcaugggcuauacacaaauaucacaccauuuuauaaaagggacuugagcaucuguggauuuugguaucuguugggguggucccagauuuugguaucuguugggagguaccaguuuucucagggaaaacuguauauggugccacuaauauggugccacuguauauggugccacuguauauggucuucuaagcuaugccaaguuuguaaaauuaaagaacaaaacaaccgggcaugguggcucaugccuguaaucccagcacuuugggaggucaaggcagguggaucacuugaggucaggaguucgaccugaccuccuggccaacauggugaaacuccgauucuacuaaaaauacaaaaauuagccaggugugauggcgcgugccuguaaucccagcuacuagggaggcugaggcaggagaaucgcuugaacccggaaggcagagguugcagugagccgagauugugccaguacacuccagcaugggugacagagcgagaauccguuucaaaaaaaaaaaagaagaagaaaaguuaaaaaauaaagaacgaaacagcguaauagaugaucaagucuuaggagagugacugcagacuacaacugcaacagaguguuuaggaaaaaauagauguuagcuaguaagugaugaucaaggaaaaagcaugggaaagaaugccgagcaagugggagaacacaugaguaacagcaguggggugggagacaagggcccagccuuuuggcagaaccuucagaaaaccagccuaauggcccaugccucuggaaagcagcaagaagauaagccaagguguccugggggaaagcugagucuaaugguuaggacuucacaucacagagaacagggagccaccaugguauuuugaacauaugaguaccuuaccuaaacgaguuauuuagauaagaagaagucugacaauaauuuacaggauguauuggagggaaggaaaagcugaaggugagaccgaaccaugaggcugcaccagagaaaaggcacugggacugaaagagcagaggaaaacauaaagggcauuucagaagagugaaagagauagggaggaaaguuccugaguucugccuaauuaugugagccguucaauacucaccagcaagugaggagaggaaccagguggccgugcacacagggaugugcauuugcucucuucgaccuggggagaacgggcagcccugucaauauucuccacuccuguauaggcugcugucaaccagucagccccgagaaugacaauacuuccauguuacccucccuaguuccgagugcuggcuaugcgacaaacauauuuuuaaugagaaaaacuauuuuuguuucaguuuuguuugaaccacaucauucacaaaugacugaguauaagaaacaacacaauuccaaaaauaauguugcuuaauuuuaggaugucuagucuuuuuuucccccucuuucucucucagaauaugccugaaaauagugguuagccaaguuuuuguuuguuuuugugguggcuguuuuguuuauuuaaaccagggugagaaauauuuucugggaguuuuaacuacuggaucacaaacagaaaauggggguggcagcuaugcaaaaaccccuaugaucaugaaaccaagaaguuaugguuacuaagcacugugaauuuaacaggagcuuaaaaucauggcucugacaccuggaaagaugccacugggcucagaccagcccugugcagcucacaacuucaacuggaaucaaaccugaccauauccccacuucucacuuaaaaagaaaugguuuuggccguacugguagagcaaaaccagaaaauagacuuugaauuagucuucaugcuuugcaaaaagguacuaacuuguuaagaugcauccuccaugucuaacuaagccuggucuaauaacuguuuugcaucuguccucuagcagucugcugcugauugguggugggaggggaagagggaaacagcuuaaaccauuacuccuguuuugugggcauuugaaguagcugccaggcacaugacaccacugcuccaauugguucagagugacaucacuucaugauucaacuuuguuugcauuucggcuuccuccuuuccaagggguucucaacuucacccugccaagucacuuucaaacagaaagagagaggaacagcacaucuuauguagucaugaagugucaaauguccuuuguguuucuuagcccaguuuaugagaggagaccuggagaaauaaagguuucaaucaacaccacaaugguguaugacuuucuucacagcaugagguggggggaacgggaagaaaagcaaaagguggcugcuaagcuuugaguaaguuaaaacugauggacuucaauaaaaauccucaaaguuuguuuucaagugggaaaacucuaaaauagaaaccacaugcaauacuaugcuggaaccucauuuaaaucauucacgcuucuaagacucagagaauguuucuaauuuagucaaacacuacccucucuuucuccaaaauaauuauucuuaauuuauuucaccuaacuucuguuuuuuacaucuuagcaaugugaccaccaaaagcuggagcaacugcuuucugauucagaaaauaaaaguuuauucugauuuuuauuucugucuuccauacagucaguuaccagggaacucacaaaauuuggagaguucgagcacgauuaauuuuguguguucagcucaaaggaaaaagcuuccucauaggagaaaugcauuaauggaugagcgaaugaauaagaagcuuuauaacccaaccaaccagaagccgaggggcucacuauauuaaauuauaccagcucucaauacaaugggucaaaauguauuuuauuuuaaauucuaaguuaggcuccaaacuuuacaucgggaccuuguaagacgagaucuuuuaucaugcuagacuuuuauuauccccuaggaaauguagugacauuaaccaaacacacaaagccaucucaagccuaaaaaugccuauuacuccaauccuguacucacuugcucccugccagagacaacacaaagagaugaguauacacacucaggaaaacuucgcccgggccuucgagguagggcgaggacugugcaccacacgagaugacuugaaaaccuguaggaagguuguaucucagugccacuugcuuugaggagacucacuggguaacuguuugaggguggcucuaaugcucugcaacagucccugcagggacaaagagaaauuuccaucuuucugaaggccuaacaucucuuuucuuguaaucucauugacuugccuugccuagacucaccagucaauuauuauuuaucauuuacagaguagcucauauugacaacauaccuacaaguauuuuagcacuucauauaccuuuuaugguauaaguaccuguggaagggaaagggaaaugaguuggccuggagugggaauuaagaagccaucaugaauauacaugugccugugugugugugugcacacauacacccgugugucucuccacgucugaggccagcagcuaauuccugcucaccuuucaacacuucuagucuuggcuccugagccccagguacucuauuccugaagauccuugcagauaucaaucaucccaagaaugggcuagugguuuccggguuucaugaauaaagcugucccauucucaucacuaaucaagguaagagaguuacaucuuauuucucugccuugguuucaucaucuauggaagagcagucauacuggaucucgaaacaugcauuuuagugcaucaugcacauuuaacgccucccucacgcaucacucaacugacuggcaagccaccccuuccccuucgacucucuuccaaaaaugcuuacgaacuugaaauccagcagaaaaggggccacagugacuacguacucaugauucuguuuuacucuucuaaauucacggucuacuuacuauuaacuuauauacacguuaauauuuaaguuccagauccaagggagguaagaagcagcuaauucuagggaggcagggcuagagagagugaugguaaaaucaguuuaaaaaggggggggggaggcguguuuaaaauaaaagacaacuauaaaaaaucaacagaggaagggaaaaaccagaagcgcacaggccauuuagcgcaauguagcgcgucucacaccagaaguuguuuacacacucuuggacgccugaguucuccuugauuuuuguuuuucuucauuuuaucuaucuucguuuauccaucuucuaguucaucuacuuaaccuucuuguaacucagugcugccaaguggauucggcaucagcauuuacauaaaaaacacauugcaagcaaacugcauuacucuagcuguuguacaccaaaaagaaaagacacauuuaacauauaaauauguguucacauaccaagugaagaccaauuuauguugugguacuuccgugaacuggggccuugcgauacuuaaagaaaaaauucaauugugaugucaaagagagguguuccguaauucaaacguacucaggccuucgaggucaguuuauucacauucugagcagugguuuacuuuuagcaaaauauuacccaugucauuaaauuaauauuuggguuugaaucuuuuuguuuuauaugcacuuaauguguaaaaucauuuaacuuacaguuguaaaagaucugcaagcguaaaaaauugacaccuaggccuuauaaggcuguagguauuuaaguaucuuuauaccaaguaauuuauaaugacacugagggucugugaauuuaucuuuugcuuuuaaaaggugucucaauuaccuuagaugaaaaacugccuugcccaccugggagcaucauuaucuuaucauagaaugaaguuacuuucacagugaugacccugaguauugagaaaaaguuggauuauguucauuauauucuuuuuaaugcaagcaauguaaaacguccuuuagaaauguuuccuuuaaaaauuauuuaaauuguauugcuuaaaaaauaugacucuuucaacucaguuaucacuuaagguuuccuggaauauucugcuguuuagaacauauuuguaggauaugaaauuaccuacguaugugacucuuauaagaccagagaaaaaggcuagaauuauauauauauauauauaugaaaauagcaucagcaauuccacaaggccaucaacuugggguaugaacuauccgugaaggacuagugauggcugaacuucaaccacacucugaacagcauaaaaaugagaaaacuguacuccuugaucuuuaguucucaaagugugguuugugaacgcguaaggauucugcagcuuuuucagggggucuaugagauuaaacuauuuucauacacuacuaagacacuguuuaccuuuuuaacucuuauugucucaugaaugugugccguggaaguuuccagaagcugugugauauuggcagcagaauaaacauagaagcagguaugaucauccaauugccuucuguuaagccagagauuaaacacauaaaacaaugccacucuauucauauacuggggugggauauaguuuuuauccaacauaaaaguacguuaacgcauauuaaguuuuguuacuguuucugaaucaauaaaucuuuuuaaaguuauuaauuuuaauucuucauacagcaaguaucaauggauacaacccacauaaacgaaagcuuauuggcguuuguccuagccugucugggcaccuauaacaaaacaccuuaaacuagguagcuuuuaaacaacagaaacuuauuccuuacaguucuagagucugggaaguccaagaucaaggcacuggcagauucagugucuugugagggcuccacuuucugguucacggagggcaccuucuagcagaagaggcaaagcagcucucuuuuauaaaggcacaaucucauucauaaaggucccccacccucacgauuuaaucccuuccuaaaggccccagcuccuaauaucaucacauggugauuagguuucaaugcauagauuacuggggcaacauaaacauguagacaguggcaggguuuuccauuuuuaacagugugaagggguccagagaccacugaauuugaaaaccccuggaugauuucauuuuucucgacagggaagcuacaaguagaugagugccaaauguuucucuccauuccuggccuguccccugagcccuacacugcuguguucaacuccaucuuagcuugcccccccuggaugucugaggcauuucugaccugagagaugcaagacagagcuccugccccaucugccuucuccaccacacacuucccaaacuacacugcuccucccuccccacuccuuugcagcucaggaauggaagccuccacccccuguucuguccaagccaaaaugucucagagguaucuuucacucucccagucuccauucccuucaggcuauauuuuacaagucuucaaauauuccuaaaucuauccacuacaaauugcuaugacucugguccagugguucucaacaggguacaauuuuggucuccccacccccuaaucccagguuaacaucugucaaugucuagauacauuuuugauugucaugacuagggggcggggugggugggcuucuggcaucuagcagguagagacuagugaagcugcugaacauuuugcaauacacaggacagccccccacaacuaauuaucucacccaaaaugccaacagugccaaugcugagaaaccuggcacugguucaggacugcaccccuaccccccgcccugccacuccccaacuaauuauuucacccaaaaugucaauacugccaaugcugagaaacccagcacugguucaagccaccaacaucucucauaugcacggucccagcagcuuccuaagcggucucccugcuuuuuccacuauuccuccuucuccccuucuccacccagcagcuagacugacuguuguagaaaucagugugccacucuugugcuucucacucauccccaacuuccacuguguauugaguaaauucucacucuugccauggccuacagacccucucugcucuggucccaucuaauacugugacccaucuuauaacucgacgcuaugaaaucaauugugucucauccccggccaccucccaccuccacccugccaauucauauguaggaacccuaaccccucaugugacucuguugaagguagggcuguuaaggagacaauuaagaucaaaugaggucauaagggugagacccugauacaauuggauuaauguccuuaaucagugaagagacaccacagcuugcucucucccaccacuauaugaggauacagugagaagguagcuguuugcaaaccaggaagagagcccucacuagaaccagaccuuguugacaccugaccuuggacuuucagcauccagaaccaugagaauaugcuucuccaaccaugacgcuggagagaagaggugaaguaggcagaggcaagacugggaaaguagggcugggguggucagaaagggcaaaucacgaaaugucuggugugaaaggagaaagggaucuccccagagcuugaguauggaagacuauucaacuucagaaaugaacacagagagggagagggaaugcugcaaugucuauuguuuaagccacccaggcuacaguaauuugucaaagcagccugagcugacaaucacucucaguuucccucaucuuccaaguuccagccuugcuggucaucagucugugcccaugugacagcuuuuucuucuuauccuuucuccugaacuucccauggcuggaccuuccaaucucccuuagucuaaaugccaccuuuucacagaggccucaaugacuacccagcguaauacagcaccccucaaccacaccuggcccccaacccagcacuccugcauugugaugacaguacuguuuuguguuuucuucuuagaugcucaucacuagcuuauuauucucuuuacugugcauccuaccauccccaccccaguauucuuacuauuauuauuauuauuauuauuauuauuauuauuauuuuugagacagauucucgcucugcugcccagucuggagugcaguggcaugaucuccacucacugcaaccucugccucccggguucaagccauucuccugcuucagacucccgaguagcugggauuacaagcaugggccaccacacccagcuaauuuuguauuuuuaguagagacgggguuucaccauguuggccaggcuguucuugaacuccugaccucaggugauccgccugucuuggccucccaaagugcugggauuacaggugugagccaccacacgcagcauugaagaaaucuuuucugucuugaucacugcuggagcagacagagcaccacagcugccuaauguuuguuaaauuaauaaauaagugaaugaaccuggcuuugaggaucucagauccauacaaccgggcauuuauagccauucucugagucaggcagcuuucuggagccacaugguuaugagaaugugccuugccccaagauucaucucccucucccaccuccccaaagaaagcugccauguuuguggcaaucucauauuccucuggggaccacaugggacaggaaggaguaauuaacugcaauauccacagcgaguagcuauucauauucuuacacuccagggagcaucaagucuuaagguuacauuaaaacacaggcacaagggaaguccccaguguuuauuaucugcagcuacagaguggguaaggaugagaucuggucacuucaauugaauuuacaggcaacuucucaagagcccaacuuugaacugcccaaagaaaacacaggcaaguccuacuggcacaagagaauggggugggccgauggggagugauggccggcuaggguugacauuuguuuuuuccaccauauucaacacaggcaagugcuuucgaauuacuggcucccugaaaagggggaucuggacacauauggcaaugcgaugaaugaugauuccuggaaagaaaaauguuuaaugaaacaagaaacucacaauuuccugagaccugauaugcacaagguacugggcagaucuuguaguuauugaugggaauuucagagaaaggccugaugaggcaaagcuggcugcuggaaccucaaagagacaggaaaacaaggaugagacccaugauuagggccacugugaagacuccagaagcuucugagguucgagagaagaggugaaguaggcagaggcaagacugggaaaguaggguggcugggguggccugaaagggcagaucacaaaauggcuggugucaaaggagaaagggaccuccccacagcuugaguauggaagacuguugagcuucagaaaugaacacagggaaggagaaggaaugcugcaaauauuuuaccauauugacuuuuaauuaguugagaaucaauguaacaggucuagaccucauccaggguggaggcagcaugugggcaaugguaccaagaaagcaucagaaagaagaagggcuuggaaggcaacuacagaacaggcugccccacaucaaacuuagguagaauaagacucacuuccauuguuccuucucuagccaaagcuagagaagcucugaauuucucugcauuucgaaaacacuccaacacacagagucacacaaaacucuccuuuggaccagauggacccuauccuacgcacugagagauuuggagugaaugggacaagagguaagcccagucucuuuccucccucccucaucaccccccacaccuaaccucuuccaaaaacaucaaauauuuucuuccauaaauaauugcaauaggaugccauagcuuuucccaaacaaacaauagccugauugugcccuguuugcaugggcccagcccggcauacacaaaggccugcuuucaugcgccaggccucuccccacuguagaaggaugggcauauuucgcccuccucacuucuucaacaacuucacugaggcaauuccauucggaaaggagcaacaggaagagguuguuaccaccaggaauaggagcaacucccauuaaaaagacagccauuguuccccagguuuucuguugccuuucgaccucauccagaaaguucuuucaccagaagagagcugguuugccccaagagccaaaugacaacaucuuaugcuggugauuucuuuuaaacuuuuuauuaaauuucgaauaugauuuuaaauuguaaucacugacugaaaauauuccuguuuuuaugucauguaucuucuuaacaguaucagaauagagcuaaaacaaacgcauaaauuuuuguacuacuaauuauuuuucugguaagaaaaaaagcugaacuaaaagauuaaacuaacaacuuuauaacugcuacucugaaaaaauauccuuuuguguuuaaaaacaugaaguauuaaguuuccuuucagaauguaaguuugauuuucccccacagauauaaggaagcaucauagcaagucuucuuccuguuuccaguaauucggaauggccauucucccagguagagccacgcuuauaucagauacaauuucuucuccccauuuuuggucuuccauucauuucucuuucacucuucuaauuuaagugaaauggaauuccaaauggccaagacacuaauaagcucucugaaagccaucuugagagcauauacauuuuuguuuuuaaaaccauauaaacaggcugggcacaguggcucacacguguaaucccagcacuuuggaaggccaaggugggaggaucacuugaggccagaagucugagacuaaccccggcaacacggugagacccccaucucuacaaaaaauuuaaaaauuagcugggcauaguggcacauaccuguaguagucccagcuacucaggagguugaggaucgcuuaagcccaggaguuugagguugcagugagcuaugauggugccacugcacuccagccugggcaacagagcaagacccuguggcuauauccauccauccauccauccauccaaaucauauaagggcaccgaaagcagugcuacacagggcauuaaaaaaagcuuucacugccugguaaguguugcuccaaagugauguaucauucaugccagaaagaguaacuuaaauuaaaauguauuuuaaaguugaaucuugguuuugcaacaggaucuagugacgcaagcaacccacgaugaugugcuccauuugcuauguaugguuaauaacccagugcucaaugagcagacacuggguuauuaaccaugucacauaccucaauuaucccacaauuuacaaaacauucaagagaagcuuuugcauuugcuugugcuucagcauugaaaguaaaaaacaugaacugagguaggccagaaccuauuccggaccucaucucuacuggauuaagcuauuguuguugacagucauuguuauuuucuccaauuauuaauacaauuacaaugguggaaaauauguagauguauuaauggaagggguucgugugucuucagcccacuucauccaagaaggcaacucuugauagucaggcuccucuccaccuuucucaagucuuagcauucggacauaaggaauggacuggggccgcucugcauccaguaaauugccuucauccucaccuauucuggguacuguaugugacaaucucaaaguauuuuaagauguaggguuuacugcuauucagguacggugaggccaacaguuaaaagacaauugccacugaaaaagucuguuacucacaguccccaagaagagguagugcaccaugccaaggggccacacggagaagaaccaagguugguccugaggcagagggaaugguaggaaaacauggaggagagccuuuauugugguuuccuugggaaggaauaaaucacacaagguaagcagguuuaggacuagcuggcuggaguaauucugacaggcucugggguguaggggcugucucuugccugguaucuggcccuagggugauuaagguagggcaauauuggccuggaguaugaaaucccaauaaaggugguaaggggccuggccuuuggauugguuauuuugcauaugagugaggggcguggccuuuggauugguuauuuugcauaugagcauuguacucauucacuaccuaggaacuggcuaacccuaggggggcuggucucuucagggucagcaaggccccaagaugucaaagcaucagaaguauggaaaauaaaaaggcuugauuaauacagaaagguaacauaagucaguuagaucaaaacugccaaggccccaggaaguaagccucgccccagccaagggggaugacgagaagcuuccaauucaccagcacuaucggagaagccacuuaaaccacuguuuuucgauagaagacuggaacagccuaagagacaggaagcagguuuguggacuuaaugauaacgauggucucuggucaacaacaguacauuucacagcacgugugaaggcagcuccucuggagucaagccaacuuggaguuaucuaaugacaagcccaaggacaaugccccaagcagggacccugacaguauauuaauacguaagaaauuccaagauaaaaguugggggcaagggcaaauuaguuagauaaaauacaacauaaaaaggucacguuuggaaggauggccauaauauuauacgacgaaguuuucaaaagcuuuuuuggccgggcacggugguucacgccuguaaucccagcacuuugggaggcugaggugggaggaucaccugaggucagcaguuugagaccagccuggccaauauggcaaaaccccaucucuacuaaaaauuaaaaaaauuagccgggcaugguggcaggcgucuguaaucccagcuacuggggaggcugagacaggacaaaugcuugaaaccaggaggcggagauugcagugaacugagaucgcaccauuguacucuagccugggcgacagaguaagacucugccuugaaaaaaaaaaaaaagcuuuuucaagaacaacaacaauguaaaaauaauacaauggugacacagcucacagcuggaagggcacaagaaagaguucaaggaacuuuccuaccuccagucauugacucagcuguccaagagagcuucaggacgauaacacaaucuucagccgcaucccaagagccauggcucccagaguuagggugcuaaacgguccugguaugauuucuacuggucaugucucucaaggagggcuuuuuaaaucucaacgaugugguuucgaaggcuauuaaacuauacuuuaucaaauggagacuuaaaacucugaaacaaagaacaaguaaaagaacuagaaauauuuuaucuggggaaggaaauauucagagggcacagaaaagauguccucaaguauucaaaaggguaauuaccuugagauaguugacuuauuuuuuuugagacagagucuggcucugucacccaggcuggacugcaguggcgcgaucucucacugcaagcuccgccucccgggcucaugccauucuccugccucagccuccggaguagcugggacuacaggcgcccgccaacacgcccagagaauuuucuguauuuuuaguggacacgggguuucaccguguuagccaggauggucuggaucuccugaccucgugauccgcccgccucggccucccaaagugcugggauuacaggcgucagccaccacgcccagcugauaguugacuuauuucuuaugguucacagaauacaaauagacccaacacauacaaguuauaaggaaggagaguuuucuuuguuuacauagagaaauaacuuuuuuuuuuuuuuugagauggaguuucgcucugucacccaggcuggagugcaguggcgugaucucggcucacugcaagcucugccuccuggguucaagccauucuccugccucagccucccgagcagcugggacuacaggcgcccgcaaccacgccuggcuaauuuuuuuuuuuuuuuuguauuuuuaguggagacgggguuucaccguguuagccaggauggucucgaucuccugaccuugugaucugcccgucucagccucccaaagugcaaggauuacaugcaugagccauggcucaccgcaaccuccaacuccuggguucaagugauucuccugccucagccucucgaguagcugguauuauaggcaugugccaccacaucugguuaauuuuuguauuuuuaguagagaugggguuucuccauguuggucaggcugguuucgaacuccugaccucaggugauccggccgccucagccucucaaagugcugggauuacaggcgugagccaccgcguccagccagagaaagaauuuucuaacauucuagguugucuacagacaauaugaaagcaaaugaguaugacugugacucaaugaaacuuuaugugcaacaacagguguggcaggccagauguggcagcaugggcuguaguuugccaacuccugaauuacacuuaagaaaaucauuuagaggcugggcgugguggcucacgccuguaaucccagcccuuugggaggccgaggcgggcggaucacgaggucaggagaucaagaccauccuggcuaacacggugaaaccccgucucuacuaaaaauacgaaaaauaagccgggcgugguggcgggcgccuguagucccagcuacuugggagguugaggcagaagaauggcgugaagccgggaggcggagccugcagugagcagagaucgcgccaccgcacuccagccugggcuacagagacuccgucucaaaaaaaaaaaaaaaagaaaagaaaagaaaaucauuuagaaucugauuuuacaagagaguuacuugccuguuaaguaugguacaaagagaaagacauauacacacaucaacauucaguaaguauugcuuuccucaagauuaauuuauccaaagagaccaaaauaaaacauuuuaaaauuauuuuuaccuuaaauagcaggguuuuaauuuggggguggaguguggaauuuaaucuaaaauaugugaaugcuagcuucacuagacacaguaacuggacaaacaggcugaagcacagaguggauguaauacagauaccaagcaaaccaccagcacagcuacggaccccuuaggaaagcagagagcaguacaccagucaaguuucucagagauucaagaggaaaaccacccaccacccccuccgccagccacccccacaccaugccuuucuacaaagcuggacacccugggccccaccucccaaagcuggguguguagcagccuucacuguaaccaccaaagugguucagcauugcucccaugacccaccuucacuuaguucaucccagcuucccuaaagcgggagucugucugggucaguuugcugucucuacugagcucaugccaaaccccguggcuaucccauauacaccucuccuuuccccaccuagaccccagggugcggggagugggcuuucauucuaucaucagaacacaauacguggaacgugacuuuagcaacuaggauggagagugggaaacccuccggaaccacguuccuccaaagcagcuguguccccugcaggcacucacugagggcugaaaagacacuccuggaucucacagcacaguccuugugcagcacuuuacguuggaaaacagaaccaacaaacauuuucuugaaguauuccucaaaacccaaaccagucuucucuggggcugaacccagaaacucuucaagacuauuuacacaggauuuauaaucuggugucuacucagcgguuuuauaaaaacauggagggaaaaaugccaacgcgcugccaguucacugcggugguucacguuucuugcccgguagaccaggcaauguucccaaugcccagagcccuggcaccaggcaagccucucacgccagcggaacuugggaggcugcagaacucacacugacuccauggcgucucucccagacucaccuucgcagaaggaagcccuugcaggcucucaagacccagaacuaauagaauccaaucgugguugccuugggaaaagugaauccaagcuucuaacaggagguccucaagccacccaguacccugaaguacugcuagccagacagcaaaucucugugccacccauaggcuaccuccauccucaguacaugcaggaaagagucagggucacggcagggugcccccggagugucaaagggccucagacagaguccuggaauauauagaccucgucaggguuuucuuuucuacacuagaacuauauugcagcuaccuggcaccuugagggccugaaacauucaggauagguaaaugucuugagcagcuucuuauuuuaacuguugauaagaaucuuuuacagagggcacaguggcucaugccuguaaucccagcacuuugggaggcugaggcaggaggaucacuugagauaggaguucaagaucagccugggcaauagaguaagacucugacucuauaaaaauaaaauacaaauaaaaauuagccagacaugguggugcacaccuguaguccuagcuacucgggaggcugagacaggacgauuucuugagcccaggacuuugagcuugcagugggcuaugaccgcaccacugcacuccaguguaggcaauaaggcaagacccugucucuucaaaaagaaaaaaaaaaaaaucuuucaagaacauaccugcccuagagucccugcgaggaccuagguuccacacgacuauaggcaccucaagggugagggccuugucauauucaucacuauggcuccagcaccgaaaauccuaacagucuacaguguguucucaaugaauguauauauuaaacuuacuugcuuuuaagccccuauaugccacuggugacacagguacacacaguaaucucaaggggcugaugaucauucuuauaucacaguucaaugcaaaaucacuacauagccaauauuaaaaaacaaagugaaacaauuauucacaauuuaucccaaagcuggaaacauuuuugaagaggauaaagauacugacaaauaauacggaacucuuucaacuuuagguuucaaaauuaauaaagagcuauuucacuguaguuauuuacuucgguggcuaacaucucccaguaucuuauuauuuucaacuuauuuuuaagaugaauauaucuuauaccaccaaaugcuuuaccuuugguuauucugagcuccucaaggagaauacccuaacaucauucuuccccaugccaggcuaucccacguaccuuucccaaacaauucccaaacaacauggaugugguaucuguguguccucacaacuucauuacugcacagaaauaguaccucaccaccaaaaaaucauguucauuggaacuguucucagaaaaaacuccaaucauaaggcaauguuuuauaaugagaguuuauggaucagauauucugacuaaauucaccaaaaugauuucagaaggaaaauuacuauuaucuuacagcugcuauuguuuccucuaaacuuauacuaugucagacagaaaauccgacugcuugaaagaaggacccauaaacggcaaggagacaggguauacacuaaugacaacaaagcuaugacaaaagugaaguggcuuccacauacacaguguuucacuauggcccaggcccugcuguaaacuccucacagggauuagcucauuuaaaccucacagcacaacaaucccucacuauuaaugccaucuuacagagagugaaacagaggcaugagucucaaaaauggcagcacaaggauaaaaucccaucuggcugcugaguggauguuuugguccuuauccuaucucagagaaugcauucaaaccuaaaacuaugccaggagucuaaauuuaacucaaacaagcugaagaaaaccaaaacgucucagauaucacaaagcagugcauuuauugcauaauguugcacaacaaggaaaguuucuagaaagcugcccgaacuuacaugguuacuaccaacauccaagcaaaagaaagucccaaaggacaaagaacgugucccacauguacacgaucugguucaucuauucauauauccaggaugcagccugugcucagcgcccuacuuacaggaaucugagcuuuacgauuaguaugauuuuagcugcuaaaaaugugacaccuaccucuaagucauuuggauuuauaaaaaucccaccaugcuacaaucaagaaagcauuucacugagcaacuguaagccagguacagggcgugagcugaagaaugucccaggugagugaggccguucuaauuucaacaccuaaagaacaggucacaucagacguuauaaauucuccaauuuucuuuucuuuuuuuucuuuugagacgggguuucaccauguugcccagguuggucuugaacuccugaccucaagugaucuauccaccucggccucccaacgugcugggauuacaggugugagccaccgcgccugaccaauucuccaauuuucaugacauuaaugaucacguuaggcuuagggucagcugugcccuaaagcucucacaucaauguuuuauggauguaugggccuaacacugguauacagauacccuuggcuauaucccucuuacuaaugccagagaacggguguuucuugccacagugccacuccuggcuguccagcacauguucacaaggacuaggaaaaagggaucucucccuggcagucagcuucucuuuucacaguguugaaaacucugugagauaauuuccuuaggcguccugguaacaccuauuagaaaguguuuauuuaauauuuauucccacaaauaccaaugagagagagagucuccuacuauucaacaguuuuuuguuuuuuuuuuuuaaucaagaaauaguugaaaaggaugggagugaaggcacuuuaagcccacagaugccagcagaggugggacaugacaagggaggcuggggggcuggccccaaacuugucccucccaagucagcuuggacaccacacagcacuucgugcgcccucggcuggcuuagcacauggacaaggcauugccgcuggagucccaccuucuuagagacuccugaaaaggagcuccacgccaccccccacaccucgcccugugccacucuuccacuuguccuguccacucuggacauagagccuucacgguaaaccaguaauaggacgucaacuacuuucuggaauuuugugagcccaggugagugaggccguucuaauuucaacaucuacagaaguuaucaaguuucagguuuaauaaccuagcaaguuaucagaccugaaagcaaggggccuggcaacaaacucucaaccuuucaggcaagucagacagaagugugggcaccccauaccugcuacucgcaucugcagcaagggcagacucgugggacugaacccucaucccuguggagucugugcuaacuccagguggugagugucagaacugcacugaauuguaaggcccccaguuggugucuggagaguuagacaacugguuguugguauggcaaaaccccacacauuuggcgucagaaauguuaugaguagcaacaguucagaguccuuuaugugcguuuacaaaagcaauaauuuauggcaaggacuuaucagaacuacuuuacgauuuuauuuuaguuucuuuuaaggaccaagauuaaagauuuaauuaguuaaacaagacaaccaaaacaaauacuuccuccugaccuugaguuaucacagacugccacccaaggggcaacugaaacagaaaggguggccugcauuucagaagggcuggaggggacaacgggcagugugcucucaggugcucugaaucacacacacacacacacaccauacacacacaggcacccuuuuggaacagacaauuaugaaagcacauuaaaacgcagcaugccauuuggaagucuggucuugcugcucugcccaaacacaggguacacacuucagggaaaacaauccuagagaaacaguagcucugugaaaaaugagaaauguaaaauguuucggccaaacacaaagaaaaaaaaaaucagcgugugggauggggaggagaauaagaccuaucagaauucuuuuugcuuagcuggccaacucuggcagcauaaaguuuaaauggaaguaucuucaaauuaaaucgcaccugcauguauauaagacuccccuguaaugcuccgauaacaccucaagauugaggucaucuaaauucaaaccuuaaauauaaaaccacucccaaaagagaaugccuuugaauauaauggcaguuucaaacuuuggcaaauaauuauccuguacuucuuaucugugagaaucuaucauuuauuuuaaaaauucucugcagcggccgggaguggcggcucaugccuguaaucccagcacuuugggaggccaaggcaggaggaucaccugaggucaggaguucaagaccagccuggccaacauggugaaacccugucucuacuaaaaauucaaaaaauuagccaggcgugguggugcacgccugcaguuccagcuacucgggaggcugaggcagaauugcuugaacuggggauguggagguugcagugagccgagauugcacaauugcacuccagcgaaacuccaucuuaaaaaacaauaauuaucugcagcucccuguaucuuccaguaaacggauuagcagguauuuucugaguguccaugaugacggucuuagcacucuccuuccugccuaaggagucacaaucgcauucacaaucaaaugcaggugcugugugugcgcugcucucuuccucccauagccccguuucacuuucucuggagugcauccccauccucucaaagcagaaucaacaagcaaaccacuguccuucuuucaaaaaacaaaaacaaaaacaaaaacaaaagucauguguuuauuucuuccccucuacuugugccuccuaaauuccuugccuuagucccaaaucaguccuccaaacgcggguuacuuguaacguuauucagaaguggaagauuaccuugcaaaauggcagauaaugccccaacuagauauuucauggcauucuaaaacuacauaaaagcaagauuucuuaacauuccucuaaauaaauaauaguguaauaaauauaugaaacaggcuaugcauuuccucaguguucuuccauucccuccagugaccacacauguguacugcauggugagcccaugacugaggaauagaaauacagucaugaggcagcuaacagcguuucaaagaugaagugcauauacgauagugguccuguaaggauagaauauagcuagaaaauuccuauugccuagugacauugcaaccgugguaagauguacauguuccucauauguuuguggggaugcuggugcaaacaaacccgugcugccagcuguauaaaaguacagcacguacaacagugcacaguacauaauaugugauaaugauaauaagugacuauguuauugguuuauguauuuacuauacuuuuuauaguuauuuaagaguguacaccuucuacuuauuaaaaaaguuaacuguggccaggcgccguggcucaugccuguaaucccagugcuuugggaggccgaggcggguggaucacuuaaggucaggaguuugagaucagccugggcaacauggugaaaccucaucccuacuacaaacacaaaaauuagucagccaugguggugugugcgucuagucccggcuacucaggaggcugagguaagaggaucgcuugagccuuggcggucgaggcugcagugagcugugauugcaccacugcacuccagccugggggacagagcaagacccuaucucauaaauaaauaaauaaauaaauaaaauguaauauucacuaaguguagccuaaguguacaguauuuauccaggccuucacaauuacucaccacugacucacugacucacccagagcaacuucugguccugcaagccugacuccuaguaagugcccuauacagguguaccauuuuuuuaucuuuuacacuauauuuuuuacugcaccuuaucuaugcuuagauucagaaauacuuaccacuguguuaccauugccuacagcguucagaacagcaacaugcuccacggguuugcagccuacgagcaacaggcuauaccauggacccuagguguguaguaggcuguaucaacuaaguuugugaaaguacgcuguaugaugcuggcauaaugauaaaauccaauuaccuaacaaugcauuucucagaacauaucccugucauuaagcaacauaugacugucuauuacugagaucuguacauuuuuaauuaccuucauguuacugaauccagcuuuaaaaaaacagcaggaaaccauuuuuucacuguguuucaagucagcuacaauuuaaauaucauuaguucggugucaaccuaaaauggaaacaauuaccaguagaacauuacauauuacguuuacuuuucauuuuugguagcacaauuccuaucuaggaaaacauaauaaguuuccuguaggaaaaguaagauaaaggaauuaagaauucuuaggggucucacucacuuaagaccgcuaauauaugagaaaaaauaucuugugcuuugagaaguaagcuucaauuaccugggaaaucaacucaagcaaaaaacucuuucaaugaugcuagacaaauaaaaugcacagguagauguuugcacguccacagaaauugcagccacaaucagaugcauucuucagaugugaauucgugcauacaagcaaccccugucuuucgcagaguuaaguucaaauccuguacacacuuuguuccacaaaauugcuguuggcuugcaucucuuuugucaccuuucuccauccuuaaguccuccaagguucucucagggccaagacuguaggguucaaugaccuucccuggucagcuguaaaacuagggcuagcaccuucagaauccgccagccacacccugcuccagcucaccaccaugaguuuucucucaucagccuccaaaguccaagccaucgcuacaucucagagaugacguacaacaugugccuuuauuuuauacucucaagaugcuggauauaguaguuauuauccagaaagaaugacuucacaaucaggauccgagacuggcuauaaacagugaucgaauccucaacucauucccucucgcaccuacaggaagguauuaacaacugauccucccuuucauuuuuagaguaacaaacccagcuuguacuacccaugccuacaacagcccagauguggcacucaagguugaaaaggggccacaacuugguaacgggacacacaugaccccaugcaggagaacagccagggccaugaggaaagggacuuuggugcacaauggcagguaccuaugcccuugcugggacauggggcaucagggucauuaccagauggguuuacaaaacaccaaaacacggacagcaaaaguaagaugcucaguccauuggcuugcaguguuucagagucccugcuugcugcuagccacggggaugggggcugggagucauccuguuuaaaagcugcagugaaaacccaguguggucgucucuguucucaaugucuaccuuggaagagggaguucuuaaccucuguggcagagcaaccugaaaacagaauuauacuccauacacauagcuacaaugccucaugcagaaugcucuucccaaaaccgugcucaaggauacaaacccaggcuguccaauuuggggaaaucauuguuugaggguggcacagacaagcagucggcuugggguuugcucccugugcacagcucgaucaucaaggaaaggccucuuccgggccucaaagcucccuuugugaggaaugaggcccacugucgaggcucacacaggcagcuguaaccaggcugccccucucucuggguguuuguuuugauagagguucauuuaugccagagacaaugcccgcucucuuuguucugcccccagcaggaagcagugcagggagggggaccagcauugucacacagcuuccaauucagguuuugguggccacaacaauggggccucaagggccacaaauaaagagccgcucacggggagcagggcagagagacuggcacauguggaccccagcacaccccagguagaagucaccuccuaacaagugcucaggcucacuaucaagggcuuugagggcucugagguuggggagagggaggccaccuccucuucucuuaaguggugcugggagggagaaguaagcaagguccccggggaugacaaagccuuccuaccucuccuaccauuuaucccaacuaaaggagcaaacacucaaaaaagcaagcaaaaagaaugcacacacaugcuucguguucuaacuuaccaacaguugcacaaggaagaaaaaaagucuaaucugaauugccaaaaaugaacaauauccuuuaaaaugaagccugggcuagauggcugcaagugaaugaaauguauuacccaacugcugcuguaacacaagcccucuccucccccuucugggccucauucauaaaaagccugcuucgccccagcagcugcaggaacugggacuggauuuguguuuugugccgguguuuuccaagacagagggaaacaauugaaacagacaaucgcucagauaccaacaccaaguucgccuccccuugagaaguuugcugcagucuccuggucuaauccaaauagguggagggagggcugggagggcauccugcagagcuguucaguggcgguucuaacgcuaacacccagcguguuauuaaaggaauucccaucugcugagucacacuccguaucuuucacucccugacauuuuauuuuuuuuuaaucaaagguuguucuuuguugguaaaacggggguugccaaguuaauuaaagauugccaaauugggguagagauagcaacacaacucccaaagagguaauuuuuucauuguccacuuuuaaauggauauuaccaucuacagacuuuaugcagccugcuagaaaucuuaugagauaaggaacaacuucaauucuuaauauauuuuucuaauuuaugaauaaaccaacaaccaacaugcuucauccaggcaggaugaagcacugucucccucgcccacacccuuuuccacagcugcccucccagcccagcaucuuuuaucaccuagaagggccaaggaggcugguuugugcaacucaacaagcucuguaaaacaccaagucccuagaaaucucagaaaucaccaugagaaacgagaggcuaccaaacuuuuuagacucagcagccuucuucaaagcagggcccaaauacaagagcauguucuaauuuaccaggaaugguuuuaauacaagaauuacauaagaacagagugcaggaaaggaagggagaaauaaaaccauucuuguugcccuaauaccagagcagucuuccggugaauugauacauaaauucucuccagagacaagauaauccaagcuauuaacuguuccccucucaacucuugcaaaacacaaggcuucgaaaccuugaaggggggcagguggaggggaaagccugcuauauauuucuagaaaauaccaaauuuaacaccacgaucccagccugcucaucacugcuggggaucagccauucugggaagguaacagcagcccucagcacuccccuccgcuaaguaaacacuccuuucuaccacacucggucccccaugccggccgccucccaccucugccuguggacugacagccgaggaaacaagaaaacaagcuggagauaccaaaugaaucuugcgaaauacauggucugugauuaaaucacaauaacucuaaccuccucaaaggcaaacauaucaagauagcaagcugagagcaaaauaagcaagucuuaacagaaauuaugccaagcuuuauaaagggauuacccacaccuccuagaggcugugcagccuggaauccagggugguuuggguuuuuuuuuuuuuaaacuuacugcagcccuucuagcuauccaaugaaagcucuuacaaagaaaccuucaggucugcaguucucuguggguuuucuaugaauaugaacguacuuuacggguggagaaaacauauccaugaucauguuugaggggcucacgaaagggggaggcacaugaauuauaccaugaauacagauauaaugaauacagauuuagugagauuuuaauaccucaauauucucuggucccacucuuaaacaucgcccuucaaccaucaaaacaucuuaaauccugggguaggggcauaguuacccaaaguugugguaccuucccuaaagaaaacugaaauacauaccaggacacacauaauucugucaaguuugucccuaacugugugaucuuggacaaguuagcuaaccucucugugccucaguuucuucauuuauaacauggcucuaauagcagaacgaacccuugagaggcuguugcaacagcugguacacaguaagugcucaauaaauauucguugcuguuauuaacauugucccuaugccaucucaccccccauauaagcucucugcuaacuuuccaacacagagaacaaaauccaaauucuucaccauggcuccagggcccaugugaucuaauagcccucucugccugucacucaccaggcuccagccacccaaccucaucucauccuccucacuggacaucccacgugcauccugugugcaccagacagucuugcuggugcuuccagacucugacuacuucucuccacugaccaucuccaccauccuggucuaagguucaucuucucugcccuacacuggggcaacagccuacuccuacuggucucucuacuucuguccuugcccuuacagucucucuuaacgcagcugccagcaugguccuguuaacguacacaccagcuccaaacucugccaucuccuuucagagucaaagccgaaguccucaccguggccuccagggcccuacauaacugacucaguuuaccccaucccccaccaagaugcaccaagcucuccaagcuccucgccuuucccuucccuuuccuuuaggucuucguccaaaugucaccucucuagagaccuucucugaauacccuacguaaaaagguacccggauaccugccuggcaccacguacccuguaccccacaccuaacaugugacccagcccucccauccccuucccuacuuuaauaaaagcuccacagaggcagaggccucauuuuguccacuucuauaacccugacaccaggaacagugccuggcacacagcaggugcucaauaauauuuguggagcgaauaaucgaugccaucauggagaucuuucccucgcuggggccuaccaccucauguuccucuccacgucuucucauggcugauucacaguggcagggcaaauguccccucuucagaaaggccuucuaugagaauccaacuuaaaagucuccaucacaaucagugagucuguauuuuuuucauagcacuuaccacugucugacauuauuuucugucuacuuguuuguugucuguuucuaccacuagaauguuuccauuuguuuuccauuuggagaauggaguuggcuuugucucuguaaccccaaguagcuacgucagcacaacagaaugcucaguccguauuuguugaauaaauggcaauguauauacugacauucuuuaaaaacuaaaagcacacauccagaagaggaaccgggagggcucugucuuaccccagaugacacauacccugcaggugcaugugcauggaaugccuugggcaccugaaaacaccaccccgcucccccaaccccaaaugaagagcucuccaucugaccugggagaagcacucagaaccuagacauggcuccgacgcaaagaaaaacaauuugaaguuacuaaauaacagcccaacaucugucaccacauaugaacaacucuaugcacagguaacgguccacucgccaugcucacuguccaaacacccgggcaucagguuuaccuucccccugagugggcuuucgagcagucaucacagcugccugggagacacagcucuaaaacggggcucgggcugcagcccaggggccaacacugagcucccaaagcuuuggaugcauuuccuacucagcauggacaucaggugacuuccuuaagaggaaaaaucaccccgcaagacugcugagaaagcagguguggcauuuaucagugcugcugucauccauagagaagccaggaacaacgaaauguaacucuguguacacagaacucugccaccccacacagggcagauggggcagccaucagaaaugcggggcauggacccaaacgccagcauagcaccacacccccaaaugaggggggaacaggcucagcaccccaagacauccaagcaccauggcuuuuacagcuagaugcacucuccacaagccaacaggagucgcgagugagagccuucgaacacauccagugugaacaugcauucagcaaacauuuccugagcccugcuuugugccaggcuguucucagugcucaggauacacaaggaagaaauaaauaaaagauaagguuucuguccuuguaaagcuuauauucguguccgugugugcaugccuguguguauguauaagaauacauucaauagacacaauuauuaaguaaauuaagucauauguuagaaaauaagugcuguggcaaaauccagauuaaaaucaccaaucacuagucaggagaccccaucagcuacgcaaagaccauacagguagugugcagagacaccagagaggucacccuguuugaucgacaaaaguaugcucauuagaagguaaaccacaggacuauggggucuuuaucucuuuucucccugcaggauucucagcucaagaagagcaccuggcacaggucagggacucagaagcauuuguugaagaaauggaagugcucacccacugaguucuugcuucugcagcauuccuggcagguaacccucucgaguuggcugaaaucuuuccaagaaugaaaagcugggcuuuuacaacaaacuaacaagcaaaccccaaccaaccacccccacacacccccaggcgccuuuacuguauuacuuucuggacccucugagacacacacagucuacuacuaacgccagcacaugcugugaugggauucccccagcacagugcccacacgaugcugggcccacacagccugugacaccugcuggccacuucgcucccacggagaagccucuuucacguucauaugugcuggggaucugugucugcugagagcugagcugccugccugggaucagccagauggagcaggcagagacggcacggaccacacuccagaggaacacgccauggauggcuguauuguugauguuucagauauccaaaaaguaaauuauaaaucuuagcggugauuuagcuauccuauuugccaaagguaguuuacacggguguuucaaauuacuugguaagaaggcacaggugacacgaagggaccacccacaaauaucuggcauguuccagucgcaugcauggcaugucgcauguggugcgacaguucucaggaaacagcauuuguaaaaacaugcuuauuaaaaaauuagagagauuuucuauaagaaacacauaauaggcgcaguggcucaugacuguaaucccagcacguugggaggccgagacagguggaucacgaggucaggagaucaagaccauccuggcuaacacagugaaacccugucucuacuaaaaauacaaaaaaaauuaaccaggggugguugcgggugccugcagucccagcugcucgggaggcugaggcaggagaauggcaugaacccaggaggcggagcuugcagugagccgagaucaugccacugcacuccagccugggcaacagagugagacuccaucucaaaacaaaacaaaacaaaacaaaacaaaaaacaagaaagaaacacauaauaaugcuaaucuaaucauuuguguauuuuuaaguuuuuaacuuacugauacaugucaauguguuaagaccaaaaaaauacaugaauuuaauuuaagucuagacggcaaagucaaauuaauguaguauacaauuuucuuaauaaacuuuuccuuuccuacccucuuucgccccauuuugaacuuuaaagaaaaauuugccuuuuugcugcuuccuaaacaaucuaugacugcuacaauagucaauauuuucccacuuaguuugcuuauggaugugaggguuaaauguuaugaacauaauuuagugcuuacaacaucagcaaaucuggcuucuuccuugagcugauacacagugagguuaaggucagggaaacauccgugccuucugguccaagcugagagcauugcuaagguaagcaaucaaagcugggaaggcugggguuggggaggugucaaggaugacacaauacaaaugcuaaagucuacaaaacaagguugaagacucaaguccacagcagcagugguuaaggggcgggggauucuugcuugaagacgacaccaggcacauuuuccaguuggagagcuuguagugaauucagaucacuugguauuucaaguguuucccaaacuacuguagaugaagggcucugaaauuauuccauuuugaaacucauuacugauuuuguuacaaccaaauagcagcaaacauuuguacagcaguuuccaguaguuguacauaaaaaugcuuuggaacacauuacuugggaaauggaacuuuacacagacaaaucagaaugccacuuaccuaauggagacaguuugcuuacuaauuaauucucaaguccauuuuguaaauaaaaacagaaauggggccauccuggagaaucaugaugcuguuaacugagcuacauggaaggcgcaguuuuccuccucuuaucacuggucuuuuccuucucacacuaagcaaucugagcaccacggggggcaacaccugcucucuaauacagaagagauggguguauaccuccauucuaauacagaaugucuccauauacccagccauuucuagggaaaaucaucucugacagcuggcaugaaaucaauguccaccugaaaaguaccuuugagggccaucuaauaaaggccaaaacuauggccacgaauccaaaacugcggaagucuagacuggcguuucuaaauaagcuagagaaaaauacucaaugugcgacaucuuguaaacucacagcugcugaagaacagugucuuucagucacauagcugaacugaaugcagaggacacugccauuugugaccaacauuuccuuucuagggaggaauacccaggacacuuguuacggcugcuaccuaagugcuaagauagggcgcuucgccacugugcccccugcuucaucucaaaaacuaaaauuuuccaucaaaaauugcccucauuuugugccuuuuugcaaaagugaagcuaucuaaauucuagcaaaggaacgaacacagguauuucagaauaccccaccuuuaagggucucaaagauuccaggguguucccucuuaggauggaguuuuaucuuggcugaaauaaaagggucuuaauaaagucuuuuuccugcagaccucuggguauaaauuauagauucaugucaaaacagugaaagggauuugaggcaaaagauauuucuuucauaaaauauuaugcaucagaguauacguucuaugcuauaaauauuuagcaagggauaaugugacauauuuacuaauauuucugucaaaauaacaacaucuaaacugucacuucaacaaggaagcuucucuuccuguuuuaguauagagaagcacugggauaucgucucuuuuccuuuuaaagaaaaauguauucugacugcugguaaaaucaggaguaacuugagucugugacuuaaagggcagaacuaagcccuauacuacagugauaacaguaacaggaacaucugauuacauauaagcuggcuccucauaaacccugauacaaccuaaggccuccauuuucauuacacaccuucaaagaugcuuuuaaaauggacuuguuuauugacaacacaagauuuuuuuuaaguacuuguuuuccuuuucuaaaggggagacuucuugcuauuugcuaauuuucacaucugucaaugcugacaacaacuggaucuguugaauaaacauuuauuccuuuugacaaagaaccuucacauaaaauugaacucaauggaacuuuaugaucggggcaagagaauuuggagcaacuucacagauuaguaauaucuaacaguggccaggcccuggagguucucuugcagugacccuggggaauggaccagucuuuguaucagcagaggacagaccagagcuuuucaggaggaagaaaaaaaacaacccaacaaaucaauacagcaauauacaaugguagacaaagcuacacgcguuuacagaguuucagcgcauagaaacauccaguucagaagccuguuaaacuuacaucuguauuuggaaucucaugggaggcaaccccuggcaaaauaucaacucuuauugaaccaaaacaaaaucuguguaggcacagaguaucaguacaaaauauccaaaaacaaaagcucacuuuuccaaaagaaaaacgcuaaguucaaggaagcagccaauaaguaagagaaguuugggcuuuugaccuucccacccucccaugccaccuaggaauauucauuuuuaaaagacugaaguuaaaauauauaauacauauaugaaaagauccccuaauuugggccagccauaaucaucuuaaaaugguaaccuggguaacaaccaccuaccauaauuuauccuuugaagauaaccacagauucaugguuuugauuuuaaaagcuucuuuccaaacaaauaaauagguaucaaaucaaaaggcacacuuuaaaaauaggaagauuuugcuaauuugucuucauuugcaaagauuaaucuuacucugaaaccucauuugagagugcucuagucucucaggaugcauagaaaugccuuauaaaugcuaaguuauauaauaaugguuauguauuuggguguuagucaucugcucuucuugcugagauaaauagcuaccaucugaaggugaacacuucaccuucccuacauuuacaauacucuaccaucaaacuuucauuuagauuagcaaauaaaugggaguugauaagagagcugucaggcauaccuaacaaaccugaaaccuaaguguuaggaaaguuauucugacucaaguauucuacauacaaugaauuuggggaccuuauaggguaauagggaaggaaaaaagauuuuucucuuaacuagcugcugggccccacaaacagggagaauugucuaaaccugagccaccauucugauccucaaacccugccaggugaggaccuauagcuagauuguguacuggaggauauuagagcagauugcuccucugccaacuucucuccuuccuucuucuauuucuucccuuucaaaccagaccacugaaacucucagucuguauuuaugugaaauaacaggaacguuaaacaugcuaccuuccauuuguacagaauugccaugcaacacaaagaaugauuaugcauuagcuacgucacauuuaccugugaaauuuaucucauuguagcacuauaacucuauuuacuaaaauauguucauccuucgaucacauaguauuuucaccaacuuaaaauuuuaaacggaaucagaaaauauacagccuuuccuaauggccuccuuagguuuucaagcuucuccccaccuucuacuuuuuuucagaugguauaaggacuuuucaucugugauaccaauggguacuuuugguuggaaaaucuuccucugacacaguccacaagucacacauuacacaccuaaguggucacaaacaggauuuuaaucuaugugaacagaucaccaaucuugguuucauccuuuuaugaguaaaaugucauauaaaaauaaacuccuuaauacauguaauaaguuacaagugaaguaaaaacuaaauauuagaggaaaagauacaaauaaguuaguuguugcuuuuuuaaguuuuucaagauacagaauaucauuacagcuguugcauuugaaagaugaugcaacagacaagggcaaccacacccccaagaucuuugcagcuccacaagaauaggauuuagacccuuaaagaauaugucuuaacauuuaucagucaauaauguauuaggcauuuuuaaguaauuucuaaccaacaacccaucaucaucacugaaucaucugagcaugaacuaagcuaugcaaacuucuuuaaagaaagucugggacaagcuucaaucuaaugaaggcuuaggaacagcuuuacuuugugaacaacuacagcuugcuggagaagaggcaucucacaauagcacaaaagaacacaaaaaagaaagugaucuuuuugauuaaccaacgucacuuucugcuuuguuuuaggcauuauaagguaaaugaacuaaagguaaucaaaugaugaaguucuuccugcccuaaaugaauguguguuuaguccauuuaccuacugagucaacauggaaagaaaaauaagaaagaaaacuaaauuuuguaagacaguagaaguuuuaauacauacucaguucuaaugccguuaauuuuguuuuccuuccgauuuccuuaagggaagacucugguugagucuuucucugcuuuccacauagccccucgaggcacagagacagaagggucugcugugggaagagaccauggagcaggugcaguggccccucugaggauaaaaacaacacgcccagaggcuacaaagccagcuagugacccagccuucaccgcucccagacuccaucuccccugcucccccgcuauaccacaggaccuuugcaagugcaaacugcauuugagauaagcuuccccagacaugcuuucaugaggagcuuauggcguuuucugugcucacaagcagggucuggcacugcccuaccaagggaaugaucacuuguaagaagagggaggacaaaacuaucccugauggcucuuucacauguuucuuuuaaauaaaaagagugaugaucuuucuaggcaaggacacaaguugcccaggccacccccuuucccuucaaacacccauacccaccucauauggcacauauaguaccccaaaaugccagauaagcugggccaccucacacacugcaaugaccaagcccaucuccuccauuguccucauccuuccuucgaaaucaccugucccggccucuuuccaaacccaaguggaacagagccacuugaacagagcuuccuucacagaaauccuccggaggcaaaauccuagagcacaaacuacauagaaacugaacaguuaauguacauuuccuuuggcuaagucacagacacuaaauguuggcagacagaguacaucugaagcaaaucagggccauuuucagggcagagacuugcuuuuauucucugagcuccagcaacccgccucucugacuucuuccucccauggugcuuuuccacccagauaacucgcccccaaagcugaggacccucccaaggccaugaaagggcccuggguucaccuccacugucacagaguuuaagaacacaugcccuguauagccuauuuuguuugcuuguuucuuuauuaaacuauaagagcaucauccaauuugaaaugccccuccuccaaagaaaaagcugcguggcccaauguuaaaggucuacaucagaagucacuguugcacaucauuauaauuaagaaauggcauaucaccuucuuuguaagguauaacauuuucaauguugcaauauaagcugaccaccuccucuaaggcgaggacucggcgucaggggcagggagguggugagcaaagaaagggcaaaaacaagaccuugaucacagaagcaagaaucugacauuggauuauuuuugaaacauacuacauacauaaggaaaaugaugaugcuauaaauuaaaguugugguuuucuacauuuuaaaaaaaggcuagccagccgaccuuaucaucccugucauuccaaugggaaaaagcgucaucagcacaauuguagaagccuagaacaaugugucccugucaacucagugaggguuuucuucuuucaaagauaaaucaagaugccauaaccuaggaauaauauaacuacuuacacacagagaacaaaguuggcaaucacgaucugaguuaaguuuaagguauguuugucuuuccauuuuacaagaagguaaaugaacaggaaagugagcuggaacaaguaaacugagccauaagccuacgugugcuuuuuuguagaagcacagucuaaauacacacacgcaagccacugcaaaaugacuuucuaaguuaaaagucagagaaaucaauguuugacugacuauggagcauaaaaauucuucauuugcuuucaucagcugaaaaaaaaaugcuagaaauaacuacggagaaaugguaaagaaaaaaauguaauguacacaguuuugcugaaaaccaugaagauaccagcagaagaaaaaagaaaaugaagacgacaaauguauuucacacaaagaugaccggggcuguuucugcacagccuccaccuggagcugaaucaccggccagaacagggauuaggacaggccucacuggccucccagagcugucagaccucagcagggcgggcgcauccuuggguagcccaaucaaggcugagcaguauagaccguuugcaaacuugcgcaaacugugaaguuauuuacaugcauucagggaaaagacucccccaaacagggaagcuucuaccaaacaaaugccuuaaaaauuauuuuaugaaagagaugucuguuauguguaaacagacacuaauuguugcugcaccuuggguaagugacagggcucagagaacaggaaggaagccugugacuuagcagacaacaggacaguucuucccuuugaccuuccacuggucccagauuaugacucagagacugucucccacucuuuacccaaggggagaucccugcaccuccuccucuaacauccuacaucuuuaaaaugcuccucugaaucccagaacuacagaaaccacagcacucgugcuggugagcagauuccuaauugcagaagaugcauacaacuugaugcuuucagauuagagucuacccauuccuaccaugcauuuguuccuacacaauagcauacgggcauguguaggaggucaccccacauucuuuauuaacuuagagaaaucacuauuuacacacacacacacacacacacacacacacagagagagagagagagagagagagagagaucccuacccaccauaggaacguggccugaggauccagaggcaaaucugccaucaagcguggugaacaaacuaaaaacccuacuuucccuuaagcaucacccccauuucucuuuugucucccuuucccucuccaaauucaauguucucacaccacaaagggccuccaggcacaggaacaaaaacauauacgacugauucaaaaagcagacacaugucccuaccagacaccuccagcugaguguuccaauucuuuccuucugaguugaggauacuauuuguuggugcaaaaguaauugcgguaauagaaguuucugcaaaguacuuccaauguggaacccacuucaguuagaaaguggugagaggucucuguuuuaagagaccuagggugagaggucucuguuuuaaggaucaauacucuguuuuaaggucucuguuuuaagagaccuagggugagaggucucuguuuuaaggaucaauacucuacaucugcuucccaaagguccaacauuucuugauagcaaagguggggggaggguuacagagcuuuucauuuggauuaggaagggcaaagcucugugucaccauuuucccuuugcucacgcuccaacgccuucaggauuuagucagccugaaaguuucauaauuuaaggugggugguuuugugagcauggguuucuggguuuguuugaagguguuuuaucugagagugcuaugggggcacuuucuauccaugccccuaauauagucaugaacaaaagucagguuggcacagagugacuuuauucugcucugcaggccagaaagauucaggagaggacaaaaacagagacaggugugcccagagaaugcugaagucccacuuuuaugccaugaauccuucccaggagcccagaaagagaagcucuacucaacucccuugcccgagucccagccccgaaggagguccaagucucaugaccaauuacgaaggggcgcugauggaaccagggcgcucuuguggauauuuaaacuacauugcuggcucacagaaugucgucaccaaccagaaauagugcuauuucaauccgaaacccaggcucugagcaauccucaagugggugagagagguaaggaaugucuaaggaucaauucuccaugacuugagaaaagguuaggacggcaacaaaguggggaaaggcuucacguuccacacaggcucucuagcugcccaguucucuguccuacagucaugcaggcaccugccugaucaucuugugaccagacacuggcccaguuauuggccagagcacaauguccuccccaaacuauucuaaaaaaaaauccuaugagugaaaauguacaugcaaaccuggacuuucuucccccaaugcaacaacaacaacaaaaaaagacagugguuuuucacuguauuagaggcaacagagaaauccccuguguuuccagguuccuuagaauacuugacugaaauaggcuuauagauuuugauucauccacgucuucaaauaggcaaaggagcacaaagcaagcacugagcuggaaggcacuugccacacccgaggccuggccauucgcugcagcacauggccucuuucaauggggccaucugucccagaaaaaucuagagguguuuucuucuuuguuuaauaaaaaaaaaaaauuaacucccugguuaacaauuaaaccacugaguaaagacaauuugcaauguggcuaaucauucugacucugcauuagaugagccaaggaaaccacacuguauguacccucagguuuuccuccaccuuguucuaaguguccuggcuucaaacaggugcugaccccaaaugacuggaaccaacaaaaccugcacugaggucaacugguggggaaacugaauacucaucuguagaccuaggcaacuugcuuuccaugucugagauuaacaaggcuguacucgcugaagccuaggagugcacgugauuucugggguagccacagaccaagcccuaaaagggagggugagagaggcagagucugcaggggaggggcagcagcugaaaggcugagcgcugggaccauccauaauuggauuagacagccgcaaccaacugacucuuucagcagaccgagcccacauugugcuccagcuaguggucacguaggugugcuuuguuuuaaggaaacccaauaccuacauuccugauuuacaauacagaugcuuuauuggggcaccucacauggucagacccuccugccucucuuuccuuuacugcuugagguggguggggaucacuuccugagcuccaaggaaaaauaauacaggcuagagaauauuugcaucaauagcacaaucacagcaggcuagacugcuuuaccaacacuaucgaauucaaucuucaaaguacuuccaaaggcauuccauuuauucccaauguacuggugaggacucuggaaaaguuccacaaaaccuuuggggcuaaaguccucugaacgcuaaagccugcggcccuggggccaauuaacacaccuccuauaaguauuaaaaucuaaauuuugcuacccuuccuuaugaacauuauuuuuaacucuggauuaccugggacugaaaucaugaauguuuucuagagauucuauuacuugacauucucaaauacagugcacacacaacuacuuucauaugcuacaaagggaagagggaauugugacaucugauagaaggauaaagaaacucaaguccaaaagaacugcaaguaucugacuguguacaauuaguucuugguacaaacuagauauacaguguauuguuuccaaaaagcauucuguauacaagaaaaguagauucaauuaccuaaauaacaagaugacauucugaugauuuggagguuaauuacuguaaggcacuaaccaaucaagucaaauuccaguugcaaaauugaauuuuaaaauuguaaucauaaaauuacaaacuacuagcaacuauuucccauguuuaacagcuugcucccuucuaaacacauacacauauauauauacacaugaacuucuguguguucauauucuuucugguuuaauucaaguugucgaaaaucuagacauguuguaaauacagucaucccucaguauccaagggggauugguuccaggacucccacggauacaaaauccuuggaugcucaagucucugcaauaaaauggcagcgcuugcauauaacguaugcacaucgucucauagacuuucagccaucucuagcuuacaauacccaauacaaaugcuguauaaaaaguuguuauacuaguuuuuaaauuuguugucuuuauuguuguauuguaauuuuuuuuuacuguuuuuccccccaaauauucuuaaucuguaguugaaggaauccgcagauguagaacugaaggagacaaagggcugacuaccugcaguuuuacauaagagauuagaauuacaauaacucagguaaagaauguucacaaacuggacgcuaaacuagggcauauggucaaguaugacuuaaccuagacuaaauugcucagcaggaaaauguguauuuuggccaacucugaccaccuagguugguacaccucauucugacaucaaccuaaggggucagaguuggccaaaauaaaaauucuacuagcagaaauucuuucuagcaguaaaaagaaaagggagaugcucagauauccuggacuccccagagggguaagauuaccccuaggacuucucuguuuacugccaugagaagaauaucagcuugcagcaccauaauccagagcugaaaaaagacuuuuuauacuuaaaaauaggauucaggggccgggcacgguggcucacgccuguaaucccagcacuuugaaaccagccuggucaacacggugaaacucugucuccacuaaaaauacaaaaauuacccgggugugguugcgggugccugcaaucccagcuacuugggaggcugaggcaggagaaucgcuugaacccggaagccagaggcugcagugagcugagacugcgccauugcacucuagccugggcaacaaagggagacuccaucucaaaaaaaaaaaaaaaaaaaaaaaaaaaaaaaaaauuucagaugccauaguauuugcaauagaccaaucaaaaacucuaugugcauauagcacauaaauaacuucuaaucuagccuaggaagaaggauagcgugguacuaucuauaaacccacuuugugacagcagcacuuucuagcaacagcaucgguauucuccacaaaauguagcaagugacaccuaauaaaaauaaaaggaguugacauaucuugagcauguauugauaauuaguaauaaacuagcauaaacuaaaaagugaguucaauaaguuguaucucuauauacuggcaaugagcaaagaaauuaaauacuuaggguguaacucuaccaaaacauacacaggacuacaaaaacuacaaaaugcuaaugaaguaaaucaaagaaaaacuaaauaaauggagggacaugccaugcucauggaauguaguacauuuacaccacagaauaccauucagcaauaaaaagaaacaaacuauugauaaacacagcaaccugaaugaaucuauaaggaauuaugcugauggaaaaacuucaguuccaaaagguuacauacuaugagucuauuuacagaacauuauuaaaugauaaaauuuuauauagagagaacagguuaguuuguaaccaggcaugaaggagagaggagagauagaagggaaguagguguaccuuuguggugaugacauauauccuuacuauauuaacgucaauauccuagcugugauacuguacuaguuucacaaaauguuacuauuggaggaaaauggugcauggaauuacucuuuauuauuucuugaaacugcaugugaaucuacaaguauuucaaaauaauuuuuuuaaugggggcagggggaggucucccaacaacaaauaaauuaacuugccauccuccagcagccuaggcaggcagagagcuucucgcaaaucacagcaucaugauguugggccauccagauguagaacauauucagccugugugcugccacuucaucaggaagucacagcuccaaaaagguuaauuuuuaagucucuauuuagaaauccuaucuuuaagccacauugcuuucuuagcucaaggacuauuucaguuguaacaguuuaggauuauauacuaugaaaacaauaaaaggagaucuuaaaaugagcaauuacaguaauuagcacaaaagaauuucuaagucuauuauugagcaacuuucugaaggaacaagacuauuuuaaacuaaaagaaugcauacccaagacacguuuauugcagaguuauuuguaauacuaaaaaacuggaaacaacuaaaugacuaauuuggagugauuaaagaaaucauguccaucauuccagcuuuaugcaaugguuaaaaaugcauaaagagcagguccgcaagcacugacaauaauuauaagcaagguaaauuauuaagcugaaaaaagauacagaacaaugcaaaaagauaaccccauuuaaguauuuaaaauuauacaguagaacauaugcauauauaauauaaauaaaugagagaguauuuucaaaauuaguuguaaugaagacuucauggggaaggggauggugacauuuaaaauguauuuucauuguaaaaaaaacauaaaaaucagaauuuacaaauuuagauuucuaucaaucaugauuaaaauaagauguuuuccacuuaauucaacaugguaaacaaagcugcuuccuuucaucccaaaauggacauauucagguuuuuauccaaauguguuacugaguuuuguuucuucuuuaaaagugucuagauuagggacucacaaauucaauucuuucaaggaauacuacauauuaacaggaaaguuauuugcucaaauagguuugagaaaugcuauuuaaaacauaaacaggagaccaaggcaggaggaucaccggagucaggaguucacaagcagacagggcaacacagcaagaccccaucucaaaaaaaaucaauaggagggaaauaaguaaucagccuuuugcugggcuaugaaaacauuuuaggccagugcaugaaaagaugcucagaggauuucagaguucaagaaauguuggacuacauuaacauuuaauguagucuugaaccuuaagacucuuaaaccuggaauaucacaaugcuguccaaauuauccaucaagucuacaaagacaggaaauagacucaauauagccccaguaccccggcacaguaauagcacaugguacauaaggagcaugugacaugcauaugcaaauaagagguacaaaauaugcaagguagauaaaguucuaaguaguuuacauauuugcccuaucuuguuuauacuauuuaccaaaaaaggcuaaauguuauuaacucauuauuucuauucaaaaagcauuugauaaauagcagaaauucagucaaguacuuacuacuuuacaaaaagcucagguaaauaaauauaaauggaaaacugagaaacuagguuccacuauaagcagagucuucaccagcuauggguagcucuaauggaacaguaaaaucuucuaauggauuuaaauacgaucugaugugcgacauuaguaauuuaauuuggagggacauuuauuucuagcaaaagugaucaggcaagucccuucuacacccuaaaacccauuucuuuuuugcccccaauuuuaaaccugccucacuauuaaagcuucaagacaaacucuacaaucauuuuaucaagcuccaaacaagcugcagaaguacuaaaauuguuuuuaaauuauaaaucaauuugggaagaagugacauugauaauauuccaguuucucaccuagagaaaauggcauuucgcuucauuuaaaucucuuuuucuuuauuuugaaacagggucucgcucugucauccaggcuggaguacagcggcacaaauguggcucacuguagucuugaccuccugggcucaaguaguccucccaccucagccuccugagaaguggacaugacaauuguaugccacgacucccggcuaaauuuuguuuuguuuuguuuuuuaagagacaaagcuugccauguugcccaggcugguaaaucuucuuuucuacauuguucaguaagauuguguagauuuucuguaaauacauccuacaaguuuccuauuagaauuacuucuuguuaucuggauuguuuaauuaaaaagaaaugcaguuuuauuacuuccaaaaacauuaagcaauucacuuaucuaucuaaaccguaaggagauccuuaaggagauagacugccuaaagugaauagugaggcaugauuuauaauuaguauguuaauuucaucuguaaauaggaaacuauaaaacuuuucaagguaguuuaaaaaauuccaucaaguagauaacauauucaccuuacaauuuuauuuacucucucucucuuuuuuuuuuuuuuuuuuuuuuuuuugagacagaguuucauucuuuuugcccaagcuggagugcaaugaugcaaucuuggcucuccacaaccuccaccucccggguucaagcgauucuccugccucagccuccugaguagcugggauuacaggcaugcgccaccacuguggcuaauuuuguauuuuuaguagagaugagguuucuccauguuugucaggcuggucuugaacucucaaccucaggugauccacccgccucagccucccaaaguacugggauuacagaugugagccaccacacccggccuacucuguuaauuuaaacaacuauuaaaugagacaauacacugcaaagcacuuagaaaagugccugacacaggaauaaguuuucuuuuuucuuuuuuuauuuuauuuauuuuuuuauuauacuuuaaguuuucaauaaaugcgaauguuuguuauuacauaaauuuaaaaaaaaaaaauagccaccuggcuccauucuuggccacaaacucugaagagguggaguuaaagugugugagguaugucggauaaccucccaugcaagucacuaccacagcugacaucccggagccagagaacuugaugaaugucuucaauggucacagcugaaaagggaacuaacuccagguccccaggcugacuugcccuccgagccuggagggcaaacucugcuaauuaacucucuuugcuuggguucgccucugucaucuucaccccugugccaacaggcuaucuccacagauagccugcucucgugugcccucuacuggagggcugugguuccagaguugcuccagccucggacucggcuccccgcagacggaauguccuccuccagggagaggcucgagucaagugcuaauguguugucaaccucugacuccagagaagcggauuauaugauuuaaugauaguuccgcaucagaaaagauuuugaaacguguagcucaaaacaguaaaauuucacagugauuaucugaaacugaaguaguccaaaccgcugacgguguaaccugagcaacuuguuuuaacuccucugaggcuguuuccucaucuguacggugggaauagcaguacuuaccuaaccaggcugaggauuaaaugaauuaguaucuguaaagugcuuagaaugguacauagcacagagcaguguucuuaaauauuucuugaaaaaauuaauaaaggagaagccuaccuuaaaccuucagagaaaaucugaagucgaaauuuuuaaaagcuaaauuuuagaaucaauugcauuuuaaagucaucaugaaacaugagguugcugcuacacagucacuugugcuggauuauauaacaggugaaaacuuauucucuugggaauuuccagaacucuguggcacagccaaaauacaccgaccuugaauacauuguucuggaacaaaguggauguacugaacacugaauugauguuacuacuucguaccaagcacacagcacugaaugcucucacgcucaauuaucugacagugaugcuaguaagaauaaaacauaauuuuuaaucuuauuuaaaauguauuaugcacucccagaguacuuacaagaaacuacucuucugcuuuucauggauaucuauucauaagaagaaagacagcugguuuuggggcuggugguggguuuuuccauuguuuucaaaagacagagagcuaugcauaugcugacuuccaaagaggcuaucaucagucaccggaaauccacagaaaaggucacugccagagaucugccaugugugauccacccacucucacuucaaggccacuagcaccacuaccaggcugacacaaggccccugggaagguggcccagugcaggacagacacaaaagggaccacagucaaggagcagccuuacuuucucaccucacccaagauagagagcuaugggccaagggaggggaaaucaggauauggccacccaggccagggcugcccccacuccucaacccugcuccccuggagaaagaccguacucuuaucaagggcccugugggugacaaagagcuagagagccacugugaccacuggguuucugcaccauuuggcuaaugaaaaccaugacccucucugggucucagucuucucaucugugaaguggaaggauaggcaaaaugacaugaauaacagaaugagugacuauaacccaagcccacagcuuagugucaaggauugugagaacgaagcaaaaggcaucaagcacucugaauuguucaaauaaugaagaugaugcccacaaagacagauagaacaugccucaaagcuucucaguuuuccuacgacuaagauaaccagucaccauguggcaugacuccgaggaccacguacaggcuuugcaucuucugugaaggcuucaguugcccuuggggauacaucgccguucuguccaccaacacucucucauguucucaggacauaauuaccuauuucuguucuauccucacccccuaaaagauuagucuagaaccuguucuuauuaagcucugcauugucauugcugaacacucugucaugcaguaggugcucaauaaauaucuaacccccguacacacaucaaaaacaaaagagcaucuaugggucuuuauacuguaagguuuuacuuucuucuccccuacuucccuacuauuggucccuccaucuagaccuuacgaucugcaguggucuacauuugggacccuuacaguaaacgugugccacuucucugaaaagucaugcagcugcucccagcuccgucucugcaugaccaggcaagugagugcagaccucaucuuacaucugugugguucucuuuucugcaggcugaaaugcugcucuccccaucaacugugaggaugcacuugcugcccucuugcccaccaagguauggggccuggagagcuacguuugugucugcucugacuuuggacagcccccacaggggucauuccccggcagcucauuccaucacugagaugugcugagaucccagagccgccugcacccuugagguuccucuucggucaucauuccuugcuuggacuucuuuagacgucuagagacuuccgaggucggugagcagacuguguccuuaaccagcauuuuguuucucagggccuccccgggccccucaccaccucccucucagacucccaaacccuggaacugaauucaaggcaaccuucuucccucuuugaaagguuuaacaaacagcgucucaacuuuaaccuuggcaaguacauuaaccaaguuccaggucacaugaauuaacggauggcccacuuaaaacaaaccacacugaguagcuacgaggaaugucuccacugcggcaagugcaaaauccaagugaaggcccugaucagcaaauugagcgugcuucaggacacccgccccuccugccuggcccccugccgcugcagcaacacaugugaacugacacgguaucugagcacaccccgggaaacagaccgcagcccucccuggcgcccagugauuacaggccaaggcugaaagcagcaacaagaaccaagaaacaaagccuucugugaaaccagaaaccacacaaggucacaaaaacagcaagaacuuguaaauccugaaaacccuucagugaggaauuuuccuaagcaccuguguccagcucugaaacaacaguggcuugacacauaccugagacgaugagagcacaaauccagccgccccuccggaaagaccauucaaggucacgggcguuuuaagaugugguucucuuuugggcuuaucuguggaaaaacauccaaggcacagaccaaacagcugcuuugaaaacacacucaagacagaccacauccuugcacaccgcuguggccucaggugagaggagguggaggugagggccgcccagcaccaaugucugguaauggcagguaggggaacuucacaugcaccuauguuauuucagagccugggcucaacagggagguagggggaaggagggaagaggcucuuaaaaauaaugcugacaaaaucaaguaccaagaacacaaguguccugauaacuaguaaguuucuuuuuuaaagaaauaaaaucuggcugggcgcaguggcucacaccuguaaucccagcacuuugggaggccaaggcgcguggaucaucugaggucaggaguucaagaccagucuggccaacauggcaaaaccccaucuccacuaccaauacaaaaaauuagcccggcaugguggcacaugcccauagacccuguuacucagaaggccgaggcaggagaauugcuggaacccgggaggcggagguugcagugaccugagaucacaccacugcacuccagccugggcgacagaguaagacuccaucucaaaaaaaaaauaaaaaaauaaauaauaaaaaauaauuaaauuaaaauaaauaaauaaaaauuucucuugccccuuccacccucccuucgggaguuuaaggaaaaucaccacaaaagagaaaaccaaagucagucaaaagcugcuuaaaggaugugcaauuacaugugauugagaaagucuguaugauuaaagccagaaagaaggcugcguacuuggcaaauacuaggcacuguauuuaggcaaauauucuuucaacuaucagucucuuccucccacaacacaccucccuaauuugcaaagauuuguuuaauagaccagugguucucaaaguguggucccagaccccaaaaaggaucacaugggaacuugacagaaaugcaaauucucaucauccaaccagcccgagaccugcugaaucggaaacccugggguggggcccagcccugugagcuuuaacaagcaacccaggggauucugaccugggagacccacuguacucugccuggauccuucagugcggaccagggacccagcaccagcaggggccacaggcacagaagccagguguugcucugauccuuauagcugcagagguggccaaagaccccuccccagcugcuuccccgacaagugggggcuugggacacaucccagguggcauagcuguggugguggcagugguaggaggcccagguugagacaugaggggaagaacagugucuagggcaacggucccugaacuuguuugcacaagguacucacccagaagccucgaaaacacggaugcccagucccaccccuggaaauggugauucaguuggucuagagguggggguggcagccuggcuuuggaaucgucaaagcuccccaggugauaauaaugugcaaacaaguuuagaucugccuacagucuugugacuguuaaaacagagauggggcaggacacaaaaggcaccuuccauguggagguggggggaacgaggcaauggucccgcuugcuacagcagggaggacuuggccugacccagcugggggucauccauuucugagugcuccaggggccuggaaccagcaauggcuugauacacauggacucagguauuauaaccuauuuucccucuaaggacucugggacuaaggcagguuauuauuaaccuccaagucagacaaccuccaguggagccaggacucaaaccugggacugcccagcuggagaaggagucugguuccagguuccugagcuacguaacuaguaagugagacccuaccuccaguucccugauguaauauccaauaaugagucgaguacuacucaucuuccuuuuaaauuuaauugugggaaaauauccauaacaaaauguaccguuuuaaccauuuuuaaguagagugcagcaauguuaaguaaguucacacuguuguacaacaucaccgccagccaccuccagaacuuuuuccaucuugcaaaagugaaaccaucacuccacucccuuccccaaaccaccccccacccccccaccaccgcagccaucauucuguuuucugucucugaaugcgacuacuccagggaaccucaucuaaaugaaaucacauagaguauuuguccuuuugugacuggcugauuucaccuggcauaauguccucaagguucauucacgcuguugcaugugucagaauguccuuccuuuuuaggacugaauaauauucuauauuucuucuuaaagaaacaauccucaacuuuaaaaucuaaacucgauagucaaacccugcauuuuccaugccuaaaagcauagacacugcagucccugugcaaucaaugguaaacacauccuucagucuuuuguggggaaauuugcaauauguuccccauuuuugaucugucuuguguuuuggccucuaauucagaccagaagaaucuacuuuacaacugaaucacaagggaucugagaugggugcuguagccaacgugacuuaacaggcagcauuucuaagcacaggagagagagaacuugaucugauuugaagggauucaggaaaggcucauaaagcuucagugaaugucccccgcuucuaagauccucuucuuuuugucacggcaugaugucuaaacccacagcauaguucuucagcuauuucugaauugcugagauuaaccaaaaaccaaucccaaagagauaaaaauaauugauucaaacugaguauacaauaaaggggauuuauuuccuuaaaacuggaaaaaauacaaaaauaggguagguuucaggcacaguuuauucugggcuacuacugcgguugucagugauugugccaauccugucucucaccccacaauggcuuuguccuuaggcuggcuuccccccggaucacaagaugucgucagacaccuacuggagcuauguggauccuuauucacacucagagagagcacugcuucccagagccaccaaaccacaguucugagcagcguucuaagggaccaaccugaacuguggccaggaaaugccucccugcugauuacagugugggguacaguccaucuuuugggggaggggaggacgcucgaaugcuaguugggguuaauuucacucaaaauguguggcugcuaugcagugcagauaagagugguccccagaacaaaaucugggcgcugugagcaaaaggaaaugguugcugauccaugucccccaaggcaccccauggcucaaguaaugcuccguguuaauccuugugcugaaacugcacauacuucuugagaacgccuugucuggagcgguaagcaaucuagcauuuuaacuuccccucaaggaacugauuugucccuugugaccccauuaauguuugcagaugccuugaccuucauuaauuacgggaguuuuuguaaagcugaacauugaggccaacagcagccauacuucucuuuuaggaaaauggcagccacucugagccucgagguuuacacagcccccaacacucucuggaugggacuguacaugcagcacgggggucaucugagccaccagcuacucaucuuguauagaaacaaaacaaaaaagaacugaguacaguaaccaaggaagaaaaucauaaaaguucacacgcuggaaacaacuuucuaauucucuuaucuauacuuggccacagaugagcuaagaaucaucaccaguaguuaacucaagagaggcaugcaaauaugugguaagaugcuauaauuuugagguuagaaaauaaauccauguauuuauaacuuaaauagugauuugaaucaaggaguauuaauggcuguacccuuagaaaaagaaugauucuaaccacuuacccuucagcacccaaccccuaucaaaagcaaacauauucugugauaacaaacaucguaauaucaucuuuauuugucugcccuggaaaaaacaccaaaucaugacugguguuccuguuauugauuccuccccaacaaggaaaaaaaaaaagugaccuuuuggcugggcacaguggcuagugccuauaaucucaccucuucaaaaguaaaaaaaaguuaaaaaaaaaaauuagcugggcguggugguguacauauacaguucuagcugcuagagaggcugagggaggaggacuguuugagcccaggaguucgaggcuucagugagcuaugauugugccacugugcuccagccuggccaacagagaccuaauucuuaaaauaauaauaauaauaauaauaauaauaauaauaauaauuuuuaagugaccucuugaaugaagucuuccuucauguuuauuuuuuacaaaccuuucuuagguucagaacagcuuguucaauauuaauuccauagaacagagccgaccacacuaugagaacucaauuugaaaacaacaguauaucaaaaauaucagugauuuucaaaaaauuccucuuuuccagacuagaaauuauuaaucaaaaaauuaugaauuaguaguuuuuaguaaaguugguauuucaccaauuuuguuaagucagaaaacuccuuauaaacaccuguuucauguuuucagaaauuuucaaaugauuccacaguugcuacauggucaauaaagaaaaacuucaugcuuuuacuucaauuagaauucucuguucgcaguuugggggucucacuggccaguguguguaugagaacuuaagggauguaugcacuuuagagcucagcugugcaagcugggcuuuccuuaccuacgcugcuauaaacauacugcuagaggagggacauuuaagcuacucucaugcugcuacaagauuaaaugccucccuaccuauuuaaaaaaaaaaaaugucaguggagaagaaggaaggagggagggaaggaaacucagcuugaaugucaguaacuugauaagcaugcugcugauaaagaacacccuggacuuuguagcaauugccaauaaccaaaccaauaagcaaacaauccaaacuuaaccguaaccuuaaauuuuuucccuuuucauguuucauuugaacaugaaaauguucaaaucucuugcauacguuguuauucauaagugagcugcagggggaaacccaagccuagauguaagauacacucuuuucaacaugcaugcaggccucaccagugaugucucuggaggcauauucugaccagaucaacugccucaccugcgacaucaccguuuacugggucucacuauauauaaauaacuucucugcuuacucacuaaagccuugugcaggucccucuuaccuccucaaauacguccacauguguaagcacacauaucugcacaucgguuugcuuuauucacaggaaucugagaaccccuaugaaacggcagugaggaaggggagagaggguggaauggguaccagaagggagagaggaagacaauguacaggaaaacaacaacaacaacaaaaauccuaaguaguuguguucuccaaagaacuaaauguaaauggucccagcacaccuuagaaaaacaggagcagcaggggguauguguuagucaucuuucugagcuccacgugggugcuuggauggagggaugaaugaugaauggaauacacaaacagugccacaacugacucccccuccgugaagaccccauuagauuccaaggugcacuuccucauacaacaacaauccaacucucaccaacaauccucauucgaaguuucauccacagaacaaaguccucaguagcaauucuccaccuuuaaauguucaaaaguacugccauggggacuaagacacaacugggaccuuuuuauugacuguugaucuaaaguuuuagggaucagaagucucugagaauguggugacuuuuggggacccuucuaccaagaaaaaugcauacagacgaauuuugacacaauuuugacaugguggacacucaggauuccauguuggaaaggaauuccaacuuagaucccugccggcaaguagaaccaggacacggcagggagcgggagggaccugagagacagugauuguugccuguugacagcuaacggccaacuuacacagauuccccacacccuaaaaccaucccuggucuucccugucaaaagguucucagcuuaaaaaucuaugccuacaccuaugucuuccccuuuauuuuuuauugaugugugauauuuguacauauuuaugggguuaauaugauauuuugaaacauguaugcaauguauaaugaucagaauaauuaggauauccaucauuucaaacauguauccuuucuauguguugggaacauuucuaaccuucuagcuauuuggaaauauacaguaaauuacuguuaacgauagucacccuauuagaauguauucccucuaucuaacugaauguuuguacucauucucuaccccucuucaucgcccccuuucccagucucugguaaccaucacucuacucucuaccuccaagagaucaacuuuuuuugcucccacguauacgugagaacacgcaauaucuguuuuugccuuccucuaacuuuuaaucccagcagagagacauucauucagcccauggucacacucauuaucaucuggaagucagagugacaugguggacacccaggauuccacacuggaaagaaucccaauuuagauccccgucagagagcaaaaccagggcagagccaggaggggaagagacuugagaggcagcaagugcugacuguugacagcuaauggccaacucaggagaucuacagagaacaaggaagcaaccgaagaccacagagaggcuaagacaaaggcgggagauuaacacucaccggaauaauccagcagacggaaggggauagaaaaucucaaauccugcuuuaaagaaauuuugccuggaaaaaucuuugagcaugugccauguacaaguuuaaauaagcaagacaaacagcuagggcuaauaaguguaaaagcagugcuacugauaagaaaauagaagagaaugacaaauucccaggcaaaaugagauacagaaaauaaccaugucaacaauguacaacggaacugucgauaaguccccuccauauccuggucuaauuaaacccuuucucacaaaugccagcaaucaauaaaaaauuauuucuuauucaauguggacuucaguuuuaauuacuagcaguacaacacgcugugauucugagagcaucugaucugcuugaauauacuucuuaccaagucuaaaagaaugacaugaugacauagugucuucuuuccuuuccucaccuguagcacuguuguuggacugaggccuuagaaggccccugggagcagcugaugcauacagcuuuaugaguucuuacagaaaaagaacaaaaggaaguuagcagacaaggugagaaugaguuaacuuccauucauuuuuuaacaccuuauaccccuuagagcaaaaauaggugaguuuggaaaugcuuuaaaggccuuaagcgacuuaagcaacaaaacacaaugccuaucccuucauggacaaauuagccacaagguacauaccacaaagguacagaaauguuacucuuugaugcuauuugcuuacaaagaagaucaagaaucuuccugucuaaaaauguucaagcacugaaagaaauacauauuuauacacuuaaaacuguugcugauuauuuugauuuagagauuuuaugucaaagaguuaaaauaacaggucaaauaaaauuuuuuugcaucaaauauuaaguggauuugcauuucacauugucuagauuuauuaauauggaagcucugggagaccaggguugugagguguuguuguuguuguuguuguuguuguuguuuuugagacggaaucucacucugucacccagguuggagugcaguggugugaucuccgcucacugcaaccuccgccuccugggcucacgccauucuccugccucagccucccgaguagcugggacuacaggcgcccggcaccgcgcccggcuuuuuuuuuuuuuuuuuuguauuuuuaguagagacgggguuucaccguguuagccaggauggucucgaacuccugaccucgugaucugcccgccucagccucccaaagugcugggauuacaggcaugagccaccaugcccaguugugggcauuuuuuuuuuuuuuuugagauggagucucgcuuugucacccaggcuggagugcaguggugcgaucucggcucccugcaaccuccaacucucugguuaaagugauucuccugccucagccucccaaguagcugaaauuauaggcacgcaccaccacgcccagcuaguuuuuguauuuuuaguaaagaugggguuucaccacguuggccaggauggucucgaucuccugacagcaugauccacccgccucagccucccaaaguacugggauuauaggcguaagccaccgcgccuggccagguugugcacuuuuacuuuaaaauuugauaccucuugcacaaugccaaaguguagaaagggcauccaacgaauacuuuccuuggaaggacuacauaucaacuaaaaucaaagauacaaaaaaaaucucggugcccaauuuccugaacacacaagcucauccaagguccugaggguguacaugagaacagaacuguggagaaaggcuuuuuaguuggcagccagcacaggagucuaccguuuccucuagcaaguuagcuuacuaacuugcaaagucugucugucuuccuauggaucugaauuucaccuaugcuucaccucauggcuagaggcacacaccacucagcuauggucugcagacugaggaacccugggaccuucuauuauuuugccacauucucaggaaaacaucaccccacacacaaacacgcaaguauucaaacaaugccagggaucugacuugggagguaagaugcuugggagauggagacacaguguuccccaccucuucccuguccuaccggcaccagcaggagguggaagcccuauccugccagggacaccauacccacugucagaugaaacaacauggguucaaguggaaaguuuuuuguucgugcgcucuauuccuuuaacauccuauuuuaacuaaaaaccauauguuuuaauacauuaauucuaccguuucaaaaaacucaagguaaaucuaccuacaagauucgcugcacuugcaaacugcagauuaucaacaauaagaaauauuuucuggguuauucaaaacauugauaaagcucuuucaucauuuuuuuaaagaagcuuuuaaaggggaaaaugaacuuugcuuuuggccucaguuuuccaaaauaugacgaagagguggaaaacagcacaaaccaagccccaccggauaauuacaguuaugccucauguaucaaaaugcccuuccauccuucauagcaggagcaaccugacagaagggucagugcucccugaauccaaacugcagcacagaaugagagccugccuggaaaagaagaauggaacagaaauacucacacucagaaaagacauuucaucccaccuaugaaaaauuuaaauacugaggucacucaucccccaguacgcuuacugagagauuacaugaaaaaccuaaccaaugcauguaaaaaguaacuaaaaauaaugaucuagggaguacaacaaaaagaaauacagauggaaaaaaauaaaugaauucuaaugaaccauguggaaauccuaucuggauuucuaaaaguucagaagguaccacugggcgaguaggcaauuaacgggcggaaaggaaggggaaaggcacccuuggucucuacaccgagccuggucccuacgcugacaccaugcagcccuggaauaauguggcuggcuggaugagcuggaguuuuucuacaaacagaaacaucaauuugugacuugcuuaaauaaccuccuguggagauuuucacaauaaccugaauuaacaaaauaacauuaauucugacuuagcacagaauuaugguuacaagaugaucaugacaaaacaguugaagguggugcuguuucugcugucuccaagaauaaaucaacacgcuugcgucccaccacucacaacuaccgcaucaacuuuggcagagguuaacauuaucaaguuuuuacaaaaggacuaaaaagggaccacagggauauaaagagggguauguauggacccccagagaguuaaucaaucaauaaauacauuauccaauccccaacucaacuacucaaaucaugcagcuauauuaaaaauacgaagaauauuaaggaugacccuugcaguauaaaauguaaugauuauuuuuaucuuucaaugaaucaaaguucucaccgucacaccauucauaaaauuggaauuuucagaauaccuacuuuaaaguauaaauccauuaagcgaaaaauggaggaaaagugaaaggugggaaucagaaaagagacagaagagacaggcgcucagcaaaaccaggugggagacgaaagggauuucuggggauuugaaaaaccuuauggauuuauauucaucgcuuggauaauugacaguuuauuauuacugaauuuacuuaagcuuuagaauucgugaauuaggggaauucugauucaaugaaaaaccuuucagagacacccuaaugacugaagaaugaagcacacuugacggccuugaacugcuccguaccugccuggggucccggcucacccuucauccacacccuuccccaugacaggcugccuccaagcccugcagucuguagagaacaccuuccuccuccugcccuaacccagguccccacgguaccuugguaagggguugcaccacugccacugcacagaaccagacacccucucccuugcguggcaucagcaugcccaccaugggauacucaucacuagcaggacaacacugacccaucugcccucucccugcuggaccauggacaccuuaaggccaaacacagcugacuccaggugcacacuggcugagaaggaguggguugugcaaucaugggggagaauuucuacaacccuaggguacugcaaagaaugcagccauucuaaaugaaacauaagaucagcugguaaguuuugaauauuuuucuuuuuaaagagcuuucacuucuauuauugggauguauucucaacauacuucuaaauaauuauuguuggcauggccaggcaagguggcuuaugucuguaaucccagcacuuugggaggcugaagcgggcagaucacuugaugccaggaguucgagacgagccuggccaacauggcaacacuccaucucuacaaaaacaaaaaagagaaaagaaaaaaaaauuagccaggugugguggcucacaccuguggccccagcuacuugggaggcugaggcacaagaaucacuugaaccugggaggcagagguugcagugaaccaagacugcaccccagccugggcaacacagcgagacugucucaaaaaaaaaaaaaaaaaaaaaaaaaaaagguguuggcaugaucauugggugagagagagagauauacauuaaguuuacauccaucucagaacaaagauugaggugucugaagcccugaaguuaggcaaugaaaagcaaaucuucuggauacaacuggauacaauggacuauuauucacccauaaaaagggaugaaguacugauacauuacaacauggaugaaccuuaaaaauauuaugcuaagugaaagaagccagacacaaaaggucacauauuauauaacugcauuuauaugcacuaugcaaaauaggugaauccauagaaacagaaugcagacuggugguugccaggagcugagcggaaaggggaauggggauuaacugcuuaagggguacaggcuuuccuugcggcaugacaaauguauuuuggaacuagauagagauggcaauugcacaacaguaugaauauacuagaugucacugaguuguucaccuuuaaauggacaauuuuaugucauaugaauuuuaccucuauaaaaaaauuuuuuaaacaaaucucccaccauauauaccaaagaggaaguccaaaacagacuccuguuuucucugaaaacacaggggcacucaguggagcuggaaauagaacaguauaaaagaauuauucgaagacgaagaacuuacugguuauuagaaaaaaacuacaaauuguuuaaauugguuuaauauuuucuauuauuuaauuaucucugaaaaugcuucacaguacuuauaaaauguccucuuuucugugcuagaagccucuauuuguaaugaacucuacuuucccuuauuugguaaaagaucccagcauucuuccauauguaauuccucuggugcaaacacuauaccaacauucuguguguguuacucaggaagguuaauuauuuuagcacauaauuuuuauuucuaaaaguuccccucuuucuugucuugugauaaaacuaguguaacaaaaaaacaaaaacaaaaaacacaauaacaaaaaaaauccugccaaagccuguuugugaauauuacuccauuccauuauaaauuacaagauuuucugugacuuuuucugguuaauaaggagaaaaguuauaucccaguaaagacacgaaagcuucagguaauuaaaagcucuacuaaguaaugaaaagcuaauccuguagugaagacgugugggcugaaagaagaugagguguuaaauaugcaaacuaaaugucuauuuauugcuaauacagcccucacaagaacaaaucggaugccaugacaaguguucuuaucaacaacauuuguuuucuucaagagaauugaaaagcuaaaacauggacuucugccuggccacacacaaagcacagcccccuccuaagaacccagaaugggaaagaaagcucuagaagcaaaguacauggccacugaaagccacauacaugcuaaugaggucacgcugggcaaggugacaucgcagcugcagagccuuguuagaaguaugugacaucuacaagcacaccuggacaacccacucauuuggaaguaggcuuuauucggucaggagucucugaacgacuuuccagucuaagcauucaaaaugaaggcacaaaagagguuaaaaccacuuaacccaguuguaacaagggaauuuguaccagaauuuaagauuacaaccuggaugagaucaaaacccuuaggcuuccaaagggacuucacaaccuuuccaggguucuguggaugcuaccuguuaacacgguuuacaaugccucaccaauaaggagagauggguggggaggugaacaaggcuacccaguccaugccaagacaaggacacauucuuuguucucaaaaagaaaaaaaaaaaaaaucaggagucccagccacgucagguguaccacggugacuguugcuaaaaucaaacaagcaaacaaacuaaggcccuccaggucauuugcaacccucaauucauuuccugaaguacaacaccaaaaauuaacaaaaggaaaguggaaggaccuaaacacaugaagaaaaacaaagccagacuggaacaaaacauuucccuaacuagguuauguaagacgagcaccauagaauaugucaacaugaaauaagagcuuaucaaaauggcauuuacacacacugcauugguuuuaauuuucucucaaaguugucuuuuccuuuuaaauuuaguugacaaguuagaguacaugugaucucuguaacagaaaaacuaaacauuggaauauauguuguggaggaauuuuuuuuuuuuuuuuuuugagauggaaccuagcucugucgccaggcuggagugcaguggugcgaccucagcucacugcaacuuccgccucccagguucaagcaauucuccugcgucagccuccugaguagcugggacuacaggcaccugccaccacacccagcuaauuuuuguauuuuuaguagagaugggguuucaccauguuggccaggauggucuugaucucuugaccuugugaucggcccgccucggccuccuaaagugcugggauuacagacaugagccaccgugcccagccuguuuuguuuuuguuuuuguuuuaguuuuguuuuguuuggagacagaguuucacucacugcccaggcuggagcauaaugaugcaaucucgguucacugcaaccuccaccucccggguucaagcaauucuccugccucagccucccgaguaacugggauuacaggcacgugccaccacgcccagcuaacuuuuguauuuucaguagagacgggguuucaccauguuggccaggcuggucugaaacuccugaccucaggugaucugucugccuuggccucccaaagugaugggauuagaggcaugagcuacuaugccuggccggaauauauguauuuuugaaauauuuuuucauuuaaaauuuuuuguggaacaaguaauagaaucacgagguucacaaaucaaaaugaagucugaggcaggcgaucacuugagcccaggaguuugaggcugcgaugggcuaugcgcgugccagugcacuccagccugggcagcagagccagacuccaucucaaaaaaaaaaaaaaaaagaaaagaaaagaaaagaaaaaucaaaugauauaacaacuuuuauucauuucuuauauauuccuccaaugcuauuuaugcaaauauaauggucacucuacaugugcaggauuacauaucauucagaccaagugagcuacaucaucacaaagaugggaaaauguacccugagguauccaaacgaacaucauacaggcccccaaacagggaacaaaugcuaggcaggcaagaucgacugauauaacagguaaagagcaaucaagggcaguguaguuaagauguaugauuugucuguuucucccacuaaacagugagcccucugcagccagaaacaguggcuugcucaucacuguaccccuccauaccuagaaggguugucuggcacuugaaagguggccaacaaauguuuguggaauaagugcaucaaccaauauuccaucauggaggaccuagggacugaaugggaccugaaaggauggaggaauauggagauacuuacagaggcaaagacuguccuggcagggacaacaguucaagcucacggguaagaccacuaagccacuggauggaaaugugguuggagucugccucaaaccucaguggaaaggggcaaguuccugcaaagaugcaugcauucacauggccuuuccugccuggaggugacagugagugguaguaccugcacacagggcucuggcagacucaaccagguagccagucucagacaaacuguggaggcaaauuacggaagguuugaucccuggcccuguccucugugacugguccaugaagucacuuuuccugccugguaugaaugcuuccccguccauguccauccucgcuuccuuccaggacucuguagcacuuuccccuuucucaguguggcuaggcauuguuuucucccucccucucugccccugcaacucauguaggacucagcaaaagcuugagagguaugcagugacaguacugucaugucucugugacaccccaagccaucagagacaacgccagccaacaacagaugugcacauacccaggugcuccacagugccccugcagacucuccuacuggagaacacucuggaacucagagccaggguugcccaagacagagagcugcagagaccagcaguaggacaggcaggucaccuguccacuggcacagaggccaggugguguuuaggccccgacucuaccaagaggacaacaaucuacaaagcucugugcuaaacucaucuccaguuuauuuuacauuuggcaagacgaagcuguucaguauauaugucacuuugaaaugcuuucauaaauuagacaucgaaaagcaaacaacacggccaagaagagcugagcgacagcuccuuucccauuuuuaucacugugguauuauuuggucuguaucgaaggauggguaaucagaaaacauaagccuucuuacauaauacucuccaaauuggacagugacuuggaguucccaaaacacaaucuccauccuaaaaccuccuacauggaacugaagagcuggacuagacacauuccaaucacuacaaguggugccagucuggccuccuucuccugcccgagacaaccccuggcagacgccccguugcaagagccaacaugcacacacgccugcaaugccgcagcgacaugcacucagcucagcuggagacacacaaguacccauguaaauggucaaaauguucaagucucacaguaaauaaaggcacuuguauuacagcuaucguuauaaaaaucuguaacacuucaagagaccauuauggagcuauuaaaaagauuuugcauucaguuuucaagaugacuuaggcagaaugccaccacuauaguaauuacuuuauuuaucacuauguaaacggauuuuuuuuuuuuugaggcagucucucucuguugcucaggcuggagugcaaugacacagucuuggcucacuaugaccuccgcaucccagguucaagccauucuccugcccucagccucccaaguggcugggauuacagaugugcaccaccaugcccagcuaguuuuugcauuuuuuuuuuuuuuaaguagagacaggaguuucaccauguuggccaggauggucucaaauuccugaccucaggugauccacucaccguggccucccaaagugcugggauuacaggcgugagccaccgcgcccagucagaugcucaauuuaaaaagagaaacacaauucauuuaaaaagagaaaaaugguguucucacacaauaaccaagcaaaauguggcagcaaaggcaguggcucugucugcaaauacuggucaucuugaauuagaagucucacgguaccacgggacaggcagcugaacuguuugagaaauuaaaaacuagcaaaauaaaauaauucugcaagacacauuguggcugaaccucagauggccacacagacaccucuuucauuagcagguucgggcacuuuaccuuucaguccugauacacauagauaucuuaagccaacuaugugccccaugaacuaaaaaugccuugaaaauauucaacucuaucugacauauugccccaggucccuacaaaacuugaaaauaaauuuuauuuuauucaguacagaauugguuaagaaaucuucugacauacaugcauagcaacaauuuccagguccuuacuugugcuggcaauuuugcaaggacaugaagcuauuucuagaguaucucacugcaauaauacauguguucaucaaacagacccccuggggggccguucuucuguaaugcaggggaagguacuucaaugucggaccaagucagagaagugcuucggcacuaacauccugacuuccugagaaaugagagaacacacuaaauaauuccaaagacaggacuguuauuaaaaccaagaacagacauacacagguuuaaccuaacacuacuguccuuucuggggcacucuggauaaacagacugugaacaucagacagaaacaccugcacugagauacagauggcaauacccucaaauuugggccaagcuggcuaggcauuuugucccaaguuuuccagcuguggagugaagaagugcccccugccccugugcguguguacauacuuacaggcauacaauugaugucauuaacauugauggaauguaugauuugcuauacugagugauggagacagaggaugaggacucuaagaaacaguccuuccuguaagagaaacaugcuguauuaugcuuccuuuauauaaguaucccacuuucuuauaguugagggcaauccagccccgcugaugcagcaccacucucagaacuguuuccaaaugcagacaugcacaucuuuuuucuaccuccuucucacaauacagcaaagaaaaauguacacaaauauagucuuuauggggaagacaguggccugaauaaacauacuugguccugccucccucacaguccccucucuaaaguaacaaggacaguaaucuaaugagcuuacagguagugcaugggaugagagugagggccuucugaggcccucaggaucucccaaaucuccaaaacagagagcggguacaguucuccauggucauuguaacugagaguccauccacagggaagaaggcccugcacccugcucauccugcugucccaggugaaaccagagggaaggggggcuuccauggaagguggaacuguucccaagccuuauguugucggaagagacugggaacagagcaacucagcggcacaguaucuguuuccuggcuuaucaccuaccaucugcuggucugccauuccuugagugacacuaacccaugacuugugugacggcugagggcagccaucggcaagcaaagaaaaaccaugacccacugaggacgacgcaggagccugagggagggugaccaagcucagcugcaacagguggcaccagcugaaacagaacuaaucgaaccaagaaaggagaacuagacgggaagaggagucuaagagcauauguggagacacaauuggaguauaaaaacuuucaggaauuaaaaaaaaaaaaacacuuuaaaauuuuaaauugaacagaaaagaucuguugcucuagaguaucagauucuggaggauuaagaagaagaaaugcgagcgcccaagagcaaggaauaagaaucuacuagaauccaugagugaaaagacagagaacacauccaggagacagagaaagucaugggaacggcagaaauugcggaaaugcaaacccugguggaagaauuaguaauuuaaugcugguaccuauuucaggagaaaaauacagauuuucaaauuguuaggcaccgguagcuuugaaaauaacacacuuuucaaauuagcaaaggacuuguucaauuaacaugggaauugagaauaacagaaaguaaaauaaauggcaaccauugaauaagaugaaagcaauaaagcaaaauguaugcauuaucacaguaaagaaagacaaggcagaacgucccuauuagagaacaaaaaugucucaauggguuuuaaaaguccagcucuauuuaaaaacaaacaauugaacaagaguauaccaagcaaagucaaguaaaaagaaagcaaagcuggcaauaguaaaaucaaaccaagaacucaaggccauuaagcauuaaacuggacagagagggauauuacaugugauaaauauguaaucccugaaaaauaaaaaaauuacacauauugaugcaucaagcaaaacggcagauaaauacacuaagcauuucucuuggaaauaugaaaaguuuaaaaauuauaaaaggggcccggugugguggcucacaccuguaaucccagcacuuugggaggccaaggcaggcagaucauuugaggucaggaguuugagaccagccuggccaauauagugagaccucaucucuacuaaaaauaugaaaauuagccaggugcaguggcaugugccuauaaucccagcuacucaggaggcugaggcaggagaaccacuugaauccaggagacagaggcugcagugagccaagaucacgccacugcacuacacagccugggcgacagagugaaacucugucucaaaaaaaaaaauuauaaaaggugcaucauuaacugucaauuugacaacugaaaacauacaugaauuuggaagaucugacuauaaugcaaucaguaaguuugauuuacuaaauacagaaaauaaaaccuuugcauuuuaccaagggcauaauuuuuuaauguccacaaagcaauuaaaacuuaaucauguacuuggaugcaaguaaacguuaauaaauccucucagauaccucagagcugcauucauaaaucauauaaacaauaucaaaagguaagcaaaagaaaaauucaaggacagacauacuucuaaguaaugucagaaucaaagaucaaauaaauauuuuaauuacaaaccaucuagaaaacaacaaaaaggagaucaacugucuaaaaccaaaaauacguaacaaaagcaauuuucaaagaaaauguauagccuuaaaugccauuauuuuaagaagacuaaaaagcaaaugagacaggcauucaacuuaauaaacuuaaaggaauggaaaaagugaauaaaaauuaaauacugagaugaaauuaaaagcaggauaaauauaaaauuaauauaccuaguuuuuugaagacaauaaaauauauaaacuucuaacaaacuugauuaagggggaaaaaagcaaaaaaagagcaaaaauauguguuaguaaugagaaaggguuaugauuaccagagaaaugauaacaauauuacaaauaacugugcgauaaacucaaauuguagauaaauucuuucccagcaaguagaaaauaucaaaauccagagaaaaggcuuaaaagcugaacagaacaacuauaauauauucugaaaaacuaaaaaauuuguuuuaaaauguucugggaugggacuacaggggaugccuaugaaguuuuccaguuaauuuuacucuaacuuaaaaaaaaaaaaaaaacagguuauuuccuauauuauguaaaugcuucuagaugcugggaaagggugaaauucuucuuaaauuauuuaaaaaacauaauccuaauaucaauaccugauagaaugcaaacaaggaaaaaaacuaaagaccccuaucuguagggcuuuguaggcuacagucacaauuuuuaaaaaaauauuagcaaaucaaauagcaacauauccaaagauuaucacaccauaacaaauuagggcuuauuccaggaaugcaaagaugauucaauauugggaaaucuaaucaacguaauuuauuacaccaccaaauaaaagcaaaagcucacaauuauaucaugccaaaaaggcauuucauaaaauucaucagccucuuccgauaaaaauuaaaacaugaaugaguauacacaacuuaaauaugauaaacuauauuuaccaaaacuuaacauauuccuuguuaaaacacauuuuuuuauuuaaaucaggaacaaggcaguaaugccuuuuuuuuuuuuuuuuuuuuuuuuuuuuuuuuuuugcaauggaguuuugcucugucauucaggcuggagugcaguggcacgauguaggcucacugcaaccuccgccuccuggguucaagcaauucuccugccucagccuccacugccaccacgcccagcuaauuuuuguauuuuuaguagagacaggguuuugccauguuggucaggcuggucucaaacuccucaccucaggugauccacccacuucagccucccaaauugccgggauuacaggcaugagccaccaugcccagccagcaauacacuuuucuauaguaccagcaaagauggauguauacacauacacgagucaauuuacuguaauccuguuucauuagugaaacacagagaaagaaaaaacaagaaaccacaugacuguccaucaacagaugauggcucgacuaaacuaugaaucauccauuuugugaacugcugaaauuuuaacucguuucaaacuccgcagcaacugaccuaaauugauauccauacaccgagaaaaaguaaaaauguuacgaaagacuauauagaggcuauucacuauacuaauagcaugaucucauuuuuauaaaaacccaaaacuauacugcauauaugcauauaucuuuccuaaagaagauuaacgaggacacacaauuuucuauauauaucuuuuauuuuacacuagcaucacuuuuuguuuuuauuaaagagaauuuuaaagagaccagauauacacauauauaucuguuucgauaacacaaagcaccuucuaggcacacaauauuuagaaaagaaauucucugcguauuguuucuugggaagguaggaagggugagcacugcagcagcuauccucaggucaaccuaggugugaauccugaccucauugaguagcaaguucuuuagucucuaggagccucuguuccuucaucuguaaaauggggauaauuucucccaccucucauuagccuguuaugaggauuuaauguuuacaccuaaccugcaaaucagucauuacuagcguucuuuuauuccaagcucauuccucucaaaaacaaagacagaaagaaggaaccaaaacuucccucccugugguuuccaagagcugccuggcagugccuaaccauggcugugcugcuucggaacgcagcaaagguucaguggggacuccuguucaguguuccuggagcugccagcgugagucaaaggugagcugaaaacgcuggugguccucaguuuucauguugggaguuuaucacaaccacaacaccaaccuucagcuucucaacugguacuuaaaaagcagcaacucacucaaauacucacaggcagauuccuggcaggagcaggggauuuccuggagaucgcuuaagacucuuuuggacaaugagaaaaggacaaaaaggaagcacuaguagagcccucuacuuccaaauccucagguuccccuccaagacagaaaggcagaaagaaaacaucagggagagccacagauacugcagccuagcucccuggauuaauuaaggcucauuaaaagcagaaaagaaaaacgaaagggaaaacuuggagaccugguuaccucccgauccugauacugaucccauucuguaagcuauuauuaauaacaaaauaugaagaagaaaaaaauuaucaacaggaaagggaguuaaauugugcguuaaauauacauuuaaauuuucugaaaaaggaaaacaaggcuucccugagaaaugagcuggcuggaaggaaggcuggagcccugcaguaucaagaagcagaucugucccagaggagggagggcacagaaaauuccugcaacaaagacuuuucaagagugaaaaggaaaaagcaucucagcuuaaacugaaaguauccuuucucuguuauagaaggaacucacauacaagagagaccucccaacucacaucuuuguaucucacauuuuccaagauacuuguuucaugauccaaauaauaucauaaaaaguaauaaaaccaucuguaagaaacauuaauucgccaugguuuggcuaacagaauucuucaccaucuccucccagaugauaacauuaaaagcuaaaugaaaugagucaaaagcuucuuuuguauaaaauccaauuaacuuuauaaauauacucucaggaggaaaaaaaacccacaucuccuugaagagcaggaauuuauaucaaaauuuauauaauuauuggccaggcauaguggcucacaucuguaauccuagcacuuugagaagccaaggcagguggaucgcuugaggccaggaguucgagacaagccugggcaacauagaaugaccccgucucuacaaaaaauacaaaaaaaaaaaaaaaaaaaaaaaagccagguaugguggugcauacuuguggucccagcuauuuggggggcucaggcgggaggauugcuugagcagaggaggucaaggcugcagugagccgagaucgugccacugcacgccagccugagacccucuuuauuuaaaaaaaaaaaaaggcuggacguaauggcucacaccuguaaucccagcacuuugggaggccgaggcaggugaucacgaggucaggagaucaagaccauccuggcuaacauggugaaacccugucucuacuaaauacacaaacaaauuaggugugguggcacgugccuguaguccuagcuacuugggaggcugaggcaggagaaucgcuugaacccuggaggcggagguugcagugagccaagaucaugucacugcacuccagccugggcaacacagcaagacuccaucucaaaaaaaaaaaaaaaaaaaaauaguaugauuuuccagcccuaaacauauucuuuaucucaucugaguaacuuuggcuacuauuuuagguuuuccuucugcaauauuugauauugauugaaauaaugcauuuuaacuaaaauugaauuauguaucacuuauaauaacaaagucaauuuaauauuauacacaucauuaguuugagccauauuauucacaugucagguacauuugggggauaaggcucacauacuuucuuuuuuuuuuucuuugagacggagucucgcucugucgcccaggcuggagugcaaguggcacaaucuccgcucacugcaagcuccgccucccggguucaugccauucuccugccucagcguccagaguagcugggauuacaggugcccgccaccacgcccagcuaacuuuuuuuuuguauuuuuaguagagacgggguuucaccgcguuaggauggucucgaucuccuggccuugugauccacccgccucggccucccaaagugcugggauuacaggcgggagccacagugcccagccaaggcucacauauuuucguuaauaaacacucuauucuuuaaaagugaauuuugaugaaaacgacuccccagacagcaggacccauuauccaggauggccacaugcccugagcucucacaguucugauuuuauagaaaaaugaccuggugugggcucagaaaacagucauaaaugucaacaguucacacacgaauguuuuguggaaagcaucugcuugucauuggcuaauauagaggcaggaaggucuggaaggguaaaugagcaacugccagguaucugagcaacugucugaaagguuuggggccaccucaacucagcacgcaaagaacccauacugucuacaagucugcacagaggaacccuaggaagacagccugaugcccuaauucccguguaaacaaauacugacacagacucacaaaauacauguauaauacaaacagugaagagucuguauuauguaaguuguuuauacagaagacugacuugggcuggggaagggaaagggugggagacguccacacaaaccacagcauauauccaaacaauuauguuauuuguucuucccuuauuuuucuuauucgugggaagcuucucccaaagacaaugugaacauuucacacauaggcuuuagaagcauagguccgagucucaacagguaagcuguuuggaaagcaacuuggccauaugggucaagagcuuuaaacugauaccuuuccacagaaauccuauuucaagggacguauuguagggagauaauuugaaauaaaggacaaagauuaaguaguacaacagaguuugcugcagccuucuuuacuuauaaaaaacugggaccaaugcaaaugcccaacaauggggaaacuuuaagaauguuacgguuccuucaucccaugucacuuuacacuaccauuaaaaucaggguuacagccuuuugagaguugaggggagaggaucgcuugaagccaggcauucaagacagacaccugggcaacauggcgaggcaucacuucuacaaaaaacuuuuuuuuuuagaaauuaccugggcguggugaugcacaccuguaauccuaguuaaucagaagguuaaggugggaagagcacuuaagccaggagcucaaggcuucagugaguuacgaugguaccacugcaccccagccugggugacagagcaagaacacagcucuuaaaagaaaaaauuaagcuaauaaggaguguaugucgcugaaaggcuuuuaaaugcuaggaaauaaacauguaacgaucagaggcucaacuacacuaaaauguguuuguuuuaaacaucuagaagaaggccgggcaugauggcucacgccuguaaucccaggacuuugggaggccgagguggguggaucacuugaggccaggaguuugagaugagccugggcaacaugaugaaacccugucucuacaaaaaaaacacaaaaauuagcuggccauggugguguacaccuguagucccagcuacucgggaggcugaggugaagaggaucaccugagccugaguagguagaggcugcagugaguagugaucacgccauugcacuccaaccugggugacaguaagaucccgucucaaaaacaaacaaaaaacuagaagaaaauacacuuaacuguucucagaaugcuggaguuauagguggcuacuuuucugaguuuuuccaaauucuuaagcuuagagacaaauuuuuaacccugaauaguuuuaggcaauuauuuucuuuaagagacagggucucccaauguugcccaggcuaggcuugaacuccuggccucaagcaauccacccuccacagccuccugaggagcugggauuacaggcaugagccacuuugcccagcaguuuugggcaauuuuuaugaacagaacaaaaugaaaccaaggaugacagaauaccauacuaggcucagaagauuuggacuguggcuccaacucugcucuuggacaaaucccuaaacaucucagagcaucaguuuugcaccuggacgacgagaagcuggacuagauaaauccaggggcccuccuaggccaagggcccuugaucagggaggccagcccccuugccugugacccacaaagucucagggcacagggaaacagggagaagcgcaaaacugcccaggccaagggaccccccaacaagggagcacagccaggugccccagugucaccugaugugaggccuuucucagcucuuucaguccugccugcaccuuagacuuccagaugcucuauauacugagggaauggacucuucagguaagagguugagaaugacaaaagagaaagguaagaacuuucacuggaaucaaaaugguauugcuauaugcaauucccucucacagcuucauaucccuuagagguaaggaaaaggaagaagaaaggaugguccuucugggauagaagucgagcaaauaucuuuguucacuaagaaauaaggagaacaaaauacccaaguagaacagauucuuuuuuuaagccaaaaaaaaaaaaaaagccuaaaaauauuuuaaaagucuaaaacgauaaaauuauuuuuucagguggcaccaugaacguuaugguuaaguagucuaaccagaaaaaugagaagugucccaccaugcugucaccugccuaagcagccuagcagcagccaaaucgaaucucuuaggcaaaauaugggaugauaggauuacagaauuaauuuuccuguaaggcauaauuguuacugacuucaugucauuacaaugucagcucaucugguagacgauugcuauuacauucuaauuacaaaaacacacaaacaauuuguaaccauucauuauuaaauaacaagugaggccaugauagcuaauggaaacuuagaaaaaugaaaauuaaaggcaaacuggacaauaagugcuuaauaaauuaaucaauuagucuugaugaaauuucucaauugcguuaccagguaaccagcccucagauuaccugguaaacauacuucuaagagccauguuguuuaaacuugauuaaaugucagaaugacccaaaucacuuugggucaccaagaccaaagagaaauacaaauauuuaagauacagcuuuaccuuuuaccuuggcacuaaaaagagcagcauauccccuuggcugucuaacaacaagguaagcacagaaacaagaauuuuaaaaauaggcaaauuaaaggguauuuacguaauaaaaagauuuauucuguaaaaaaaaaaaaaaggauuuauuaaauucuacugcaacuaugcuaagccuaccuaaaugaaauuuuuuaaacaaggaaagaaauaggcaauaguguccuccaagaacaacaaaacuugaauaacgggcaauugacaggcccuuaaauaaugcacaguggaggucucauggaaagaaaagagauaauucccacccugaccacagcacacaaccccuuuaagauauuccacgugcaauaugugaguguccaguggagucuaaauguagcuuacauaguaccuccuccuggcucuuaauucuaacaacuucuggaauaaccacuguagcuacugaaaaucaaguccuaaggguagagcaagaauggcucaagaauaaacgcaauuaacuaaauguuugcagugaagauaccaacuuacauauauccauugccaauggacuaacuacuuacauggcaaaaaguguucacauacucugaaagcugacaaaggccagugaguucuacaagugaauauuauaagucauagaagcgauuuguuuuagauccuacaguuuucuaauuuuccaguuuccuacaguuuuccaauuuuccaauucuggagugcaagucaauagaaaaugacgauuugcacgcucauuuccacuuuacacauaauugcuaaagaaugcaccuaaugaguaaagaaauuaaaaggugugaaaguguacacggacugcaugugguggcucacgccuguaaucccagcacuuugggaggcuggggaaggaggaucacuugaggccaggaguuugagaccagccugggcaacacagcaagaccuccaucucuacaaaaauaauaauaauaauaaauuugcugggcaagguggcuuaugccuguaguuccagcuacucaggaggcugaaaaaggaggaucccuugaacccagguguuugaggucccagugagcuaugacuacaccacugcacuccaaaguggaugacacagcaagauccugucucuaaaaaauuaaucaauuaauacuuaauuaaaaguugugcaugcagaaguaaauaugaaagcauuauauuugucacaugagaaacauuucucugauagaaauaagaaaaucagaaauaaaaauuaagggaagcauuuuuaguuuuggaauuauucaaaagguaauuuaucucuuuaucuucauuuaucucuuccaaauauauuaccgaaaucuuuggccuaacgaauccacaccccucucccaacacacacaugaaauauauguaaaucaguuggcuacuuauacuaaugcuauaggugauauuuuuaagcgucaguaaguauuuuuaacagucauuucccaacaaauuagugauacucaguacauuauaauacauucaaaccaaauuuggucauaguaucaucucucucuagcucuugagaaauacagcagaacuuuauagacucuccaaaaagucccgaccacagagugucaacccaccauuuaacucacuguccagaggcuuuuuuaaaaaucuccaaaucuccuucuaauccacuaaucucuucaggaccacccgacacaguucucaugcucacauaccucugcuuauaagauuuagucgucagagggaaucuaagaugcaaaauaaccuauauucaauuaaucgacuuggcaccaaaaauaacuuacccugauuuauuacaaauugaguagugccagggcacaguggcuguaaucccagcacuuugggaggccgaggcgggcggaucaccaggucaggaguucgagaccagccaggccaacauagugaaacccugucucuacuaaaaauacagaaaauuagcuggguguggcggugggugccuguaauuccagguacucaggaggcugaggcaggagaaucacuugaacccgggagguggagguugcagugagccgagaccaugccauugcacuccagccugggugacaagagugaaacucugucucaaaaacacaacaacaacaacaacaacgacaaauugaauaguguaaguguauaaaugaaugggaacugauagagcuauaguuugaagagcaaauugcuggaguugccggcuugauuuuacauuacacugcacuuacauuuucuccugaacauuuggcacuagagaguuaaauaacugauagcuugaaacaauuaaucacagcgauccacgcaccuggugaauuacgaguucauccaucaagagagcauagguucaacucaagagauaugauguaagaacaacacagcuccaaagccaugugucagaguuucuuugccaaccauaauuagugaaauuacugacaccauucaagugccaagagguucaaagaaauaacgaacaacacacacccauuuagcccuuugaauucuuuaccacaugcaccugggggccucaacucucaaauuaaaaggcaaaacacaacaaccaaacaagcaaguucuuuugaaacccaaggggaaauuuaaucagcagaccuugugacuugaacaaugacaaggaaaaggagaccaaaggagaacaaguucauguugucuggaaauauuccuuucugcaaacuaagaaaauaucuaguuuugccuccacugguguagaugauuuuagaagcacucaggacuguggggaagacacucauggagcaggggcugccgggaugacucaucugagaggcgcccugacaguguacaaggugugcuaaguuacacuaaaaagacaucuauccaggaggcaugcacucacaccuuuuguuugguuuuccggcaagucugcaagaaugccauccaagagaccaaccuagacagaguuccagagaacccugcaccugaggagauagcacuaaguuuugauacauaaugcaagcacagacuuuuaaaaaugauacaaagauguacacugaggugugucacucccauaccugucccgaccuagauguuuccccaccuaccccggugaaucaucguguuuuucaguuacuugguuucccuucuagugucagucugcacaaauacaagcagaugcaaacaugcagucuuauuuacccuccuuaacuuuacaaaaaagaagccugccuugccuucuccaccuaauauacuggagaucuauucacaggggugcagggcauacuugugguuucucucagcagcagagcauuccauuuugugcauauaucuuaguguauuaaccagucucccacugaagaacacguggguuauuucuaacguauuacuaucaaaaacaaugcugcaauuuguaugugggcagguguauugguaagauaaauuccuagaaguagaauuucugggucaaagguaacacgcauuuauaacgccaauuugccuuccauaaagguuguaccguuuuacacucucaacagcaauguauaagaguucuugucucccuggagucuugacaagagacuguugauaaauguguagauuucagggcagcuuuaagccucggaacaggaaagagaaaacggaaguuucuccaaagaugaauuugaaaagcugucaggaguuucagccaucuuucauaaagaaaucuucaauuccucaaagauuuuuuuuucacuccuuuauccucaggacaucauaacaaaaccacagagguguccuguuccugcccuaccagggccccauucaggccaguucugauguccucucuuauuucaagugagaggcaagaaagacaggagaaggaacccaggagacagggcucugccacuuaggagcuccugacugggccaccggcuuucugucucugcaccacccagcuuccucaccuguaacagguagucagcgaugacacacaaccacauggggccacuaguggggaagugcuuagugcggcuagugacacaaggcacauccuccaggaaagaauaacuggugucauuuuauaauaaaggcauggccaucauuuuguaauaucaagaguguaacaaaguauaauuuaacuccuguaauucaguagaaagcucaaucaaguaaauggauacacagauacuguugcuuuacuugagaagcaugacuuccuucucccuauauuagcuaauacugauagaaaaagaagugaccauucaaacaaaugcaaccaucccuuaaaacaugaaguucauguucaauucuacuaggcuaaaaaagucauaagagaguuacucccagaccuccaggucagaggacaaggcuacgauucaauccuggcuccucucagaggcagcagaacaggaggaaaggagcccagcacuaguccuccuccugagggacucugggaauguuuccuggccucuccagggcuuaggguccucauccaucaaaugaggagaaugguaguuucuucucauaagguuugauaaggaucaaacaaggaaagcauauacaaaguucaucacaaacgccaaaagaaaaaaaaaaaacagagcaguuugcauuaccgucauguuuaaggggccaucuguccuuccucuuaccauccaaagcuaaucccuccaucugugcuuuggccuguccucagaccucuggguccuuacuggagcucuccccuucugucucauggauccacccuucccucucagcagagucccuuccauggacuuuuagccccccucuaucucuguuggggaaaacaagauccacauuccaccucugcuccucccuggcugccaucccaccuccccugugcacagccaugcuucucuacuucuucaguuccuccccuccccacaguauuccucccucuccagagcugcuuccagccaucacuucauucaucagcucucaggugagguccucaaaggccuccccucuugcaagacccaguggaggucuucauuucucacucugcuuggcuucuuaguggcuuuuagcacguuguucuccuuaaaacccuccucucucccuggaagccuggccaucacacucgcaugcuuuccucgcugugcuggagccaccugggucccuuuacagcucaugauccucuaccuggcccuugaacgcugacgucccuuuaagcuccauccccagaauuaucucauguguguuucuacuuuccaggaccaccuaaaccaagucacugcugggaauuccuucucggcaccaguccacauuuccaaaugccugcuugacucagaagugucucaaacccaguaucugcaaaaaucaaacucaugcucacaguccccaccugaucuuccuccagcaucuccuagcucaguaaugggcauugccauaguugucauccaagccagaauccuggacauuaucuuugauauccugcucacaagcccacccccaacacaggccuggccaauuuuacuuccuacucucucugcagucaacuuaucuccaccacuaguccaaguucacuuugccuuuugcauugccuacuccaauugcuuccugauuggcuuccucccuaaucuauucuuuacacuguggccaggaugaauuuuuuaauggaaauaugacacauaccccaccucuguuuaauguucuacacuaaucucccacugauccuuuggugaagacaaaacccucaacauggcuucuggggccccauguggcccgccuccagguuccccaccuuuccaccccaaacccuuuccacauuauuucuuuuccuucuuggucucauggcaucaugucuggccuuugugggauucagcacacauacaauguucuauuuguuuguggcuggggugauuagggugucuccgacaguuagucgaacaguuguauagagaugccacucuacacaaaugacuccagggugccuagugggcauuuacuagguauucacguaaugaaugaacaaggagaugagugacucacuggcccagcccuacuccaaaugacaugaaaauucguuaccucaaagguacauuguaagaacuugguaguauaccugugucauggaaacacaguuuauuguguuuccauuucuaaaucuuauccacaacaaauuguuuuuuaaaaguaaugaauuuccgucuuacuucccguauguuuaaauccaucuaauuuguacuuuauuuucaaaaguuagaacacauuaggacuagucacugguagaaaaggaaguaaaagaaaaaaauaacgaacaaaaccuauuuacuaugauaucaugauuaccacaacacacuguuuccuuaagggauuuacacugcacucgcuggagugcaaugacacaaucuuggcucacugcaaccuccuccucccagguucaagugauucuccugucucagccucccgagaagcugggauuacaggcacccaccaccaagccuggcuaauucuuguauuuuuaguagagacgggguuucaccauguuggugucaaacuucugaccucaggugauccacccgccucagccucccaaagugcuaggauuacagguguaagccaccacauccggcccauugugagugcaauuagaugcaggcaagccaauguuuguaacaaguaaaaacaauaucacuuugaaacaguccaaaaugaucaguacuacuuuuugguuuuuaaauauaaaauuuaaaaugugaacuucagcaaauuguaugcuaacaacauaacacaggaguucuuaccuucuggcugggacuguuucagaucaagccacacuagccuaggguuaacucuacagaauuauuuuaaucccuuuggaaaguguuacaaacacugccacugugucagagcuccuccacccgcguaaagaugcuccaggagcagccccagcccucguccaccuugccccccaccacaagcaucuccacaccucaggcagaccaagccucucaccacuccugcuggcuauaugaaugaucaauagcagcacuaguuaugugggguuuauuuucaaauuuuauuaaauucaucauuuauccaugaacugaucuguuuuagaucuggcuucaugcuguccauacuccaggccuaggcuaaccuugaacagauauuuaacaggauaugcugugagaaggcuggauacacuccuccggaauaagaucugauguuuaaagagguucucccccaacccagcugaaugucaggugaaccauuucagaacacagcuagggaagaaaacacuaauagccuuggcuuagcagggacagaccaauucuuaaagggcuaagucaaguucccuugccucacaaugacuuaacuuugaccucccacucuguucagcuacuaccacaaacuaggcaccucaauccuuucaagcauacugcaggucuuucuugaauacaugugcacauguauacaggugugcauauacgaacacaaacaaauuacauagaaaucuagacauacaacugccuacaguuuuauuacuaaccacaugaaaauccccauggaggaggagaaaaacagagacaugccuuuaaauuuauuaaaaguuuuacaccaagacuugauuuuaugucuucaugacaauucuuugcauacaguaucuccugggaaaacccaacaacucucugcaagacucucuaguuugcaaaagacucuacagaagaagaaaugcgggaggacggagcagugcuggacuagcucuguucuucacccuuguuccccgacgugcagaaaugcagcaccugagaguccaucaaugaccuggaaagacuuggcaauuuauucucagagaagggauuguguuuuugcuaagaggaugcuauuuuccaacaugaccccucugggugucugguaaaaggcaauacaauacacagccucccacuaccugcugaagaagaaaaagcacaaaucaggcagcgagaccaaauggcaaaacuauuuccaaaaaaggaaguaucuuaccuaacccuaaaagaaagccacuucuauacguagcaucuaaaaguuucuggaagugauacaaacuaaaaagccaagaguuuuucagcuugcauagguaucuuguuaccaaaaaaaaaaaaaaaaaaaaaaaaaagcucaggaaaacuauauaaagccauaucaacagaacugcaauggagacagcuuaauggaaaggaaaauggacaugucaacacgagagugucugcuaauaauuuacccaagagagucauucuaaaagacaaaguuuagaaacaugaagucaacccacaauuuacacagcguaaagcuuuuuaaaaaaauaaaauguuaaacauuaucacucuuuguauuucuauucagaaagaauuuuuuuuaaaccacaaauacacucaacugagauuugccgaccagcaaagcuauccuugaggaauacuacacuuuugacaaaguggaguuucccuagaaaauuaaauuucacuaaauaucuuuuaaaagccaguccagauacauaagagaaaguaggggaauaggguuguggggaugccaaggaauggggagaagcauuuccuaagccagccaccuuguuuaaacuguguggauccuagaauguuuuuaacaugugcagcucgaauggaagcuacacagcacagagauuuuaggaucuuccuuuauccugccuccaaaauacuacuaaccaaaucugugcccuacagauaugguaagccgcauauuuauuguuaauaaaacauuuccccuugcuguauuuuucccccucaaaaagagaaauccuacuucucucagacacaucgauuucuuguaucacacguaacuaaccacaaaagccuuuucagcuuuuacugugauuuggcagcaaggcugcagcaaauucugaaacuuggguuucgaugggugugcuucaagacucuguuuggguuucuuauuuauuguuuugccuucuuaaaagcuucagauccuugaccuguuaaaugcuuuuucagccugcauuuacucuuagucccauuuaucaucuuagagaauggccaugauauucucuaagggaaaaacuggcagagaagaguuaauaaagccccaagaguggcacaguggauuagccaugcacagagguguguaaaucagagcaaaaccacguggcaagcaaaacaaaugaaggaaugcuaaggcauuuuaaaacaucaagauuacuaacccaaaacuuucagccuuaaugcuuuuauuuuccgaaguaaauaauggauuauaguauuuuaaguagaaaauggcacuaucuacgcaugcucugaaauuuauucccuaggcgugagcagucgucaacacgcagaguucuucacagaauggugaaaucuugccccuccauaaauguacacuggagaggagacuaagaccuacacuggguaccuucacaggaauccuguucagaucacauuucccauccuaaguuuaauauuuucuuacagcaggccaggcgcgguggcucaggccuguaaucccagccccuucggaagccaaggugggcagacugcuugagcucaggaauucgagaacagccugggcaacauggugaaaccccaucucuacuaaaaauaugaaaauuagccacaugugguggcgugcaccugcaguuccagcuacucgggagacuugaaccugggaggcagagguugcagugagccaagauagugccacugcacuccagccuggacaacagagacucuuaguuucaaaaaaauuuuuuuuucuuuuuagcaaagguaccauuuuucacaggcuauuuucuacuuucauaaucaucucauaaaggcaguauagguucaaaaggcaaauuuuuaggagacaaccugaucagccaccaagaaucguuuuugauuugguaucaaaagacauaacauuugaucaguuugcaauuuuguuugggauaaauauccacagugauacuuugacucugaaaaaacaucaaagugccgcuuugggggagaucaugaaaacacagcacgcaggccuaagaguugcuaggaaggcuaugacagacgggacagcagcagguucucucucaagacuagaccgucaacagagcaugcagagaaagaggcacagaggcuguugcuucacaaaacugaggacggucaggaucagccaccaccacuuccuggauguuucugcauaguucccaagucaagcauuaaccaaggucaauucugucuaaaaugcacgaaaagcccagcuccugcacagcacagccacagcauaaaaauagugaacacacuguuuccacacucacuuauaaccaauguuuuuaaagcaaugcaaacucugaaguugugaagcaaggcaagaugucacucagaccucuugaguuuuguucuuccuguuguuucuuuguguuuugguauguaagaguauacaucuuagaguuuggaggguaugacuguacaaguguagccacucagggugagaaaacaugugcaaaagcauuuugacgaacauucuauuguccugaauguaaacuggaguuaauuauaccuaccuuucauggcugcgggaagaauccagugaguacacuggggaaaugaccggcaaacugugaaaugggauagucaagagaaugcugggcauuaccaaguauucaaguacagaguugaauuuccaguuauuuuggucuuuuauaaccuuaauagagaaauucaccugaaaaugagaucugagauuuagccacacaaauccuaaaugggggggaaucugagccucagacagacacaacugcauaguaauacacaagucaggacuaaaauccugugggauaauuuuaucuugcuuuggggcagagucucacucuguugcccaggcuggggugcacuggugugcucacagcucacuuuagccucgaacuccugggcucaagugauguuccugucucggucucucaaagcacuuggauuauaggcaagagccaaccugcccaggucccacugaucacuuuaaagcccgcucauuuagaagaaagaucuucaagcuaggcaagguggugugugccugacaccaacagucccagcuaauugggaggcugagucggaaggaucccuugaguccagcaguuugaguucagccggggcaaacuagugagacucuaucuccuggccuuacaacgggaccaaacuguagaauaaaccauguuuuaccccgguaaaggguaaccuguugccuaucauaagacucucugaauaaguuuagauauaagcaggcccaucugucauaggauuuuaaucuagauacaggagcaugaccaagcuauauagaaaaaccugcagcaacaaccgcacccagcggaaacagccugccuagagccaccauccaccucagagcagcagaccuucauacacaaggcagugggaacggcugcgggaccaggaaucacuuuugcuccuagagcagacaucaaaggccugagucggcuuugaccugucagugcagcacgaagggcacaaacccagagggcugacuggagacccugagcaagagagagagagaggcacagaagacgacagaacuuuccaccccuucccccuccacaccuccucaaggucucuuucucccuccacucuaccucaucaucucagcaggcuccagcuauuacaaauacaugaugaaaaaaagcuuuucucaaaccugcuuuucuucgcccuaagauauuguggggacggggcaaagagggagaagaaaaaugagaacaagguaacuuuucgaagucuuuuuuaaauuaaauuuuuaaaaaaauuccaauugagaaacauaccugagaacaauucagaauuuauuugacagggcucaaacuugggaguucugugacucagcccacucuuuuggguaaguccuacccaaaacaguauuucuagcuccuaucagcuuacuccacugcucucaggccagaggcaagucauguucuuggcagaacaaacgcaaggguuccaaauccucgcucgguuccuaaucuccacauugaaagacaaugaggagccaacuggucaccaaaaugucaccagccaaacacuucaacaugcugccccagagagaaugccacgcugggguucccaagacgguggauggcacagagcagcugccgccuguucccauccucauuguuuaccacuguguaagucagaugagugcaggaaguaauuaaacacaagaaaucacugcagguaccaugugcacacacaaaaagccauuccauuuuaagucccuguagagggggugucccucucaaaacacucaacuccccaaaagacuaucuucagggacugggucguuuccagaaaaucgacugacuuugaauacaucuuaguucuacgagucuuggcaauucacagaugcuucuaaaacaaaaagacuguuaccauguugggguguggugaauuguuguucucuuugaaaauacucccaccagccaggcucgguggcucacgccuguaauccuagcacuuugggagcccgagauaggcggauugccugagcuuaagaguucaagaccagccugggcaacauggugaaacgucgucucuacuaaaauacaaaaaaucagccaggugagguggcagaugccuguaaucccagcuaaucaggaggccgaggcaugagaauugcuugaacccgggaggcagagguugcaguaagccgagaucaugccacuccacuccagccuggacaauaaagugaaacucugucucaaaaaaaaaaaagaaaaaagaaaaaagaaaauauucccacuaauuaggaaaauauaugcagcccccuugcaaagcuuuuaaaaggaaggagugccuuuuuaaauguggccuccaauuucacgaaguuacgauaucacccuguaaacagacagcaucuaaugcugacugccuaccaccccccauaaaacugaaagagaagaaagccuuauccaugucucaccaauaacuguuuauccagugaguuauaaaagaagccacuggguuuuuauuauccaagcuuuuaggacaguucaaguucaauacacacaauguuucauucaugcuguuaaauugauaauauuaaccuuucuugcugagaugcauuaaaaauucuggcuuuucagagcaaauguaauuaguucacauuaguaacuucaccagcagcagcgacagaagcaaagugaacuaacaggauauggauuaauguaaucaaaauaucaucucccaucaucgccacucuuuaggcagcuggcuacacuuccucucuugguuggauuguuuuucuuuuuaauaaaaaugauacaucaaugaaauggaugcauaacuacuuguaauccccccucagggcaguacuguacaggaaaccauauuggugagugaucccaaaaguuuuaauuugaugugucugcuuaauacaauuuugacaucugagcaauggcucaaggcucuuucagggcacagagcuuugggaggaggcaggaggagccuuggaggaaaggaaggagaagccagaagcaguacauggcuucuagagcaccacuguaaguaucccacgaagauaaaaaguaucucccucucuaaauacuguaucacuaagagaaauaaaucaaagugguguguuugcucuuugaaguagcuccaaugcgaucacacaucaaaauauauuucugcaacccuguacugcccagccauaguggguguuugcuauuuugcgacccucuuucuugaauauccacauuuucuccuaagggaccaccuuguccuccuucuuccuuacugaggccgggaaccucauggccugggcuggcacaucagagcaucuuucucuggaacacacugguggagggcaguggccuagcacuaucacggcuagagaccucuugaaacaggucugugccacuggaacagauugcucacccuuggguacugaaccugaagguggggaugcaggguuaaaguuguaacaacccuuuugcuaccaccuggauccuuagaaugaagacaauaugcaggugggcagagucacggggagcccccaguggacuuccugaagccacucuuagacucuuccauuaaguggacccacagugcucuuuuccgcuugagccaauugaaacgggcuuucuucccugggaaaugaaagucaagguacuucacacaacacauuuuugacagggacauaaaacccuaccuggacugaaacgagggguggucaccucuccccaggcugcaaaaccccagacaugggacaagucaguuaacagcacuuccaccuuccccagcuucggaacuugugggugaacccuggccacaaucuaaucagcacugccauuaggaccuuucagggucucacacaggaccaggaagcagaaauaagaaggauaccgcuacccauacuuguuuuaaugcaagaaacugaaaguagagugauagaguccuucuuuagggccaguguuuacauacaggcugcauagaaaccugaaccuacaauucgucuuggcauagaagggaaauacccaauugacaacaacauaaaaacuuuuaaaaaagcaaaaaucacacuuagaagaaaaguuauuucauagcucccccaaagacauuauaaauaggaagucaccacaugaauucaguucuccaaacucagggaagccuccaaagguuacacaaucggccuccuggcaacauuaaaacacaaagggcaguuaauguucagaaugguagucaccaauuaguccaaaacacacacuuacuuagcaagcacauaccucugcuuaagcuuugagcugcucuguuagcauuuggcuaagccugaagugacacagguucggggucagugacuuuacugcgaaguuaaugucaccuuuacgaaaccuccauggguauaaacucuguaagccauucugggcagugcuggguacaaccaaaaggcauaaacaugcuauuuucucuccguauguuuucauuugaagaaaaaaaaauaggcaugagaaauauuaagacuuaaccaaggccgacuuacucugaaguaaaaaaggaugcauuuguagccaaccauuuuaauuuuuuuaaaaaacacggaaaaaaacauuggcauguccuauggcuucagguuaauacuacugagcagaaugccuaaacgagaauaccugguauuaugcccaguuacaaagccugagcgaucuucccauuaagugacaccacuguuggaaaauacaaaacccugagaaauuacagugcaacaacaauuucaaaugaaaauaaucaucuaguuuugauuuauacgaugcgcgcucuuuuacaucuaagaauugcagcagauacggucagcaucugaggguccuacgaggcaggcuaauguuaccuauggcucggaacacuaaucaaucgccacuacaguguguuugcaaaggacuuccgggguauguaauaucagcuccuguuauggcccuggcuguuaguagaucaaauguacuaaauuaucuagauauaagacuuuugagaaaggggauggaagagaugauuaggggcaaacaaaacaaaucccugggcuuugccucccgaagacagcuuucaguagauuauuugggaucccaagcaugugauuucagaaacagaaguagcuugcaaacagucccauguuccaccuagaucuuguuaagaccuuacaguggggggaggucuaccacuucucaucuucaucagguagucagacagcaaacugauucuacaaaucagcuuaaugauuuuggagggcucuucacucaaaugacuaugcugggggccaugcaauagcaguggaggcuccucggagagggaauuccccugagauccucuggccucgucuggaccacauggggguuuggaagggggaaaaaaaaaaaaccuucucagccagguacaguggcucaugucuguaauccuagcgcuuugggagacugaggugggaggauaacuugagcccaagaccccaucucuauuaaaaauuagccaggcauggggguaugcaccuauagucccaaccacgcaggaggcugaggcagaaggaucacuugagcccagaggcaggaggcugaggcugcaauaagccaugauugccucuacugcacuccagccugggcaacagagcaagacugucccaaaaaagcccaggaagaaccugagcccuucaaaacaaccccuuuuauuggagacucggaggagccuucagacccaauccucggaucacuguggugguuccaucgccaccaaggucugcugaagccucccugcaugggauacgccagguguucacccacacguagacaucuuucuguguagcagcuacuccuuauagaaucuaaaagacaaacauguauccuugaaaaaugggcucgcgugaggggugcuccuuucuuuuaacucccuauaaccaaccucuucccuugggagucgucccacugaccccucccaaagggguggcccccuucccagugauccuuccccacugggauaacucccaaaacaggugucccaggaucucccucucugcagccaggucaguguuuccaaaaaccuccuagaccagcucacuccccuugcucgugccacaagcaccuaaacucaacaacucaacagcacaaacauucuccccugucaaacuccuacccuuuguuguuuccuauccuaguuaauggcaaggguggucaucuucuccagucagucuccagucauccguaagcucauugcuuuuccucuaccugccccaacuucauccuucaccaagucuugcuguaucuaucuccaaaaggccuccgacccccuuccccaugcucacuccauagcaauggcaucugccuccacccacggcucugccagcuucccuccuuccccagacagcugccagagacccuucaggaaacacagaucugcucguggcacugcccugcuucaccgucacugccuguaaagucagguccagucuccuagggaaggcagacagggccacaacugguuuccgccagcauucucaccuucauucuuagaggacaucugccugaauugacuuauccuuauacucagccuuuauucaccuaccccacaaucucugguacuuggcaaacuccucugcauccugcgaggcccugcuccuaggcaagucuuccccugcccccuccacaccaaucuaccccuucuccugcuuccuguggcacuuugcacaaagcucuaauaagauaugcaccacacucccauuugguugguuuccaugucagccuccccacagggagauuuccccagaaguguggcugugucuauucaucuucagauccccaaagcugagcucaguaguugcagaggcggaaaucagcaaauguuugcugaauacgaaugcugcacgcccaacacccagagcuugggggugaagacugucucucugagaggaauccaacuggucucaagcuacacacuuggccaagucaggcucucccaaugcaagcaacuccagucaacacgcagcaccaaccaccacuacugcaggcaaacaugcugucaacugucacugcuaaccacauuuuccaaugguuugcuuccuggccuagaccaaccggcucacggcuauguacaagccuccaaccuguaugccucuaaccagagaagagcuaacacagcuuuuaauuaugacccugggguucaguagcgugaagggggcagcaccaagcccaaagggugcacuguccucucacguguccacacgacauucagggaaaugggauacgcuuugugccaacacccaccccucccuagaagaggcacuaaauccagccacagagcugaagagcacuaccugcaguuucgauacacagauaaguaagagcaguuaucaacgacgauucaccuuucaucauaacccaucuuuuggaaaguucacugagagacagaaacaaggaggagaaugaaccaaagucauaugaggggaaaauggaacccuuuuaaaaaugcuauucauucuuagggguuaauaauuacauggauagaugauuuacgcagaggagaaaaaugcagccaagcagugagccccuaauaaguauucgggauuugaccaaaacguuccuucaguugcuauuaacuauaacacugaagaaaggauucacacaucccaugacaucuauuuuuauagcacagggcccagaguuagccauaucacuuuuaaugacuugagauuccagaagaauuaucacuacgguaacauuucaaaauggccaucaaaguuaccaggcaccaggccacaacaguuuggaucucauagggccuuuuagaacagaccaaguuauuuucaaaauucaucuaauugauuccacauuccuaacacagccuugcuggaaguuagcuaaugggguuauugacaaggaugaauuaacagaaagagcacucaaauguuaucuguuuccacuccgagucaagcucuucuaaucauaagccaccagaaaauaauucaucggugacuacaaugaugugauaauauucuuuaauauuucuguaagcauucaaggaaaaauaugaaaaaaaaauacgggaagguaucaaguuugccauuauuuuuguuacuuuaauaacugacuugaaauuauuuuacaaauaaaaaguugauaaaaauuacccaagauacagaucucgaauauuuaaaaaugcuuacagaugaacaaugaaacacaucaugcuauugggaacauauacucaaauucuuaaauucuucccaguccucaggggguagccaugaaggagggaaacaagugacucucuuccauccucauuuucacaggaaaacaggaggcugaccucagaggccaacucuaugugcacuaaguauggggcacucagcugagagccaacagagucaaaaucagggugaaaaggaccuuaauaacauccuuuuuaagccgcuagcugcuacccauugguaguucucaaaaucaguuuaaggcaucucuuaccagcauuagaauagaagaaaguaucgugguacuacaugaauagaaagcgugagugcugugucagacaagaagugauuucaaaacacuuauuuuaguuauauacuuauucuguccugggaucaugguguauaucuauguuuuacugugggucuaguuaaaaaaaaaaaaauugaaaaucacagauguaguauaucaccuuucuuuccaagagaggugaggugaccugcccaaaguaauuaagcagugguacacucagacauuagaauuuggaucugccucauuuuuaaacauucuuucaucaacagaaaacucaacacagacauccagugggaugaauuuagaaacagaaccauauuugagaaauuaagggagccacugacacaaauucugcuuuuaacugugccuuuagaccagaugcccuuuaaauaggcccuugugaucccauaacuuuuuaauuacaauaucauggaccugcagacaggguguuacaagugagaacugugcuuuccaaggguuaugcagggcaaaccuuauccaggccugccagaagcacauggcauuuucaaggccauuuacuaaggaaagacacacucacacacaucgugccaagggcauucuaugccagaccccagccaggaccuacuguuagggcucuucaagaggaugaaggcgaauccuaggccucuauuccugugaaggcccagcucuuacugggaagggcagggaggcccccagauacugucuccagggaacgggacaguucaccaagaccacacacacagccugcucucacugaaggacaaugagauguggaaagguucacuuaaaaaaaaaaaaaagcacauuaggguuuuucuuaaugcacaguacaaugaagaaaacagaaaacagaccagaacccuauuguccagauaacaccuacugaccuuugaaaagaauagaagaaauaaaagcacaugguuaaaaaauuccaaacagugcaaaaauaauacaagauuaccuguggaggucaccaagcacuuccgguuccuuuccaugaaaaauaagugcuuauuacuuucugggauuccuucucaaaaacuucuuaaugauugaaccagcauucaccagcaaacaugcucuuuuuaaauuaagcccugaagaaucagaguacauauaaugcucuacaccuuuuuccacuuaauuuaucucagaacaaagaucuaaccuuucaaagaacagcuguuguagugagaauuccacucuuuggaaauguauaaaucagacacaaauucaaaaugcaguauuuuuugugucagccuuguaauccuuuaacagugaguccuaugggaauuuaaaaauuaugauaguaucagcuaauauuucauugaggcauugugccaugucuggcccuggacuaaccccuuuucuuuaccucucacaacgaccuuagaaggaagcugaguguccacagucguguagcugagaggccuuaggaagguaaauucucuucaccaaugugcagagccaagagguagcacagccaagauuuuaagccagaucugucugauucuacuaccaccuacuacaaagagcuuucuugucauaggauaaaggugcuggcuucuccaccagaggaaaggaagccacuuaaaaacuuacagagagggugaucaccaaaggccaccagcuggccucgggagagugcagaaugcacucccagagcuaggaugaagaagcgaugggggccugaccccgcccaggcggcccugggcaucagcauaggcaccucacuggguucacaauggcucagaacaugcucaccugcuugagcucagccucuugaacgucugcugcuaauagccgcucuucaagcaaagcacaugucaugagaccuauucaaauacaacugagugggacccugaaacuggggcuggcaauggugggagcacuaagucaggcccucuugcugggaggugaugugaagagggccacuucucaucccugcucugcuguccccuuaaccggggucuugagcaguggaggaggagcucaggccccuccagucaaagacaguccaggcugagucuagacaacccgaccauucucauccccacccagcccggccagccuuucacagacaggcaccgggaucugugauggccagcggcaacaacaggcgugauuucuccuaggacacaucacuuuucaccaagaagcccaucuugaauagcuggggguguguuuacagauccaggaaagcucagagcaaaaauacuuaguuaaaaagcaaguuaaaaaaugcaucuucagggcaacccgcuugggucccuuuccaugcuguggaagcuuuguucuuucacucuucacaauaaaucuugcugcugcucgcuuaaaaaaaaaaaaaaaaaaaaaacaaugcaucuucagugaguacaguggcuaccucguguuccuuuuuuauuugaugggaaauaaaggggaagagagauuuacuuugagucggcaggccagaucugcaacagggacuggagaacuuuccaggcccagcagccccggccuggcccgcauuccuucggggugacagcgcaccagggccggccggcgguuuccccaguccuucugccgccgccacacagugacuaagcccacaggaaucccagcgggugcuggacccacccggaggacaagcaggccgagaggaaagccugugacugccccgaccagcagaagaagaccugcucucugcccuccagccccuggguauaaugcaggagaagcuggggaggcuguccaaggcaggagcagccccaccugagcucaggugacagcccaucucacuugcaaggccuugcagagacacccaagccccauacucaggacugacuuugcugaggaaucagagagcagaguuucagggugcaccuuuaucucccugagaaagacucccaguaaaagucgguuguuugcccaaaggaggcagaauuaaacuacgggcaggcaaccacaaguuugcuuugacaaauaaaacaagaaaaaaaaaauguaaaccuacacuggcccaaucacuuuccaagagccuaauucaugguaaaaccagcaguccaagaucugauuuugauaaaucacuuccugacucuucauauauuuuacucucuguacgacuguuauuuuuauuuugcaaaagaauuaaaaguuuacuggaaaccacauaccuuucuuccuuuacgacaaccugucauucaucacagcuaaaacauccacccauuaaaugauauuuuuacaagauuaaagaaugguuuuaaaaagaaagaaaucuccuuaguuaaaaaugaaccaaacaaagguaccuaaucacugaucagcaucaaaguuuuguuccacacaugaaaauaauucaucaggccagguguggcggcucacaccuagaaucccagcacuuugggaggccaagguggguggaucaccugaggucaggaguucgagaccugccuggccaacauggugaaaccccaucucuacuaaaaauacaaaaaauuagccgggcauggugacagaugccuguaaucccagcuacucaggaggcugaggcaggagaauugccugaacccgggaggcggaaguugcagugagccaagaucacaccauugcacuccagccggggugacaagagcaagacucuaucucaaaaaaaaaaaaaaaaaaaaaaaaucaucaauguaaaaaugaauucugccuaaggaggggaauuuaaaaagucagagaaaagcaaggaauuaaaauucagaaacaagcuguuuuauaauuaagcaucugcaauuuaacuauacuaugucacucugauuuucaucuuuccuuucucauaagagucauagauguucuccgcucauauaaaggugguaggaagggagggagggcgccaugcuaauagaacccacaucauguuuacuaagaacuaggcagauguggacaaaaacuccaaagauuuaaaaguuucuugacuagagcaagacaucuucaagaacucauccaacauggugccuagccuucuucagagcaagacaagccacuaagucaucccuggguguguguucagcagcagcccacuaggaaguauuaggugagcuacgaugggagaguaaugggcaggaaaaucauaggaaagcaggucuggauuugggcuggcugcuuagcugcauggcaccuugcacaaguuauaaucaggucucuugccuccauuuccucuuccacaaaaaauggaacaguaauauccauauccacccuacagacugugcaaagauuaaagaauacuggcgaggugccuggcaccuagucauuguucagugaaugccagucaugaucacgaacacaguccuugcuaagagggugauaugauuuggcuguguccccgcccaaaucucaacuugaauugugucucccagaauuuucauguguuaugggaaggacccaggugagguaauugaaucaugagggcuggucuuucccgugcuauucucaugauagugaauaagucugacgagaucugauggguuuaucaggguuuccacuuuugcuucuuccacauuuucucuugcugccaccauguaagaaguaccuuuugccuccugccaugauucugaggccuccccagccauguggaauuguaaguccaauuaaaaccucuuuuucuucacagucuuggguacgucuuuaucagcagcaugaaaacagacuaauacagaggguaaucaccacaggaauccagacggggaguggggucaguucacugguacaaggaucuugaucaaaggaacucauuucccaccugaucccuauucacuccaggguccacaucuaggagucccaaagaccggcaugcauggguugggucaacaggcugccuggagguuuaccucauuccaggaguuggagaagcacugugggaggaacugggguucaaaucugcaaaccuccaaaacauaggagggaucuucuaaaaguuucugagaguucuaaccacagauuaggggaaaaaaaagaugcccuuucaucaacaugggaugaaaugcuaggauuuagacaugguuuuuuuguguguuuuuguuuuuguuuuuuuccaauucagaaaacacuaaaucauguaaaaaucuuggaagaggagauacagauucugaccuaauaagaugcuacugcucugauuccaccaucagaauaccuuuagguuggcaccacuugcaauguauuagugcagcaaacugcacgaauccccucauuagauccagggccccugagaguagaaaggggaguggggcaguaaauggccagggaacaggagacagugggcuggagggugucccagguucuaaccccagcugggccuucagagcccugguguggucugggcuaaccucucaauccuuuuccaagucuuaaguuuccuuccaacucacugugauucuuccagagaauuacacagggcaggugaaauuauuuccuagaaaaugcccauggaguacagagguucucacugaacuucucuauuccagggccgaugccuuuguuuuaauggcagcgcaucaucgacuaaccaaauccacagguacugcacaggucugaaggauccggcucugagggauaccgaggcauccggggcucccucugucuucuuucuguguacacaagguaccuucagugacugcaaggaaaauccucuugcuuucuacaucagagcacguuccauaagggcaaagugcuccagucaucaccuccuguuuucucuagccagaccugcucugagcuggagacccacugcagucaagcaaacuuuuagacacaagaaaaaaugacaacgugucuauuacagaggucucagcuuaaucagaaaauggcacugugggccagagaaaagcugacggugauggcuccuaccccagugcaauaggcagauccaugagagcucucacuggggcugcuggagaacuggcugcucucucccacuuuagucaccccugcuucauaaaugucugugccagaaagccacagugagcccccaguggccccuguauuacccacccagagagacaaccucuccccuccaugaaacucauuucugggacccacaccuaaacuuuaacacaaaucagaaaaguugagacuccuuaaaaaugcguuuugcaagcucacagguucuugguucauaagugauacuauggaacaaucugguugggaaggguggcacacaauagaaaaaguuaaugauuaucugguguaguuugcuuuagucugugaguucaaaagucuccucauuuacaauaaccuuaaaggauaacaaaauaaaguccuagaagaaauguaaauuuaauuauuuccauuuucucaaaauauuaauugcugauacaauuaaauggauuggccuaaacugcuccaaagcuuuuccuaucugcuaauuaaauuugcccucgcugccauaauacaaauucugggaaaccuucuggcuucugggcacacuauguaggaugagagaaucaaauccauucaguccuaaucuacugccccacuuaauaaacaaaaaauguuaagaacaugcauuuaaaaaaaaaucuaaaugccuucauaauauagauacagcaagucuucccauaaugcuaaugaaggcuucucacaagaguuuaaugagcuaguauccaguaucuuccaggcccggggauguuagcuucuccucccuuaguacagagguugcucagacagcaaucagcaucaugauccauacuaaaugcaacggcccuacucuuuaucuuuauagucuguaauccaagucacucuauuaacaggcagaaaaaucccagcuagcuucaaaacucccucaucuuuccauuauuucaaaugacaaccuuuucccacuacuuuaucuuugcauuaaguaccaggagcugaaagaugcaaucaauuuaauauuucccucugcccauuuacaugacuuauuuguuucggcagaucuucuuugccacaaauccuucauuugcccauucaugucugcauacuuaacauagauuuaauauuucuccaggccaaagaucauaugcagaguuuuucuuugacuggaggacagaagagacaaggagagaagaagaacgucuggaauuccuuuguucuuggagacaacuccagagaacaauucucaauaagaaaaguuauaaaaagcuucaaucagcacccucacguuucugauuuaaaguuggggugggggagcguggaauaaaaagagagggaacuaaacauguacgaaacucauucuagcgugagacguugucagguacuuugcugacauuuuaucauaaaacucucucucgguggccacggguuacagcagggaaccuaaaaccuagacuugggaccccaaguccucgcuucacaaaaaucaugacauggguguugaaccaguuucuguucagccacacagaaacucauucaaguccuucaagaggaagaaucccaccuucaacuccacaccuccuccagcaccaggcggagaugcuccugauuccacugagaauccuccugcccacacaggcaggaaacucggggcacucagugccugcucucucacccacugcaugcccacagaccucugcaaaggcagcuccuuuauucccccaauccugaacaucuguuaagugcuaaggccucagagggggcuuuuuaaacaggcacaaaguagaaacuaccagcuuuccaccacuccuaccucauccaucagaaaacagagccaccagccuuccaggguaggguucaucaagccuuuuccuccccauggaacuaagcuguacacaguagucagagauaaauaaugucuaagccaaaccggcuugagggcacauauggagguggggggcagagggacacuggccugggaccuaaaccaccauucagaccucaucuuuacaaaauaguauacuccacauuccaaaugccuggcaaaguuuugcauuacaacucauucacgagucgagggccuuguauacaguguucggcaaacaguacugagcaaguguggacauuucucaugaaaggccucgauuucaaccagacccaaauauucuuuuaauccaaaguuccaaauguggaacuuacccuccucugagcuccuagcacuuguugccucuauuucucuucuggcaaaagucguagagugucucgucacaccgcauaaguugucucucucuuuuaaaugucaaguguuuuuaucuuaucucacaacagaauccuaguuugugucaucucauacugccuagcaugagacuugcacaaaacgggggcaccuuaauugugcagcugagggacacgauggaaacucuggccaaggaacuagcaaggaaaccugcaaagacacauccagaccuaaccuaggugcgacuuauaacucaaaccucuuccccagucucccucucuaugggagugauauguacacaauguguucgcuuccacuuccuuaaugaugguggacugacaugaauaagaaugauggggaggaccauaggaccccaaauaauucacaagucagcaaagugaagaacucaccuaggccauacaugugcacacauucucuagcacacacacuuacucucacacucuacuguuauuuaguuuguuuauucauuccagcuagaaccagggaccaauuuggucauccaaaaauguuuuguaaaucucuuuauaaaauuccugcaccucucagggccagcaccagagcaaggcaagauugguguccaggauacaaaauguaaacaggugcucccucucauggugcacuacccugagagaagaccucuuuugucucugguccaagauuucucacucugguccaagaugccaccacugcugccacugccaucgccaccuccuccuccuucccuuccuccucccccaagagaacuaugaggaccaaaccacucagacacuaaguggggucaagcccacaugggagauggauuuuuacagaguaucuccuccacgggcuucccauuagcugugagguuggagaaucaaacauuauaaacaaagcaugaguccuaacccacaagugguuucucaacuguuuggggagagagaugaaugaggaguaaacaagguccucugaaccuacugauaaaaaguacagagaaaccaucaucacugaccaaauaacccagcaauggaugagcacaaaagcaaccuggaagcaagaguccucaguaaggaagauuuggggggcuucauggaagaucaagugggugaugguuaaggagaaaccacgaagagcguagccucaguagguaacgucugcuccagcuagagcucaccaugcaugcacaccaaacccagaugccgaaaaccaaaaaauacagcagaacgcacccaacucccaaaccacugagaaaguauuuuaauuuugcuuugaucacuccagcugcgcuucagaguccccagcauuucagcagcaucauagaagaagacaucaaucacuggccauggcacaaggaaacuccugcuuggcuaucgggcugcucagauucuggaugagggaaagcuuacuuuaguggaaaagaaugacuuaaaugaauuuaaauucauuccacauaaucgaguuacaucagcauuucucauaugcacuuaugaauaauucacuuugguaacagcaaaagccagaccagagaaagucacuucaaagaucuaagacuuaacaucaauccuaccugaauuuccugcucucaacuccuucccuaaccacuuuauuuccuucugcccuaucacugaggugcuuugccagccuccuguccuacauccguuaucccucaguaagcucucuggaacuuuccaauugcagccaccuccuaauguccacagccuccucuucuagaucuaguuucguaggcagucccuaaggguagggcccauccuaaaaaguucgacugcuucauaccauuccaagucuagaacauguccucagucucuaguaguguuuacugaaagccacggccaacagaucuauccgagguccccaacaaccuugucuucaaaacugaaucucagagcuggaaggaaagucaguagaagaggccagaucgugcuuucugcaauagacaauggugcuuaaguguacacaauuuucaugcaaauucccccgaucaugaagcugggcugcucccuauacuucuugucauuugauucuccaggccaccugccucuccagcccagcuuuauaaugguaaggcacugaugaguuugcauuuauuuagauacacuggagggauuuugcgacuggaguuacaggaggcugaggagcuggcaucugaaaguccaugcuucacgcuuuucaaaugcacuauguauaaccaagcucauuuccaaaaacagaaucugaacuagcucauaauaaaccauucaccuuuuauuuuuugcugaaggggucagagcaucaucccaauuaccauuucucucuaaugaccacuuacucccuucuuacacauuuucaucagcucuuuauucuacacugaguauuuccaagaauuaggauaacacuaccgcccaauaagauagaguugggguuacccaaauaagcaacagaagcuuuccagugggaccgagucaagucaagggucucaaguccccccacccuaaagcacugaacacgaaguucagggagccugugucugaggccuaagcacuugcccugcaucacaaugagcagaagacacaggaggcacgacagccgucaucacugcacagccaccaguacaccucgaagccaauuaauccugcaaaacaaauuccucucaaaauggcagucuguuaggucaaguuuggcuguuuuguuaaucgccuaucaacagaaacagcuuugcuaggcacacccagaaguucaucucuccucaucacccaccuuuggcacccagugacuuuuccaaggaggaucuuuuuccccccucagcaaacaagaaauauuuggugagcuaaagaagcauucuucugagaaaauuauacauucucagaauuccauucauaaaggacuacuggucacaaaagaauggccagggguaaggcaggggugggaggaggaagggcaggagacccaacggauggugcugccuggacagucccugaagugauaaagaguuagaaccagacacacacuucugcauucagcugcugucuuuccuugugaguggaaaaacacacucaguacauucucugcaauccugcuuaaaaccucuucuaaagcuucuuugacacaguuauucaaaagcuucuaaaaguaguaucgacguauuacaaaauaauccaaucauuucaaguucacugaggaagagaacaaaaauauauccuuacauccuaucugaagaauagucuaagcaccuaauaauaucaucuacuuagcaaagcagaaggggccauucagaggucaagaaauaggaacggaaacguuguacuagguuaccaccccaggaacaaagcuggucuuuucuaggacccaaggaucugacuaguuuccauuugucucugcauuacaacuaauaccucugggaggugggggugggggugauccuaauucaaacaguaaggcugcccaggaaguauuucuaauaauaucaaccuucgucuuuccuuuuuuguacuguaggcucuuugucuccugaucuucuuuuauuuuguucccccuuuuuacuacuaagcccaacuccuggucucagcagcugcuaaaacacguccaagcacuuugcaucuauccggaaauccagaauggcagccuggguucacagaucugcugccaagggcagauguaugcgcacugcagcugggcccuccuccccaggggccccaugggcacaagcagcucagggugggccagcgagccucagucacacuggcugcccucagccccaccuucugcaugaaggguggcuaagcuccaugggccacucugcauuaaccccaggaacggcaaccucacuaacuucauccaggucccuucauuaggacuugcaaaaacaaaucagaugcagcuacacguuggggcagugggugcagcuucucuaaacaaggccauggguaucaagcaaccgacagucccuaaauacgcugccucuguucccaucccacauggauucugggaaaaauggcaggaagaaagaagagaggacugggcgcuuguuugugaccaaggcaaagaaacaaaaagcgacuucuguucaauaaugagaugaaacagaagcccggcuucgggcagaggccuggcauuccugcacaacauuuucccacccaccugauccccuugaacggaaggaagaccuaagggaggacagagagccaguguuuguuuccugcaaugggggugagaggaggaaaaugaaacuaaacaaaacaggagaagaggcugggugggagaauaaagugguacgcacauacacaaacacacacgcacacgugcacgugugcacacauauaccuagcguuaccaaagaagaggauaaacaggcacaugcuucauccuggagcagaugguuggcuaccuaugugagaccuaaaguugucauaaaaaugcacaucuuuguaaucuuuaccaauaacugugcccacucuaaccacuuuaauguuauccaugcaaacagacagaggcauuuaaaaaauaugguauuuaaugauuuaaugucaguaucauacaagaaucuauggauauuucuuaaaugcucccaaauaccaaacuugcaaacaaaauaaauucaguuucggaaccaaauaaauagaguuuacauaugacuagggugacuccacuggcaccccgauauagacauauguaccucgcugaauguucuguaaagauacaguuuaucuggacagacacaagaauuugaacaguacgaaucaaauuagcaagaaccacaccuacaguauggcccgcuauuuacaauaauugaaauucuacaauuuagaaaagcaauacagaaggaccauuuaguuaugguagugaacauauauagucaacacagcuuaagacucagaauuuuagauggucuuagaaugcaacucuuagauaguuuaauuuaaaaaaaaaauagcagcagcugccaccauuuaccaaaaaccuaugugcuuggaaacauguuagaugcuuuucaaauacuguccuauuccugucucacugaaggaaggugaggucuggcagcuuuguccuagcaccacauaccugaggcaaacagauggcacuaucucaaggcaucaacgguccuuaaaccuuugcauaugauaccacuuguccacacaggaacguaguuuaaaagaaauacauccuguucuguacaaaaugauguauucuugcagaucucgcuguuaauaugccauggggaaaacaagcaggggaaagcuguacauccgcauguggagccaccuaaacauccugaagaccagucacacugagagugagggcaggcacaggaugguagcuucugcccccacggacuccacaauauuguaaggaacagaugcucagggauaucaggggugaggccuggccagccccaugacauccugaaaaccuaacagcggccaagcugaccccgcagaagaagugaucuaaccuggauggucaccuucccugccuaagacucacccuuuccaccggccccagaagcccuuauuccuccuugacuugaaaagacaacugucccccauaagcccucacaccuccuaccaagcuccaaggacuguucuguucuucugccuacucccgcaaugcaguucaaacguuuaccagggcucuacagugagcuacuuuuccaaagacagaaaagcaaggcuaugugcaaucagacgaaacuccagcucucauuguaacauccagcuuaaagccauauguuagccaguggcagguacagauuagaacccagaauggucuagauuuuggguuucuacuugggguuccuucuuccauauaaaugaucucuaaauuucuuaaacccugauucccaaauuauacaugaugaucagugugccauuugaugaguuaugaacauuuuaaaugcugcauaccuugccuguauguacuaggaucaaagaggagagagagagagacagagagagagaccaagcaacacgaacacacaggcagaucaggaagcaagaaaucuucucagagcagaccacggaaacccucaguaacuuacucaauuuuagaguuugaggaaacggcacagguaguccgaugcaagccccccgaguucaaagaaaggaaauggaaguacagggcagacaggugacguggcaaccgucccuaggaaaggcacugcuggacccagcugucccugucccucaccagccucacaugcccaagucccauguaccccuggggcugccaugcuggcugcugagccaugggcgcugguuuggagaugaacuucuucgaggaaagcagcuucuuaucccccagaaguucugcagaucaucugugcacuuugguuuuuacuuaaaaugugauuuaaacagccugcucuacuuaauacugccugugccacagacagaaaaaucccaucucccacccaccagccucccuggaacaaacaccuuggcugucucucgcuaccuccaagucaggggaacauuccaaccaggauggugcucagagaccccaccuuuuauagccagagucccugauucacaccauaugcccaaaggaggcguguuucuaagugaugcuuccaacuucaccaccagccaaacuuaacuuuugaaccacccuauacacgcaaguugagcaaggcaauucaggacaagauuaaccacgggcccacacgcuccacgucauccccacucugccgagaaugucacacuggcauacacaugaggaaagcaagacagagguauuaacgcaacaaagaaagaggcuuuucaagcacaggaagaaaccagaacaauuguacaaauagguuuaacuggugagagcugaaggggcuccagauauuuuccaaauacuuggcaugcaaaaaucaccacaagucagugguucugaaagcuuuuuggucucuuagacgagaucccuauuaaaaacuucugaaggaggcccaggauggugacaccaucacuaaugacaauuagccaaaagcaaagucuuugaggcacaaggcacacgccccaagaaaugaggugggcuaagccaggucccagggaaccugcacacaaacugcuucaccaucucggcaacaagcgucggcaaucaggcagaagagaaugugagcuccacgccugacuauaaaaggcauagcaaugaggccugggggcaugugacccccuucuaaauaaagaucacccccacacugggagcagcugaccagagcagaggccuuccagggcaaccgagacaaguuccuaccaacaacacaaagccagaugccccucuccuggcugccuucuccuccaggguccacaagccccucccaagaguccaccugaaaaugcaagccugugucaugaucgucuuagcagucuggggaacaguggccugcagaagaccagcagcagaccacacagugcuuaacagaaacaucucagcucuucacaaguagcuuaaguuuaaaaaaaaaauguuaagaugaaauacugcacaucacaugagugaagucucacuacaaagacaaugugccccucuuccccccauccagcaggugauuuacacauucuuuuuuuauuauuauuuuccuuucucaaagcuagccauaaaacuuaguuacaaaaucuuuuuuuuuuuuucucagacaggauuucauuaugucgcccaggcugaagugcaguggcacaaccacggcucacuguaaccuccaucuccccaggcucaggcggauccucccaucucagccucccaaagugcugggacuauaggcacgugccuccacaaccagcuaauuauuuaaauuuuuuuauaugaacaaggucucaccauguugcccaggccagucuugagcuccuggacucaagcgauccuccugccucagccuccccaaaugcuaggauuacagguguuagccacugcgcccagccuucaauuuacacauucuuaaacagguccuccacuuugaucuagcaggucagccacaccaaccuauagaggaaaacgagggaaggagagcgccucuacuccgcaagacaacacugcccuugugagcaguggcugacaaacaaggauauaagaacguggcgguggaaaaauguagacuuuuuuuuuuuuacuacaaccugccuucauuuuaagucagugagaugccaucagugagauggcaguaaaauguuuuccuuuugucaauaaaaacagccauuuacugccuucucgaaggcuccaaucugcuauuuuccugguuucucauuuugagggcaauaggaaaugcaacaaacuccaggacugcugcucccagucaaugcccuuuuaauugaaauaaggcugccccaccagcuaagccagcuuccaacacagcccggcccugccuuccuggauuuccuggcaaagcccaggccuucucacacgcacucagggugaucugagcagaccacaggcuguucaucccaauggguuaaaaaguacuuggagacuuaguugcaguaaggucuuagguuuuguugggguuuuuuuugugggaaagugaaggcaucugcaccugaaaugaaauaccagaaagccuccacagcaagcaaacaacaggcacuuagguaaauucagcaggaaguaagaaaaccacagguacucaggaggauucaccuccgucccucccagggcagaacuggccuucagcaaaacugccuuacaaagucaugaauggcuucacgugccaagcuucaaccuuucagaugauuuccauacuucuccaucaucuuuggccuggaaucauccccacaauggcaggaaagaaaagagcuacccgccauagugguccucucugccaacuaagaguugcagaugauucuggucaguacuccucaguagcaaugacagcaacaaugacacaguaaacaucugcauuucauaauccugguacaacuggcucaccgaagacugccaggauacgcuacucucugcucaaggggaaaauguaucuuccgaacaauaaauccuucacuaagcagaugcagugcuugcccuuggggugacagcauacaguggaggauacacccagaauuuacaguggggcaaaaagugucccaucaggugcugggagacaggccucccgaaaucugcagagccuuuacauccuugagaggaaaaggcaaggcuagaguucggccaggugagccgugccggcuggucagcacgggagagcaccacuggggccaaggacacagcaggcaggcgggagggaguggcacauggaguguggcauguugucacgggguagcuguugaccacucaggagcuucacacuguaccacaugccuauccuauagggacuugcuacaggauuucagguaggggagcucaucaguccaaagugcacacuagauggccgggcgcaguggcucaugccuguaaucccagcacauugggaggccaagaccgguggaucgccugaggucgggaguucgagaccagccugguuaacauggugaaaccccgucucuacuaaaaauacaaaaauuagcugggugugguggugcgggccuguaaucccagcuacucaggaggcugaggcaguagaaucacuugaaccugggagcccggagguugcaaugagccaagaucgcaccacugcacuccagccugggugacagaguaagacucuuucuccaaaaaaaaaaaaagugcauacugaaaagcuccccagugcucgguggagccacaggacacaauagcaggagagaggcuaugucacugcuguaagggggaggagcagaggaacacagcugaagcagcauuuccauuccauucgggagggaaagggccugguauccaacuggagaaggaaguguccaaaggacacccacauuccugacauaagaaccaggggaacaaaaguguggcccacuuaagagggaauagaaaagaaaaaaaauaggcaaaagugaggaaacagggaagaccaucagaggcuguagugaaaugcucgugguggucugauaugaaugacaaguccuggguucaaaaggguucugggauggauaugaaugacagguccuggacucaaaaggguucugggcuggagauacuuggaaguuuagguggagacaggaggcaaugcaguuaccaguggaugagaugagaacaaggaaagugaaaagagagcccaggacagaacuccagccaugcuaugaucugaauguuuauguccccucaaaauucuuauguugaaaccuaauccccaguaugauggcucugggaggugauuaggccaugaggguggagcccucacaaaugggauuagugcccuuauaaaaaagacgccagaaaaaaaaucccucgccccuuccaacaugugaagacagugaaaaggugcuucugugaaccagagugugggcccuccccagacaguuaaucugguaagcaccuugaacuuggacuuccagccuccagaacugugagcaguauuucuguuguguguaagccacucaggguaugggauuuuguuacagcagccugaauggacuaugucaggagaccaccguuaaaagccagacugagggaagggagacagagaagcggcaccuguggggguaggaagagacucauaagaggguggcguuggaagacaaggaagaagaaucaaccacaccacaugucagggggugccacacaacuauguucuuacugaaaggaaaccacuguacacaguucuuuaagggucaaucgcucuuuaggaaugacucaaaaauguauaaaauccacuccuaaauccaaaaagaaccgagaaauacagaagugugcagagaacccacagagggaucacguccauagagggaguagagucuacuacgcugccagacacugcagagucacggcacagaaggaguuuaaaggacagugccaagugaaaaccgcgcaacagcacgacaaaaucgaguaggcucaacgauuucacacacacccuugacguguuucuccagauguucuccguaguucuacagccagccaacagaagauuaccugaaugggauucuucugugcuuaauguuuucgaauggccaucuuaaugcuuauguugaacucaagguagccauucugccuggacucaaugcccuucauggagcuccccaaaugauuccuaaggguucuggcuggagagguacaugcggggcuaugagcgcugcagugacgacucagccaaaaagaugaugaggggaagaacuccugguguuaaaagaaaugcucuaaagcagcuuaccaacacagaaugcaagccacaucuguaauuuuaaauuuucaaguagccacauuaagaauuaaaaagagucgggcaugguggcucacaccuguaauccuaacacuuugggaggcugaggcgggcggaucaucugaggucaggaguuugagaccagccuggccaacaugguggugaaaccccgucuccaguuaaaauacaaaaauuagacgggcaugguggcacaugcuuguaauuccagcuacuugggaggcugaggcaagagaaucgcuugaacccaggagacggagguugcagugagccgagaucgcgccgcugcacuccagccugggugaugagagcgaaacuccgccucaaaaaaaaaaaaaaagaauaaaaaggaaacaggcaggugaaauuuaagaacacauuuuacuuaaucuaauauauccaaaauguuauauuucaacauguuaucaacauaguaauuauuaaugaaaugguguacagaguuuuugcuauacuaugucuuggaaaucuaguguauauuuuacaccuaaagcagucccaauucggacaagccacaguucaaguacucaauaagccacguggcuuacucaauaagcggcuaccacacuggacaaugcaggucuaaauggaaucuacgcaaaccaagaggaaguucugauucaacuagaaaaucuccaagaaauaugcccaugccugaguuuucaggacaaggggaagggaagucaauuucccggaaagcaguuaccaauuuuauauaaguacuccauugugaaaucacaaggaacaucagcagggcugggauggucaaggagaaggcugcagggcguggccuuggggaagcaggugaccaaccaacaggugauaucaaggcucugucugucaccagcagagcccaccuucuaaccaucguuaacauuuucacggugcuuuuccuuccuccuuuucaucuuccaacagcccuaugaggaaggcaggcuuuaccccauuccacauaugaagaaaccaaggcccaggcaauuuaaauaacuugcucauuucuagucgccacucuuagacuuggacccagaaugcaggccucaccccuaccccaggggucuucaaucaguagcucaucagaaacagccaaaaaccuauggcaagaccaaaguaacuaccuaccuaguucgugaacaacucuccacuuaaugacguuucauauggcaccucccuucucuaaagagcuuaugaguuuucaaaacauccucaugcccauauaugaucaccacuaagggauguacuggacugcccuagaaauauccuaaaaaagcccaacuacagcccagaagggcuggcccauccaaggucauuccuggcccucaucaccacauucaacaucucuuuucuacuccaugcugccucccuugauaacaccuuuuacuuuucagauaaaauuuuuaaaugucaagguuauuuaaaaaauauauuuuguuguuuucucaaaccaguggguaacuuaaugauagggcaguuuuaaucaaccacacaagugacuuuagcauaagaucucccuccaacuccagccaaccuuaaaguggccugacugcauucucagagcucuacaagguacuggcugcagccagugggaccccugcccucacuaaucaauguucacauacgcacugauccaauucugcagaauagaaaagugcguggcagaucaggguacacagauccuuuuccugccucaggacugguugaacgggaacugaagggcuaccugggaggucuguccuuuauuuacuuuacacacuucaccccuguggggucucgccuuuuauuuauuuuaggcaagucuaacaauuugggguuucuugguucuucauaacuagagaacauggguuccuuacaucuuuaacugggccaacacuuaaauaauagcuauuuauagcuaacacacugacuucaaaccagugaggaaaagcuuccuagccaauauacauaacuauugcugaaugcaauaaggugaaggcucagagucacauuuuaauaccaaacagccugguucuuaaggaacugaucacaugaaggcaagagcucaguuauucucaagggaaaauaagcauauugcagauaaauauacaagaagcuucaaaauaccaccaucugacccccagaacaguaaauacuuuccaaaguuccuucacucgugaaaucuuaagauuuucacaacuguucaguaaacagguauaaaagaacgaaaacagaaucccagagguuuaaaaaugcacccugcuacacagcuaccugcaaguacagccugaaccugggacuugcagaaauggguccagaggucucccaccugggccaggugcucugucauaaccaggacaccugaguaucauaacaucaucacuaggaccuaaggaccacuuucacaggauaugaguuagugcuuuaccuucccuuuauuuaaccauauuccaaguccauucaaacuaaggaaguccugcagaacaaaaaauaucacuucgcacaaaggaugaaagagcugacacauaagcagcccccagcugccaaggcucagggacuuccaagcacaccaggucaccuuucucaucaggaauucaaagcugaaggucagcaagugucuagcccaggagugugcuggauuauuucuaacaugugauuugaacagucuugacagcagccaugauggccuccagccacgccacagucccgcaauccaagagucccagaugcaaaggaaagccaaccaagacccccacugggaaccacuuccgcacagcaggcaugccacguccuaaaugcaacacgacugcacccugcccagcggaacucgugcacucagaagagaagggaggucaaggaggaggagaggagagagagaggcagagagaaagcagcagucagcaucauucuuacuuuucuggcagcgguuugugguccagcagcgguaguuguacucauuguugaugguggucuucucacacaucggcuucuccuccauggucccuggacacagguccccacauuccuuugggggcuuauuccccacaauguaguuauuggacaccgcauccaggaucagggaccaguccacaguggagagguaacagaggucagcauuuuucucaauccugauggccccccgaguaauguuccucagguuguaaagcccaauauccuugagauuggucaucucgaagaugaccagggcguaguuguagaagaguuuccagccgcggaugaccgugagguuggggaagaggucuccgaggcucucgaggccagccacucggaacagcagcaaguacucgguaaugaccgugagcuuggggaagcgguagcugcgguaguccucggccuuggagaugagcaggauguggagguagcccucgaucaccgugcaguucuccaggcgcuucagcugcugauagucguugcggaugucgaugccuggcccgcagacugaagggagacaagaggguaaacgucucaguuagaaggaaauaauuuuuaaacuauuuuccaaacaauaauacaguugguuuucaggaauccuguauuauuauuaaagaaaugagguucaauuguucacugcagagcuguggguugcagacugacaguuuagguggcuaaccaguuagcuggcauuuauacagugccaacacuggaccagacgcugugcaacacacuccaaccgaccaugggagaggccauccccguuaaccgugcaaacuaaagcuuacagcccagaggcacacagaggcagaggcgaaaguuaaaucugcaacccaggccagccggacuccaccaccgcacacuccugguccguucugcagagcgucaguugccaaggccugaacgacagcucagcagccaaguaucaauaacuuacuacugcacccugccugaaggacacagggcaaucaaucuacucuacacuggagaaccgucacugugacuuguaaaguggggacuaaaaaacgcaugcuuccaugcuucccacuaccauuugacauaagccgaguagacuguguucucuccacacgugcauuaauguagacauaaaggauaaccuaacaagauuaaaaacgugauuuuuuuaugaauaaaagcagcauaaacuccaacuuuaaguuuuauugaucaagaaagcaugcuuccuacagaguuuagagguaauaaccaaaaaaaaaaaaccaguaaaaaucaucaacgaucucaacauuccacgauaaacaauguuaacacuaucuaugccaauuauccacucucuauaaaugaagguaagugaaaucagacaaaaaugacauuuguaaacacacuuccuucacuuaauauuuuacuaggucaauacauguccuucuacaucaccauuuuaaggggacaguaguuccagaguauuaauacacaccaugaggguuguuuuuuuuuuuuaaccaaucccuuauuguuggacauuuagguuagcuccuguuuugcacauuauaaacaacacuccagugaacauuauuggcagauacccaagacuauuuucuuaggauaaaucccuagaaguggaagugcugggccaacgcauuugcagauuuuaaaggcuuuucauaaaauggccucaauacuggaugacuuauuuucuaaauucuaagcacagacacacaccaagaaaacucuuugugauaaccuuuuuuaggauuuaauaaucccaaguacacuauuaaagcuucucagauagagugaaguuuucugacugauguaauuaauuugggaagcacccaacauguaugauaccacgagaaaugccaacaggcagugcccugcccucugaggaggcucauggugaaggcaaagagcuaagacccaugaggaacaacugucacaugaggcagguggucaguggugugcacacagcgaguccacucuagaugugaauggaauuaagcaggacagacaagaggugguguccaagcuuugugccaccgugcuaaggggagcucugcacacaggccggcucccaaagggugccuaggauuuaaagcucgguaaauaucccacaggccagagacaaugcagaacaagguaugcccaugugccagcagaucugauggucagggugaagaggggagcaguugaggaaaugaauuugauagcacccaagucauaaaggaucacauguggggauaagaacuuucaucucagaggaauaaagcccccacaaggcuccugagcgggagagaagcccaugugaggccuuuugcaggauuaaucugguggcccagugcaggacggaauaagugaacagacgagggagagaagaaaagucccacugggcauuacauuacaaucaaagacagaaacugagcagagauagcgaagagaagaggaaguggagggacccaagggcugaggagugggcaaagcuugagaacuuagaaugugaaacuucauaucaucuaauucuucuguuuuaccaaagagaaaaugacaccccuaagacagagaaaagaauagcagaaaccagcacuuggcaaacacccauuuuaaaggugaggaaacagauuuggggaagucaagucacuuauacacagucacauacauuagauuucagccccuacauagcaaaacuugacacaaggcuugucaauagucccaccucucagcacccucaccuccugguuaccuuuaacccacuccgacugagcuucuguccccauuaugacaccgaauagcuccuagcagagcccucagugacacugucgaagugucacuugaccuuccagucaccuggcauugccuccuccucucggcuucccugauuccacacugcucugccuucuaccuuaccucuaaauguugguugcuauccucaaccuuuuccucugucaccucauccagacaaguggcuuccugugccacucauacucuagauaugaucaaauucaugucacuggcccagacucuuuugagcucuaacguauacauccgaguauauccauugaggugucaaacaacucacucauccccccacauaauccaccuuccaagcuuguaaacugcagcacucucauucucugaguugcucacguuaagaaucaaagagucauuccugauucuucucuccucucacaccucacauaucuaguccagcaacagaccucagggcuuccgcucccaagccuaugagaaucuugguugcucuucccacaaugcugccccacgucuuuccucccugugcagcacgcuguuccucaacaacccuacacacuucccucccaagguacaccacccucugcaggacaccgcucuggcccuucuuuucauggucucucucaccgcagcuccaguugguucacaauuauaucaccagugccuaaaacaguacuuggugugcagcggacacaugacaugggacacacgcagaaugagugaauuucaucauucuuucaaugucugugugucuccacuacuuuagcucugaucugagccacuaucaacuccagcuuggccuaaagcaacacauuccccaugauccagccuccucacgguccgucccugucccaacaccaucugacaagacuccacgggacucaccaaccuccaacacaccgagcuccuccucugugauacccugccgcccacagugcuucugcuccuucaggaggcugccccauucucuagccaucugggucuccacucaaacgucaccuccucagagcucugccuaaacaccuuagcuucaacuauucccccaacugucccccaacuccucccucccuccccuaccucucauuucucuucucgcuucucuaaaaagucauuuuauauauuuuuaauaaucuugugcaugaaacaaaguuuguauacaacgaaccauuuuauuacccuuuguggaggugucugagggaaucugggcauguguggaaaagacacaucacagcugaagggggccgggagggucuuuuuuccccuggggacacuaaauuaacugugugucgugugccugaguuucgaaaagugacccgucacaugaggucagguguggaauuuuccacuuguggugucaugucagugcuccaaaagcugaaacuuuugaagcauucuggauuuuggauuuuuggauuagacaggcucaaccuguauaaagcguuaggcaucuauuuacuuguuauuuccaacagaucacaaaauucaguaccuagugaaacaacaugaagacaaagacugaagcaaguugaacuucauacugcaaucaaaaugcagacaggaggaaagaaucugcuucacuuugccaucuggccccccuuccacagucaguguugaccacuaguuaacagaggccacacuacagagcuggaacugugaauuuccuucaaaugaaagagcagucuccauacuucacacuuuuccucccauuuauagaagaaaagagaaaaaaaguaggaagaagcuacccacuuacucuggaagaaaagacaagcccaaaccacagagcacgaggcagggccuaggaaccagcuguuuuggagccuaugacugacaccacuggucuucaggagguuuugugauagaaacagugaaaaagaaaaccaagcuggaccaugaaugauagcagcguucaggaggcgcaagccacaaacaggaaagagaagaaaauaugcuccacuggugccaugaaauaauucaugcaccgagggaguaaacaguaaacacagcacaagagggagagacacacccuuuguggcuacucaccgaugauuaaaaggaaaaugcaaaauacccuuucucccuucucaaagcaaccgauauuggcaugauccaaaaacaaacccaaaaacuuuuggaaugugagaucccaggcagcccuguaaagaauaagacaagcagggaagcagagagaaaggguacagcuggaagauggggacaguggggccucagcaaaguccccaaagccagagaauggcaacagcagaaccaaaacagaugggggugcugggagucagggaagggaguugggaggggcaggcaggggcuugguaccuggguagaauucacuucuccaaagaugucauuuuauuuauuuuuuauuguuuuuugagacguggucucacucugucacccaggcuagagugcugcagcacaaucguggcucaaugcagccucgaccuccugggcucaagcaauccuuccaccucagcucccaagcagcugggaccacagggguacaccauaacaccuagguuuuguuuuguuuuuuaauuuuuuggcagagagaggguuucccuauguugcccagguuggucuccaauuccugggcucaagcaauccuccagccucagccuccagaagugcugggauuaccaccacaccuggccaaaagaugccauuuuaaagaaagccuuaaaagucaggcacagugguucaugccugcagucccagcacucugguagcccaaggcagguagaucgcuugaggccaagaguuugaaaccccaucucuacuaaaaauacaaaaauuagccaggcgugguggugcacgccuguaaucccagcuacuuggguggcugaggcccaagaaucacuugaacccacaaggcagacguugcaacaagucaagaucacaccacugcacuccagccugggagacacagagcaagauucugucucaaaaaacaauaauaaaauuaaauuaaauuuuaaaauaaagucuuucagcugaaaugaguacuguuaacaaaauacucuuagguauuuucuaaagaucaagaggcagaaugucugcucuaacaacuuaggugaauggcauauacaagcuauauauauuuugaaaauaaaucccuaagaacuaaauguuaauaugagaagggcuaaagaaaagcauuuggcugagaaaacgccccaaagcuguguagcuaaguauuuggaagaccuacacgagaacuguaaauuaugucuuagacacaaccuugagguccuaggaaaaaaaaaaaaaaaaaaaaacagcgugacucccaugagcccagagugccauuuaccagcuccugcucucaggcagacacaccucaccucuaaaccccaucuuccucaccugcaaaaugggcugucacuaccuacccuauagaagcuggcauaagaaucagguaagugcuuuuguguuacugcaaacaguaauaccuuuuagcagcuguuauuaaguaaacauuaauggaaauacugaucuauuuuguugccccaauguaaauauuacuaacauacaacaaaggaggguggcaugaauuagcaaaaacacugauuaucccucugucaacaauuccauuaaagaauguuauaguuauccauuuaguuaaaauggguaacuacuugaucaacucuucuuuaaaaauaugggauagguuggccgggugcggcggcucaugccuguaauaccagcacugugggaggccgaggcgguaggaucacgggucagaagaucaagaccauccuggcuaacacggugaaaccccaucucuacuaaaaauacaaaaacaaaauuagccgggugugguggcgggcaccuguagucccagcuacuugggaggcugaggcaggagaauggcaugaacccgggaggcggagcuugcagugagcugagaucacgccacugcacuccagccugggugacagaacgagacuccaucucaaaaaaaaaaaaaaaaaaaaaaaaaaaaaaugagauaggcuuagcuuauaguuggaaauaaaagacaucaggaaacauaauuagccuucuuuuacuacaggucuacaggcacacugugaagguaaagcacauuagugaaccaaucaucaucuuuaacucuaaugguaaaauccaacauaacaaaaccuuugggcuuaugugagaagucgguuuugucucaguaagcggcauacuauaguaguucuuuacuccucuuaaaaugaauucuuuggaaccaauaacuuaguacaacaaaaacccucucuagacacuaucacucugugaaagucaaaaugauuuaagagguuaggagaggauuaguguaucacugaauuuugcacaacgaaggcagaacaaccaucucucuagcaaguggcaaauuaaaugaaaaaaaaaguuuuaauagcgcaauagacagaacccugggaacauaaagacaaggccccacaacucccuaucuccgaggaggucaggaagacuucucagcagagacgacccugaaagaugagcagggucuugccaggaagagugggaggcaggguacuccaagcagaggcaggagcacacccugggaggcagcuggagcugaugccugguggcagcugggggaaucccaggggugcagcccguguggcggggagaacaacaaaggcaaugggacagaugcuagaaagcagacugagacaagugugugggaggucaacuucacuuugcuuguaggaggaguguucaaaguccucaacaugcaucaggaccacuugaaggaacuguuaaaacgcaagaggugaggccccaaaauuuguuucuaauaugcacccaggugaugcugaugcugcuggccuaagcaccacccugugagacccacugcccuaggaaagaacugaauaacccaccacaccaccugucacuacccucccuacccaccuuaucugcaguguggugcagguaaagccugugcaccuguuacuucucaaauugacauucucucucucagaaaacccccaagaagcccgaagaaacuacgaaacaaagcaaagcagaagaaaaaugggguggagacagacucucccuaguauaugauccucccaugcugugcccuucaaggucucagcacacccuccuugcgcucagagaagagagagcauggguuucuuuaggccucauuccuaauugaaaaaucagagaucagaaaagagggaaaaagacaauguuaugauaacaaacacuacugacacuucaguuuauuacaguagaauuuucuguguaaguguaaaccgacacaauucauguuaagcccuuuaucuucacgugucaaucagaacauguuuacguuguauauauacauucccauuucacacagacagcaauccuggccaccuaacacauucaauaacugaaggcaaugauaagaauguaagagauuuccauuacagaggaaacucugagaacagaaauuagaaaccgaguguaauuugaaugugaacuguuuuacugccgcagagccacccacacaucaugcauaucaacaaaauaaaugcacacaucaagggcaguccugaaggcucagaacguuaaaaccagagugcuacauacagcaaagaacuuacuaagaugggugagauguuucuauccugccacgccacuuaagacauggaaacuuuaacgggaauucaaagacuaaagggaacacaagccccaguguccccuccacugaaagcaucuguagccaaacagacuggcgcagaauuggugcagagcuguauuuguaacaaccguuuucccggaucuucauaaaaacaacuuuaucugcucugacaguuacuccaaaugccuuucucaucuuaaaauaucccaaagcccaauauucuaggucuccauauuucaaaaaacacccuuagaagagccucuaagccuuucuaauuauccacaguucccauggguggcuggcuucucgaugaagcaggacaccaggagauagagucccucggagccagagaucuuugccucaccaugaggccuuccgaggggcagcaccugccuagucccacacccuguccucacuaccaccuagcacccacugugcaugagacagcacccuaaaccuccgaaggacagacuguagagccaguggauggugcugugagguacagccaagcuggggcaaggcccaugcugagcaggcaccugcaaaaaccaaguuccuucugccuuccuuucccucucucucgugacuuucaacuuucuucucagaaccaggcaaauguccuaaauaaaagucggcccuguguccccuguccucucacuggcuucauuuuguagaacacauuacaucauuccaguuacaguucacauccucauuucaaaagcacuuuaccuugcccuacaaugcuccaguuuccuuaagugaccuguacucuuuucaauuagccaguuaucuaagucuagcugauaacaguguagaaaucccacucaucuguuccccuacccugcagugugauucuucauggauguggugucaaaacagaagcuucuugaaauacugaggcuuucuaucugaucuggggacuuuccuagcaaggaaaaggacugggcuaguauucagagaccagcuaccucuuggauccaucaccaaccacccaucacauggccagaggucagucccugcaucacucuaguucaugcacaggaaggaaauccucucacaugcaacaaccuggauggagcuugaggacauuaugcuaagugaaauaaggcagucacaaaaggagaaauccugcggauucugcucauagguacucaaaguagucagacucacggagacagcagaaaguggcugcccguggcugugguaggagagaaugggaguuauuaauggguacagaguuuccguuuuucaagaugaaaaguguucuagagauugauuggacagcaguguaaagguacuuaaacugaacacuuuaaaauguuaagaugggaggccggugggcgugguggcucacaccugugaucccagcacuuugggaggccgaggcaggcggaucacgaggucaggaguucaagaccagccuggccaacauggugaaaccccaucuccacuaaaaauacaaaaauuagccaggcauggugccuggcgccuguaaucccagguacucgggaggcugaggcagaagaaucacuucaaccugggaggcagagguugcagugagccaagaucgcaccacggcacuccagccugggcgacagagcaagacuccaucucuuaaaaaaaaaaaaaaaaggaaggccaggcgcggcggcucacgccuguaaucucagcacuucgggaggccgaagcagggggaucacuugaggccaggaauucaagaccggccuggccaacauggcgaaaccccaucucuaacaauacaaaaguuagccaggcaugguggcgggcgcguguaauuccagcuacucggguggcugaggcaugagaaucgccugaacccaggaggcagagguugcagugagcagagaucgcgccaccgcacuccagccugggugacagaaugagauccugucucaauaaaaaaaaguuaagaugguaaguuuuaugucauacguauuucaccacaauuuaaguauagagggaaaguucugccgcauuuuaacacaagugcaaguggacagcugaggggagaccacacagcccguccaccaccgagaaccaaggggaacccagauggaaggaaagcagguuuggccacagcucugcugcagauacagcacacacaggccaggccuuuaaagaugccacccauaccagguguggcugugggacugcauccagcacagucagauucgucaggacacaaacagaagggucccccaggagugcugcacugacuccccagggaaaugggcucugggcacacagccacaagcaggcagagguggcggagcagguggacgcccgcaugcaaccucuguauugagugggcaagagcuaaaacacuguaugcaaccaaccacucugcaaacugaacaguggcagguucucacuaucugauguuucaagggcagaagccacaaccgacugcguugauuuucuaacuuugaguguuuggcacaucuguaccccaacacaguucuuccuuuguaaaaugcagcaggguuacuaugaggguccaucacggcuccagccugucccagcaagccccugccuucccuucaaugaucacucccacucuugccaaagccuuuguaucugcuacaacuucugcauuuacucuucugcucuaacaccuccagauucaccucuucccccaaaggaguacuuuuuccacugcacgcucauccaagcauccggaggacaauccgcaucccugacuucuucacugaggcauccuacgauuucuacuaagaccagguacccucggcauuuaggauuucuccauccacacccacaggaaccucugcccaccagcccagccagacagcagccccaugaaggccaaucccaucaucagccaggagaggaugucuaaaaccagugcucuuagcuucccaaaaaaaaucaccugaagaccuuucuccugagcagcucagucccacucugcuccagaugacagccaaucauagcccgacacucaagcccccugguaguaacauucucuuaucugcacucuagcagugguaucagccaaaggcaaaaacagaagaaaaacacugcuacaaagugaagcccugggucagaagccguaaacuacaauaaccuggguuuuggggaugugcccauuuucuuggcauaaggauuuuuucuuaauauguauauuccaggaacacauacuuggucuacaaugccuugcuaagaucucuuuguugacaaggugaagaaauaugaacuacaucugaauagcuuaguaaauguucaauuuacccuacaaagugcugauuaaugaacagaccaaggaaggucucuagugggaggccacaggucucuuucugaguacuguagauuucaacauuuuuaucaauuacuugaacgauggcacagauaaaauguuuaucuaauucaaagaugacaaguuuccaggagcaauggcaaauacacuggaugacagagucaagagcuaaaaagaucaacagauuggaauugcaauagagaggaaauaaaugcuauuuggacacuugggugcaaaaaaagaaaugcacaaauguaggaggugugaaaaagacuuaggagauuuaauuggauauaauuucuguaugugacgaugugauguuguggcugccaaaaaaaaaaaaaaaaaagaagaaaaagucaggcagucuuagacuguaccuaagggagacuuaguaaggggccaggggagagacccugaaaacuggguuucugccuccacacauuaagagagauaagucaguggaagaacauccaagugagagcagggaccagaagucccuucucauggagaacggcugcagaaacccagcacacaaaggucuccagggagggggacuggucaggcucuuuaugacccugcuggaggagagaaacagagaacuuagaucaacacagggugagggacugugguuccauauaagaacagacaguaggauucauuugaaacccgacuggacugccuaaagagguaaugaagauuccuguggagcugcacauuucugagauuguguaagccugaugugauuuacuaugagaacucuuuugggguguuaucugcucuguuuugcagcuaaggaaacugaugguuaacaaugagcaaaugaccuaccugggaucacucagguaauuuagggagcagagcuggggcuuaaauugagaugaccucacaugauucuagggguagaaaauuccgcuuuggagguaucucuuaaggcugacaaggaugcuacagccaggugcauaugauugaagaggugcucucucacacacaucgugcaugcugacagccaucucaccagagugggcaccucuuuaaagccucugagaguagaaaccucugucaaccccaaugccuugacccgucaaaggagggcaacacagggagcucguaaaaagcuuuacagagcuucacuuuguaucucauaacccacauguaaaggaaugaaacugacuuacuagggaaaauccuauuauuucagaccuuauaucccacugaaaagcauacacuguuugcacgaguuaacuauacugcagaauaucaaauucuuguuuuuguucacaacccauagaggcaggaaaaaaaauaaagacagaaaacacaaucuaacccaacuacaugaacuccuccugcacauacaacauuuuccuuagaggacagaaauggaucucacaaauuuggaacacaagauuuccacuucaucaggcaacugccacucaucacacccuguuucuauuaaaucccauucccuucguuaucuccacacuuagcuuuccuuccacgcacugcuuacacacaguucaaacuuuccccagcaagccacaggaaagucggccuccccgacuucggcgcacccauucuuuauucagugcugaugcgcagaucacacaaagaucccuucaugcuaagaaaguuuccaccccaccagaaaaucuauauucuuccauggaaauugagaaguacauuuuuuucucuuuuacaaguuccaguugagaacaauauaauucucaaacagauggagagcucagacaagcaugagcaacccuugccuuuaaagcaaaucaggcagugaagugugaggggccaagugucagucacuggcaccugcaucccccccacccugagucuggcccaggagcgcuggaggcugagguccaaaaaaaaaaaauggggaaagucagguggccacaaccaccucacuccaggaagguggggauguucauagagccacacagcaguucaaguggggaucccuaagccuuccuauggcucaucuucucugaaggguugacaggcaugcuaauggauugucguggaggauuaaugagccugccaugggccaggaacacaagaaugaauggugcagugacaucuuugaggagccgccucaccccuuuaauaacccucccauuuuguuucccugcacccuugcgcuucagcacgaacucuguuaauuugcuuaaaagucagcagcauguuacaucauguagacacgaacaauuaugcuuuaaaaaaaaaauccagaggaauaaaaguaugccaauuaagugcauagggaucaauguaaaugcuccuugcuaccagauaaaggacacauuuccaaauggucaccagaaacgaggcaggugcugccaagcagcaugcugacaaagucagaaaugucucccauuacuccucuuuaggauagcacaaguacagccuugaagaagucuacccuugacagugggcaaaaacagaagacaggaggucaggccaggcacgguggcucacgccuguaaucccagcacuuugggaggcugaggcaggcgcacugcuugaggccaggaguucgagaccagccugaccaacaugguaaaaccccaucucuacuaaaaauacaaaaaugagcguggcaugguggcauacaccugaagucccagcuacucagaaggcugaagcacaagaaucacuugaacccgggaggcagagguugcaguuagccgagaucaugccauugcacuccagccugggugacaaagcaaaacuccgucucaaaaaacaaacaaaacaggaggucauucgaucagggaacaaaaacaucccugggagguggagacgacccaaaaggcaggcaagccgcugugcccagugcaccagggaggcagaaaaccccaggcacccaccaagcaagucuacagcguccucugcauucugcagcaggaggcagggcugaaggacagcagccccauucagcagcuuuguggaccagucuucccagggaccugcuguagaacaaagcucaagguguaaaggaaaacaaaacccaaagucucaaauccccacaacagggugguaaaucuugccccucuacauggaaauggcacuacuccaaggcaaagcaaacgcuccccugcccguagccaacaucaccucuaugccugccucauucugcucauccaggacccagcuuccaagaccaaacaggucucccagccacagcacagcauccuauaguugcuggauggcacagcaggaaauagcaaggacguucauauggggucaggggggugcugcaagcucuccccacacagcccuggguuagggaaccacagagcaugcuccaccagccccuccaugcucucuaggcaacaccacgggcaaauggaacacgggacaaagggacaugggacaaagccuuggcaaaaugcaaucacgcuggagacuaaggauccagggucucccacuguuccaccacucauaccucccccacccaggcuuaccccacccugaggccccuacuaucuagggcggggguggcuacgucuauauccucccuacugauguccccauaccaucaagcagcucuuaccaauguaucaggugguaaacaacagacucucacuaacuccauuuuuaaaugcuggggcauaugaccaaggacauuaucucagguaguuguugcgggaaagagcuuuuagauaauggcuuugauuccuuaaggguagaccccuauuuuguuuauauuguuaaugagagcuugguacuaaacaguuuccaaauguuacuggaaaguccaaacucaccaucaucuuacauaagguuuccaggguaugguaaauaaauacacuucugacaauuagagaaaugcacacuaagauauuuuuagcuuggcugagcauaguggcucaugccuguaaccccagcacuuugggaggccaaaggagcaggacugcuugagcccaagaguucaaggcuacaguaaacuaugaugaugacaccacugcauuccagccugaacagagcaagacccuaucucaaucaaucuucuuuuuuucuuuggagccagggucucacacugucacccaggcuagagggcaguggcacgaucucggcucacuguagccucaacuuccugggcucaagugauacucccacaucagccucccaaguagcugggaccaaaagcaagcaccaccaugcccagcuaauuuuuuuguauuuuugguagagaugggguuucaccauguugcccaggcugaucuugaacuccugagcucaagugaucugcccgccucggacucccaaagugcugggauuacaggcaugagccacucugugcccggccaaagaaagaaauauuuuuaacuuaacagauucacacacaaaaaaauuaccaaucuaauaacaccaagcuugagugaggacauggggcaacaggcacucuccuacuuuugggaggagcauauguguacagccauuuugaaggacaacaucugccaaaaaauacaaaugccuauaaccucugaacagugacuccucuucuagagauccaacccucaugucaguggggcaaauagauguauguccccacgcauacacugccucauccagguggugaagguuaacaacaauggugauaggucaugcugacaaaucacugaagggagggcauuucagcucuguggucuugcucccaaaaacccauggucccagacuaaccauaagaaaaccaugggccgggcaggguggcucacaccuguaaucuuagcacuuugggaggccgaggugggcaaucacccgaggucaggaguucgagaccagccugcccaaccuggugaaaccccaucuuuacuaaaaauacaaaaauuaguugggugugguggcaggcaccuguaaucccagcuacucgggaggcugaagcaggagaauugcuugaaccugggaggcagaaguugcagugagucgagguugcaccauugcacuccagcuugggagacgagugagacucugucucaaaaaaaaaaaaaaacaaaaaaaaccaugagacaacuccaaauuaaggggcagugugcacaaaaccuggccagugucccucgaaacugucaaagucaccaaggacaaggaaagucugagacccugucacagaccagaagaggugaaggagacagcuaaauguaaugugcugugaugcgcuauucugcacaggauccuagaccaggaaaggaacauugggcaaaacugguaaaauccaaaaaaagucuugaguuuaguucacugacagucauggacuaaugcugguuccuuagcuguggcaaauuaccauggugacacagaauguuaacagaggcgaagcuguuaagagguacaugggaucucucuagacuaucgcggcaacuuuucuguaaaucuaaaacuauucuaaaagaaaaaguuuauuuaaagaaacagugaguaugcaugagcauguaagccgcaggacaacagggaucuauuuaaauguuuuuuuaaaaaguacccuuacugcucuguggcuugcuucugccugacccgccaacaccgccccacccugccgcccccaguuucuuaugcagguggacauaaccacauggaaaaaaugccuggaaggagacaugcugaugggccaguaguuccuuccggggagugaagcagacuggggagaguagcaggaagaggagagggugagcuauaucaccuaucaccuucuacucuguaacuguguauuguucuaauuuccauaagaaacauacauucacauauuaauuguauacuuaaaaucauuuuaaaaacaaagaucauucugcuauaggaagagagccaaaauuuauauaaaugaaaaaccacaaauugcaaaucuguguuuaaacgauggcuaagaauagcauuuuugcuugcauagcaaguaucugcaaagcuuacccuugggaagcaggggggaagaaggaagagucagaggagaggaggaggggccuggcauguuuacuccuuaccuccuguuuuaauugccuaccauaagcauguguuuuuguuuuuguuuugggauagucuugcucugucacccaaguuggaguacaguggcacagacauggcucacugcagccuugaccucuuaggcucaagggauccuccugccucagccuccugaguagcugggacuacaggugcacaccaccaugcuuggcuaauuuuuuaauuuuuuuguagagauggggugucccuauguuguccaggcuggucuugaacuccuggacucaagaaauccuccugucuuagucucccaaagugcuggaauuauaggcaugagccaccaugcccagccaagcauguuuuuaggucauuaucaucaugaaaaugaucauaaacccucaaaguucauuccuuacuugcucuaucuccuugacccccaaaccacacccaaaggagcccacauuuuggaauucugcuucuagggcugugauggcacaggaucccucuccuuugcccacagcuugagggcagcgugaggacagugugagggagcaagcacccucagagguggccccugcccucacucacaccgcuggcugaaacgcugguaucucuccaucggacaggaucuguucaacaucaaugcuguucuccacuggggcaucccgagagaccuauauaagggggcaacucacauccaucugugauggcagcaaaguguggcaagaaccuaaugugccuucugagucaucuuuaaacuaugcaaggucccugccugcaaucaauauauucuaauacuuuagauuaauacuuucugauuaaucaaucuaugacaaaccccuggauccucaacaauggcaucuaaaaaaaaaauguagugcaacuggcugagcacagugacucacgccuguaaucccagcacuuugggaggccaaggcaggcagauggcuugaggucagaauuugaauaacaugaugaaacuuugucccuacuaaaaauauaaaaauuagccaagugugguggcagacaccuguaaucccagcuacuugggaggcugaggcaggagaacugcuugaaccugggaggcagagguugcagugagcugagaucacgccacugcaccccagccugggugacagagcaagacucugucaaaaaaaaaaaaaaaaaaaaaaaaguagugcaacuguccaaagcugcuuguccuugaaaaggacgccaaaaaccaaccaaccaagcaaccaaaaaaaaucugcaagauaucuagagugggaaaacagcacaaugaagaugaaaaacugcuauuucaugcugcuuuuaagaucaagugauuuaauuucacuaacauugauuuuugcagagugauuuaauuuugcuaacacugacugagcuucugcuuacugauguuaacaucugggcagccaaagucgucgcccaccacacagaggaaggaggagaaacaucaggccaucugagaacccauccacaugcauauacugaugaaucaaagcguacugcguaaaaagaggcuuccaagauuaaucaagguuuauuuuuuagguccugaaucucucaggaugucugauaaaaagcugggcccuuucuccaaaaaaaauacacuuacaaagagcuugcacgccauuuccaaaggcccucugaaccccaucuauggggccuuuugagucacagacccucaucaacuagucuugagcuauaagcaucugugauaccauuuuacagauuuaaaaaaaaaaaugaggacuuaagagcaauugggugacuuucucaaaauucucccaccagcuaauggcaagguggagagcucuggucucaugcugucuagaaaacaugaagcacacucagcagugguuagcacagacccccaacgaaagcauuauaauagcauucccacaugugccaacgcuacgcaaagguauacacaugaaauaacagugccaucacacacacacacacacacacacacacacacacacacagguguguguuguguggugagucgaagagagaaagaaaguugggagcgggggagagagaguguggggggaagugaaaggcagagagaggagggagagugggagaggaaggagaguaggagagaaggggcgggggagaaaacaggagcaggagagaaggggguggugggagaacuauacuacugacacuaugaacuugggccagggcuggccagggcugaauccaaaacccugcccccuacccgugaaacaagaaucuagguucagaucaccagagagcacacugagaagccaccauguccuuccuucaguaaggugcaggcaggcagggggccucaaucacugggacucaaacuccccgcccaucagccucuguuccaugcuacaaaccacagagcacaagacaccgcugcaguucaggagcaaagccccaagguaaguggcaccaaguaucccauuuccacagcacuccaggaccacuaccaaacaggggcuggcaaucaugaggagcccugcuuccagcaaggaaguuaaguaacuucggccuuccacuggaggccagagauggcaaagacaaaaaucugaagauaaaaacaggcagagagcucuacagcuggacacuuuuaagagcuuuauuucuugccccaacuuaaccauuaauuacacaaugacaaccuggggaugcuuuggcuucuaugccaagucguggcuucuaacaccaccaccucucucuccccugguuaccacacagcaucucgcugggggcuggacccuggucuagcccuccauaaugcacccuccacccuacuaccaaggcggacuuuccaaaccacaaaccugacagugcccauucuucugcauuaaguccuucaaaaccucccugugccuuccagagaaaaauccaaccuccuugaaauggccuaagacucugugauuugaccugugucaauacauccagucucagcucccgauauuccuuuacuaaggacgagacauggagccaacugagguuucuaaacuccaagacaccgaguacacaugcuucccagcagcuccuuccaucaaaacacccaucuucucuaggccaggccuuuaacacucgccugggugcagacucgccccuucaccgccacaggaccccaacugcacucauuucucuuaaguuuaggcacucguuuaccuacuggacugugaucccaugcgcagcuggaacugcacuguauuuacuguccuucacaagggccaaaccagcacaggucugagacacagcaggugcuuaguaaacacugggcaaaugaaugacaaggaaguaaucaguugcucuuguucacaugcucccucucuuccuucuccuccuccucccaaaaccuuuagguuuuuucacaugcucccucuccucucaaaaccuucagcuuuuaagugaauucauacccauaaaaauuuaaauaagccaggugcaguggcucacgccuauaaucccagcacuuugggagguucagguggaagaacugcuugaggccaggacuuccagaccagccuagaaaauguaccaagaccgcaucucuacaaaaauuuaaaaauucaccaggagugauggcgcaggaacauagucccaucuauugaggaagcguaggugggagcaucacaugagccuaggagguugaggcugcagugaacuaugcucacaucacugcacucuagccuggacaacaaugugagauccugucucuaagaaaaaaaaaaaaaauuaaauacuucauugauauuugcuaaaacucaaaagucccaucaaaaccauaaugagauaccaccucacauccauuagaauggauagcuacuauaaaaaauuuaaaaaaauaaauaaaaauaaacguuggcaagauguggaaaaauuggaauucuuaugcagucuacauggaaaacaguacagugguuccucaaaaaauuaaaaauagaacugccauaugauccagcaauuccacuucuggguauauacccaaaagaacugaaagacuuaaggaaauauuugcauauccaugaucacagucauauuauucacaguagccaaagcgggggagcaacucaaguguccaucgacagacaaauggauaagcauauauaccacaugguaauggacauuauauaaauguguuaucacacauacauauauuauuaaauauuauugggccuuaaaaaggaaggagauucuggacacaugcuacagccugaaugaaccuugaggacauuaugcucauaaaaugggccagucacaaaaggacaaauaguguacgaguccacuuacaugagguauccagacagucaaauuuacagacagaaaguggaauggcgguugccaaagacuuggggaaaaaggcaauggggaguuguuugauggacauggaguuucaguuugggaagaugaacaaguucuggagauggacaguggugaugguugcacaacaauaugaauguacuuaaugccacugaacucguacauuuaaaaaaauucuuuuaaguagccucaauagcugcugucugacaccacccuuuaaaguucaaaaugguuucagacacugacagcugccacaccacccaaggaggcugcggcuccaaggcugggcaaucaggcuaccugcgguggaguggugagccgcugaugccugggaccugccgcuagaccugaauacuggaagcacgcugguguucuugcacacuccuguuccaucuucaacaauuaucuggaggaagcaccaccaggggcccagcccacagaggcaucuuuggagggacccuggacagacaaugagcagauauacacauggucugagccagucguggaaagagccacugggaagauaccgaagggacacagaggaagaggugcccagcuggcuaacagagaguagagugggcuggaggagacugauggaaacccacugggaagcgggugcccuagauuauuauuaaccuccccagacuaaguaagcagaaguuggagucuguccucuaguaaguuacagccccaguaagaacccacacaaagcauguaagcauccaggcaucuaaagaacucaacaucuaccauccagcguguccacccacuuuccaggaaguauggugacaggacugcaaaggcaagcacagcaucauucuucuucaaagccaacaguuccagccgggcaugguggcucaugccuguaaucccagaacuuugggaggcuggagggagaggacugcuugaguccaggaguuugagugcagccugggcaacauagugagacucccaucucuacaaaaaauguuaaaaauuagccaggcgugauggcacacaucugugaccccagcuacucaggaggcugaggcaggaggaucccuugagccugggacguugaggcugcaguaagccaugaccaugccacugcauuccaacugggguuacagagcgagacacuaucucaaaaauuuaaaaaaaaaaaaaaaaaaaaaaggaaaaggaagaagaaauauauacauggagggagccuacaguguggggucagacuccucacaaaguuucaaacauucugaagcucagggagacgaaauaauuugccccaaaucacacucacuaaauauuagcgcuggauagaaugcaagcccagacuuccugaagccaaaucccacaugcgcucucucagcacacagucucccgaugacugccuuucuccuucuacucucucauccacagcaacccaguggccaaauuuugcuccauuuaaaaaggaaggaaagaaaggucccuguccucaucuggauaagcuuuaguuauguuuguauaacauucagaaaaggccauaaaagaucuucacugagggcugugcuaaguauuaaguguuacucaauaaaccacagcauagagguugccaacugacguuuagcuauaaccuggaaagaguacuggcugaauacauuuuuuuuuccaauuucaauuucuagguaucauuuauauucauccgcccacaccccccaccucccccauuagcaagcauaaaacaaacaaaaaaaaccccacagagcuacaguuguaagacacaaccagaguagguggcauauuaugauaaacaaagaugacaauaaaacauuuuuccagcugugauaaacauauuuaagaucuaucagaggcugccagagcuaaaacugaaaacuaugaaaauugcaaguuguucauaacacagaauuuaugucuuagaagcuuuuauuuuuuaggcagaaguugucucacuaggagaucauuuccuuaccuuuuuaaaaucugaacuuuuaaagcugugacauguugaggcugucacacguccaaagugauuuaacaacuggcugagggagggacugaggcugagcacgggcacaugguacagcucagaggcccagcuggagaagacaauacugcucagggcagcccuacuaagccuccaggaggaucccaaagaucuacgcccgccaggugauuaggacacucacauuucauuacgucucaaauacugugaacaagcaauucaauuaacagcugucucagugucuuagagaucagaaaaaauuaagaagaauggugaauuaugucccgauuuccaaauauccacgccuuugugcccuuucuuggcuucugaaaccaucugucuuccuuucccaacuuaaaaaagaaaaaacaaaaacuuuaaacaauaaaccuugccauccaacugugacugaugagauguaguugugaaaugggcuugucagaugcacuuauauaagaggauaccgacuugauugcaauucauaacaucucuaacaucugaaaaacuucaacaaugauuuucucaauaaacaaaacuguuguguauuacacuaagcugagcuaagauuaccucaucccuuaaaaaccaacggcuguaaacaaguuguaacacaacugggcaaugcccacacaagcaaaagucccuuugcaaagcccagcagacuuccagcaacuuccuggccuuccgagcagaaacagccccaaugaugggacuaaaggaggagaccucacagaacuggagaacaucagaucgugaaagacucagaacagaacacuuuacuuuuagaauccuaaaauaaacacagccagaccacuugaggaaucacggagguguauccgugaaaaggcgcuguaucugcuuuuuaagucacacacccaaacucgucagaucucucuuaaaacccuugagaucaacccuauuccaccccuuuugaugaacaccuaccuaugccaugcacuuugucagauccuauggaaacaaagaacauguugccugcccuuaaagaaucccuauaaccacagaaagagaaagggagagaaaccaguaaucucagcacugugugaucagaauaucuagcagugcacacgagauacacugugacauggggaggucacugauaugagggguucaucaacucuagggagggaaguggugccccggagccugcuccaacuuaaaugcauagcaagaaaaguauaaccacugaucacauuugagacccaaauaagacaguagguaugaauuuaaaaagcaacccaggccaggugugguggcucaugccuguaauccuagcacuuugggaggcagaggcggguggaucaccuaaucaggaguuccagaccagccuggccaacauggugaaaccccaucucuacuaaaaauauaaaaauuagccaggcaugguggcacgugccuguaaucccagcuaccuggaaggcugaggcaggagaauugcuggaacucggaaggcagaggcugcagugagccgagaucaggccacugcacuccagccuggaugacagaguaagauucugucuccaaaaaaaaaggcaacccagagaaagauacuaguuucucugugccuaaggaaaauguaaaaacguagacaagcucuucaauuaaaccuccacuauuucuaaaucgccuacaguauuuaaagagaaagacuccuuuuauaauuacaccugacacuucuccccaugaaaacaucucggagcacagauaugcuucuucaaugugaaggucggucuccacgggcccuaaaaggaacacuagcucaccuuacaggaacacccucagcaaacaugagagggacagucaucuuucuccugguaccuucccagcuccuccuggaaaacaacucagauaaccauaggagaccaaagaguccuaauaugauuuaggagacggaaguuacucaaaaucauuuccaacaaguucaccacugaacacuuccugugaccaaauaaugguggcagguccugcccugaagguuccaacgguucugcuccauccacccugcuguucacucaucaguccugccccuagaagacccuaugccugaggaccuaaggguggugaauuccuuccuaaucgcucuccacccuacacagaaaaucacuaagcucaaaagaaaaaguguaagggccccauccacauuccaaauugauuucacaugacccaacagaaaucauagcauuucuccccuccacccacccauccugaagagugaccaucuccuuggucacacauagcaaacaaaaauucagaugacaccagggacagacccuaaauucaaguauuagccugaugcaggucuaaagcagagauauuaacagauuuuuugacucaaaccaacugaaccagacucaccuuuacuaacuaauacacaggguaaaauuccacugaguuuuuaugaaagccaugucacaacucccccaagaauagccuugaggguggagcaugagcccccgacagggauggcaaccaaccaccccaggcaggagggucugcugccuccaucccugcagccaggaagcaucagaugccauccaagcugucuucuauggcucacauauccagcaaauuacagcacuccccaaacuuagagguuuauccuugaacuacuccuuggaaugaacccaaauagguaagcauuuucuccuccauaaggcuacccauuaccugcacccauugcacgagacugcaaucaaugaaaaccuccugauaacuaucagaauagcugguggugaaugcaaagacacaagcagagaagcaagaacugaacaacgagguguaugucaugcgccagguagacaugcgaaacaaggugcaggcagaaaguagugcagccgcccucaagaugucacaaucgaucagcaaagcagacuuguaaagacacagaauccuaacauaaccaaagugcuacagaggcuuaaagaagcagaguuacguaucacuuaaugacagggaugcauucuaagaaaugcacaguuaggugauuucaucauugugugaucagaguauacuuacaccucaaugguauagccuacuacacaccuaggcuauacaguauagccuauuacuccuaggcuaccaaccugcaaaccuguagugcauuacugcacugaauacugcaggcaguuguaacaccaugguaaguauguguguauuuaaacauaccuaaacauagaaaagguacaauaaaaauauaguaagaaggauaaaaaaaaaaaaaaaguacauauggccaggcucacaccuauaaucucagcacuucagaggccaagcacuugcuugacaccaagaguucaagaccagccuaggcaacauagugagauuccauuucuacaaaaaauuaaaaaacaaaaauuagccaagugugguggcaugagccuguaguucuagcuacuuggggagggugacacaacagaaucaguugagcccaggaguucaaggcugcaaugagcuauaaucacgccacugcacuccagcuugggugacagagcuagacccugucucuuaaaaacgaaacaaaaggccaggcgcgguggcucacgccuguaaucccagcacuuugggaggccgagguggguggaucacgaggucaggagauugagaccauccuggcuaacacggugcaacgcugucuccacuaaaaauacaaaaaauuagccaggcgugguggcaggcgccuguagucccagcuacucgggaggcugaggcaggagaauggcgugaacuugggagguggagguugcagugagccgagacugcaccacugcacuccagccugggcgacagagcgagacucugucucaaaaaaaaaaaaaaguauacauacguauaugggaguaccaccacgaauaaagcuugcaggacuggaaguugcucccucgggugagucagugaguggugagugaaugugaaggcugaggacauuacuguacacuacuguagacuuuauaaauacuguauaccuaggccucacuaaauuuauuuaaaaauuucuuucuucaauaauaaauuaaacuuagcuuaagcacaacuuuuuuuacuuuuacaaacuuuauuuuucuuaaauuuugguucuuguauauauuuucuuuauauucuuauucuauaagcuuuuuucuauuuuuaacuuuuuuuuuuaacuuuuuaaacuuuuuuguuaaaagcuaagacacaaacacacacguuagccuagaccuacaaaggguccggaucauccaugucacugucuuccaccuccauauccugucccacuggaagucuacaggggcaguaacccaggcggagccaucagcuccuaugaucacaaugccuucuucuggauaccuccugaaggaccugccugaggcuauuuuacaauuaauuuuguguuuaauaaguauaaggaguacacucuaacaauuaaaaguacagcauaguaaauacauacaccaguaacaugguuguuuauuaucaaguauuagguaccgcacacaauuguaugcgcugcacuuucaucugacuggaagcacagugggcuuacaccagcaucaacacaaacacgugagcagugccuugcacuacaacagacacgauaucccuaggggacagcacuguuuucagccccauuauaaucucaugggacuacuguuacagacgagguccaccauugaccaaaacauguggagcacggcaauuaauucuggauuuggauggggacacaaaauaagcacagcucuggcagaucuaaucaagauuaagagagaaaagcaacuaaaacaucugagaaaacagauacagagggcauaacaccacacagaaaauacuacauacaacugagcuauaauuuuuaauugacuugcuggaaauuacuaaauuacuaaaauugauuuaaaaagaaccagaaggccagcaugguggcucaugccuguaaucccaacacuuugggaggccaagggaggagggucgcuugaucccaggaguucaaaaccagcaugggaacauagcgagacucugucucuaaaaaacauuuaaaaauuagccagguaugggucccagcuacuccagaggcugaggugggaggcuugcuggagcccagugggcuggggcuacagugagccaugaccacaccacuguacaccaucugggacaagagcgagauccuguuucaaaaaaaaaaaaaaaaaaaagagcaucagaggaaagaaccagaacccuggaacagaccaacacccauggaagaccuuuuuuaaagcugucacaaaacaaaaacuaaccaucuuuuuacgccaggcaugguggcucacaccuguuaaucccaccaccuugggaggcgaaggcagguggaccacuugagcccaguaaugcuagaccagccugcgcaacguggcaaaaccccaucucuacaaaaacuacaaaaaaaauaaaaaauuagccggguguggcggcaaaacaccuguggucccggcuaccagggaggcugaggugggaggacugcuugagccugggaggucaaggcugaagugggccaagauuaugccacugcacugaagacuaaaaacaacaccaacaacaaaaagaaacacaacaaaaacuauucuuuuuuuuuuuuuuuaagugucagccuccaggcauuuaacaagugaguuguuccaaaccuucaaaggacaguuuauugccacacuauaaaaacuguuacagagaagguaaaaaggaaaagucauuaauucauuuuacaaaacuagucuaggccugacagcaaaaucuggaaaagaacucaucuaaagagaacuguaaagcuaucucauuuaaaauaagagauuaaaaaaucugaauauguuagcaaaccaaauuuaauuaggaauuuaaacagccacccaccgcaaccaaaaauaguuuaacacgggaauuugaggagggauuacuacuagguaaucuauuccuaccucaauuaauagguguaacaaccacuucugaauccaaaugaaugccaaaaugacaucugaugacauucaacacccauccuuaauaaaucacccaagaaaacaagacaggcaauucuucaacaugaugaaaaccucuuaaaccaaaagaugccuuacacauugagaaacagaggcauuaucauuaauauagacaaaaaaggacaaauaugccuguaaucaacauguaacaauucuggaugugcaggcuaaugcagcaagacccuaugaccaaccaugcuugguuggcccaacccccaugcccaacccacuagccauacccacauucaucucccaccuucuagccagcugcaugcaacucaguucuggccaaggagaagcagggccuacuggcugagcagcgcuugcugaccugucauucugccuuuuuugccuuuugucuucauuccuucucaacuucuuccugccugaaacagacauaauuccuggaggucaucuuguguucacgaggacaaaagccacaggcuaaggaugaacaaacagaagccaggagcccaguccucacacccucuuugagcaccucacagcagccacagacuccuucccuccagacugccugaacuugagaaaagucagccccugucggccuacucccuuauuaggcaggcuuucaguuauuuucagccauuuauauuccuaagugacacacaacugaugguaaguaaagacguauuauguaccagaaaaauggagaccaaauuauccuuauuugucaucaaugauucucggcacaaaaaaauuaggaagagucaacugaaagacuauuauaacgaauaagagcaaucaacaaauuggguagguacaagauaaguacagaaaauaccagagcuuuccucacacacaaccaauaaucaccuaaaagaaacaaggaaggucaggcaugguggcucacgccugcaaugccagcacuuugggaggugaaggugggaggaucacuugaggucaugaguuugagaccagccugggcaacacagcaagauccugccccuaaaagaaaaagaaaaaacuuagccaggcaugguggcgcauaccaguagucccagcuacucaggaggcugagguggaggauuacuugagccuaggagcugaaggcugcagugagucaugaccgcaccacugcacuccagccuggguaacggagcgagacccugucucaggaaugaaaaaaaaauuuuuuuuaauugaaaaaaaauuuaaaaauauaaaauaaacaauggggaauaaagauuccuucuacauuagcaacaaaaagcauucauuaaccagaaauaacccaaaaggaaaaguauacaaccucuaugaccuucugugauuucuucauagauagauaauaguugaguaaauggagaaacacgaaauguccuugaaugaguaauucaaauaucuggaaauguuuucucccaaacugauuuauuaacaaucaaaaccuaaugaauuuguguuuucuuuuuuggaagaguagcggagaagaauugcaaaaacaaaacaacauacacacacacaaaguucaccugaaauaauggugcuucaaauuuuuuuuuuuuuaaccugaguggagauucuuccuagcagauguuaacauguauaaugaagcuacaguguuuaagacaaaaugauuuuaccacaaacaaaaggcaaaucagugggagaagacagcuuuaaaauagagucucggccaggagcgguggcucacgccuguaauccuagcacuuugggaggucgaggcaggcggaucgcaaggucaggauuucaagaccagccuggccaacauagugaaaccccauuucuacuaaaaauacaaaaauuagccgggcaugguggcacaugccuguagucccagcuacucgagagguugaggcagaauugcuugaacccgggagguggagguugcagggagccgagauggcgccacugcacuccagcuugggcaacagagugagacuuugucuacaaaaaacacuaauaaaauagagucucuaggcugggcgcaguggcucacgucuguaaucccaacacuuugggaaggugaggugggcggaucaccugaggccgggaguucaacaccagccaggccaacauguggaaaccccaucucuacuaaaaauacaauaaaaaaauagccaggcgugguggcgcacgccuguaaucccagcuacuuaagaggcugaggcaguagaaucacuuggacuggggagggggaggcugcuuugaacagagaucacaccucugcacuccagccugagcaacagagcgagacucucucaaaaaaaaaaaaaaaaaaagaaagaaagaaagaaaaaaaagaaaagauauuguuacauaauccagugaagaaaaaaaacagcacaauguggggaaacuaaaucgucaacaggaggagguaucuuacuucacuuaacuacaaauacauucuagaaguauuaaagaauuaaaagaaaaagauaaacaaggaaucaauaugcaugauuaaccgauuuugacuugaguauaaacuuacuaggcaagggaagaucauaaugaagagacugcuauucuauauuaaaugauacaacuuuuuaaaugcuaaaauugcaaagcucaauuuaguguucaauucugguggaguauggaugacagacacugcuucuggaagcugaaacuaagaauuuucugcaaaauauuuuggcaauauuuaucuaggaucaugcacacuuacacaauucuuauuccuuacuuuccacuuuuaggaaucuagcccaaagaauuaaucagaguaguguaucaacaacaauacacaauaauuuuaucacaucauuuuuuaaugaucaaaauuauaaaaugggccaggcacaguggcucacaccuguaaucccagcacucugggagaccaaggugggcagaucauuugaggucaggaguuugagaccagccuggccaacauggugaaaccccguuucuacuaaaaauacaaaaauuugccaggcaugguggcaugcacuuguagucccaaauacucgggaggcugaggcagaauaauugcuuuaaccugggaggcagagguugaagugagcugagauugcaccacugcaguccacuccagccugggcaacagagcaagacuuugucucaaaaaaaaaaaaaaaaaaaaaaaauuguaaaauaccuaaauuuagcauuuauagaauaauuuuaauuuuaauaauuucauuaaagaccucauuccaggugauaaagauauaauguuaugggcagaaauucacaauauguguguacauaguauacuacuaauuucauuuuuuuaaauauauagauacacauauaagucuagggggaaaaucucaggaaaacacaacaaaauauuaacaaugguuaccuugagauuaaggauaauuuuuauuuuccuuuuauagagagacagaaaacuuauuuucuaauuuucuucucauaaucaucuauuacuauuauaauuugaaaaaagcaauacacauaauacuuguagugucuggcggcaggcaaaugugucccuaaucaaagguucgcuguucgucauagcugcacguuauuuuuaaacaggucaaauaugugaagucauucuagugcuauguguacacgugauugcugaaucaaugauaagagcccucugaacgcgcucuguagaccucauauaaaggaggcaauggacucuucuggaaaagaaguaacuggaaggacgaggaagccuagggugaugauauugacggugaucuuggaacucuaaggaccuccauuucuuuaauauacauuuauagaacauucaccaugugcagguagcaggcauucaagagugaacacaguuccugcuuucauggagcuaacaguuucuccuccaaaaucuuauguaaagccaucaugaccacuguaguuuuugccuuuuggguaugucuaaccgugaugugauaacaaauccuguuucaaugcaacaaucagauuuccuguauaguaguauuuuaaaauaugucugaaacccacucucucaaaaagcugagacuuuaucgcuaugacuuuuaaagacacagauucucuagaaccuauagauagcauuaacauuucaacuauucagaggccaccacucauucacucugccaaugaaacuugucgaaguccuuaagacagcuucucuagacaagagaaacauggcuguacauuuuuuccaaaucuuuuucagacaaacuacaaccacaguggaaaguucacuggaugaggagaaaaaggaacagggaaaaagaugcuggccucagacaugcaaaauacaaaauacagcgccuggcacagaccuggugcuuaucagguauuugcacaauaacuauuuugcagaaugaacagcacgcuuaaaaaagcagaugcccaucugcucauucagagcacccagcucccaagagcacuacaccaucagcagaaauuggaaacauuccuucaccaccaaaggugaggccagcagugucugugacugcaaaacauguacccagcauggggggauccaguggucaccgccccauucaaggcaagcacagguguuuucaaaaaugaucuguaaggcuacuaagaguuaaagguguuucugccuuaaaagcaaaugaaacaacuaaaaagucacugcccagggauuugagucuuuucuuuccacuucuauuauugagagagccuccagaagacuacagcuaagagggcuguuauuuuccuacuagaagagcagcugaggaaagguaaaacagagcgagaaugaucaucuauuuacuguacaaccgcuaguccgccacuaagagaaguaugcaaacaagagccuccagaagauggcuauuccaccaguacaucaauuaaccaaauaguguaaugauacacacaaugucacugacaugccaguacaucaaucagcuacagaguauaaaaccaugugugguccaaaaggacccuacaauaauccccaagaaugcuacguggcacaguagcucaugucuaucagcccaacuacuugggagguugaggcaagaggaucacuugagcccaggaguucaagguuacagugagccaugaucacaccacugcacuccagccaggauaauaaagaccucauuuuuuuaaaaaaaaguaaaauaaaauaaaaagaugcucccaugugacagucuuacaaugcaggcuagugucuccaaagaagacuuacugagcuacacagaggaagcuggacauuaggaaucccacccagaaacauuuguuaacccuuacgaaaucacugauuaaguuucaccagauucacugcuucaacuuuccagguacccguauuuaggggggaaaaauccauucaccccaaaugaaaugauuacuggaccaaaauuaguuaacccaaucagaacuacuugaguggccaagccauuaucauccuauaaagcuggaaagguuuuuguauuucucaaaaucuuaugacucucaucacaaaugagaccggaagaaauacaacguuuagcauggaagcauuugaacuguaggcacuuuugcuaaccuacacuuuuuuuuuuuuuuuuuuuuugagauggagucuugcucugucacucaggcuggagugcaauggcgccaucuugucucgcugcaaccucugccucccagguucaagugauucucccaccucagccucccgaguagcugggacuacaggcgcacaccaccacacgcggcuaauuuuuguauuguauuuuucguagagacgggguuucgccgugcucgccaggcuggucucaaacucccgaccacaggugauccgcccgccucggccucccaaagugcugggauuacaggcgugagccauggcacccagccuuaucuacauuuuauuucaugaaaagaguugugggaaaaugugaaggcugccaguccaucauuuucuugguuacuuuggauccuucuccuuuguugcaagaaucauaaauauucccaauucuuuuacaggcaaaaaugaaacgugugcccaaauauguccuuuaaaaauaaacauuaaacauuaugagggaaacaacuggcauuguggaaaaugucugugcacccuggcuaagcaacucacuauugcuuggauuauauuaauauacacaccauaaagcuaaggaagaacuuaaauuugagccucugcauuucugugcugaguaagcuguaguucuuucgacuuaucgccuucauacuugccuguccaaacaaaaagaucucaagaauuccacugaaauaguccaaacaagagccuaaacuuacaaagcuguuuuucagagcucaauaguacaacaacaggaaguagaacuucugggauggggauuuugcuauuuauuuuuucuuucaauggccacuuuuaagcaaaagagaaaaaagucuacaggcauuacaaauccuggaagcuaugaaucaggaagugggaaauggcugauccugaaauggccagccugaaaauccuggcucuuuuauguagucaagucucugaagccaggaauuucagaaaucuuaggcauuuugcauuauuuucugaaucuuaaaagagcugagacuugagagaaaagagaagggccaggauaaaugaaccaauaaggaagcccccagucuccagcuccaugccccuaccaccacacaaaucuugccccuauaauuacaagcucaguugggacaugcuccuuacaaaugacguuuguuuacaaugcugcuaaggagagggggugauagcccaugguuucugcagacagagccugccccaggcuucagcuuucucauucuuucccaauguugaaucuggaauggacucgggacccuaaauauuucacaacuccaaacacccugcaguugauuaaaaacaauggucacuuuuguuuucaggaaagacuauaccugauuuuugcuaagucuaaguaaaaugcaaagacccaugcaaugaaccugcaugaaugcuuucagacaugcagauuuggagggggacacugcucucuuuugagcaaauggagauccaguaacagagcggggcucacucugcaauggcugcauuugcaucaacgugagacaccaaacaaaugcccgcacacaggagucuacuauguggaucgagggaaaagagggcaccuuuauccuuccaaauaugacaacucaauagaaaacuucucauuccaaaguccuaagggucccuacaacaggaagcuacuggagcuugugaaauauuuccaguuauuuucuacagaaauuaaacauaucaauucuaccggcaggucaugugagaugacagguuuaaaaauguauguugauugggggagaaaagcaaagaaaaaaaauagaagaaaauaaagucauuuccugugucaguuguaauuugggaggcuuuuuuccagugcccuucuaaguaaaucugccauaaucaaauguagucaaauauaacugcaaugugcaaaagcacagugaugaccugagaggaaggugccacuaagaaccccugggaccagucuucuaucucuuccaucagacauccacuacuaccuccccaaaaaggcucaggguuauuucauaaacaccaguagccucccauguauuuaacuuagcacaaauaagagaaccaauauguaagggauuuuuuuugcucuuaagaaccaaccauuccucuuaccccagccuuuacagaccuggaaaaccaucccugauuugcccccagccucaucccccacuacaacuuaaacaaaccuuccucuccagccuugcuuccagccccaaaauacauuuuuaaaguucugaugccaagaccaccccaucaagucuaguauaauccuucugaucaucuaaguacccuccuccaggagaccuccaagaucccucugggcaaaaugaucucuuccuccaauuccagggcucuuucccagugugcucacuccauccucacucauaaaagcaucugguuccauuccacagcugggcacaccuuaucuucucaagagacaauguaagcucuuuuuaaaacaggggcugcauuuuacacaccucacauaccuccugcagguccccgaacauccaaacacuccaaauuugucucugucuccaaauccuacaaaaccaaauucucucuacccagcucagcucagcaucccuggggccccgaucuaccucaucugccuccucugcucuagaguaaaagcaacaccagucacccccacucugccgcccacuguagccgaauccaaguggcacucucagcccaugcucuuaucagugcacugggggcaggccuaccaucuaccaagcaccagaaaugccccuccgagcuuugugcagcccccuugccaggcagacagccuccagggccagguucggcacgggaagcuagaacacggggcugacugcacagccuggggcagacacaccucagcuuccacacccaccugacaaggcugcccagaggauggagggaagucaguguuucacccacugcccuaaugggaagacaguguuucucacccacugcucaagccuggaagcaaaaggucccaauguuccuacucgaugacccgcccugucaugcccuguccagauaucuaacccucaccuuucucuguccaucaagcaguaagaauucauagcagccagcacauaugacccugagggcaacguucuaacaaagccaaagaaaagguggcacacuggccuucaauucaaagcccaggguggcaagaaaagggucacuaguucccugaaaauaacuggcaugcaaaauucaaacagguaauugggguggaguucauggaaaagggaagagaaaaccucacauggguuuguauacccuucauuuaagcacacugucuucaggcagcagagguuucaaggugcaugcuaaacacccuugcgcagguuucagagagcagauaaaaggggcuaaccaggcucucaggaagcccaauccgcacacgcacggagccgagccaguggaaaccauaagccugucucaucugucucuaaacugcucacaggaugaacaggaaggcuugaucgauacugauuuuacagucauaggagugacucaucacgaaauucuacccagcuuaaagcucagcugugaacagaaacaaaacaacauaauggcagggucagauuuaaaauaguaaguaugacugguaaacaguuaaugcucauaaacaauuaacaaucaccuucccagccuccuggauuugcugggagaggaaaaaguacuacugagggcucugaagcgggcugcagcaguaagucugucuucuguggcagccccuuccaacucacugaugcuggugucagcuuuacaaaacagacccuggagggucacgaggagcugcuuuuaauagaauuccacacaucugauggguacgugcucacugaggaggggagagaggaggaauguacuuacauggaacagaguuuucagagagugaaauuuaagcucuccuggaguauaacuuccucuauguagcuccugcagaguuuaaaauaagcaacuuaucuguccuaaaaugagagaaauggggucauauaaaauuucucaauaauugaguuccucucaaacugcauucacuuuaaggaaagcacuggggugcucagaaggugcacuacacauuucaggcauuugguuacagaggcgaaugugcucagcgccauccugaagacauguacuuucaaguacuggauuccauguaaauuuuaaugaucuguaaccaacucucagaccuggccaagaacuuccauagagaauccuggucuggagaucccuucacuauggcacacugcuccacuguucugaacugcaugacuguguccccuccaauucauauacugaagccccaacccccagauaccuucagugguaucugaagguggggccuuagggagguaaucagguuuagaugagguccugaggguagagcccccauaauggcaacaaugcccuuacauaaagaggaagagaccagagccccuugcucucuccacccugugaggacacaugacauuugucaucugcaagccaagaaauggacccuuaacagaaaccaaauuuggucggcaccuugaucucagacuuccagccuccagaacugugagaaacauaagucugugguuuuagcccucagucuauaguaaccugucacagcagucugagcuaagacauccauacagccccguaagagaaccaacccagggacgagcaacaccucucaucaucugacaccaccuccugccugacgaccaggcaaaacaagcacauacacaaacaagcaaaaggggaggaugagaguggucauucggguuugcuuuggagguccagagaaaaugcaaguccaacuuccaggcacagaccaguugcccgcagcaggcuuccucccauuggucucagaccaaggugagccacucccccgggcgggacagagaaagcuccucuggaagccagacaagcucggccaccucgaagucuucuuuggaauccagcagguccaggccugagcccuggcgccugguuaaaccaaaggaugacaaccaagcagaaaaaaauagccccagagaguaucugcuggagaggcagacaggcggaccuggccuucgacacacagcaugcgugccauggucucuagcagcgcgucccuccaagcuuccuggccuguaaggcgaagccucuagcccuuuucuacuuuuaggaugcucagauucuugccugcagaggucaaucccuuucuuucaagggcuccccccucuguaaugaggcaguccauuuacaauaaaaaaaaaauugagcugucaaaacaaaugaaaaacuuccaguauaaucauaaucagugagggaaucaaacaucuaaacaaaucucucuucuggaaaaauaagaaaaugaaaaagcaauuacacgucacauggcugauuagcaauaaauuucauuugugacuacgguggcaugaguuugacuccugacuugcuuuccuugaaagaaaaaaauuaucugcaauacugucucuugauauagaaaacagacccauuccaucugacucagcucaaaccugcguuuuuuuucaaggccucuccugaccucacaguucccccgcagugaucccgugguaccuaggaccgccauggacaaggacuggucuccuugaauuugucuccccaacuauuccacacauauacucgcauaaacaauugagaaauaagcuuuuuaaaauugugguaaaauauacacaacaaagaauuuaacauuuuaacccuuguuaaguguauaguucacugacacugauucacaauguugcucaaccaccguaaccauccaccucuagaacuuuuacauguucccaaacugaaacucuguacccauuaaacaccaauuccucauugcucccuccccccagccucuauucaccgccccucaccauucuacuuuccgucucuaugaaugugacuacucuacauagcucacguaaggguaacaauuaugcacuguuuguccuuucaugacuggcuucuuucacuucgcagagugucuucaagguucacagacauuguagcacaucauagaauuuccuuccuuuuuaaggcucaaugauauuccauuguauggauagaccacauuuuguuuauccacccgucuauggauggacccuugaguugcuuucacuuuuuggcuauuuugaauuauuugcugccaugaacauggguguacaaauaucuguucgagccccugcuuucacuucuuuuugggcauauaccccaaaguggaauugcuggaucauauggcaauucuaugaugaauuuauugaggaagcaccauaucaucuuccuguuaaaaaaaaaaaaggcugugccauuuuaacagucucaccaguaaggcacaaggguuccaacaucuccacauccuggccuaugcuugcuaucaucugguguuuuugguaauagccauacuaaugaguaugaaguaccaauugugggucugacuuacauuucaccaaugacuagugacuuucaacaucuuuucaugugccuauuugccucaaguaguaaguuuuaaaucaaaagaauuaaccccuccuccuaagagaccucucaucacagaaagcaaacaguaguauccuuaccuacuagcauuguuaaauugguuagucugggcucaaaacacuuuuguuuuccuugcaaauaccaccauaggcaauauucgcuuagcaagaccauucaaguccaucuaccaaguugccuaaacaggacuaaccuugaauucuggucucaggaagaccuugugcgauccagggagcagagcaagagagcagcuccuucucgcaccauccugcaucaggcaacacacugcagcuggcuucccaccugacugaagccuucuccuguucuggcagccaugggccgcuccagcuggggaugcucauccuugcaagcagccauccacgcacaaagggcacagguucucaggguucuccacauucaauuuaaaauacccuaauuuguguugcagauacuuaaucuaaguguuuuucagauccugugcccuaaauuuuggcuggaaacauagucccacucacaucccucaugcucgugaccaggcucuuccccaggccacaugacccccaauuaccucccccuccuugaagaaggaagagacugaagggcgaagggacauccacaguucacauugauaacgcaaaugauccaucaccauggccucaaaagggccuuggaauccaaaugacccacuuacuggaggaggaugcuucaaacggaggcagaugcagagucaggagggagacagggacagaaaaggaggaagcugugcugcuauccccaguggagcgcuugucaaacucucuuuacaagaaaugaagcuggguuccugccgggcgcgguggcucacgccuuuaaucccagcacuuugggaggccgaggugggcggaucacaaggucaggagaucaagaccauccuggcuaacacggugaaaccccaucucuacuaaaaauacaaaaauuaguguggcagcggacgccuguagucccagcugcuggggaggcugaggcaggagaauggcgugaacccgggagguggagcuugcagugagccaagauugcgccaccacacuccagccuggacgacagagcgagauuccauccaaaaaaaaaaaaaaaaaugaagcugguuccuaauucugcagucaaaaaaaaacggcaaauguagcuaggagcaaaacaucagaaucaauacacacccaaaggguauuuuuuuuuuuaaaggaaguaaauaacuucuaaugcguauuuccucuauccuuagcaacaauaguaucagcuaacuccuaguguuuauaaacccuagguucuaagaaauguguauguauucacucaugaaguauugguaacgauccuccaagaugggugacacuuuuuuuuuuuuuuuuuugacauggagucucacucucgcccaggcuggagugcaguggcgcgaucuuggcucacugcaaccuccaaccuccaaccuccaaccuccaaccuccaccucccagguucaagugauucuccugccucagccuccugaguagcugggauuacaggugcaugccacugugccuggcuaauuuuuauauuuuuaguagagacaggguuucaccauguuagccaggcuggucucgaacuccugauuucaggugauccgcucaccucggccucccaaagugcugggauuacaggcaugagccaccgcacucggccugauggguggcauuaucuuccauuuuacagaugaggaaaggagagcagagagggucaauaacgugccccgguacaaugcaucaguagacuucuaauucuccaacccucaucucagaggggaauggugucaugaaacaagacuggggggaaaagggagaaggccugcuuucuagucgagaaaagcggagaccgucugaaacucuacuugcuccaacaggugaacgugauugaaaauucagaauucacucuccuaauagcaggaaaguguuacaaaagcccacaggccaaaugauaccacccucccaggaagucucuugcagaacuguguuuuuuaauguuauuugucaagugaaaacaguuacaguggcagaacaggcagcacccagagaguggcacuaaucgugggcuaaggaugggcaauugcuucucaucaagaaccacaauguguccagucaauuuacaaacauaaaucaacacaaguucaaaagcaccaguagcaaaguccaggccuggaugugaagcuggcaccccucuuuaaacaaacuguuccucuucacuugcaugguaaggacuggaaagagcccugccgcguuggccagcucuucaggguagcgggggccaccgcccucucccagccucgggaagcccaaggccacugcaucagccuggcccagcccagaaccagccucgggcccagccggcccaacucagaaaaaggcaggggucagucuccagccuggacuccucuaaaaaucagaaagcagugccccagcaaacgaacaacaacagcgcucaccugaaacaguuucaccuucauuuuuagaggagaggaacacaauaggagggcguauuacuccacggguuuuaacccuagcccuugaugcuaccagguauccaugaugccccuaauaaaggugacaguuccuccacuuuucuaacauccagcuauucuuuaaaaaaguugaacacugcaguuuccggagaacuuugcuaugugaauugccucacugcaggugugcucuccccuagcucucuccauuccaugccuuaaaagugccaggugucuccucgggagcugcccugugcuaccgcccccaguccugcagccaaccuguuuugcggguccugccucuccaucaacugggacugcucucucgacaaaccaccccagcccacagcuccucuggcaacccagccccucacaccgaggacccaucucaccagucaccucccucagcugggccaaccuguccaguccauuccugcuuccuggucucaggucuagagacaagacuucccucccugagccuguccucacugccucccucaucuauaccaucacuggcucacaccggggugucuaucugucccccaauccugacuccaucgagagaccagagcagccuccccagaacacccuucucagcggguccacugcaauggugcaaagguuucagcgcuccucauucucuagccagcagucaauuccuucccaccacacaaacaccggauucugacacccucuccacuccaucagugcacacugccacccacaccacacauggucccuuccucuccuggggagcugccuccuuggaucuugagagucaaauauuuagggcacacuaaagucagacauccuccuuaaagcuucucaagccauucugcaguuccgugaccccacugccugcagcccacauacuucucuccggucagcaucccauaacuuagcacuaaacucauagcaucuguuacucuccaccaguaguugaguuuucccaacuagacaacaagcucgaguaaaaaaaaaaaaucauauucuuucauaugcuuuccauggagcagagaccacuggaggcccucaaauaaucuagauaucagaaacaggguuccauacucugucaccacucaccuuccacucccacuccccuuccacagauagggacaugaccuugaaccagucagccugguuaaccuaaaaacccauucucuucaggcacagagaagcaaggugguuacuuagugguuucaacaacugaccugagacucagacguccggguucaaaccuuucacuguagaugugcaaaaaaagacccuccuuggccagccacaguggcucacaucuguaaucccagcacuaugggaggccgaggucgguggauugcuugaggccaggaguuugagaccagccugaccaacaugccuaaaccccgucucuacuagaaaaaaaaaaaauuagccaggcgugguggcacacgccuguaaucccagcuucuugggaagcugauccacaagaauuguuugaaccugggaggaagagguugcaguaaggcagagguugcagugagcggagauugcaccacugcacuccagccugggcaacagagcaagacugucucaaaaaaaaaaaaaaaaaaaaaaaaaagggcccuauucaacuggcagcaauuccccaguguuguggggaaggaggacuggaggccccagagagagcccaccagggccacccaccaugaggaggagaaaaaaagagaaaagcauccauuuauuggaugcuuucuauuugccagguuugcugggcagcuuggauacauuaucuauugcuaauucucauuggcaucccugcuagagcaguguuauuccaaucacaggcagagacacugaggccuggagcucccuuuccaacaugccuccaugcgugggagagagggagacagugaauuguuugaggggacaaggcuucaaaggaagcccugcacauaugcaaaccgcacggagaagagcagagcaaagacaggccaggcuguccagcuaaguucacauccagccgguucagcauucacaugagaauuucacaagaugcuuuuuuacaagcuacucuugaauauuaacauuccagcuucaaaugauuauguuuacauuuucugcaagaaauaucccaccccacuccucggaagaggagacuuuaaggauaauuucuaagguguucauuaaguucaggaguccccuugacaccaaccuagacaaguaagcuuucuucuguccagaggucgggagcuggccucaccgucgcccuaccaggacacugucaaaggccuucaccagcaaccaaaaccggcaggguuggagagggugcuucaaugauagagagaccuguaagaccuugcuacugucccucccaggagugaggcaaaagcuuacuggccucaccaagaaaacaaugcaaaaaauagaagccaacuuccauacguggugauucugcuuguuccaaccacaucucccucaaaucuccaucucucucucugccuaguaucuugagaucugaaggcuggaagggccugugaaaugaccuagguccacccuguaacucaaggucagcaggugugcaaguacccuacccacccaacuuucugagaugccacccuggcccucugcaccaggccacuccggagaccaccaggcagccgaguccagccugcagaugcuuccuccucaggaacccagcuccaagaggguuuaaaagcacacuacagacauaaaucggugccaaugaauuauucauuacaucuuaucuauagggaacuuauggaacaaagucuccauccacagggaugaggugaucuugacacaaggccagacucacaaauuacccuuccaggaguucuaauuuuuuuuauucaccucaaugugcaaaaagccuaaucaaacaaugauuuuaaagauaauuuuauugcuuucaaguuccaugcagcaguaacuggugugauaaaauguuuuggcuagcagaggugcaaugaucagaugaaaauaaauuuguuguacaaagaagugcuucaaagugaauggcgaguaucccuuuaagaagucuuccguuucuucagcuccuccuaugcaccaggcacugggccaccuccugggaauucaaagauaaccaagguaccauuccccuccccaauggugggggaaagcaauaugggggagaugcccaaauaggagguauagcaagagaccacaggagcucaagucagugcaaucauucugcaugcagaaucaaggccagagagagggugaaauuacagcuaacucuuaaaggagcuugccagagggcaagcugguaguauuguuugcuauuccaagcagaggggcuuccaccugccaagacaaagagacacgaaugaguacagccugaacuguucaaaaugucugggaggaagggaggcugaaguucucucucagacagccaaacaaagauuuccgaauuaaaaauaauaaaaggcaaucauggggaaacagguuuaaggcuuuugacacguaaaacugaauaaccagcuauauauuuuguguaaucucagcaagaaagauucugaaaauaucaauaaaacaugaaacaaaauacauaaaauuagcuagcgaaauauagacggugugggaccuaacacaacacuggauguauuuauucuuauucucugugaguauuucuggcuggcgagcaucuuaaccacauagaauagccaaaggggagagagaagagaaugaaaguguuacuaccuguuuaaauagagcaauggaagguaaaucuugcuguauuuuuccaaaugaaaucaguaguguuuuuuuaaucucuaaucucaaauauuuuggagcuuuaaauuuauuaaaguccuguaaaauuaucuuaaaacucuaacuguaaaagacacacuagguguuaacagcucugccauggaguugcagugcgccugucugcaucacuuaggaagacccuaauucucucaggacagcucgcacugacacaguagaguaaccuuaauccaaaacuguagcccagugauuucuacagaagucuguaguauccacauuuucuugcaaucaguccccaggaagcaagccagagaguggguugggaucgcuaucuuccuccuuggggcacuauuaauucagucaccuaauaugcugaauuucccuucuggccacuagauggagccuaugcauaggcgagaugggcaaagugcacacuggacaccucucaggugugagcagaaauugacaaaugacaauauuaagggagaaaguguaauaaacagaucucugaaauggaaggcaaacugcagggggaugaccaucguuuacugaaaaaaaaaaucacaacuguuuaauaagcaacaugccaucuuguuaauaaacaccuuagcaaaauaaaguuuuauuauacauuuauugagcaccuaugugccagguucuauaacauauuuaaauggcaaggacaaucaaacaucaaguaagccuuauauuucuauccaaagaacaucucuguucgaggaugucacaacccuaagaacaguagcaguugaaguccaagggcuuaauaccaggugccagguucuauucuaggcacuugacauguguacgaauuugauuucuaugaauguuuaaaguagauucuauuaaaauuauaauuucacagaugaggaaacugaggcacaagaagauuaaauuauuugccugagagcuuagcuacugaagagcugagauucaaaccagccacuuuggcuccaugguccuaauaaaauuacaagcaaggaacaagacaaaucacugucaaccagcaaaaccguggguuaugaacucaaaaggaguaaugggaaaguagaucuauacaaguuagggaaaucccaaaaaccuucaagaaggaagaggaauuugacuuggaaauguaaagauggcaucucugaccuauucaaaccacagaaaaggcauaugggggaaaggaaucaccugacuuagcgugcugccuuuugaaaguuaugaucuugucccuauuuuacagauccaccuggaacuuggaaauuauuucaauuuaaaaaaccuauucuauuuccucacaauuuuucugacuuugguuuucuaaaccuguuagaaaagguuuucauucuguuguuuagugagaaaaggagaaaugucucccccaaauauuuuuaagucuccgcauuucuaucaagacucagaaaaguuaauaacuuuaggaccaaagaacuaauuggcagcuaaggagaaacuaaagcuauggugaccuuccuguguucuuaagcggcacuuucugcuauucaguauugaggauggaaggagaaguagcagaguagugaagaggaaaaacauucucagcuauggaaacagcagaagcaaaaacuugaagacaggcauaacacagcuuccuuuccaucaagcuaaugcacagaugcuggggaguaccaggaacuaacaguggaucccuacagcacaggauuacuaaggaccuguuucauuacuugauucuaaggacccuggacuugauccuaggaccacaagaggcacguucugaguauuuggagcuggcaaguccaucagacuaagggaaugguacaggaacugguucagaggccaacucagcauguagucagagucaaugcaggucugcacuggaccaggcuggaucccggaauaggggucaaucugagcgauuucaagugacucagugagaucgaaaggcaacauucaauuaaugagucuccccagaaaaggacaggcugcagaacugaaacugaacaaauuccauccugagccaaucucuguugcugaaaauuuuacugaggugcaugugagaaagaaaaucccaauuguaucaccugacgaagaaaggcuaccauaacaaaaguucuguaccuacgacuacacgauaucauguugugaccuaacauaugcagugaacucauuauccacagaaaucagacaacagaacuaagggaagccucacagcagaucucccucugcugcuacuggucucuguguucauuuguuuucguggcaaucugugcuucucuuuaaaguccugagucuguaagcuuguguauuaucccacuaaaaugagacucagggaaauuagguaaagagaauaaauacaggacaacacagauaaauguggacacaacugagagggauuuuacaaucuagacagaauuaauagcuaaugacuuagaaaacacuuuguaagcugaugcagucaauuggaucaugggcuccuaccuggaauuucucuccaugcuuccuacuuuuuccaggaaguuaucaaaggucacuaagacgcuuugaauuuggggaaaacuccuacaaauaaauucaucucucccuaauuaccauuagacuucuguucuuuaaaguucuauugacuaaacuuuggcugacuuaaauuggugaugucucauuuacguaaucaagcacauauucccaauaaccaacuuuacagagacuaaccacgacuauauuuuuuacagcagaggacaagcugaaagcaaucacaauguaucaggaaaaauuucaaguuaugcucuauaaaauauuuaugcucuaacaacuaucaaaauauauuuguucucccaugucaagaguaauuuuuaaagugguauuuauuuuuaaacugacaaauaauuccaaagccaguuugagaaagcuagugccauguuaaaaagaaaaugguugaacaaaaguauacaaaacagcaacaacaauguauuucaaacucgcagaauuuggacgauggacggauggauggagauacacaauucugaacaaacggcauucguauuauguaacucuuacugaaguagagaccuaugguauuaagggggcuaagacugaggagugagauaaaacaaaguuucaaacuccuccccgcaagaacuuucuggauuagcaagacuacuuucuaaagucuuuaaaauaugcaaaaaaacaaaaaaaaaauguuuuccagacuauuaccaggugagcaauuuauuuuuauauauguauuuugugugugugauggagucucgcucugucacccaggcuggagugcaguggcaucaucuuggcucacugcaaccucugccuccuggguuucagcaauucuccugccucagccucucacguagcugggauuauaggcacgggccaccacgcccgguuaauucugguauuuuuaguagaaagggggugcaccauguuggccaggcuggucuugaacuucugaccucaagugaucugcccaccuuggccucccaaagugcugggguuacaggcaggagccgcugugcccagccaggugagcaguaagguaggcccagcuaucgcugcagugugugauggccccauccacaggugugcacaucuuccccaugugacuagccagccgccccacuacuccaaagaaugugaaugcuucaagaccaccaaccaccaagugagcuccauggacacaaggcccaacaacuuauauugcaaucguagguguucaucccucaccauaaaagaaacuacuuucuguugugguccagugaaaacagaagagcaaucuaugaguuuacaaauucuuguaggcugggggcgguggcucgcaccugugaucccagcccuccgggaggccgaggugaguggaucgcuugaguccaaccugagcaacauagcaaaaccucgucuguacuaaaaauacaaaaaauuagccaggcaugguggugugugccuguagucccaccuacuugggaggaucacuggagccugggaggucaaggcagaaucaagccgugaucacaccacugcauuccagccuaggugaccagagacccugucucaaaaaaaaaaaagaaaaaaaaaucuguaguccagggcaggaaaaagaaaaauuuuaagcuugcuuacuaguuuguuucguuuuauuuuuuuuuuuaauaaacauggcaguaacaucuauaguuugacggguaucuuuaaaaacuuaugguaagacauuuuacaguaucaaauaauuucuaaaccuaaagaacugcauccaguaaguacucaacauguauuuacuguggaagaaaagagggagggaaaacgacuauuucucaguucaaguaaggaaauaucaguuuuuccuuaagauuugaaaauaaaacauaaguaaagccggcaucaguggaaaaaaagggagagaaaucuucaaaaaugguaucugggacuuucaaacgaguaaaauugaccauuuaaaaacuuagucuucaaaaguccaaaagucucaaaaucaaagguauuguuaauacuuugagucaaauaaaaccaaagcaauuuaacaaaagaaaacaucaugccgaggaaguaugcuucucuugagauaacaaucuaacuuguuuuaaagauccuuuguuuacuaaccauuuuauauuccaaauauauguuccuuccucagaacaaaucaauucuuuuccagacccucggggaugggggugcaggcaugaggggauguguacauauaucaaaguuuuaaucuuuucaaauaguggaacucaguuaugcuucccaaaugucaacaggucucaauguccacaaacacuggggcugcuacccucccccauccccacuuaaagccacaucacaucuuuacaaauaacuggaaaaccuccucuugcuaagcugaugccaaacaccauuuuccaggagggaucagagugcaucacucauuaggcacuuuguugucucuaaaguguucagaauuuuccuucagaacaucucagacuggaaaucaagaaacuauauccguaacaugugugcaacuauuauauauuuaguacaauugagaagagcucauccccuggacucagcaccuguccuaagcuggcuaagaaaagcaguucaaaucaaguucgcccacaggcgcaaauaccucuuccaugaacuaggucugauuuuuaaaugaguuuugaaaacaaauuggggaaaaucacaaccuauaaagaaauguaucuuguaugcuuuacaauuaaaaaacaaaaacuuucaggauuugucuccucacucuuacucccucacgcuuuuaaaaacaccaaguuauuuacaaauuauaaaaugcccugaaauuaugaaugcuuccugauuucuagaaagcuaacuaagcaauauguaauccagaaaacuucugaaauaaguuccaucuuucuuacaacucaaaacaugcuaugcaacguucauguacacaccugugacuccuaauuuuuggaaaaaggcaacuacaacacugcaguuuguaaaucacaauugccauauccaauguuauaaagaagacagugccgccagucaagauggguuaacaucaccuguaugucacagucuacagugacaucccaauauaacggaaagcaccaaugaggcaaaaaagguauaggguaaaggcuucugaugaacaacacuagaguccuaagucuacagaaauauuuuuaaaagaaccuuuaaaaugcuaacuacugucuacuugaaaacugcacccuauacugagucugaaaaaaaaucugaauuucaagaaaggugguuucaugcaagacucugcagguucaugcacugaguagcacaaggucagcuuucauacaguaggugcacaauaagugcaggcuggauucaguugcuucuuacagcacauucuuacaaaacaaaugaaaccagauuuaaaaggaaaccaccgucccuugaggguuccucuuggcaaaaacucuaaggcaacaagugaaaaugauacaguugauuuucauuacugcccugaucuugcaacaauaggaagggcaggaaacauuuuuauuaguaaacuaagccuuagacaaagaccaaaagcaaauguaaacaacaauuauucucuaggucuuuuccuauugaaaggccaggguaaaucuggauaaaugcacacaguuucaaaacaaaaaugccuuugccacauuuuaaaaccuuucguucuguaaggaauuuuaauuuuauaaaaaucacuguauacuugaaacaguguauccuaaaacuacugcauccuaaagauucuuucuccugcucagacccuggaacuauguaagaaauaaaauaaaacugcaaagaaaagaaacaacaauacugcauuaaaaugaacuguucuguucauccucaguccuuacuaccacuuguggucaauguggcauaucaaaaaaugaguguuuaaaacaucuuaaaacagcaaugucuuucuuuguuggaaaacauaauaaaacuggaaauacaaacagcccuucagacucagcuccuaaacucuauccugaaaaaaaccaucauuucagauucagcugagguuucuauugucaaaaaucugcccuccaccagcauuuguguuuuuuaaauccagcuccucaaucccuaacugaagcuacauagaaccaagauucuuuuucuccugcuugcccauuucuacugcgggauugaaucccuguugcuaagcuucaauuaucaguuuguuguauugcugcaacucacggaucugaaaaacucauaaaugaaaagagagagagacaucagccugucaaauguauguaauaauuuuaacguaauuuaagguagcauaacaaguuauuuucaaccugaucacauuucuuuaaaaaaaaaaaaaaggguuuauugagauauaauucacauaccauuaaaguccccgauuuaaaguacauaauccaaugguuuuaaguauauuuagagcuaugcagccaucgccacaaacuaauuuuagaacaauuuucaucaccccaaaaagaaacccugugcccaccagcagucacuccccauuccauccgcccccagccccuggcaaccacucaucuaccuucugccucuauggauuuguuuauucuagacauuucacauaaaccggaucauacgauauguggucuuuugugacugacuucuuucacuuuuugugauauuuuuaagcuucaucuauucaaccuuagcauauuucuuagaguugaacuuuucuaaucuuuuucgacaaaucaaacauuaugaccuuuuacauuucaaauccugacacaaaccccacccuuccacaaaacaccauuugcuugcuaugucucuccagaggaucuaaacuauaauuugcuguuuagguucuuucagaaguucuuuuucuggguucuccuucugguaauaaaacacuaacuucuuuaaacaccaacauuucacauaccuacauuucugugacaacaggaugccugggguagaaagaugacugaauccuuuuaaggagauggguacaauaaauuuaaagugcaugcugacuuuuuaaaaacaaaauagcccucagauuaucuggcuaucacucagaaccuccgaaccgccuucauuuagaugcucuguucacauuauggugauacaaaacaaacacauccauaugacugccucugcuucagaaacuaaguuuucuaagauaaacaacacucuuucuacugccaucacacucaaagaggaaacucuaaucucucaauacgccagcaaaauaccugcaacugaaccaacacccugucuuuauuucuccaccagacaacagcugaaagaacgcccucccugauagggcucagcagcuuauuucuaucagaguuaaguggucuagcaccuucccggcuaaaaacugaacgcccguucacaggcauagcuuuuaauucuccacauuucagagauggagggaggggcagguacugagucagucaagacuucagcaaaccauaaucgagauuuggggugccuucugaccacccaucagguuuccaggaacuaaccacuguaaagggauccuggggggaagcuuugguaucauggaguaaaaacauacauuaaaacacccccucccuccugccuguguucucaaaaaucgccgucuugcacaaagaauauccuucaagaagaacgcuccaaaagaaaaacagccuauuuuaaaaugcccgacuccugcgucggcgaaggccaucccugcuguuuugaauuucagaacauuaaaaacacaaaacuagagaagcuauacaguucaacugcauaacauaacaaaauggauuauuucucccgugucuucuaaaccguacuuaucuuuuaaagauaaaaacccuccuuuguccccccagccaccaccuaaacgacuuaguaaagggagccggaaggcuuucgcccaaucgaguccgcugaaaguuuagaaaacaaagagcaggagagcccagaucuguggaagguccggccccaguccgcgucccacucggcaguaaacacgcgaaccacgaucugcucucguuccgucgcggacucauuucuuaccagacguuuaaggauuuguuuauagaaacagccuuucugaauugccccggugauggggccauacaaccuccgcugccuccuccuuccccgccucacucgugaaggcucagucgugauuuuuucaaaguuaaucggcaccaccugcauacccucggcaaccauuacucaccaacacgcccucaccguucccagucccaguucugcgacauuuaaacuuuuaaucguguucaaauuacccuaccaucuugaauguaccaguaagccacacuuucaacuuuuucagaagaauaaaacccccaccuccuccggccguagacaccggggggaguucucgcuccccgcauccccgcgcuucccuacuaacccccacccgacaccaccaaaacaaaagcuaucagauugcaaaagacagcgaauguggagcgacacugcuuauuaacuacguacaaaggaagugcggggcggcagaagagagggcgacacgacgccgaccacaacaaaaccaaggccagggcuccgcgcucgcaaaacacaacacccuccccgcgccgccgcagacccuggcgcugaaaccacagcguacgacaccucucgccagggacgggcgucuagguguccccgugaggcggcgacuacaccccgcgcugcgagcacgugugucggaaugcacgucggcuccgaccacacacccaccaacgcacacucggaugcggcccuaguaccccuccaucccccggcccgggagaaacugggagaccaucccagagcccucugaacuggggacccaguggcgcuccccggaagagacaagcugaggaagacucccggccucgcacuucccggggggcugcccagagagcgcuuccccucaccccaccgcccagccccgggacgccgggggcagguaacccaacgaggagcgggccaaagugacgggcaaggccaggaacccgaggagcccgaggggcaaaagcacguugggcgacgggaggcagcgacgggcgcuuggagacguguccuggggcuucggggccucuccgcagggcaccuccccccucgagggcaacucgcaccccgcgggccgggcggcugcccgcuccccacugcccggucagccccagcagcggagacgcggugcggcccagggugcugucgcugcugccugcgcgccgcaggggaucagcgcugugugcggagaggcucuugcgcauggaaggggcgaggugcgggucgcggggcccgggaaccgcggagcccgccccggcaccaacuucccuaccgaguccucgcgccuagccgggaaacacggcugggcugucaggacggagaaagagaaaagcccuucccgcgcggggaugcgcggagccagggcccgcggggcuccagacgaacgagcccgggucccggguccgcugcagccucccucccggcagagccgcccugcgccccaccccgccgcucccgagcccgggggcccgacagcugcgacgguggcaacucggguuucgcaaacagggcgcagccccucggaggaaaaguucccgcaguggccgcgggcggcgggcacauacucacuuucuccacucgucggccagagcgagagcgcggcggagagaaacaggagcccccacagcgaggucggggacccuccuccggagccagacuucauuccuuuuauuugggaugaaauuccccuuucucaaaaaaaaaaaaaaaaaaaaaaaagaaaagaaaagaaaaaaaggaaaugaaaggaaacaagucucaaacucagucuucgcucccccuccaaaaacaagggcgaaggaaacaauacuccgaaggcggcgccgccggggcccuccgggugcgcggacggggcgggcggcgcggggcggccccucagcgccggcagcagcggcccagggcucggcggagucgggaacccgaggcgcgccggggcgggcugucggcgucgucggccuccauuuucaaacccggagaggcaggaaggggggaaaacugcaaagaaagggggcaaagcccaaaucugccuaggcgaggaaaaacaagcccggcccuggccgcgcgggaggcggccggacgcccgagcuuccgccgcgggagggcgcgacgcaguucgcaagaucgccccgaaguccgggucacaggcgaggccggcgaggggcagaaacgcggagucaaaaugaaugagcggcucccccuccuccuccuccuccuggcuccgcucgccgccgccuccucccucagcgccgccgccgccgcggcgagcuccuucccaaauccaggacacacacaaagcggcgggccggccgc

SEQ ID NO: 21426 - RNA, 44018 nt, Homo sapiens
cugaagaaagugcugucuggcuccaacuccaguucuuuccccugagcagcgccuggaaccuaacccuucccacucugucaccuucucgaucccgccggcgcuuuagagccgcaguccagucuuggauccuucagagccucagccacuagcugcgaugcaugugaucaagcgaggugagggggggacgaggugggcgagaaggaaggugaggggaugcgggcugccgccgccggagcugaugcccagaccgcccgcccgccuucgcugcuucccgccuuucccgcauuucccgccgcggccuuccgcccugucagcccgcucggccuucugucuucagucagccugccccgaaccuccuucgggccuucaggcugcgcccccucggcuuugucauccugccgccuuucaaaaggauaacacuuaccccguaucgaguagugacugcguacgccgagcacuugccaggcacuauuuuauuccucccugcaagccucugagagaugauuagcuuauuacagaugaggaaacugacgcucagagcgaggugucgccgacugacccaaagucacccauaggugacaauacgguuugauuugaaaaccgugggguuggugagcugucuuaggcacagggucggggggcagcuaggaaagaaggagggggccucucuacccuccguaggcacuugucaguuuacugaucucuuuuguggggugaggauaggaguguggcguggaaaaaacagaucccagacagacagcacccucgaguuccuuucccuucaugggaagagaugcugaaucagagaaggguggcugagacaucuucugacaagauggggacugggaagagucaggaacucguauucuuucucaacaguucuuuuucauuagacuugccaagugcccgcuuugugcccagcccuuugcuuggcuuugugagauuguaggaggagacagucccugccuugggaacaggcuucaucggguuggaaaaacaagagcaacauacuuuuaacaaccgcaugagauacguaugaacaaguuuugaguugaaccuacuugccuuuguuaaagcaauacaaugauuucaaaauuguaggcacuuaguaaauacugguuaaucgacugguuguuucuauuuuguccucuaggcugugaacauuucaaagauggagacuuguuugagacagagucuugcucugucacccaggauggaaugcagugguguaaucauagcuuacuguaaccuugaaguccugggcucaagcgaugcucuugccucagccucucaaguagcugggacuauaggcaugcaccaccaugaguggcuaauuuuuaaaaauuucugguaguaaaggagucuugcuguguuucccagucuggccuugaauuccuggccucaaaccauccucccuuccuuggcuucccaaagugcugggaauacaagcaagauggagacuuuucuguucacguuuagcacaggaccugacaugaacagauucuuaaagaaugaaugaaaauaguuguaucaaaauguaggacacgaugaaugcugugaauaagcagguaguugauuugguuuaacuacagccaauguccagauugguuuaacuacagacaagaguuggaaagguggacaguaguggccuuucuuguuuuugguaucuugagaacaucauucugugaauuuuccuagcucacauuuuagcugaccaaagagcaaaauaacauagugcacuuuuauugauccauucauaagagugagagcugagcaucuauuuuuguauuuuuauuuuuuuacauuauuauuuauuuguauuuuuuuagagaaggagucucgcuauguugcccaggcuugucuugaacuccugggcucaagcauucuucccacuucagccucccaaagugcuuggauuacagugcugggagccaccgcaccuggcuugagcaucuauuuuuuaaaucuuuagauaugggagagauguuuaggauggucuaugauaagucaguaacaaagaugaauugaaaauguauggacuuagaugaccagaauggguaaaauucaacccuguguugaauuuugaacuuuuagagucuacuucuaaauacuuucguuuaaaaagugcuaccuuggccuggcguggcagggcaugguggcucacgccuguaaucccagcacuuugggaggcugagguggguggaucauuugagguguggaguuugagaccagcugggccaacaugguggaaccccgucucuacuaaaaacacaaaaguuagccggacgguagugguuugcaccuguaaucccagcuacucaggaggcugaggcaggagaaucgcuugagccugggaggcagagguugcugaaaucgugccauugcacuccagucuaggcgacagagugacacucugucucaaaaaaaaaaaaaaaaaaaaaaaccacaaagugcuagcuauaacuagcucuaaaaagcagagcuuauuuucucauuccuucauagagcacaauuugauccagaugguucaugcuguagauucugccauuguagcauucagcaagacuuaauauacaacauguacuuagauuuguuuguuucuuuuuuuuuuuauauuucuauguuucuauauuuuaauguuuuuuaauaugcauaggguuuuugguuuucuggacuuuuuuuguacccccuuauuuuuggcaugucaguggaauagcagacuaacuccuacaguuuuuguuaauuuucuuugagauggggucuugcucugucauccaggcuggagugcaguggugugaucucagcucacugcagugucugccuccuggguucaagagauucuccugccucagccuccucaguagcugggacuacagaugugugccaccacgccuggcuaguuuuuguuauuuuuaauaacaagggcaacuggaaguugacuuugaaguaccuacugaauaugcuaaugucuugcuaaacacugugagggcaguaauggagaaggcagcucuaucuucaaagaacuuaaaauuguuagggauuuaggaacaauccauaugaaaauuauuagauagaagagaauaguagaugaguuuuuuucaucugcuaucuugagcuauuuuuccuaaugggagaguaucauuccucaaggagauuaugguuaaaaaaauaaacauugagaaccauugcaguaaaugacaaaguagcuaacugaguuguaaacuguuuuggaauuuaguguaguauuuucaaaacuuuggauuguaacucacaguaaaaaacaaaacauuuuacagacauguguauauauguggauacacauaaaaugauacaaaaguuuacgaaauaaugucuuugaaagcauccauuugcacucuaaucuuucuuuuauuccagauucuuucccuaucccugccucccucccucccuuccuuccucccuuucuuccucccucccuuccuucccucccuccuugcuuccuuccuuccuuucucccucccuucuuuccugcccuccucccucccuccccucccucucccccucccuccgucccuuccuccuuccuuccuuccuuccuuccuauuccauucacagccugcuaauauuauuuuacaacucuguggauaccgugcuguucaccgggauugcagugaugaguaggcagacaugguuccagcuuccaaagauccuacaaucaauugagaaagauagacaaauaaagaaguaauaugauaaaauaugauaaauacucugauagguaaaguauaggcaguagaggccauucauucaguuauucauaaagcauuuauucagcaccucuuugugcuaggaaccguuguaggcauuagagauucugcagugaacaaagcuaaauuacauuucucauugaguugacuucuuggugugggugggagugguaaguguauauaagaaauaagaaguaaacauaauaaucaguuaauuucagauacugauuaaugagaugauaguaaaacaggaucaugugauaaagaugaaugagaaaauaaccuuggauuggguagccaggaaaggcuucucugagaagccaacauuugagcugaacccuaaauaguauuaagagcuaguaaugugagaucuguggccugaacauucucggcagagggaauuagaaaguuuguauccuguggaaaaggcacgcauccuuggucuuacaggauuagggaagucuuccugaagagagaagaaugaaagacaguuuauagccaagaggaaaucacacuaguaugcuagaggauuuuuuaauuuuauuuuuuauuuuuugagacggagucuugcucuguugcccaggcuggagugcaguggugugaucuuggcuuacugcaaccucugcuucccagguucaggcaauucugccucagccucccgaguagcugggauuacagcauacccagcuaauuuuuuuuuuuuuuuuuuuguauuuuuaguagagaugggguuucaccauauuggcuagacuggucucgaacuccugaccucaggugauccgccugcuuuggccucccaaagugcuaggaauacaggcugagccaccaugcccugcuggcuagaggauuuuaaaagaggaaaaggucagugugaguuaaaagugguugaggcagguuuuauggaggugugagauuuggagggugaguaggaguuagauguauggaaagguggaagaggaaccuuuaggcagaguaagguauaagcaaugauguggauaugggaaugggaagcccucuugggacuuauauuucacagggaacaguugaagagaucuggggccaaacuaagaaaggcuuugcuugagagaagaggauaauguaggcagugagaagcagggauuagugaugugauaaaaucaacaucuggcuugaaaaacuaaccaaguggaaugacagaauagagaacugugugucauuggaccuuuagaucuuuagucugccuccuauuuucaagugugaguuaagauaauuaccaaugcacuuuuuuuuuuuugucaguuuccugauugacuucagaacuucuggcaguuguagaauuuucuuuuugcuaaguugcuuuccccccccacugcauguauaauugcagaacgcuaauguugcuuugcaguuaccugccugcuuaguuauccaauugcuagagcacugagguuucagucccagugccagccaguuaauuuaccccauuucagaguuaaaugcugcagaugugagccugaugagaaaauuaucacaauggugaucagaaagagaggggcuaacauaucaguguagaagaaaaagcaacuuguucuagugauaauggguuaauagugaugucuuauuguucauuuauucuucaucaaauguuugagaacuugccuuguucuaggcacuaaauuugagaauacagaugugaaucagagggccaaauaaauguaaacauauuuagcauguuucuuauugguuacuucagguugaguaucccuuauucaaaaugcuugggcccagaaguguuucggauuuuggauuuguuucagauuuuggaauauucgcauuauacuuacugguugggcaucccuaaucagaaaauccaaaaucugaaaugguccaaggaacauuuucuuugaacauuguguuggcauugaaaaaguuuuggauuuuggaguguuuuggauuuuggaauuuuggauuaaggauacucagccuauaguuacaauggauuguaggugcacaaaagagacaaaaacuaaaucagugugagacacuaacauuuauugagugccuauuguguaucacauacugugauuuuuuuuucccccauaggagcagcuuuauuuuauaacgagguauaguuguaacuaugccaaaguuguuacaacaaaagcacuuuuuaccuuaucuaauuuuauugucacaguaaacugauuaggcaaguaaaauagauauaauaauuaaccccuuucuacaaaugaagaucugugaaaugacugauuguguuuuguggcuugucuaagguuaaggcuguuuggugguuggauauauucacuauuccugguaagaauaaauaaaggucggaugagcuacuauuugagguuaaacuaagaguaguaagacuuuuuugucuagaaggacaaagauauaaucuaaguccaaaaucaugaaaaauauuagguaaaauauauaguaugucagaugggguaagugcaauggagaaaaagcacagaaggggaagggggauaagaagagcaaggguccuauuuggggcauugcaauuuaaaauggaaucaucagggaaagccacauugagaaggugaugacauugagcaaaagaccuaaaggagauauauagcaagaaggccaaguugucaagguacaauaggaaggaaggugggagaguuggaggugaaauugggaagugggugcacaggacaagugguauaggauucuguggauuuuuuuuuuuuuuuaguuggaguuucauucuuguuguccaggcuggaaugcaauggcgugaucucagcucacugcaaccuccgccuccuggguucaaacaauucuccugccuuagccucccgaauagcugggauuauaggccccugccaccaugcccagcuaauuuuuuguauuuuuaguagagacgggguuucaccauauugaucaggcugaucucgaacuccugaccuccagugauccacacccccccccgcucccuuggccucccaaagugcugggauuacaggugugagccacuaggccuggccuguggauuguuauaacaauuuugacuuuuauucuggagaucauaagccacuauuaggaguuuugaaggagguaaugauaugauucugaguuuaacuuuuaaaggguaauuuuggcugccaugugggaugggggaaaaauuuaggaaauuauccguaaacgucugucuguauagaauucauacucuuugaaggugacaucagagaagacaaucucuucaugaaucuuuugagggggccucaaucuuuucugugaaauagcacuucauguuggucaauuuacauguuaauuacauuugauucuuugacauuguagucuuaauaauugcuaacaugaauuuaauaauugcuaacaugauuugauucuuuagauggccgccaagaacgagucauguuugacaaaauuacaucucgaauccagaagcuuuguuauggacucaauauggauuuuguugauccuguaaguaaauaugguuuuuaucuuggguuccuucuuucauguguuucuuuccauuugucucuuaucccuggaccuucauucaccugauauacuuugguauucuggcuaugcccuucgauauaaaauuugaauucauugcuuaaaacauuuuuuuuuccuuaauuuugguucuguccugugaguucucacuuuucagagaacuaugaaugugaguaaagaggaaaauuugauauuaacauuuaauaucagauauuuccuugaguaaauuguuuuauucauuaguggaaaagccuaggccaggcgccguggcucacgccuguaaucccagcacuuugggaggcugaggugggcagaucaccugaggucaggaguucaagaccagccuggccaacauggugaaaccccgucucuacuaaaaaugcaaaaauuagccgggccugguggugggcgccuguaaucccagcuacuugggaggcaggagaaucacuugaaccugggaggcagagguugcagugagccgagaucgugccacugcacuccagccugggcgacagagcgagacucccucucaaaaaaaaaaaaaaaagggaagccuagaguaaagcuuguuuuggaauugugguuauuuagguagggacugguuuaaaauuuguuuuuuguuauuuauguaaaaagauuuaaguaauauaaaguagauuucauggacaauauuuaagucaagaacaaacuauucauaaaccaguugcucugcuuuucuccuuauccuuuauaacuucuguauucuagacucucaucaucaguuaucuggacuguuuucuguggucucugcaguguccuggacuuccucuaaucuuacccucuucaaacucgucuuccaccugacuucuaaaaugaucuuccuuaaaugagaaucucuaagaacucuuuuuuucaaauccacccauauuuccgucuccuuauuuagguaucuuauccgcacugcuaagguaucuuagguaucuuauccguaaaaccugugcucaucucauagcuuuaaucauauaguauggaaauuaauuauggaucuuuguccuccccuagaauugaggaugggcuguguaucuuauucuugugauauccucagugcuugacauguaucuaauuagccacuugaccaaaguaaguuuggucaagagaaaaugauuuuauguaucuugaaaauauguuuauuguaaauucucuuuuauauugaggacuuaggcaauaauuagaauaguagaauguuagaguuggaaugaacuuaagaguccaucccauuucaucuuugguuuauagauaagaaaguuccaaagagagaggggagugacuuaaguuagugggaguguagggagaagcaccuaggucucuugacuccuacauguucuauugccucaugcaguaguacauuuuagagcgcaagaauguugcagcauccucaaacuuccuaggguagauucuguugaaaaacugucggugcacaucuguaaucccagcacuuugggagacugagguaggcagauugcuugggcucaggaguuugagaccagccugggcaacauggugaaacugcccaggugcaguggcucaaucuuggcccacugcagccuccaccccuggggaucaaaugauucuugugccucagccucccucagcugggauuacaggcaugugccaccacgcuauuuuuuuuuuuuuuuuuuuguauuuuuaguagagacaggguuuugcuauguuggccaggcucgucuugaacuccugaccucaaguuaucuguccgccuuggccucccaaagugcugggauuacaggugugagccacacugugccugcccucaacccuguuucuacaaaaaaaaaaaaaaaaaaaaaauugguugggugugguggcgcauaccaguagucccagcuacuugguggugggaggaucgcuugagcccuggagguugagguugcugugagcugagauugugccacuguacuccagcacaggccacagaaugagacccugucucaaaaagaaaaaaagaaaaacugugugcuguuagaucuggcacaguuagcacacagaugguauuuuauucugaguucuaauuguuugccuuauugcucuagaaacuauuuagaagacuucacugcucuuauacugaacacaccuuaucugcuggaucugggaagaaagugaucaggagcaacuugggcuuagcuauauuauaauuagaauagauugcagacuguuaaaauaguuacacacguaugugucuuuuuuugaggggaguaugcauuguucagcugggaaacacauuuauuuucuguuggauuaagcgguuucuuaaagauucaauaaauaaaccacucacaacuuagaauuuguuuuucuuaaaaauguaugcuaauacccugugcauuaccugucuuaaaaacuggaacuuauaauguggccuugaaaacagugaaaugcagugagguuuaaugggauuggggccagaagacuuguauaauaauauaaccuugggcaagucucaguaaccugagccucagguucuucauguaaaauagguauaguaauaaucaucucacaaagugauugugaaaugucagagauuaucaaaguugauaauuacuuaucaacuuugguugagaaucauuugaaccucgggggcggagguugcacuuuguaauuugugaagugcuaaagaaaguugucauuaaauuaucauaauucagccccagaccuaauuuauacuucugucuccuuuaauuggccugauuaaaguuugauucauuugcuuuucuguacuuaccuuauguggaauuugggaaaaguaaguauggagcuggagcccugaucacuuagggagaaucugaaugaaaaauggggaaacccuuauauagaaucagucuguugggagaauuugaaugaaaaauagggaaauauagaaucauuaguauguuuucagcuauuucccugugagacuaaucgauuuaaaggcuauacuuagauuuuuuuuaaugacacuuucauuuuauauguaguauacauuuucugauaguucugcuggauuaugcauucucauuacuaaguuucccacugcccaccauucugaaagauaaauuuucagagaaguaaguugucuuguucuuuguuugagacagggucucauugugucgcccaggcuggagugcagugccaugaucauagauagcucagugcagucuugacuuccucagcacaagcaauccucccaccucagcuuacccuguagcugcaaccacagucacuuaccaccaugacuggcuaauuuuuuuauuuuuaguagggauggggucucauuauauugcucagguuugucccaaacuccugggcucaagcgagccuccuaccuuggcgucccaaaguguugggauuacaggugugagccacugugcccaaccugucguuuuuauugugaugugaauuugauuguuuucuuuuuucuuuccuuuuuuuuuuuuuuuuuuuugagacagggucucacucugccacccaggcuggagugcaguggcauaaucacagcucauugcagccucagcuucccgaguagcugggaucacagguguguaccaccacacccagcuaauuuuuuuuauuaucuguggagauugggggcggggcaggguggucuuccuagcuugcccaggcuggucucgaacuccuggacucaagccauucucccacauuggcuucccaaagugcugugauuaugggugugagccacaacgccuggcuuuuuuuuuuaauagugucgugaacugcuaagcuuaagugaucuccucaccucagccacugaguagcugggacuauaggcauguacuaccacaccuggccaugaugguuuucuuaauuacucuuuuaaggaagcuauuguuucuugggaaagcucaaguaauucuugguuuuauuuuuguaggcucagaucaccaugaaaguaauccaaggcuuguacaguggggucaccacaguggaacuagauacuuuggcugcugaaacagcugcaaccuugacuacuaagcacccugacuaugcuauccuggcagccaggaucgcugucucuaacuugcacaaagaaacaaagaaaguguucagugguaagucuggggugaaaaaguaaaaauuuaguacucucagaaaaguaauaaggguacuagaaauaaaucuugacuguuuaaagaagcaaauauggcuagaugggguggcuuacaccucgaaucccagcaauuugggaggccaaggcaggcaaaucgcuugaguccaggaguuugagaccagccugggcaauguggcgaaaccccaucucuacguuuuaagaaaaaucuaaaauuauaaaauagacuaggugcaguggcucacgccuguaaucccagugcuuugggaggcugaggcagguggaucgcugaggucaggaguuugagaccagccuggccaacauggcgaaacccuuucucuacuaaaaauacaaaaaauuagcugggcgugguggugggggccuguaaucccagcuacuggggaggcugaggcaggagaauugcuugaacccgggaggcggagguugcagugagcugagacugugccacugcacuccugccugggcaacagagugagacuccgucucauaaauaaauaaauaaauaaauaaauagcaaauauguaaauuagugggaaagagcagacuacaauuucguauuucuccaugcugccuaucugcugcauaaaaagguugauggaucuuuguucuuuuuuucauuuucucuuuuuaaaauuuuuuuauuuuuuuugagauaaaguuuugcucuuaucgccuaggcuggagugcaauggugugauuucggcucacugcaaccuccgccucccggguucaagugauucuccugccucagccucccgaguaguugggacuacaggcucccaucaccacgcccggcuaauuuuuuguauuuuuaguagagacggguuucaccguguuagccaggauggucucaaucuccugaccucgugauccacccgccucggccucccaaaguccugggauuacaggcgugagccaccgcgcccggcccaggaaucuauuuuaaacuacaagaacuuauaaucacuuuaacucuagaagauuguuuccuuaaaugaggcauuacauauuucuucaacauauauguguuuauugagcacuuuauaugcuaggcauugagguggguugagaugacaaaaaggguugagaaccacuguuuucaacuauuaccuaaagauugaauuagcuguuaaguggucuugauauauuuucauuuuuuguuguauuuuuuagaugugauggaagaccucuauaacuacauaaauccacauaauggcaaacacucucccaugguggccaagucaacauuggauauuguucuggccaauaaagauguauguauaacacuuaucugguggaaauuuuuugagagucuuuuuuaauaaugcacacauuuuagaaaauuuaaacacugcaaaagauacagguaaauacuaauucuguuuccuacccugauuccugauuuuccucucuagaaacaacuuuaucauuuuaaaauguauuuuuccagagcuauuuuguacauacgugugugcauacauguguauguguguacauacauauuuuucuucucagugguacuguacugugcauacaguuuucauugauacuuucuucacuuguaaguauaucuuguuuguucuauaucagccuuuaugaauuuacccuuuuuuauaacaguuguauaacguuccauuuuguagauauauugucauuguauguauguguaagaauuccuuuagugaucaauauuuguuuuucaucuuuucacugcagugaauauucuuguaugguagguguuuugcucauagaugaauauaucuguaagauaaaucccuucaguagaauugcugagccaauguguauaugaauucaaaauuuugauaggcauugccaaacugacucccaaaaagguugcucagguaaaauuuuacaagcucaugcucagcaacuuaaaaauuauccacuuguguuugaaccuguuucuuaacuagaugccagaggacagaagggaaaagauguagccuagccagcccuuuuacacacaggauuuauuuaccguguauaucuggacagauuagagaccaguuuuaacuuuagguaauauaaugauuaggccgggcgcgguagcucacgccuguaaucccagcacuuugagaggcugaggcggguggaucacggggucaggagauccagaccauccuggcuaacacggugaaaccccgucucuacuaaaaauacaaaaaauuagccaggugugggagcuggugccuguagucccagcuacucaggaggcugaggcuagagaauggcgugaacccgggaggcggagcuugcagugagccgagauugggccacugcacuccagccugggcaacagagugagacucagucucaaaaaaaaaaaaaaaaaaaaagaaugauuaauugacuaucucucuaaacauguaucugauguuaaagagacuaggagaaaacugaguuguuuguguguuguuaauuuguguaaucucgaagacaaguugaagacaaaaauacagcagcagcaacagcaaaaccugugucuaaaaauauaccuauugauagucaaguauuucaguucucuaauauucacacugggcccauaccugccuuuggcaacaaagaugaccuuaaaauuuuaagagaaaaggaaagcaagcuuucguauagguuuuucuaguccuuagauauggaucauuauguagaaacacugucaguauuuugaaaaccuggcuccuuuuuuuucucuccaaaaugauuauuuguacguuauugcuuuuauuuuccucugaaugacuuuguagccuacaaaaacucuguaacaaggaccaguuaugcucuaaaaucuuacuguuacaauaguucuuuguuggaaacuuguuaaaggacuauagauuuugaagagccucagaauuaacauaagccugcuuccugucauuguuuauuauauauacuguuauauacaguuugaaguaggcuagcuuuuaaaauaaauauauauauauauuaguaaauaugugguaccaauacuuuuggauuaauagccaaucuaaaaacauguuuaaggaugauaauauagucccauuuaugcucauguuuuuucccucuuucaaaacauacuauaaacauaauaguaaaaguuuggaaaaucacauuuaaucucacaacauauauuuauguauuaucuucuaguguuuucauauacauguuuuuaaaccuaauuaggauacuuaauuuauauguauuguuucuuuuuuuuagaauguuagauggacuucuauucuacaguaauaaugcuuaguguuaucucauuguauccuguguugauuuuaguucuggagucagggccgagagauaagagauuuugugaaaauaaguaauuauuuuaauuuaauuauggguucuuuuucaccccuaucagcgccugaauucugcuauuaucuaugaccgagauuucucuuacaauuacuucggcuuuaagguaaauaauggguuucaaguaugugggaauuuauacuuaaaucaugaaauaaaggauuuuguuuauguuuuggugacaguuaucaaggccauaaguuguuuggaguugagauggaccuggggaauuagugggguuaagguagcaguggugguuugaauuaaggcaaagguagcuuaucuauuugcaguuuuugaauuuuccacauauuacuucuggauuaccugaggaguuaugcagauaaauuaccauaaguauuucauaacauucuaaguauuuuugcguugauaggcaguauaguauaguguagugacugagaacaugaaugucaguguccaccugaauuccagucucugcucuauuucuuauuagcaaguuauuuaaucucucugugcuuguuuccuccauuuuagaauggggagaauauaaaauuucaacaacaaauuuaauuaaaaaaaaauuuuuuuuuugagucugugucucacuguguugacuaggcuggagugcaguggcgcgaucuuggcucacuucaaccucugucuccugaguauaagcaguucuccugccucagccuccugagugacugggacuacaggcacacaccaccaugcccagcuaauguuuguauuuuuaguagagacggaguuucaccauguuggccagucuggucuugaacuccugaccucaggugauccacccaccuuggccucccaaaguccugggauuacaggcaugagccacugcggccaauuuaguuuaaauuucaauuuaaagugccuauaacaggcugggcaugguggcuuacgccuguaaucccagcacuuuaggaagccgaggcgggcugaucacucgaggucaggaguucgagaccagccugggccacguggcgaaaugccuucucuacuaaaaaauacaaaaauuagcugggcaugguggugcaugccuguaauuccagcuacuuggggggcugaggcaggagaacugcuuauacucaggagacggagguugcagugagccaagaucguggcacugcacuccagccugggugacagagugagacucugucucaaaaaaaaaaaaaaaaaaaagugccuguaacagaccaggcacugcucuaaacaacauauacacucauuuaauccgcugaggaaucccugauguauauguugcucauuuaauccccaugaggagucuucaggggauuaaaugaguguaacgaguguauauguugcuuagauccgugccuagucuguuacaggcgcuuuuuaaguguuagcuguugugaaguugaugaugaugaugaauacuacaacuucuguuaauguguguagagcuggcuuuuuccagaaauuuucaugcagucucugccgaaacaaaagugccagugaggaggcugagaugggaggauuccuugagcuuaggaguuugacaccagccugggcaacacagggagaccaugucucuacaaaacguuuuaaaaaguuuuuuuuaaaaaaagugccaaugauaauucuggcuaacaugacgaaacccugucucuacuaaaaauagaaaaaaaaaauuagcugggccugguggugggcgccuguagucccagcuacucgguagccugaggcaggagaauggcaugaacccgggaggcagagcuugcagugagcugagauugcgccacugcaccccagccugggcgacagagcgagacucugucucaaaaaaaaaaaaaaaagugccaaugauaauguuccagaugaagcuaggaagaguaaaugugcuauucuuuucauuugaaauuuuauagaaacggcgaagauuuaaagagauugccuuauuguggaugauauauccacugcgucuuuaaaaacggugcucugaaaauuuuuuguuguuucucucuuucuagacgcuagagcggucuuauuuguugaagaucaauggaaaaggugagaaaugaacauguuugucuguuacauuuucuacucauuauauugaauguauagcuuugagcuauaagucuuaauauucuugcuuagacucuagauaacauuuuggacuuuagguuuaguuuguggauaauuguccuguuuauuaguauaaaguuuuucuaguuuccuuuugguguccuuuucugaaauucaaauacguaucucaaccuacuuuuucugacgucucaucaugugaaaacuccucuuuugucuauaguggcugaaagaccacaacauauguugaugagaguaucuguugggauccacaaagaagacauugaugcagcaauugaaacauauaaucuucuuucugagaggugguuuacucaugcuucgcccacucucuucaaugcugguaccaaccgcccacaacuuucuagguagguguuuugaguagggaaauacgccuugaccugaagaaacugggcaguuaguucaucacauaaaaaauaauuuaaugaccuuuuaguagcugccugcucugauuaaaugagauuuagauucuggaaagaucucugacuguaaugugguaaaugaauuggagaaaaggcaaaugcuuauaacaaaaauguucuaaaauugauuggauuguggugaugguuacacaagucuaugaguauauuaaaagccauugaguaguacacuuuaaauggggaauuauauuauuugugaauuauauuccuuuuuuuuuuuguuguugagacaaagucucacucugucacccaggcuggagcgcaguguugcgaucuuggcucacugcaaccugugccuccuugguacaagcaauucucuugccucagccuccugaguagcugggauuacaggugcccgccaccacacccagccaauuuuuguauuuuuaguagagaugggguuucaccauguuggucaggcuggucuuaaacuccugaccucaggugauccacccgccuuggccucccaaagugcugggauuguaggcaugagccaccacgcuuggugugaauuauauuucaauaagguuguuuuaaaaagaagguaagugccaagaacuaguuaggggacucuuauagcaguuuauauaagaaauugugguagucuagauuagggaggugaaaguagaaauugacagaagcagauagaucaaaagauauuuagggccaggcaugguggcucacaucuguaauuccaacacuuuggaaggcugaggugggaagaucacuugaggucagaaguucaaggcugccgugagccaugauuaugccacugcacuguagccugggcaacacagugauaccuugauuaagauaaaaauauauauaaaagauauuuaggcugucaaauugacagaauaugggucaagaaugguucuugcauuuauggauacaguaaguaacaggauuaaugaugaugccauuuguugagaaaaggaacacuaacggucugguaauacauuaaaaaaaaaaauaugccauuaucaaguugguuuguuucaggaauucaagaacaugguaacaucaaaaaauacauuaauguaauucauugcauuaacauuuuaugcaguuuaaugcucuuucauaauaaacacuuuagcaaaauugauauagaaaauaacuuccuuaauuuggcaaaagauacccaauaaaaaccuagauguaucgucucuuuuuucagcaugguaguggaggccugagccagcauuguaaaauaagaaaaagaaaagauuggaaaucagggaacaaaacuguaaugauuugaagaaaugauuuuuacauaggaaacucaagagcaucugcagacacauuauuagaaauaaaagauuucagcaaaauaucuggauauagguucaauauacaucaaucaguuauguuucuguacuuuagcuguuagaaaauuaagucuuaaccuacagccaugcauuacuuaacgauggggauauauucugagaaauguguuguaaggugauuuccuugugcaaacauuauacaguauacuuagguaagccuagauuguauagccuacuacacacauaggauauauggcauggccuguugcugcucauagguuacaaaccuguguagcauguuacuguacugaauacuguaggccuuuguauuaccaugguaaguauuuguguauccaaacauaucacaguaaaaguacccuauaaaagauaaaaaaugggccaggcgugguggcucacgccuguaauccuagcauguugggaggccgaggcgggcggauugccugagcucaggaguucgaaaccagccugggcaacauggugaaacccugucuguacuaaaaauauagauauaaaaaaacuagccaggcauagcagugugcaccuguagucccagcgacucaggaggcugagacaggagaauugcuugaaccugggaggcagagguugcagugagccaagaucgcgccacugcacuccagccugggcaacagagcgagacuccgucuccaaaaaagaaagaaaagauaaaaaaaaagauacaaaaugauacaucuguauaggacaguuaucaugaauagagcuuguaggacugaaaauugcuaugggugaguuagugagugaguggugaaugaauaugaaggccuggcugggcguggugggucaugccuguaaucucagcacuuugggaggcugaggcagguggaucacgaggucaggaguucaagaccaacagggccaacauggugaaacccugucucuacuaaaaauacaaaaauuagcuggguaugguggcaggcgccuguaauccacuacuugggaggcugaggcaggagaauugcuugaaccuggaaggcggagguugcagugagccaacaucgcaccacuacacuccagccugggcaacaggagcgaaacucuaucuuaaaaaaaaaaaaaaaaggaauaugaaggccuaguacauuacugacgacuguagacuguacaaacauugugcacacuaaauuuauuuuaaaaauauuuucuucaauaauaaauuaaccuucgauuacuggaugaccacugucguauguguaguccaucguugacuuuuuuuguuuguuuuuaagacagagucucacucuuuugcccaggcuggagugcaguggcaugaucuuggcuuacugcagccugcaccucccagguccaagugauucuccugccucagcuuuacaaauaguugggauuacaggcgugcaccaccacacccagcuaauuuuuguauuuuuaauacagacgggguuucaccauguuggccaggcugaucucaaacuccugaccuugagugauccgucuuccuuggccucccgaagugcugggauuacaggcaugagcuaccaugcccgguuuuuuaaguuuuuuagaaauuucucuaaaacaugauuaaaggacauuaaauaauaaauaaauggaauagauucaauuuuauaaaaaugucaguuuuucccaaguuaaaauauagauucaaaguaauucuaggcaaaaucucaacauacugauucuaaaauucaugugaaagagcaaaagacugcccaaaaaugucaggucgaaauuccuggaaccuguaaauguuaccugauaaggaaaguggucuuuguagagaugauaaggauuuugacauggagagauuaucuugaauuaugugggugggcccuuaauccaaucaaaaguauccuuguaagagagaggcugagggagauaacgacucacagaaggggagaaagugauguaaagauggagggagaaauuggagucauguggccacaaaggagagcaauuagccacuaaaagcuggacaaagcaaggaacagauucucccucaaaaccucuggagggagcacuccaaaaaaaaaaaaaaaagugaguugcagacauugugacucuugauaccuccacuuaccuuuuuuuuugagauggaguuucgcucuugucacugaggcuggagugcaguggcacgauuuuggcuuacugcaaccucugccucccggguucaagcaauucuccugccucagccuccugaguagcugggauuacaggcacgcgccaccacacccagcuaauuuuuguauuuuuaguacagaugggguuuguccauguuggccaggcuggucucgaacuccugaccucaggugauccaccugccugggccucccaaagugcugggauuagaggugugagccacugcgccuggcccuacuuccacuuauaucucgauaggagaauauauaauaugaccucagagcaaaacaccauagagcaaaacauuggaaaaauugacuacaauuaaaaacuucugugugaaaggcaauggaagggcaccguggaucaauaaggccgagaggcgagacaaagagggcaaaaaucuucuuuauugagcucucgggcgagguucacugguccgcagggggagggccagggaagucucgcugugccaaaggugcagcgugcuuuuauggaugcugggugaggaguggucaggguaggggcagggucgguugaguuucacgcuucugagugugacacgcccuagugggcaugugcguuagucgggguggcaggaacaggaaaggugaacccggaaaugcugagucaggguguccgagguggcgaucgccaucuuggagucuucaccggaguccaaucacugugaaccaaaaacgaagucaaauaacaaguuucacacuuugggaggccaagguggguggauuaccugaggucaggaguucgagaccagccuggccaacauggcgaaacccugucuuuacuaaaaauacaacuauuagccaggcgugguggcguaugcccauaaucccagcuacucaggaagcugaggcaugagaaucauuugaaccugggagacggagcuugcagugagccaagaucaugccacuguacugcagccugggcaaaagagugagacucugucucaaaaacaacaacaacaaaaacacccaaaaaaacaaguuucagacugggagaagauauuugcaacauguuaacuauugagagauuauaagaaaaacaaggccaggugcaguggcuucugccuguaauuccaacacucugggaggccaaagcaaaggcuggcuugagggcagaauuugaaaccagccugggcaacauaaugagagccugucucuacaaaaguagaaaauuagccaggcgugguggugcacaccuguagauuuagcuacuugaaaggcugaggugggaggaucgcucgagcccaggaggucaaagcugcugugagcuaugaucaugccacugcacuccagccuggguaacagaguuaaacccugucucaaaaaaaaagaaaagaaaagaaaagaaaaacagaaagccaaauagaaacaugggcaagggcuauaaacaaauaaugcauggaagaagaaacuugauuggcuaauaaacgucugagauguuaaacugugcaauaggaaaaugaaaauuauguauauauauauuugauaaaaaugaaaaggcugacaauuccaagcacugauaagaauguggagcacaaggaaaucucauacauugcuagaaauagauuuguccauccacuuuggagaaucuuuaguaaagugaaacguguauaucuuuugacccagcaguuccucuccuagguucauauucuacagaaaugcuuagagauaaacacaagguguuguguucaagaauuuuuauagcagcauuguuuggaauugcaaaugaauuggaaauaauccagauguucaucaacaggcacaugggacaaauguuuugguauauuuauacaauagaauaccuuauagcaaugaaaauaaaguuuguuuacauauaucaaaaggauuaauuucuguaaagcaauauugaauuaaaacaaguugcagaaugauaaacagauaugcaaccagaaaaauucuaaguguauaacauguaaaaaugucauaaaggaaaugcuugaaaauguuagaggauugcaaugaggguauauuuguggugucuaauuuuuugagguagguggcaaguacagaguauuuguuacaucauucucuauauuuuucugaaugucugaauauuuauauaaacaccuagucaauagauagaauccauuugcaugauugaauauucaaggcagugaagagauuauugauagaguaagguuccugagguggggagcaggaugagauccaaagugagguaaagggguugucuuuaaaaagacuguaaaggagcuaugauuuugguagacguaucaaagaauugguugacaauuggagagauuauuuucauaaauguuuguuuuucuuggcuuacuaacaaccugaaaagacggugauguauguuuaugaauaugcaugagaaaaugugaaaauagcacguuugcagucuggugaaaauguaagccaauauuuuagacuuaucuauaagacuuccuacuaggcuuauuuacuuacuaucuaggggaggcagcaagaugauuuuaaaaugauauuucgauauguuuuauugugucauguacaguaaaguggguuuucuucuuugaaaaucauuuaggaacuuucuaaacuucaacucuuuuuuuuuuuuuugccuuagugucuuuguguugaguaaucauuuuugugacucugcuucauuuccuugcucuaaguugagacauuuuuucccccguagcuguuuucuucugaguaugaaagaugacagcauugaaggcauuuaugacacucuaaagcaaugugcauugauuucuaagucugcuggaggaauugguguugcugugaguuguauucgggcuacuggcagcuacauugcugggguagguuucugccauuugacuuuuaaagggggauucaagucuaaaagcaaacagauucaugguugagagggcauaugcuauuuuuugggaguccugggucucuguuaaauuacuaaauggcuaugugacuuggagugagucauuuuacuucuggcuucauuuucaucuaugauauuagauauuuagauuugacuagauaaucucuagaauccuuuuuagcucagguuuuagaauucuggcuuauuuuagcaguaauaagagcaguuaucauugauugauugcuuacuguauguuaaguuuguuauaaauguuuuacaugagguacucauuugacccuuacuacaacgcuaugagguaacuaugauuauagacucaugccaggaauuuuauuccuuaaaauaaccuugugaauaaagguaccauugucuaauuuuacaagugaggaaauugagacuuagaaaguuguuacuuucugagaucaaucacuuaauaugugguagagccaggauucaagauuuaugcauugacacuuuaugauguaaacuuuagcccuuuguuaguuuacuguucaaugggagucaagauaauaguuuuggauuuaaauccuagcuccacuacuuaacuaguaauguggccuagaguuaguuauuuugugucugaguuuguuuccuuuucuguaaggugaagaaaauaucuaacucuguagaauaaaguuccagaaggaaauuauuccauuauguuguguuuuggaggugcugugauauauacagcacuuuacacagugguagagugagcuauugcucacuuaucuuucuagacuguuuaaaggcuuguguugggaucagaaggguuaaagaauuugaugaaguaucuucuagucguaggagucucuauuuucuuaacaucauucuagaguccacuuauugcugagaaucuccuuuuaccuuauuuauugcccugauauagcuaucgcauauaauucuuauuguaaauugccuugauuucuuuugggaaaaaggcauuguaguaguguuuauauucuuuuuuacucuacccaaaguguaucuuuauauaacgaccuuuagaagauguagaguuuaaauuuagcuaccuugauuuuggaucccuuuggccuguaauuguuacaucucauuauaaauuagaaaugccaugagguaacuuaguacauaauuguaauuuauucaacauuuuguugauuuuauuugggcauuuuuccaaagcagaaguagagauggagagcagguaaaacuucauagauugcuaccuagaaauuaggcaucuuuuuugauaaaagaauggggccauuuuuuucuuuucuuugcugagugcccucugucauuucuaucauggucucucuuuuagacuaauggcaauuccaauggccuuguaccgaugcugagaguauauaacaacacagcucgauauguggaucaaggugggaacaagguaugcuccaugaauugaaaguacuggaaaucagaacuaaaggugauuuagucauauacacuuaagaugguucauuuauguguaguuucuaauuaccuuuuuuuuacuuguaaaaucaauuugaggagguauaauuauuuuaauaugcauauacuuuaaauguacaguuugauggguuuugacaaauguauacacuuguguaaucaccacauugauaaagagguagaacauuuccauuaccccaaaaucuuuucucccucauauaccuuuacauucagucaccccugucaccccuacccacacauacuuuaucccuggcucuagacagccacugaucuauucagcuuucuuacaugauaguucguuugcaaagaauuucucaaguuguaauucauauaaauuuguuacuugaaaugggguuguaacaugugcucuagguuuuucuuucguuuuuuuuuuuaucucucucuuaucacccaggcuggagugcaauggugcgaucuuggcucaccguagccuugaccuccuggacuuaagugauucuucugccucagcccucccauguagcucagacuauaggccugugccaccacacccagcuaauuuuuauauuuuuuguagaggcgggggucucacuuucuugccuaggcugaucucaaacuccuaggcucaagcaaucuaccugccuuggccucccaaaguguugggauuauggguguuagccacugcaccucgccuagguuguucuuaaaacaaaaacaaaaacuaccuggaauaacaaaacucucccuaauuggcuggaugcaguggcuccugccaguaaucccagcacuuugggaggcugaggugggcugaucguguaagcucacaaguucaagaccacgaguucaagcucacgaguucaacaugacgcaaccccaucuccacaaaaaauacaaaaauuaaccgggugugguggcgaacgccuguaguuucagcuucucuggaggcugaggugggaggauggcuugagcccgguaggcaggagguugcagugagccgagauuauaccacugcacuccagccugggcgguagagcuagaacuugucucaaacaaaacagaacaaacaaacaaaaacucucccuaauugauagaagaaacaguaaaguugagagaauuggguuguuuaccuuauuuuaucaacaggaugguuuacaacuagagucugccuuuugugacuguaggcacacuaaucgcuuguugguuuaugaauuucucucugauggacuuuggggaccuugauaagacagaucaacuuuuugaccuacaauaagagcauggcuuauacugucaaagcaacuuccuuugggcuuuauguacaugucaugugguguaaagagagcugggcuguugcugaagaggaggcuccaucuguaguucaucaugucacuuuagaaaaguuaaucuuguuucacauuuuguuuauaucauucguucguuuuuacucauagaauuguaaaauauuacuuuuacaauuauauauggaaaacuuacacuuuuauaauacuuuuauuuauguuauuuaauucauuguagugaaaaucaaaggagauacuauaaaagugcuuugggagacaugauguuucuuuguuucauuuuuauucugaagagaauuaugauuuauuuaccacuagcguccuggggcauuugcuauuuaccuggagccuuggcauuuagacaucuuugaauuccuugauuuaaagaagaacacaggaaaggaagagcagcgugccagagaucuuuucuuugcucuuuggauuccggaucucuucaugaaacgaguggagacuaaucaggugagagauagguacuuguugguaauagcaacuugauucacaugagcuuucucuuuuuuagucaucuuaagucaugcuuaggaagagcccauaugugugugaugccacagaaggcauucugaacaaguuaagagaugccgugcuugucuucuuauauuucuauucucuaaaguagaugcuuugugaccuaaaugcuuaaaaggucauguauaaacaggcagaccuagauguuugggccugaaccugaaaaugauuauuucuacagcaaauuuccaagagagcuuguaaaagucaccuuaugcuugcaguguuucuaauggauuaugguuggcuauuugaaguuucuuaugagugauuuuguccuuuccuuuuuaggacuggucuuugauguguccaaaugaguguccuggucuggaugagguuuggggagaggaauuugagaaacuauaugcaagguaugggaaaaauaugaaagaaaacaauaauguuuuaaucaugguuucucuuauuucagggguccaaauaucaaaaguacuugucaagaaucuuuugaagcaucuaagagaaaaagugacuaauaauuuuggucagauuugcuuccugacucuucaccaaaauugaguugugucuucuucuuucuuaaaacuuuggaauguauaaauagguucuugggauuuuuaauugauccuuuuaaaauuuaagaugacuaguaggguuauuauuuugcucugucauauaguacuuuugauaagcuaugcuuuauguugcauaaaggaaucaugagugacuaggacacauaugucaguaguuuauuaaaauuaaauaggucaggugcaguggcucacaucuguagucucagcacuuugggaagaugaggcagguggaucauuugaggucaggaguucaagaccagccuggccaacauggugaaacccugucucuaguaaaaauacaaaaauuagcugggcgugguggugcacaccuguagucccagcuacuugggaggcugagguaggagaauugcuugaaccugggagguggagguugcagugagcugagauugugccacugcacuccagccugggugauagaacgaaacuccgucucaaaaaaaaaaaaaggaaaaaaauuuagcacagucuuaagagauuuggcuuccuuaguuuuuacuccuuuuuauuaugaaagauauuauugguuuagugggauugcgaucaucugaaggcaccuaaaacugccucauuuuccccuauggcuuuagcuagaguaaaauaaauaucauauuccuuuuuuucuuuagcaaaacuuagagaaaauuuaagaguuuucauaacuuuauauuuuaaugucuucaaguugucuacaauaaaguuuuuuuagggaauauauauuaaauaauauuaucugugccuuucaguuaugagaaacaaggucguguccgcaaaguuguaaaagcucagcagcuuugguaugccaucauugagucucagacggaaacaggcaccccguauaugcucuacaaagauuccuguaaucgaaagagcaaccagcagaaccugggaaccaucaaaugcagcaaccugugcacagaaauaguggaguacaccagcaaagaugagguagguagaaaaaauucuuccuagaguacuaagaagagaaccuuaggcaguuauuauuugugaauuccucacuugauuucacuugagauaagugaagggaguuugcauaguuguaagcagaagaacacuguuaaaggcagagagcaaaggaaggaaaggguaugaucugugccuauaaauguuuuuuagucuaagccgugugggaaagacacaguuuuuucuuauacacacaucacuguaauaacauuuacucaagaaaaauagaaauauacaguuauguuaguuuaggacacacacaaaaauguguuaggauguacauucaauuuaaacuauguaagccuugagccuggaaaguggaggcugcagugggcugagauugugccacuguacuccauccugggcgacaaagugagacccugucucaaaacaaacaaacaaaaaaccaaaaacaacaacaacaaaaguauguaagcuuauaaagagaguccuuucagugaauggugagaucaaauucuaaucucaagucuguaaagagacuucacagaagaaucaaggcuagaaaugggacauggauuugguguuuuaaaaaaaaguuugagagaggagcuuuccauuuggaaagaguggucuguaugauacaccagagacagggcuggguuuuaugcaguguggcaaguaagucuguuuugauggugcaaguagauuaauuauuggaauauggagagauggcuauggcugggggaagggagauagaagguagaagcugacacgucacggauagguagcccuuguagguuucugagaggaaaauagcaucaaaauguuaagaugaaaaggaagguucuugcuucugguuacagagugucuugcugugagaagggauuagagguuagccuagggagauuguuguacuaguuggaugacaggcugcuuugaucuuggauguaaacuauggaaacgaggaaggaguagauccucaauucuaggaccuuaaaaaaaaagacaaaugaaaagucaggaaguaaauggaaagugaguuaaauauacugcuaagguuacaguuuaauucaaaauuuauugugcaguagcuauauguaaaacacaauguuaagugcucugagaauauaaauaaauaugcugcccucuggaaacuucuaauuuaguuggaagacaucgacauauauugagguaacuauuaugcaagacagauuauauuauagaggcuagagugacauuuuuaaaauaaaaaucagauaaugucauuugucugcacaaaacuacucuuuggcuugcuaacccaugcagaauuccuuuuuuuucggggggcgucaagauuucacucuguugcccaagcugggcuguggcucacugcaaccucaacagaguucuuucuuuuugcaaauugagcuauaauucacucuuuuuaaaauguacaauucaguguuuuuuuucuuuucuuuucuuuucuuuuuuuuaguauaucugcaagucugugcaaccauuaccacuaucuaauuguaguauuuauuuauuuuauuuuuuuuuuuuugagacagagucuugcucugucaccaggcuggaguguaguggcucgaucucggcucacugcaaccuccgccuccuggauucaagcgauucuccugccucagccucccgaguagcugggacuacaggcgcgugccaccacacccagcuaauuuuuguauuuuuaguagggacgagguuucacuauguuggccaggauggucucaaucucuugaccucgugauccgcccaccucagccucccaaaguguugggauuacaggcgugagccaccgugaccggccuguaguacauuuuuaucacuguagauaaugaaacccuuuauccauuagcagucacucccuguucccuucuucccucagcccuugacaaccacuaauauauuuucugucucuagauuuguggacauuguggacauuccauaggaauggagucauauaauauguggccuuuugugucaggcuucuuucacuuaacauguucuuuuauucauguuguagcauguaucaguacuucauuccuuuccauccagaguucuuacagugcccuacaagguccuacacaacuggauaacccaccucaucugcgguuacuuuccccuuuguucacuuugcuccaacccuauuaauuuucuugcuuuuucucaaacaugucaaccaugcuccuaccucaggauuuuugcuccuucuucccucuugaauguuaaaaugcacccccucuucccauagccacaugauuugcuuucuaaccuguucaguucuuuguucauauguaacauuuucaaugagguccuucuugacaauucuguuuaaaaauuauacccccuucaucuuuauccccaguacucucugucuucuuuuccugccuauuuuucuuccuggcauuuauuagacuucugugauucaagcuauauuuaaaaaaauggguauuuggcaacauguguagaauggaguagaugugaagggcaucaagaguucaacugggaaacuuucaguaguccaugugagagaaguuaagacuuuggcuugggauagucauaaucaaaauggaaaagaaaguguauucauucaacauuaucaagacuuacugugugccagauguguugcuagugcuaaacauauaaauauaaauaagaugauccuugugugaagaagcucacugccucguguaguggagaaaucacuggaagagcuuuuucagaaaucacaaauugagauccauuguugcuaagggcuugucagaauaucagugaaggugagguggacguguguguuuugaagaacucugcagugauggaaauguucuguaucugauggcuauugagcacuugaaauaugacuagugcaacugagaaacucaaauuuuauuucauuuuaaauagauauauguagccaguggcuaccauauugcagggcacucaucuacugaauaaugagauagguauauguaaaaagcuaauuauaacauagugugauauaugucugguaauagagcuguguacuguggaacauaggguucucucucucucuuaccuauuuugcugaugcauguuauaacuaacacauaugacuagguauugaagaaauagaaucagugggauuuagaaauggacugaugaaugaugaagagggagaagucaaauauaaaaauuuaaaauuuuaaugucugaguauuagaggcucacauggugguguaauugacacaggaaguagaaauaaaaauugugugauucuugaccuguuuuuugcauuccagguugcuguuuguaauuuggcuucccuggcccugaauauguaugucacaucagaacacacauacgacuuuaagaaguuggcugaagucacuaaagucguuguccgaaacuugaauaaaauuauugauauaaacuacuauccuguaccagagguaugaauagauuucucugcuuauugguaauuauugaaauccaaauugaaaggaaucaaucaugaucuucaagucaucauuuaaaugguuaucaauaaaaugguuugagaaaaagagguagucugucucauuugguacagaauguugcuuuuccuguucaguaauguuuucuccuuuucuuuaaaaucuguugacacaaaggcaugccuaucaaauaaacgccaucgccccauuggaauugggguacaaggucuggcagaugcuuuuauccugaugagauacccuuuugagagugcagaagcccaguuacugaauaagcagaucuuugaaacuauuuauuauggugcucuggaagccagcugugaccuugccaaggagcagggcccauacgaaaccuaugagggcucuccaguuagcaaaggaguaaguauauggauggaauuguuuuugccugugaguaccuguagugggcugaauggugaccccacaaaaggauauguccacauccuaauuccuggaaccugugaauuuaauuucauuugguucaaaaaaagguauuuugcagauguaauuaagaaccuugagauaaggagauuuaccuggauuauccaggugagcccuaaaucuaaugacaguuguccugcaagaggcacagaaggggaagcaacgugacuauggaggcagaaauuggaguguuacaaccacaagccuuggaaugcugauaaccacuagaaguuauaagaggcaaggaacagaaucucuucuagugccucuggagggaguguggcccucccaacauguugauuuugggcuucuggucuucagaacuaugagagaauaaauuuuuguuaaguuaccaaguuuuuaguaauuuguugcaccagccauaggaaacuuaaauaccuuuguccucuggaguaaaaaggauacucuguuuuaaucucuuauuuagaacuagucauugcuaaaauaauguaagagggaugcugccaauguuaguuuucuguggguuaaaacauggcauucguuaucucacaguuuccacaggucaggaguccagacuuagcuuagcugggccuucuuuucugggucuguguucaagauguugguaagggcugugaucucgucugagacacagaguucucuuccaagcuuaccugguuguuggcagaauauauuucaaggacucauggcaucuugcuucuuuaaggccagugggagagaccaucucucguuucaaaaggggcacagucuagucucuuuugaggguuuucaccugauaaguuagguccacauaggauaauguccucaccaccccccugucccgcuuuuuuuuuuuuuuuuuugagacagagucucacuuuguuacccaggcuggaguguguggugugaucuuagaucacugcaaccucugcuucucagguugaagcaguucugcugccucaagucucccgaguuaguagagaugggguuuugccauguuggccaggcuggucuugaacuugugaccucaagugauccgccugccuuggccucccaaagugcugggauuacaggcaugaaucacugcaccuggcguaaucuuccuuuuauuuaacucagaaucggcugauuugcaaccuuaauuacaucugcagaaaccuuucaccuuugccauaaucgcuggagugacaugcauccuauucucaagucauguccauacucaaguggagauuauaaauagccugugcaccaaggugugggaaucugggaagcugucuuagaauucugccuuucccacugccuuuauuaucaguacuaugauucuuuacuauauaaaauguuaauuucauuucugacauuccugcugauauuagaaaaucuaaugugugguuauuagaaaauagguguuuuuagcuaaguaaacagaucaagggacagaugaaggcacugaagaaaguaacauuuuuaguguuaaaaaaagagaaugugucagccacacccuuuuaugaauguuagaguuuucugguuuguagauaugacaugggauaaucaguuuucuuagccugcuucugaucaauaugacuacauggaauuuuguccaggaaaaucucuggagcuuguauuccucauagagguugauuagaagacagcauuuguugggauguggggacauggcagcuagucauuuguggguuuuuuuuuuuuuuggucauaguuuuaacuugcuguagaauaaauuugaguuguguauuccuuagauucuucaguaugauauguggaauguuacuccuacagaccuaugggacuggaagguucucaaggagaagauugcaaaguaagugaaaagauguaaaguagcuuugaaggcagaaggguuuagguucaccuucuggaucuucagaaguuagauaugucauuuuaacuucuuaaacucauuuauuacaaauggggcuaaaauggccuaucucacaaaacuauuuugggaaaaaacuucguaagauaauauauauaguaaccuggaaguugcuuggcacaaugaaagcauuucaguaccugguaggaauuacuauuauuaguugaucuuauuuuagggacuuaacacaccuagauuagguaauuuucuuucucauuaaggcuuuuuuccaacuaugauuuuuuuuuuuaaauguuuuucauucuuauuuauuucccaauuuaguuacaucgggcauauaaauggcuuuuguuugaauugauugucauaggaauaauggauuuuggaagaguuuuuggaggguaauguguuuagacuauaugaaaaaaaaauuuuuaaauugaguuuuuguaggccuuucaaacuaauaagcauaagggauucgaaggcagacagaauguuuugcagagugaauaacaaagcaaauuguuuuuguuuucuaucgugaugacuuugucauuuauggguuaaugcauaugcaaagugauuaauauuuggagaaugaagcaguagcuuuaaaaugcucuuuaaaaaaaauaaccguuugccuuaaaauuguuaaauuaaaauuguuuuccuacucaaauaauacauguuagaaaauuuaggaaaacauagauuuggaaagagaaaaugaaaauuauacuaauacugccucccccagaaaaccugugugcaucuuagugucugucauccuuuagguuuucuuccaagaguacacauacauguguauuuacauggaaauucaacuuuuaagaaaauggaccuguacuguauuuauauauauauauauauauauuuuuuuuuuuuuuuuuuccccucaaaauacuauggcuuaguuuuuuauauacaugacuuuuuuucuaauuucaaaauuaguauaugaacacaaauuuauuauuaauaaagcucaaauacagaaauaaaauagaaaguaaaagcccuucuucauacuucugccaaccauuugucucagaaaacaaaccaaaaaaguaacuuauucuuuuucccagagauaagacuuguuaaugguguguauuuuucuagaucuuuuucaguacauuugcagauagguacacauacacgguuuugucauauaaaugugaucaaacuugauguauucugggcugggcaccaugacucacgucuguaaucccagcacuuugagaggcugagguggguggaucacuugaggucaggaguucaagaccagcuugggcaacauggcgaaacuuagucucuacuaaaaauacaaaaauuagcugggcgugguggugcaugccuguaaucccagcuacuugggaggcugagacaugagaaucacuugaaccuaggagguggagauuacagggagccgagaucaugccacuguacuccagccuagguaacugugacucugucucaaaaaaaagacuugauguauucugagacuuguuauuuagugauuuauuuuggagcucuuucucuuuuaguaccuguaggucuaccuaauguuuuuaauuauuauagacaauuccauaguuugaauauaucauauauguaggacuuuucacaacauuuaccugucuguagacagaugauguugcuauuuuacagaugaggaaguaaagacaugaagauaguuggugguuugcuugauaccucacuacaaagugacagaguaagguggagaaccaccccccaaaaaaaguaaauaaaaaaauaauaauaacuaaaaaguagagaacccaguuguauuagucgauucucacacaguuauaaagaacugccugagacuggguaauuuaaaaaggaaagagguuuaauugacucacaguuccgcaggguuggggaggccucaggaaacuuacaaucauagcagaaggggaggcaaacagguccuucuuuaauacggcggcaagcaaagugcugaguaaagggagaaaagccccuuauaaaaccagaucuugugagaacucacuaucucaugagaacagcaugaggguaaccuccucugugauuaaauuaccucccgccaggucccucccguaacguggggauuaugggaacuacaguucaagaugagauuuggguggggacacagccaaacuauauccaguuguacagacuccgucaggauaugaggcuguaugcuaagcacuguaugaauccauagguauagaauguaggaaagacaggcucuuuguguuuuaaaaacuugagacuaagaaaacaaguaguuaagguauacggaaagguacaggucagagaaaauguuugcagaguagauauuuguauuugacauuuguauuugugccugccugaugaggaaagauguuuuaaaauugcuaucaauuaggcugagcuuugaaggugagccaggggcaguugggagauuucucagugugucagauaguguauuuucucuuauuagucaaaagauguuaaccuucuugcaggaacuuauaauugaagaauauacuuugagcauaauuucuuccucuuuacaggauaauggagaauuguggugauauuucucugauucugaacacuuucucaucauuauuuuuccagaaggggccuagcacaaugauuuuauaggcacuuggaaaagagugaggguuggaugaguguaaccuaauacagguggggagcgcuucaacagugauuugaauauuucccuacgcaagauaguguaucaaguguuaugauuccugagugccacaguccaaguggcauaaaucaugguaugauaaggauagccaacaauaaaaauuguacuaauucaguuuaggagucaggcauuuaagaggagagugggcuauaauagcacccauacuguggaauugccucccuguaggaguuuaauuugaaagucaacgugugaguucaaugcauguacgauguuacauuuacauuuacuacauuuaucuacauuuacuacagugacuuaaaguagcugcuuuccuggcagauuguagcuuugggacuaguaccugauaaucuccuuuucuuuagguaugguauaagaaacaguuuacuuauugccccgaugccuacagcuuccacugcucagauccuggggaauaaugaguccauugaaccuuacaccagcaacaucuauacucgcagagucuugucaggagaauuucaggugagcaguucacaaccagccuuacagggagaucuuucaaaagccugauguugggaguaaaugcucacucauguuuaauuugcccauuuucuuaguuugggugcaaacuuugauaaagacagucaucuucaucucuaauauuauuauuuguuauuaauauuucagcacaauaggcauuuaauaaauaaucuguugaaagaaugagugaaugagggucgaguaugaaaguaaguuguugauaguuaaacaugauguuuaaccauuauguaaucauagugauauauucuauaacuucucccagaugcuuaaguuaggauacucaaaauguauaaagaaguaucauuuaaggcagugguucucagacuugguuaccaauuagaauuuauggugggugagaccagugguuuuuucuuuguuuuuaagguucccagguaauucuuauguguagcuaggguugagaaccucaauuuaaaagacuauuugugaauuuccagauaucuugaaguaaaguucuguaaaguucgagaaggauacguuuccaauuuuuuuaaccuaaguauuuauagauuuacccaucuuaggcgcuauucuuuucacuuuugcaaacgccauauguuucuuuuuuaaugaaaauauuuuuucagcuuuauuaagguauaauugacaauaaaaauuguguauaaaaccaagguauacaguguaaugauuagauauguguauauauuauauaacgauuaccacaccacaauguuuuuguugucgauacuguuuuugagaaaaugucucacuuugucacccaggcuggagugcaguggcaugaucuuggcucacugcagccucugccuccuggguucaagcaauucucaugccucagccuccugaguagcugggauuacaggcaugcugcgccaccaugccuggcuaauuauauuguuucuugaauaacagaugucaagaucuuaaaggaauauagcuuucgugugguggcauugaugucucgucuuuauaaaagauagaauuuaccaagcaaucuagcauuaaauaacucuuaagugauuuuaguuuaagcuucaaagcuguagucuuuucuaagcagucacuguuauuuauuucuucauacauuuucugcuuuuccauucagauuguaaauccucacuuauugaaagaucuuaccgagcggggccuauggcaugaagagaugaaaaaccagauuauugcaugcaauggcucuauucagguauagaaugaaaaugaagugugcucugcaggggcugaguuggacauugugguaccuccucacucaugcuagacaauggagagaaugacuucauuguguucaucuagguuuugcuuguguagcucuguucaccucugcauuguugugcuaggauuguacacaucuuuacauaacccuuaccaucuuguuuuuaugcaauaauauaaaaaaguaguucucaauuuuucugcaucuuagaaucaacuggggagcuuuuaaaauccugaagcuuagguugcauuccuuaccaauuaaaugucuaggaacaggaaccagacaucaauuuuuuuuuuuuuuuuuuuuuuuugagacgaagucucugucgcccaggcuggagugcagugguggaaucauggcucacugcaaccucugccuccuagguucaagcgauucuccugccucagccucccaaguagcugggauuacaggugccugccaccacgcccggcuguuuuuuguauuuuuaguagagacaggguuucaccauauuggccaggcuccugaccucaggugauccgccugccuuggccucccagggugcuaggauuacaugcaugagccaccgugccuggccucagacaucaauaauuuuuaaagauucuuuuggugauuccaaaguauaucaaaauuugggggaucauagauagaaagacugaaauuaagagagucaagcuuaauuaaaaaucaugguugacgacugauaguccaaaagacagagucacaaaucguguaaauauuugcaacuaagagucaagaggcauuuauuugcagauagaggugucuggcuaaauguuggucugcuuagcaacacagaugaagaguccuauaacaguuccauauuuaaugacagaaacuguagcauuagccagucuguguguuuuaaugaaaguuaacccuaggccuaagaaaaccugauuuuggauuccaaagggaguuugaaauccuagcuuauuuaaaggguuuuaucucauugcuucccuuggucccugugaauuacagcccuuauuuuuuguguuuucugcaaaacucaagggucauuuauugcugcuuagcucugacuuuuccuuucuuuaagugccucuagaagaaugaauguuugggucauaaaucaauuaaaaaauuaaaaaauugguuuaugaccaacaaaaaagggaugcugaaauuacuaucaccagauugauauuugguugguuagauggggguuuuguucaacuuucuaaauagucuugguaaacuugauaaggaucauaucauaugauacugaaugguaaggucagaucuggcaggaaguaaaaugaagaucaaagcuugugucacuauucuauuaaucauacacugcuuucuuuaacuggaguaaaguaaacauuggguuuuccuucuuuagagcauaccagaaauuccugaugaccugaagcaacuuuauaaaacugugugggaaaucucucagaaaacuguucucaagauggcagcugagagaggugcuuucauugaucaaagccaaucuuugaacauccacauugcugagccuaacuauggcaaacucacuaguaugcacuucuacggcuggaagcagguugguagagaauaucaaggaguacuuaauugccagcuugagauauuuuggcauuggaaugauuuuauguuuuagccaccuauuaaauauuaucaccuagaaguucuuuaaguucaaauccagaacguuaaaaccaacccaugguuuuuguaccagaacagggucuugccuuggauuuucuuguuucuguuagguuuauuuccuucuuagguuugaaaccuuguaguuaccugugaugcuuuccuuccuuuacuguccguacaauuaccaaguuguguugauuguuccuuuguauuauuucuuaaauaucuuccuuccuuuucugcugcuguuauucuaaacugaccuuauugcuucuaggaucucugcucccagccauuuugugugcauuaccaccauuccucagauaaaacuuugcacacgucaacccgcuauucaaaaacauccauuguuuucucacuuuauaaagugaaagccagcuuacuuagcuagucguugccagcuguaaagucuggugauuuuggauuauguucuuauucccugauaauguauuggguauuuaaguagaauuauaaauuuguuuuuuaauuuaacauuuauugaacaucuaguaugugccaggacugaggauacugaauagaagaugaugaucuuuaucuuugaagucuuauagucuguuguuacacagagacacagucuagcucucuaaacaguuauaaccuaaggcagacauauugucuugggcaaaccuggaagucauaugcauaaaaacaaagacaaaagaauaaaaauguuugaccuuuccaaagagauaagccuguuuuaggagugaaaagaacaggauauuucugucugacucacaaagcauuuuugagaguacuccuagaggagauagaauuccaaguuuaaaaaaaguuugaucugguucaugggaauguauuuuauuuuauguauguauguauguauuuugagacagagacucacucuguugccccggcuggaguacagcggcaugaucuuggcucacugcaaccucuguccuggguucaagugauucucaugucuuagccuccugaguagcuaggaucacaggugugugccaacacaccuggcuaauuuuuguauuuuuauuagagaugggguuuugccauguuggccaggcuggucucaaacuccuggccucaagcaauucaccugccucggccucccaaagugcucgaauuacaggugugagccacugugccuggccaggaauguauuuuauuuuauuuuaauauuauuguuuuauuuuauuuuauacuuuuuuagacggagucucgcucuguugcccaggcuggagugcaaugauacagucuuggcucacugcaaccucagccuccugaguagcugaaauuuauaggcauguacuaccccucuugggggauuacaggcaugagccacagcgcccagccaggaauguauuuuuuuguuuguuuguuuguuuguuuuuucuuuuuauuuauuuauuuauuuauuuuuauugaucauucuuggguguuucucacagagggggauuuggcagggucauaggacaauaguagagggagggucagcagauaaacaagugaacaaaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguaaggucacugaucaacaggcucacaaggcagaagaauuuuucuuaguacagaacaaaaugaaaagucucccgugucuacuucuuucuacacagacacggcaaccauccgauuucucaaucuuuuccccaccuuucccgcccuucuauuccacaaagccgccauugucaucuuggcccguucucaaugagcuguugggcacaccucccagacggggugguggccaggcagaggugcuccucacaucccagacggggcggcggggcagaggcgccccucaccucccagacggggcggcuggccaggcggggggcugaccccccaccucccucccggacggggcggcuggccgggcggggggcucacacccccaccucccucccggacggggcggcuggccgggccgggggcugaaccccccaccucccucccggacggggcggcuggccgggcagaggggcuccucacuucccaguaggggcggccgggcagaggggccccucaccucccggacggggcggcuggccgggcugggggcugacuccccccaccucccucccggacggggcggcuggccgggcggggggcugacccccccaccucccucccggacggggcggcuggccgggcagaggggcuccucacuucccaguaggggcggccgggcagaggcgccccucaccucccggacggggcggcuggccgggcugggggcugacuccccaaccucccucccggacggggcggcuggccgggcugggggcugacuccccaaccucccucccggacggggcggcuggccgggcggggggcucacacccccaccucccucccggauggggcagcuggccgggcggggggcugacccccccaccuccuucccagauggggcggcuggccgggcagaggaccuccucacuucccaguaggggcggccgggcagaggcgccccucaccucccggacgggguggcuggccgggcgggggcugacccccccaccucccuccuggacggggcggcuggacaggaauguauuuuaaauauugguguggaaugucuaguauucucacagaguuucuccuaauaauugucuuuacuuuccuuguaggguuugaagacugggauguauuauuuaaggacaagaccagcggcuaauccaauccaguucacucuaaauaaggagaagcuaaaagauaaagaaaagguaucaaaagaggaagaagagaaggagaggaacacagcagccauggugugcucuuuggagaauagagaugaaugucugauguguggauccugaggaaagacuuggaagagaccagcaugucuucaguagccaaacuacuucuugagcauagauagguauaguggguuugcuugaggugguaaggcuuugcuggacccuguugcaggcaaaaggaguaauugauuuaaaguacuguuaaugaugauaaugauuuuuuuuuuaaacucauauauugggauuuucaccaaaauaaugcuuuugaaaaaaagaaaaaaaaaacggauauauugagaaucaaaguagaaguuuuaggaaugcaaaauaagucaucuugcauacagggagugguuaaguaagguuucaucaccccuuuagcacugcuuuucugaagacuucaguuuuguuaaggagauuuaguuuuacugcuuugacuggugggucucuagaagcaaaacugagugauaacucaugagaaguacugauaggaccuuuaucuggauaugguccuauagguuauucugaaauaaagauaaacauuucuaaguga

SEQ ID NO: 21427 - RNA, 1558 nt, Homo sapiens
uuacuuuuauugauggugagcgcaagcaggugugagugacugcaccucuuucagaggacacaggacugggcuuaaggaagggagggccagagcgcccgccuugguggauguaggauucgcuccuuauuagggcgugagugcuacauucugaaaggauuuauuuugggacaaggcacaagcacaggggaggcaggcaacaccagcccucaggcuacacucuccauuuggagcagagcuucuucggcagccccaggucucccgggaucuuccucgguguccugcggaggcucuggcuccagcgugggcuccagcgcaggcugggcuuccggcugggcuucagcgcuccggccaggcccaaggcgaggcggcuugaccggggugggcgguggcgcugcagggccuuuccggcccgaaagggcccuucggaggcucuguaccuucugcaauccggugcgccgcagccgcugggcccuggacuccaccggcuccucguccgagcucucuccaacuucggccuccagcugcucugggcccagcucggacugguccgccgggcccaagggcucuggugccuucuggaaagcgcuggcugggacuucacccuccuccugcaugugacggacacagcacugauccuggcagcuccuuacccccagcagcccgaaacucacuccuuaauuacacaagggaaaccuuuuaccuccgcagccagagucuggggggaaaggcaggcgugggaagguaaggggagggaaagcugcgugcgaacugcaaaacgcuguaaaguaggugaggccuggugaggggcgagaagaggauagugcccgcagucacggaaugcccuuucaaccaccguuauuuuagggauuggcugggacucagaccaaauucugcggacguggccugagcuagagcugggcgggcuuggauuggccaggcggggcucaggcgugagagggagggauggggcugggucuugggaagugggugcggcucugugagucuguuccacagcaacagacggcgggaggggucaggaaugugggugugguagguggauggaagcggggagcccccagcugguggcccacaggccggcaaaggccucggauuggggaccguuugaggucacugaccuugaagagcagaacguggagcuucccgcgcgccaccagcagcccgugguuggccuccagccgcugcaccugggcugcgcggcgcaccgcgcgcucuugggcggcguuggcgugcgagcucacgcgcuccgccuuggccagcagcugcgccaagguguugcugguggugucguggcugcgacucagagcgcccaggccgcucuggaugcggcgcacggacccugccaggccucccugccuucgagccaggccucccugccgcucccgcagagucuccagcauggaggccagcuucuccagcagggucaccaccgucacggcgugcacgggaccccccgccggcgccucgggcacaggcccccgcuccaacgcacucucccucaugaucccugaccgcucugcuccgucugccugcaacugcu

SEQ ID NO: 21428 - RNA, 1558 nt, Homo sapiens
agcaguugcaggcagacggagcagagcggucagggaucaugagggagagugcguuggagcgggggccugugcccgaggcgccggcggggggucccgugcacgccgugacgguggugacccugcuggagaagcuggccuccaugcuggagacucugcgggagcggcagggaggccuggcucgaaggcagggaggccuggcaggguccgugcgccgcauccagagcggccugggcgcucugagucgcagccacgacaccaccagcaacaccuuggcgcagcugcuggccaaggcggagcgcgugagcucgcacgccaacgccgcccaagagcgcgcggugcgccgcgcagcccaggugcagcggcuggaggccaaccacgggcugcugguggcgcgcgggaagcuccacguucugcucuucaaggucagugaccucaaacgguccccaauccgaggccuuugccggccugugggccaccagcugggggcuccccgcuuccauccaccuaccacacccacauuccugaccccucccgccgucuguugcuguggaacagacucacagagccgcacccacuucccaagacccagccccaucccucccucucacgccugagccccgccuggccaauccaagcccgcccagcucuagcucaggccacguccgcagaauuuggucugagucccagccaaucccuaaaauaacggugguugaaagggcauuccgugacugcgggcacuauccucuucucgccccucaccaggccucaccuacuuuacagcguuuugcaguucgcacgcagcuuucccuccccuuaccuucccacgccugccuuuccccccagacucuggcugcggagguaaaagguuucccuuguguaauuaaggagugaguuucgggcugcuggggguaaggagcugccaggaucagugcuguguccgucacaugcaggaggagggugaagucccagccagcgcuuuccagaaggcaccagagcccuugggcccggcggaccaguccgagcugggcccagagcagcuggaggccgaaguuggagagagcucggacgaggagccgguggaguccagggcccagcggcugcggcgcaccggauugcagaagguacagagccuccgaagggcccuuucgggccggaaaggcccugcagcgccaccgcccaccccggucaagccgccucgccuugggccuggccggagcgcugaagcccagccggaagcccagccugcgcuggagcccacgcuggagccagagccuccgcaggacaccgaggaagaucccgggagaccuggggcugccgaagaagcucugcuccaaauggagaguguagccugagggcugguguugccugccuccccugugcuugugccuugucccaaaauaaauccuuucagaauguagcacucacgcccuaauaaggagcgaauccuacauccaccaaggcgggcgcucuggcccucccuuccuuaagcccaguccuguguccucugaaagaggugcagucacucacaccugcuugcgcucaccaucaauaaaaguaa

SEQ ID NO: 21429 - RNA, 120455 nt, Homo sapiens
ugccagagguuuggaaaugugcuuuuauuuucaaacucagguaugugacacucuacaguucaaugcuagcacaccugugugaggcuuaacaacaugaggaacugauagccagugauacacaaauccagcacuuccucuccauuuacucugucaggcuguauauggggagcaacacauauggcuuuguggcagccagaaagugaaggucuuuuuaggaggugacaucaacaaugacacaaacacaucacucugcaacugaaggcagggaaccagacuccuagggcuaagcagagaugucagacuucagaggcauuugggggacucuucagauccacauccucacugaaaauccagggccuguuucucuccaguucacuaccgcuugggcagcagcucccacugcuucaggcuggucuuugcuuuccagaaaagauggacucaugagcacuuuuucagccccuguauauauggcuauucuuaugcucccuuuuggagauguccuuuuccucgaccucccuugcuuacaaauggaauagggugggagagggccugugccuggaaguacucuugcaggcuuuucuguggggcagcuggaggugcaggagcucuccauaacugccuuccuggccuuugacucauccagaaacaaagguaggaaacuugugaccaagugaacaauggggccagcugagccuggcccugcuuuaagggaggcagagauugaacauuccccaccuggaguucugcuuccacggccacucucuagaacucuauuugcauccugucuuuggcucugagggccucauguagcuaaagcuccuucaguuguauccagacccccuggaagaggccgggcaaaucauccacuucugcccccagagucccucugcccugcucuguaacucuuuaccuuaauggcacauccuugaucaacccuggcuugggccucagucauuuucuagcuacuguaaaggaugcccccuucaauaaacaugcuauuuuaaaguggggcaugcuugggguggggggucucucugaaggagugacugcauugagcccaguccuugagcuuggcaaugguguugcuagucuggucucauuccugcucucucacagaguagacugaaaaacagaauaagcugagguuaagaaagauguugcuuuuugcauugugauggugcugguacugagaagcaugcagcaugucagcuguccccaggcugcucuccaccaccuuaaauguuugcuuguucuuuugagcaacauuuaaugacacccucccaagcgucagccaccaugcuaggcacuuacccaagagauggguaagacaugguucuugucuuugaggaaaaaugcuaggggagauggauacauaaauaggccaugguauacuauagguaaaggucaauaauaauaauguuuaaaacgugccagaaagcacagaggagugugugaccuauuauguugugucuggugaggaguauggaaggaaggucaucaaagcugguauggaggggauaauuuuugcacucggucgagaagagugaccugaagaaaagagaagaacagcuggaaaaaaaacuagugaguggagguccagcacuaugagagaaacuguuuaguuggggagccagagauggaguagcugaugggccacuugggggaaugagacugaaaugugaggcuuccagcuaggagaccaucagaagagucaaggagagcacagcucuggagccagccuacccugggguugagcuccagccccaugauuuacuaccgggguguccuugucaaguuacuuguucuuuuugugcuucaguuuccuuauuugaaaaugggaaggguaauauccacuucguauuuuuuuuucuuuuucuucaggacuuaaaugaauucauaccuauguaauacugagaacagugcuuggcucauaguaagucguauaugaguuuuagcaaugaaagcaaacaauaucaauaacaaaacaaaaaugcaaaacaaugacaacaaaacccacauggaaaucaaaccucuacaaaacugaugaaggcaguggcuguaaaaguggggagagaagucaaaauggagaggggaugugcuccuucaguguugugcuaaauaacuggggaugcucugaaacaccccuaauuauacugggguuggaaaccccauuugaacugaagcacugaggugcaaguuuacucuugcauguggucacacacagaguaagagacugaagcagaaagcacaucuucucuccucauucaccugugagguggguuaacuguuuucaaagagagaauagggaauagauugugcuguacagcagcucagaguuggcauuugaaauggagacuaguaagucugccauugaagccaugaguuuucuguguuuuuaaaacaucuucaauccauguggacagcucauugaacaggugccuggugacugccccacacuggugaaaaucuguggguuggcuuggcaugcaucuuauuuauccagagguacacacccagagcacacuuuugaaggguuguuggcucugugcacaggcauguuguguguguguacacaacaguauguguguauguguggacagaugcguauauaauaauucauaucuucccauuucaagcacugagcuaaauucagccuauacuuuuuuuuuuuuuucugagaagccuuuccuacuucuguaaaaagaaacucucauuccaaaggaaagaaugggaggcugaaguuauugaaaaugagaugggaaaugggaagauagucacuuugcaacuccaaauuccaggucugaugcuuaggguguuagucauuaagcaaauucuuccugauaaccaauuacagagaggaaaaaagagaguaaguuuuuuacugcccccuaccuccuccucccccgugccccgcuccuuacccccaaccaccagugaagguguuuuaguucuccccagccaccugagcuaggggcaggagaccuucccuuccaauagaguuccuuggugaaggugacuucuucauccacuggaugcuuucccagggcaguuuuguugauccuccaagaacaucaagucacuguguaugaauagcucccacagaagugccgaguguuaaaagaacccuuccucaugaccugaugggaugggcggcaguguguccacacuugggccugacguuauacuuggggaaagggugguagucugagugucucagagcagggcacuggcuaggugugagguuuccuacugcucuguaggcugcucaugcuggaguccugagcuccaccaggagucccucugggcugccgagcaaguggaucuuccaaggggcccaucagccugcucugcacaagaguuauaggaauuguagagccccagcacaacagucaagaccagcaucacugcagccaucauccagaucacuugccagugcugacacaguuugggauacaugacuuguaagaaauggaccaauucuucaaguuugcugucaaugaaaaaaaauaugcagaggcuuuaguauacugggcacacauaugauacacagacccacaguucucucugcggauagcuuccaugcugucuugagcaauaguucucaaacuuagcugugccuagauuggguuggcagcaauuguucaaaauaccccaagcauacuaaaugagaauauccaaaguuaugguccaggaaucauuggcuaaauuuucccaggugauuuugauuccaccaguccacagccuugaaguugagagcuacuuaucuagaucauucuacuuaauuguuugaucauccauccauacaugcccucaucuauucacggggugauuacugauaucugcacucucccaagcccggggguacaggauugguuggccaugcaucuuuuuagcaccuagcugcauuaaugaucaguuccaagcucuaaccugugccuugccucagaugcguaauucauuguucucaguuccacaucuaacuguguccagaguagaaggacugugcuaaacucuaagcagcuugauauccagugauaaaugacaagggacuagaucaaccucaagaguucacuucaaaccauccaagagcaggcagaagauuagaagccucuagcaaugucugggugguuuguucaugauguuaucucaaccucauuaauauuuauucucuaauuucucccucuuccuccucuucuuccuucacucucuccacacuucuuucucuaucccuuucaucucucucuuccucuccauuuuugccccuuuucccucuugauuccuucccaacugucuuucauuuuguccucucucucucucuguggugugguaaaaagacaccgggcagauggccugcuuugacaaguucauucuagagcucucugaagaagcccugagccccuucauuaagccaggauuuccugauguuuuuaaccucuaacccaauuuaaaaaauaauaugaaaaaugagaauacugaggauuccugaaccaaggagguggggaaagugauagaagugcuuucugaagauccugaggcucauacacacacagcaaugaccaagccauuggcugagaagcggagagcucaaauuuugagguagcagaaaaugcaugacuaacaaaggauugacagacucaauaaaugcccuccuuagaaagggaccagaugcucagaaugccugccuuggaugcuagggccacagagaacauugacagguuuccguuccaugcgggaaccccaucagaucauuucagucacaauuaaggaaagcacgaaagugaacacauucgcugauuugaaaaucauugacuauuuucacaacuguugggaaggcaggguuuagaaguagaagguuauuuucucucagcccuuuguagauucucuagauucuauuuagacagaguuggaugcuaaaauggagccuuuggggcuguauuuccauccuccaaaacaaggugccagaguggcuucucccuacucuaaccccacucuuaaguguggcucuggaggaagagaccaagaucugucugugugaccuuagcuggucacccaugccuggccuauaaaagaguuuagaaauagauuagaaauagaauuucuuuagaagucaauuuuugguuauaauaaguaaacuucuguuuccugagaguuauuggaaaaguaaaggaaccuaaauguccucuuaaccccauagaacugguuugaacagccguuaggagaaaagacaaaaguuuuaucuugucccuuaugagucucacuuguucaaugucagaagacugugcuuucuguuuuaauaugguuaaaauauugggguuuacccaaaguuuauuuaaacugauccucaagagagcaauauuuguaacauaauuguuauauauaacagauacgugacucagacaaaaauacuuuaaugugugauguugaaucucuuaagcgaucagcagcugggcugaacccaguguuuuaaaaaugcaauaaguaggacauggaacucuuaauaaccucaaaccuugcuuguuagugaggcaccaacauuucagggaagaaaucauguuugagagcaggugcaugauaaauguuacaggcaccauugccacucacugaugaccaggagcuggacagaaaggaaccaagcuaagccuuacuuccccugggguuucaugaaaugggagggagcugacaauugccugagauugaauuagcuagauaagacauugagccccuugcuuugcaaaccagacuguuuauauuccauguacucucucucuguuuauuucucuuuuguucuuucucaguguuuggaaguguuagaaguuccagucugucucugcuguauucacgggugccagaggaaaggcuuuuugucuagggcuuugcuugacugcauuaaaggggaggaaggcaaugugguggacugagaaauaucagcagagaacccucaggagggagaugaggccuaaggagaacaggaucugguugcuuggaguagggauugcacuuuaauuguuaaacuuggagguucuuucacuggggagacagugugugauuuguuuucaguggagaagcauuucuccaguucuccuaacggcucuuccccugaacaauggggucgaccagcaugggcugagaccucugacuuuaguugaauucuccaccaacugggcucuauugauagcuccugugugccuauccauuuugcuucuaaucuucacuucauuaccuauuuguugcaugcaugugguuuccagaguuuuccagcaaugaggcacagauacauacccagauuagauaauauuucagcagcugauuagauauuuugucuggagcugcccuggaccccaagauaucccaggggucuaaaaauagauuuuggugaagguuuuccaagguggcuauuacuacauuuuaaaaaaucaaaauucaagacuugugguuuaacuauacuaauagagacaacauagcugaauauaugaaauugggcuguccugaaaauccagaauguuggcaugguuauuauaucugugggguagaguaacaccucaucuaugggugcuaguuuauccuaucccuaagcgugaacuucuaggggauaauucaggccagguggggcugagaccucauuccuauaauacuucauugcauggagugcccuggaacuaaauuaggucauuucuacgauucugcauccuaaaggccaggcaggaaccacaagugggacaagauacaggucuauauucucuuuaucuacauguuauauucuccuuccccaacuuaggggaaaguaccuuugaaauaggaaguauuuuaaaagaaaaccccaaguauuuccaaccuaaagugaagaccaagcuugauuggucagcaugguaggcaccugcuggagacucaccuuugccacugagcugaguuugcccucuauuccguguguccucccugucccuguucuuguaagaaacucacuccagggcuucgagucaacucucuuugucuugggccucuucauggggauggcuacccauaauuucaucugggaaaugagcuaaccauggcugggcugggagggacuccauucagggcccuucgcccuuccuuagcuccuggagcucuugauugccauccucccuucccaugacugccccugaccucucaagcucuugcaaacuucucauugcuagcuaucuuggcucuuugggauuuccucuaccuccuucccaacaugugugcccucuugguuucuugggcuacucacuggggccccagauucacugcugcccuggacuggcauuuccagggauuuugugcauuuaaauuagaugaauuguaacccccauuucagcaacggcaaggacuccaaacacaggcuucccaccugcuucuugggcccuuuuccucuuccucaguuucuucuaccucuucagguuccucaggacucucacucuucuguucuuccuccuccuccuucaggucuugaaguucuuuggucuucuuuagaccuucuuggaaucuggggggcaaaaaggaacaguugagucuggaaagggcagaugcagugcauccuuuccugaguuccuaggggaggggacuugagcagcaccuccaauaauuaugugcuuccuaugguuccacaaaacaggaaaaagcugggaagcuccacugaauccuaaggcagcucacgccaguaccauuuccccucacuccucagucauccuuccuguuuaugugaaagugugacaaaacugacagggaaaaaauguggugcagggucuccugacuggguucuuaacccacaaaacauuccguagggcuaagauuguauuuguucuccaugugaccguggagcuucagccucucaucuguaaaagagagagggugacacucauuucacagggcguuggaaugauuuuugcaagugccaggcacauggcuugaucuagagagguacucaguaaauguuuacgaaaccaaugaaggaguucaugcccauaaauuccaaggauagagcacaguggugggugagaaaggcacgcuuucaaagagaaacccuugugguuuuucucccccagggucaauauuaccccaaacauacucuguucacuuguccuaugcugagugucuaacacuagcaguuuggcugggcaaacccaccacugaagcccauggguucugugccagugggaagcuaugucuuccucaugagcuauggagacaggagacgcauagggcaccauacaugguuggaggugauucucuaccuugaggcuugguaccugcucaggacuuggucucuccagugcugacaacuggccaugggugcuauugaagcucaaauggaggaggaggcaguucgaaguugaagagacuccauuuauaggaggaaggagugaccaaagcaguucuagggagcagagcugcagcugcuccugggcacugcuggcagcaacaugacugcuuugagcacgugucaggaagccucaggcaccaccaagaggaacccauccaggaccccugauuuccagacuauucugagcgguggcauucugguggcucucugccuaaaaagagggcagucuuguuauugucuaaccacacccucugacccugcuuccuccuguccuuccuguggaacagucuugcucuuuccuauguaguuccuuccuguggcaaggagguccugcggccacugguuacuucccuaaagccucuaagaaacaagaaagacccaugggaaggcaucuucugagaacugccaggugcccuugggguggcugaggucugacucaccccuugcuguaggcuucuuccuccauccuggccuuggucuccugacuaagcuccuccaggcagcucagggucagcgcaggagcagaggcuucacaaucuggguccccauuugucuuuccacuagugagaagagggaaguacagggcaucauuucagaaaaagguggaggccuaaaaacaaaaccauguuuuuggcccgauuccugauuaggagugaggaaacucaggcuuuuucaguaacuuucagauuuuuucccaauccuucuacccugagacaagauuuuauaaagguccuaguccaugaauuuuccccagcccauuaaauaccucaccagcuccccuucuccucaugcucccaaacuggcguuuauucuuauuccaggagaugcuguaaugggugaucuacagcgcugagaugaggaaaaugggggcagaccagcacguuuaaggucauuccauuccuguugucuaucuuucaccugaagacccccacucaucuuuucaaauauccacucagcaugacuaagccacaggcacauuguaaugugcugggggcacauuagaaaauaaagaaaugguuuuuaccaacauggaacuuagcagaaggaaaagccccaaaaaaggaaagaaaaaauaugugauuaauuacaaauaauaacuuuuaugaaagaaauucuguacagugacagaaaauaacaaggagagaauguguuuagagugaauaguuagaaaaggccucucugaggugcugaaguugaagcacaggccugaaggaugagaagucagauguauuaauagcagaggagaggguugggugugguggcucaugcuuguaaucccagcacuuugggaggccaaggcgggcggaucaccugagaucaggaguucgagaccagccuggccaacauggugaaaccccaucucuacuaaaaauacaaaaauuagccaggugugguggcacacaccuguaaucccagguacucaggaggcugaggcaagagaaucgcuugagccuggaggcagagguugcagugagcugagaucgcaccacugcacuccagccuggaugacaaagcaaaacucaguaaaaaagcagaggagagaucauuccaggaagagaaugcggguuauguaaagacucugagacacaaaaggugcugaguuguuugagaacuuaaaaagaggcaguguggcaggaguuaacuuuuggacaagagacauuugcaaugccugugagguauccaaagggagaugucaaguagacaguugaauucaccaaagugagucagggaaguuuuagcuggagauauucauuuggugucaucagaacauaaauguuauuuaaagccacggggauagacaagauugcuuagggagauaauaugaagaaagacaagaggaggacccaggaccaagucaugaggaacuccacacuugucucagguggaaaagaaggcaucuucagagaaggcugagaaguagcagccagagagguaagaggaaaccuaggagcagguggagucuugggagccaggagacaagagcucaucaaggcggaagaguaaacagugccacacacuucugaguuugaagcgugcagacaaggugacuauuagauuugauaauacagaggucaacaggagccucuguguaauguugggagccaagcacagguuuaaaguaaagaaggggagguuggaaaggggaagccacagacacagcaauucgaguaggaaggagaguagagggguguguuggagggagugugcagcugaaguaggucaagggaggaugcacauuugaauguagguagaaaugauccaguagaggaugagagaaagggaugcccgaaggaacucagucuuugcaaaaggaaauagggacagaccuuggaaaacuagagaaucucuccuuguuuguaacaaagguaagaugaugaugaaguuguugggcuggagaucuggugaaggaaagugagagggcuccuaugggaauguagcuuagguauucucuauaaaguggaaggcaaggucaucugcugagagugagagguagaggggucuaggaaggucuguggagagaggagggguguaaaagaguuauaugagaaagaaggaaaacagacauacuagaacaucuugguaagauggcugggaggugcugggagaucauugcagguaugggaucacaaguuuaaaggaaguauccagauggcuaugcuuucccuagaaauccugcagcccaccuucauguccugauucccaaugggagcaaugucgucauggaggaguccuccaacaaggcaacacugugagcagagcuuuccagccaggacucugaaagaucacagcugccacccucccugaacucucagacaggguuuaugagugagccuuguaucuucuccucauucuuggcaucaguuucccaucucuuaguuuuccucagaccuuuuaaaauuuacauuuagucaggcuggaaaccacaacccauugugaacaagaaagauaacgcucuaaaaauaccagcuguucauaacauuucuccuuuugcaaauuacauuauccacucccuuccaugugaccuuggccuaaugugcaguuuccuauuuauccaaacgacuggagcaagaggagaaaaacauagcuacagccaagggcagggaaaguaauucuuucaugaaauauauauauauauauauauauauauauauauauauaugaaaugagauauugguaucagacuuuugauuuauauacaacugucagccuuagagguuccuuaauguuaagcaugcgugaaggaggacaguguaguauaaaggaaaagaacucgccugaggcaaacuuggauucaaauaccagcuccaaaacaugcaaauuauuuaaucuuccugaacuucagauuccucaacuguacaauggggauaguaauacauaccugaugguggagguguaagaauuaaugaagaaaugucaauaaacuuucuggaauauggcacucaacaaauuauaucugcuauuauuauuguuauauaguaaauguauugguacauuuugggagcaaucugagcuaccuccaaauaugacucauaaaaaauccaggcaauuauuuauaucaucaagggagagcuuguuauauauuacugagacacuucagagucagaggaacccuaaaugugaacuaauuuaagguaugguaaauuaacauuacauuuucauaaaauggcuuuaggaacuuucucaggugcaugucuauugugugucaucacacauuaugcaccuuagaauuuugcagauaagugacuguaaacaaagcucucauuguccuugggucacugaucucuagagaggaaaacuuuucccuagcagggccaggaagcccauuucaucgacucuuuuacaugcagaucuucuguucauuucagcuccccuauagggcucucauauacauucucucacuugaucuuuccaaugauaagaagagcuaaacauuaacuuauauguaucaggcuguggucuaacaucucauuuaaggcucacaaaugacccaagaagguauuaguguucucuguuugacagaugaggaaaccaaggcucaaaaaguaggcugaggcaugagaaucgcauuucaagugauuucauaucugucaaacagagaacaguaauaccuucuugggucauuugugagccuuaaaugagauguuagaacagagccugauaaguaaguuaacuuuuagcucuucuuaucauuggaaagaucaagugagagaauguguaugaucucgggaccagcccaagaucauacaaccagugugugguagagcucaaauuuuacccugugcagucugauaugugcccauucuucugacugcacuaucugccaccuaggugggguauuaucccauuucacagauaagaaacccaagcucagguugauuaagugacuugccuaaauucacguuauuggugcugggacucucaccuuggucuucuaccugugugucaagauggacuuuccagcccuccaugaacccccgcuuuucuuucaauagaagccuuccaugaacccccaccuuucuuucaauagaagcccuccaugaacccccaccuuucuuucaauagaagcccuccaugaaucccccugccuuucuuucaacagaagucucuuccuuucacucugcugagugaagcccuuccugcccucaggcuggaccauggcuuccaugcugccccucuuuucaaggcugcuugucuacaguguaaguggcugggagggccuuuguuuacuguguguguguguggaggguggguaggggggaguggagggguuguggguaggguggcaagugggggaaacacaacauguaaaauguuugcuguucucuccugaccucuaaacugagcuuguaguuuccuaaauaucuucucuaacuaucuggaaguuucucucuaagcaucuuuaagacuaagcucaaaugccuucuccucugugaaaccuuugcugguguucuccccucccccacacccucugguuaaaguugaucucuccuuuuuuuuuuuuuuuccuugagacagggucccgcucugucacucaggcuggagugcaguggcaugaucugggcacacugcaaccuccaccucccagguucaagcgauucuccugccucagccucccaaguagcugagauuacaggcgugcaccaucacgccuggcuaauauuugcauuuuuaguagaaaugggguuucaccauguuggccaggcuggucucgaacuccuggccucaagugauccaccugccucggccucccaaagugcugggguuacaggcaugagccaccgcaccuggcccucucucucccuuuaugcugccaccgcaccucugugacagcaugacucacagggaggcauugauguauguuuuagauaccugcauaugacugucaucacaggaagaaggacuguguuugggucagaauagugccuggcauacaguaggugccuuuaagugccugucaaguugcaucgguuucacuaugacuuauccagucccuacuaggaauguuguaaaaggcacaaguccucucuguaaaugguuauuuccugagaacccaguguuuggguuggacuaaacgaaucuguaaucauggcuauaaacuggagcugagcacagccugugcccacccuagggauuucuggcccgaaggcucauggaucuuggcaucuguccccugccugaaauccuaugugcuuucuuucugggaugauucaugaaaaugaggcucauuauucucacacgugcaccaggucaaaaauguuugucauugugcucagcucucaguaaugugaagaacuauuuagucaaaauauauuuuuggacaggcagguauauuagauucaacuuuucccacaugguaaacaauauuugaaaguggcuacuauccuuugugaucggcauaucuucuugggcucagcaauauuuccaagucacccccacugccaugguucccucugacaagcccagcccagggaacccaagcuuccuuacuccguguuacucaguucuagauaccugggguccgccacaaguuuauugggguggguggcgggagggaggaauucacuccaagauaccaucagcaaaggggaguugcuuacuguacaaauuuaguguccugugaaaucuuuaaggaauuuacccugggugcuucaagaguauagaaacaugguuauuuuuagagauucagaguuaaaauugcucugugauacauuaacauaauaaccccuuuuugacacuaacccugugcaucaucuacauccugguuuugcugaucgcucugugaacgguuccacacacacccugucucucaccccgacucuguucuccacuccaugcccaaccggucaccaugcucuuucaaaaauagcucuuaaauucauccucuucucuauggucacacugaacuucguuuuguucuuccaguugggcggucuauuaaaaggguaagggcaugugcucugcuaucuaccagcuguguaaccucaggcaagugacgauuucucugagcuucaguuuccucaucuauaaaacagagauauuaauaguacaccuaccucauggaauuacugugaggauuaacugagauuauuaauacaaagcaauuagcaaagcacuuggcauacagcgaggugcagcaaauaguuaacaguaauuaccauugucaucagugcaguaguuaacaguaauuaccauugucaucagugcaguaaauaguuaacaguaauuaccauugucaucagugcuguaaauagucaacaguaauuaccauugucaucguuaucauuaucaucauuccuugaauacuccauacuuugucacauggacaaagccuggaauguuguuaaccuccuguucaccuaguugauuauguacccuuuagauuuuuacuuuaaaaguaaguuccuagagggaaacuuuuuuuuuuuuguuuuuugagacagggucugguucugucgcucaggcuccaggcugcagugcaguggugcaaucucagcucacugaaacuucucccggcuggggucaagccauccucccaccucagccuccugaguagcugggacuacagguggacgccaccacgccuggcuaauuuuuauauuuuuuguagagauggggcuuucguuauauugcccaggcuggucuucaacucuugagcucaagucauccacuugccuuggccucccaaagugcugggguuacaggcgugagccacugcccagccaaggggaaucauuuucuaagcucucucuuccccccacuuccccaguucccccaaccuuacaccaaaaucagguuaggugcucauuuucugugcaucauucccuuagcaaccuacacuuccuuacgaucccacccaucauguuguauuauaauaggcugcuucccaucugucuuucccgcuagacugcaagcuccuugaguacauucuaugugccuggcccuuggugauuaauugcugaaggaaugaaagaacaaaagacuacaauuacauagccauuucuacuuguggaacugcucuugagcuuuguuuucucuucaucuucaggacuaacuuuaaauaucacucuccacccauauguuuaagucuacagguuucuaggcccuuggugagugaagagcaguucauuacgaaaugaccuccaagaacaaggcucagcauucucugaaaucucaugaagcaguguaaccagcucucaaguaucuuccugugaacuagccacaggguauuugaucuuauccuuugcuuagccagugcccuuccugcuuugucacuguaugcuuaggaaaggugaaaucauuuuaacacaaagcugaauacaacagucuccaaagcaauguauauuaaacuauaacacauuauuucucuuucacgauauggauagggcaguuagaauugacuguauuuguguauaggacagaagauacgaauucacuuuuacucauauauugucucauuguuagucuguugggaaucaaguaaauuuuccacuuuauauuuauuuauuuauuuauuuguauuuuuaguagagacaggguuucaccaucuuggccaggcggucuugaacuccugaccucaugaaccacccgccucagccucccaaacugcugggaucacaggugugagccaccgugccuggccauguuuccaguuuuaaauggaaaucacuuaacaucuuugagaaauccagaaggggaagcuguuguucauccugaaccccucuuccucuaaagaugcccucaccucuuugcaaccauucuuacauggguauauucccaacuggcgagucagccccagugugcuugacuugccuuaauccccacucuguccauaucucuccagguucuauaaagcacuggaaaggugaugccacuauugaucgucacccauugacacuccuaauuuggggcugcugcuuauugucuccaauuuuguaccucaguuucccuuaccaaggauaauucauguuuucaugauccccacugccuuggacagaagugcucaacuggccuggcauaaguucuacagaguucaggcccucucugucaugauuaagagucuguugaagagaucuucugccuugaguggcucugcaggccuagaguugggaaaggggcuagaguugaggguucucugaaguagggaucugugcacccaaagggaagguuggcagggagaauuuuaguggguuucucagucagagcaugaggugaccauuucuggagagauucagagacccuggaugagguacuaugacucuagggacuugguaaguuucuguaaacucgguuacuuccaugugguggugguuguguugccucuugacaauuucccuguagugaucaagaaaagacagagagagagaccccaagagacccucuauaacacgaaggaccugugagcuuaugggggugagguggcaaagagacgaaaugcugggcaaacuucaagacuaacaaaucacugggugauaagcugguggcuauacagaaugacagauguaggaggcaggcugagucuggagaugggagcuugucuguacugaaaagggucccaacauacagguucccugccagauagcaaaacuuuucuaacagcaaagaaaaacaaaggacuaaagcugucuugaggcaaggaagaaggaagaauaagguauauguuuuaccaagugagaaaagacacaaggggaaaauucugagaggcagcaggugugauccagauguuuuucagcaagcaaaugaaagaauuugaaaaguaagcuauaaaauccucugagugcauagaaacagccugccuuacucuggcugaggaugaaaagaucugcaaauugcauagaugccuagaaaaucacagaaacugcuggcugcuaauccaauaugcauuuuccuuccuacuuccuaacagcaacaugauucuguucaggaauuuacucuucuucauggagucauuuugcuuuaugggaagcugacccucucaccaaccccagggaauaguuuaaucccauaaugacaaucccuuucccaaagugauucuuuuagaaagggacuuccuuccagauuugucaaugagauaauagagaagacuggugaaaggcuucuggguuuauuccuaagaaaggaacauggcaagaaacagucccuuucuuccucuagguauuguccugucuggaggggaucccaggaacuaccagccauuugccacaauccugaugaugaaguuaacauacaauguggccagaggcaaggaaguuguagacucgcugagcuagagcccugcugugccauaccaggagcagcucuaccucuggacuuaauuaagucccauugaguuggggcuuuauuuugucuguagcccaaggaaucccaauuggcagagaaggcuccagccuucucugggcucucuaagauuggguacacuuggccucacucagggcaucuuccugguucaagaauuuugcaaacagguucugaaaucuuuguggguuucagacucccauucauuucccuuaaaacuuaauuugcuuuccacugcauuuuggggauaaaaaugggaggaaggaaaguaaaauggggaaaauuuccugagagaucccugaagccaagaggaaaaucgacaaacuuacuuuuccaaaagugcaggcagugcugaagugacagguaggcugccuuucccauugggugauuccgacugagugaaaaacagaagacagagaauugaggaugcgcuauggaaggaagaagccagagcugcuggauuucugaugaugcugggagcggggcugcugcuucuccucuuuccuccaugcccccacuuuccaaucuucaucugagcccaggacuuggcccuuucccucaggccuucccuguccuccuuuccucuagggcacaugcagcuuccuccuuuuccuucaccucugcuaaguuuccuuaagugaagaggaaaguuuacaucuugaggcuccauucuggagaggagccaucaguuuuucucugucccguuuagcaacugugacugaacaccagugggccuccuacaaaugcaggucucaggcuccuuacaauagauucacacaagcccaucacugucccuagagacauagcuccagguacaauucucaggagaugcaaaucacuacugaaagcucaaaccaucagaaauuucuuuacaauacguuccccaggauuuccagguuguguuguugcaauggauuugguuuaaguaaugguucucaauguuggcugcacauuagaaucaccugggggagguuuuaaaaaaguaucgauccacuccagaaucuugguguggggccugggggaauaaugguuuaaaaguacccugugugguuuuuaaucuauggcccugauugccaaccccuagucuaaaggaauauauauuuggaaaauaaauuuaugcuuuuaggcaaaguaugggaaauagaucuguuaaaauacacuaaccaguccucuccaacauucuuaaacauuuuuuucagguuguuuuauuuuaguggguaauuugggaauuuagguugauuucauagacgacugaaaugcuugaggcaggaagcagugaauaccacucauugguauuacauagagcuugaauuuccaguugcuuacacaaucagauuguuuccuuauaggguagugcuagucauaggcaggggauagagaaaccacugaagaaagaauuagagagaauuagccagaugcacaaaggccugggauacagaaaauauuuuguuauauccaaacgucuuugucuaaaagaaauggaaauguauuuuuccugauuauuaccaauacauucuuauuauagaaauauaaaaaggcaucaggaagaaaauaaaaaugaacuauuuuaccauugccuagagauaaccauuauuagcuguuucacauaucuucuaccagaaauuucuaugucuacacacagaaacacacucuuuuaaaaaguacaaaacagaauuauacuguuuauacacuagguuuuguauauucuauuuuacuugcuuuugauucauaauaaauuauggauaauucuacagaaaccccuuauaggaauauccauuugcuuaaccaaucucuuauuagugaacauggaguuguuucccacuuuucauuauuaugaacaaugcuacaaugaacugaggcaggagaacaauggguugaagaacucaggcuguggaaucagagaaccuaggguucaaagcuguucuaccaccuaucacacauuacaaacuucagcuacuuaagcccacugcagaguagaaaaaaauuguaaccaccuuggcagauugugguguaagcacaaaaagaguuaucauuugcaaagaacgcugagcugccaacaccaugcugagggcagugggacuucccagaguaguagaauacaugcagccugguguauauugaguuuuugagccuaucacucagauucuauucuggaaauuuccucuccuuguugacccugcccccauuuggucacccucccugcccuaggacugaguacgaaggaaagguuauucuacuauucugugcugggaggcagacaucgucauacuuaccaaggcugguaaggagggaauggaugaugagcugggaguuuggccaggcagauucagggcauuaaacuuaggaaccacagcaacgcugacccuccggcgaggcauauucugcaggaagagaagugaccaggcucacugucuuggagguagcaauagccauaguucagaagggcugggaaaaagccuccucauuucuaaugcuguaauggcauucacuggauauuuugguuuugcaguagcaaugauagaauugguguggagagaguggccaaaguugacccaaauuuucuguuguuggugagugaacgcucaaucuguucuauuuuagcuuaugagaucuuggagauacagaauggaaaugaccccacagucucuggguaacacccuggagacuguauucaagcugccuguagcaauaugaaggcuuaugaucacuucauguucauuuaagggauguauacauaguuaaggaaaccaugagcaagaaagguaagaugucagaggcuaaacuugagaguguggaaagccgaauagaaacucuguucagagauucucuggcauccauggaucccagaaugaaugauuguuugggugaccauggaaacuucugucauacuccuuccaggagcccugguauuccuugaacaugcauaccuuucccagcgugagggacauggaccgugccgugcgagggaccccaucuucugcagcaggagggagcagagaagagaacacagguaaguuucaggcuaggcaccagcaggaaacagaaacuaggcuaucguauccaugggccagaacuggcccucaagggauagcccaagggucuggguguuggggacacugaguuuggcacuucauccuuugagauggggcugcagagugggggcuuuuuuuggacaaaaccuuuauccuaacuccccuucucacuauaggaagccccagucuuggaccucugaucuuuaucugaccccacuaaacacgcucugcauaacacccuagauaguguaugaaaacuacucagcaacacgaagacuuauuggguuauuucaugcucguucaaggauguacagucagagaaacuaugagcaaggaagguguggugccaguaaauaaugaaaacuugcuaacagaaguaguuucaauauguuaccuaccaaaugacucagagcaaaggaagcuaccaccccaggauuuucuucuccuuacuacauacauuaagugauauaacucacguaauauguuuagcuucauaccuggauaauccuaccaccaggaaacaccugaguaugugcagagaaagguauuugcuaguucaauucaauuugauucaguuuaaccaauaucauuuagccugcauaucucucucuuucauauccauauauuuuuggugagucucuugaaaagcacauagccguauguguuuuuucaaaaaaaaauuuuuuuuucuuuugagacagucucacucugucacguaggcuggagugcaguggcacgaucuugguucacugcaaccuccggcuccuggguucaugugauucucgugccucagccucccaaguagcugggauuacagaugugugccaccacaccugguuaauuuuuuuauuuuuaguagaaacaggguuucgccauguuggccaggcuggucuccaacuccugagcuuaaaguaucuacccgccucggccgcccaaggugcuagaauuacaggcaugaaccaccacaccuggccuguuuuuuucauaaucuaaucugagauucucuauuaaccaauagauuuauacuaguuauaguucuugugauuaauauauuuguauuuauuucuaccauguaauuuuauauuuucuauuuauuuuguuuuauucauugacuuuuucuaccccuccucccaccugacacuuuuguuuggaaauuauacauucuauuuuuaaccuuuagcauguccucuuaacuuuugaacauacugacuuuaaauuuaaaauuaaacaagcucucuauucuuuucuugaauaaaucuuaaaauaauaacccucccucuuaauuauauugcuuuccaggauuuuuauuucaccuuguguuuguauucuuaaauuauucauuauguuuguugauuucuacagagagugcuuauuuagauuuacccacguuuacaaaugucuuuguugacuauucuuucuuguauccuacuuguuucuuuugagcucaauuuuuuuuaacuuuuauuuuagguucaggguacaugugcaggugcauuacauaaacuugucaugaagauuuguuguacagauuauuucgucacccagguauuaagccuaguagacagcauugauuuuuucugcuccucucccuccuccuacuuuccacccucaaguaggccuugguaccuguuguucccuuguuuauggccauauguacucaaugucuagcucccacuucuuagugagaacaugcaguauuugguuuucucuuccuguguuaguuugcuaaggauaaggaccuccagccccacgcauguuccugcaaaagaggugaucucauucuuuuuuauggcugcauaguauuccaugguguauauguaccacauuuuucuuuauccaauaugucauugaugagcauuuagguugauuccaugucuuugcuauugugaaaagugcugcaaugaacauuugugagcauguguuugaguucaauuucaaucuuccuuagguacauccucuaguuguucuuucagcgagggucuaugagagguaaacuuucucaauugucuccaaauagucuuuaccaagcccucaaucuugcaugguaucuuagccaucuguguuaucucuagauugacaguuauuuucucuuaguucuuuuaagaaauuauuccauuggcuucuucuauuauugccauugagaauugucauuccuuuguaaguaaucuucucuuugaugacuuuuaagaucuucccuuugucuuuacuguucugcaguuucucuuugguguguuuuuauuuuuccugcuuggaauucacguauuuucugaauccaaugauugaugacuuuccuuaguucuagaaaauccuuagccauucuuucuuggcauauuuucucuccuugguuuuccccuuaaggauggccuaauaaauguauuugggacuuucucauucugcauucuauaucccauaucucaaugcuucuuucauaauuuuaaucaauuuauuucucugaacuauacauuggguaacuuccucaaaccuaucuucaaguuaacuaauuuuucuucaacugugcccaauuugauuuaaauguuauaaucaaucaggauaagcuagguuauacuaguuuaauagcauaguaauaauaagcaacuccaaaguauuaguggcugauaacaaggaagaugugauuugcuuaugcuacaugcucauuuacuuccaagucugcagcaagcuugguucucuguuuccucacucuggacucagccuaauacuggccuucuacuauucuggagcaaugaugguuaucauguuaggaggaagaaacagggcaaacugcauucuaguucuuagaggccuagguucagaugugacauguccuucuacucauauuucauucaccaaagcaaaucccauggccuugccuugugacuucaaggggauggguaaaugugcccagaagaaggagaucuggaauaaugaagaauagccucaaauauaguaacuaccacaucuaaacucuugaguuuuugauuucugugacuuuauuccucauuuugaggaguucuauuuuauucuucuuugauaacuguauucuuuuacucuguuuuugauccauuauuuuaugucuccaauaauuuuuguuuaaguuagagacggucucacucugucauccagaaugaagugcaguggcaugaucacagcucacugaagccuugacuuccugggcucaagcgauccucccaccuuagccuccugauaagcuagaacuacaggugcccaccaccacaucugacuaauugcuuuuuauuuuuauuuuuuguggagauagggucucacuuuguugcccaggcuggucucacuuuguugcccaggcuggucucaaccuccuggccucaagcgauccuuucaccuuggccucccaaaguguuaggauuacagacgugagccacuguacccagcuaccuguaacaauuuuaagcuuaucuuaaaaaaauugucagaucauuuuauuuuccgagguucuuaggauauaauccuauuguuuuguguaacugaugacuuuuguucaugaugaauuguuuucuuguguauuuuauaauuuuaaguugugaagucaucuucagugaggcuuuauuagaggaauccuguguguccagaugcagggucugucucuccagaguacuuuucugcuuauuucuaacauaucuuagaagcaccaucuugcuguucuuuucaaauccucugcauauugcaucaucacugcugucacuuugugagcacguacuuucccuaugaggaaggagaaaguguuuuuuccuacuacaguccagggugaaacaaauuuccuuguuucucugcugguuggugauuauuauuuuuccuuauccaaauuccaucugaggauauaguccuuggacgcccuuaacuuucugugggaaucugugucaacucucuaccauagguguuccaggccuugucucagaccacaggcaagugcaaaagcucagcucccagauaaccaaggcugacacuugucccuaaggaagcugcagggucagcuugguuucaguucucuuuucuuuucuuguaucuggguauuucaauuuauuuucuuguggauucagcuauuuagacaaagguuugcuuuauuuuguccagcagcaauuucuaagugcuuguggucaaaagauuuucaaguuuuccagucagccaaaauagcagaaccagaaaauauucuuuacaugugaagaguucauauaaauuaguaaacuaccaagcuuacaaguggcaaaggucauaaauacagaauuuuuaaaagcagaaauacaaauguuccauaaacauuuggaaaggccaagaaauacaauuaaaacaauaagacaagacacaauuguggccuaucaaagucauggauauuuacaaaaagaaagaacaagaauugugucaauggcacggugaauugaguauuguaacccauucagugaaaacauaaauggguuauuugaaaauaauuugcuuuaagagccuuaaaaaauuuauuuccccugagcuaguauucauacuucuagaaaucuacacuaaggaaauaaucuaaaaugcagauaauugguaaauuucauauucagaaagaaacauguuauuuuuaaaaaauguauaucaccuuccuugaaaucagggauauuuuauuuacugcagucuucaaaaccccaggcauagacaaagauugcagagguuguauaaaggcuuaagacacaaacacuauuagggaacagucauagaguaucuuauggaaacaccugcugagugguuacggccacucugccuagcccaagcugagguauagcuuggaagaacaacuggaguggaaacaaauaucagaaaaacacguacagcuaucguugaccuuuccuacgguaagcguuuucucauccuccuagagugaaugugggacucugugguguauucuccucggaagucugcuuucuucugucauagcacuggcuacacugccuugacuucccaaagguugggagcuccuuugggucugugacugugugcccuuuaccucuauauuccaguauuauauagggcaaaccaaagguacucaauaaaugucuguagaaugaacgaaugagacucauggguaacugcucauccuauaaaucuuagguaaggugguuugcaggaggccuugugcagcaauaaaugcaggaguccacgcauuaggauuccuuuggcggcaacuuccucagcuuccaacacugacggaaaaugguuagaggccuaggugcaugugggucaggagccuugcugacagauccaaagcugacagucuggagcaugugugcaugcugccuuuggacucugggacaugucacugauauucuccaggaaacuugugaaaccuccuguuuauaaagguuucuccaucuguuauacuuucuguacuuucccuucugcagcucuugguaacacggauguuugcauuccacagggauuccuguugcuaaaaggucuguuuucuccugcuagccacccucaucagccagaguucaaacccugacagugcccauggagagaucugguccaaggcaccaaccucuuccugcuggacugagaaagagccuccuacugugucucucuuuaccucagcuuuugcacaccuccaauauauuguccacugaagucagaauaaucuaaaaauaaaggcugauuaccucaugugguauaaacuuaccaaugacuccccguugccuagaggcucaaauugcuagcauggccuggcguguggcccuggucaaccaagucucacuuccacacccugacacugccacuaugacaaacuguuuguuucaucuuguuuucacccccaaccuccacaccuuuguccaugcugguuucuccacuugggaugugucuuccucuauugacuggagaacuccuauuuuuacuuuaaaacaccaacaagauaccaucccucuuugaaggcuucuuugucucccuucaagcagaaucaggugggcccucccccgugcuccuauagcaauucguauagaacuucuaaacaagaguauuucuuugaaacuucugucuuacccaugagucugcuguuuuucuccguaacaucuccuucagccagacucucacuccacccuaacugcccagguuucaccccucaccuggacuguugcaagaacaucuucaugggguuuucuaucccugcuuugucccaguaauguaacugccacaccacaguuaaagggaaucuucuuaaacuacauauaugaucaagucauuuucuugauuaaaaucauuggcuggaucccuaaugcuuuccagaauaaagcccaaauuccuuagcaugugcugccuaaaaggggaucccaaagcacacggacugacagggucuagggucacucucagacccuguaaguccaagagcucuuguagcccaugggcuuuguauccauggucagccacugugauuuauugcuuugggaguuaggaagucacuuuggaaaggcucauguuuccugguuccagacugcccugccaggcccacugaagcagcugcugggaggccccugugggcagcacuagacaggagugcugcucaacuggaaauaaguccuggggcuguucugacagcucuaauccuagccaagagcucuuggaaguccaccuuguagggccaagauggggcaggagccuagguccuuaccagaggggccacagcugcggcuugaauucugauuugcaagcuuuuuaaacuccaugagcuccgcaugguccuucucauacguccucuuuagauucuccacauacugcaucaucacuuccguugcuuucgacaugcgcuuuuccugcggggaaggagcgcaugagugcaugaggccauuggaggaaaggcuccguuggcacuuauuugcucugaccuagggucugggcuaggagaaucaaaaggauacagggacaagacucugcccucugaagaguuugcugucugccaugugagcugagagguggacucagcaccugcgcuuagggagaaugagaaaagcacagccaccacacugcaggagaugacaggcagaggagaguuguuucugcuugcagagaacgggucaggggaggcuucauggagagggaaugcaguggauguaggaugugagcagcaucugggcccauagacaagggcaggagggacacagcguucaggccagggaacuccaagaggagucuagaggcagggaagcacagggcuuauauguagaugagguuuuauccucugaauaagaguccucuggagagugaagaaaggcacgacgacaaauuaugcugggacaaucgacauaauaaaccagggcuguccagaaagcccagacacugcagguccuccuaccuauguagggaucagcaagcaguugggucuauuuguaagucuggguugugaaggaccucgaaugcuagacaaaggaauuugaacuuauucugaaggaaaagggaagccauugaauaucucccuuaaaguaagagaguaauauaaucaggucauagguagagaugggacucaagggagugagacugguggcagugagggcagcagguaaaaacaggaugaagccugaccuggcccaguggagccagagaggaaggcaaagacugagacauagcagccaagacgagggagccauuuggagaagggagcagauggcgugagugacaggugggcugaggcacaaguuugggaagccugcacacaaugagaacaauuucucucugcucauaccccaguuagaucccucagaggaucuagcucaggcccugccuggccacagagggacacacccaguggcuucgcaggaacaggucccacagucaugcguggcugagaccagcuacuucccuagaguccucccguguugcugcucccagcuggagugacuuccugggcaccacugcugagucagauguccuuguccugaaggacacagggugggauggcccagcgacaggucuuucuuuuauuuaauaggaacugcucagggcugcaccaccccaggaaccuccucucauguaaccagagcagcaggacauagauucaugucauagcaacauaauaacaacauccaaaugcuuuacaaguacggcagcaacccucuauggcagauacugugaccauccucauuuuauacuugaaaagacugaagcagagaaaccucaguaaggggcccaaggucacacagcgaaugaagguuggagccaggauuagaacucgggcaaugugcuccugcuacaacauggggggccggggcggggcucuguaugcuucaggacuucaaaguggccaagagagagccagaccugggccugugccccgcuccgccacuaacgcuuuuacuuucugagacucugcaucuucaucugggagacaggauauuuauaggguugcuggguggauuuaaugagacaaagcagguuuuccuaaaguauguuuugucaaauacuagcuccaugggaguugaacagguauuuuuugagaaaaauaaaauggagagcuguggggggaauucuucaguuaaauacguuugggaacuauguagguaaagugaaccagccuucuccaccacaggaguuaccaaagccuugauuaggccaauguguuagaaauuuccaagaaagaaagauaguaugcaguaguccccaaacuugugcguccacagaaaccuuuuuccacaaagcaccuugaggguucagugaucugccaaaaauacucugaauaauacugcaaugaugugcauaggaugccuggcccagaggaagccaccucuaagugguaucuguaguugccgcugcuugggugauugcucuacuuuacguagguggaacagaguuggcaagaccgggggcuggagagacucaccuggcggacggcgccuaccaccucagcucggcuggagaggcgggcagccaggcggugcaggacagcgauguccuccagcaacuucugguagguuucccggugcucacaguggugccagagugaagcugaggacugaacaggaguaggagcaucaccugggguccucaaauaauguuauggacuaaaucagcaguccccaaccuuuucggccucagggacugguuuggaagacaauuuuuccacaaaccuggugggggcgaugguuuggggaugaaacucuuccaccucugaucauuagauucuuauaaggaggguacaaccuagauccuucgcaugcacaguuuacaauaggguucgugacccuaugggaaucgaaugcugcugcugaucugacaggcggcggagcucaggaggucaugcucucaggcagcucaccuccuacugugcagccugguuccuaacaggccaugguuugguaccgguuugcggccuggcccaggggaugcggaccacugggcuaaaugucugugccccccacaaagucaucugcugacuuuuggggggacauauccuaacuccucaaugugauagugaaguggggccugggcgaggugauuaggugaggagaguggagccccacgaauggaauuagugcucuuauaaaagggaccccagagaguucuguucucuuuccaccauguaagauauaauggaaaggugguagucugcaagccagagauggcccucaccagaacccgaccaugcuggugcccugaucuuggccuuccagccuccagaacuaugagaaauaaauguuugccauuuaagccacccagucuaaggcccuuuguuacagcaauucaaacugacuaagacacacaccaagccuagacucagcucucaugaaagcagcucugggccccauccaggcugagagaaguggccucugcagggccugggccacaguuucuucuggugcuuggagaagcccaaugugaacacgcuaucccuggcgccugaaaguaggagucacacccaggccacccugcccccuucugagaagcucccaaggcuuuggaggaccuguccacagcccugagggaaccaggccuuugggaucucugccucaguuccccccaacucucugaggaacacugucagagucuuggcucaauuuuucacuucaggagacuauacuugguaccugagagaagcaugacacccuguauggcccuuggggacagucucugcuccagggauuccucacaucaggcuccacaauuaccguaauggaagcuuugaaguuuuccaguucuuucucaguguucuccucugucagguugcguucccuuucagccugguuaauucuagauuccagaguguagcugucauuucuaaaggccaaggacaguugcacaaacacguucuguugggaacaagggugugagagaggugcugggaggaguuacugcagaggacaaggcugcagcugugcuccuugcacgagcguuuugcaacggccccuggaacagccgccaaagcaccaaagcagccaugugcaagggaaacgcucacuucacaggaaaccacaaaaaagaugguaaagcagggaccaagguccacgcuaggcccuucccagaaccggagguccaaauguauucuaccaaaaaauaagaagagaauaacacuuugcuuuuuccugaauuuuaagaaaauaacauccuguaucuggguuuagauaaacucaggccaguacagcuaauuguguaagcaucuggauuuaugcugggauuuauugcaugagggguuuuggagauuuugcaggaaaauacuguauugaaagaaacuccaugugagauuuaagcauuguugacguaaagcaaacuucaaucagcaucuagcccgaguauuccaaauccuguauugauagaagcuuuaaguagcugccaggagauuaaauaaggccagguaugauucuguucgguuaagcuuucuggaauaaauaaauguuucaugcuaaaauugcagccugcaugaacagacuuugaaaagauaauauuggucauacauggaauucccagaacaguaggaaacuacuagggagaagaaauagacagauggaccucacucaggaaggaagcaauggucuucaauuuuacagccaucaucugcccugagugguagcagauuuauacccugcaggguuaguaaccacaggggcuucugaaguucauguaacauggcccauggaaggcagucaucuccagaagaauugaagguacagaauugacccaaugaugaugaugaaggcaauauugaaaacuacuccuuauugagcaucuacuauaugccagcacugcuuuucauucuacaaauucauguaaucucacaauaacccucuggggugggaacuguuauaccuguuuauggguaaagaggccaagaccagaacggucauuaacuuguucaaggugacacggaguaacggagccaggauuuaaccucagacugucugauuugaaagccuguuuuauuuccaccaugccgagagcuguguccauauacaucugcggucagcauuuggacauuaaacaaaccgcccauggcccaucuucacaaaugucaguggguaggcuuagagcucauagcccagugauagaaauuuucugccuuacccggccuuggucaagucuaugaauaaugcucaaugcuuaauuuucuauaccuugauuauccccuuaacagcagugugacacaaugaguucugaauucagugagaacacuuggaucuaggucuugguuuugccaacuacaguaucuagaaacuuggugugguuauuuacucacucaguuuucuccuuugugcugauuccugcuccaccugcuuuucagagcugcugguuaggaucagcugaaaggauggcuaugcguguguuauagacugcaagugcaaugccugugugcaaguuauagauacuaccugugguagauacuucauacugucugucuuccucugcuuaucugguccacaucagcaguucucauugucucaccucugauaaguucucuuuguccgcuacagaaugaaaugcagauuccccucagcucacucacaaccccgcugggacaaggaggccccagugaggaaaccggaaggcuggauugcugacagcacagcuucccggcuccgcugagcuggcauucuuguagcugaaacccugaggaggccagcccccuuucccacuaaacuaaagcuuagaacuugaaaucugaccauuuuucaguaauuuugaaauaaauuugauucaauucugcagccucccagcugguuuuguguaucuaagucguacauuuaaagaauauaaacaauccuuacaggaauguaaaauuuccaacuaccuucucccuuuugcccaaauuugucaaaaucuuccaugaacggacgugggaauggggaucucaugguucaagagggcuggucaugaauguucacauuaccccacagucacucuuucucauuuuugucuaaaaaugucagagcuagagucuggaggaagaaauguuuugaauaagcccagucaagcacgggcacuaaauuucauaacacacuugagucacuuaccucaacuuccuuuucagugaguggaggggcacugugaaaaagaaaacacacaauugaacugugugcaaccuagucaauagacccaaaggugacucugaaugaccagcagaccauguguuuccagggguggaguaagcuguguuggugagaaggaaaagaugcaauguccccuugccugugcucugucaccugugagauacugacucuuacggcaccaugacuaucucugugacuuuggacaaguuauuuaaucucucuaagccccagcgugcucaucugcaaaaugggaaucauaucaccuaccuugcagagguauuauaagcacuauauguacucauguauguauguguauguguuuguaugcauaaauauauggcauccacacucagugggcucucgggaaaugugaccuugaacucauagccuugcugugagaaauaagaaaaugcaugugauaaggacuuuauaacucauacacaucuaaguugccauuauaauuguucuggggauauccacccaggucugcaaagccucacccuccucugucucugagggcugugacaaaggugcaugcgggccagagaauaaaugguaggagagagugaccaggguucuucuccacagcaagaacuucugauggcuagaaucacagaguggcaagaaagccccagccgacacagaggcauccuuuugagcagcuccucgucuguggcguucccacagccagggcucuccagcuauaggcagucccugcaucugcauguccacucgaugcugcuguggcugcugcucuugcugguaacuaaagcuggccccaucugaaguccacacaauguaaauaaugcacaggcccuuuccugugcuggggcggggaggccugggagggguccuaccagcgucacagaacuuggcaacagagcaugccaucaauaagcuucucaggaaacacagcuuccucucuugaacgggugugaagggaccccaagagcaaagguaggggucagccaucucugcagggggcugguucucaccccuagggaaugauaugagugccuuccugucaggaugagaagaccccauggccaugaagucagcggaguccagaacacgggacaaacagcugcagggauguuugacacuuacaguccuugucacaaccccacccaucaggcccuugccuuaacugucaucuacagcauacacauaugauuuaaaugauuuggcaaaacuugccaaguuuguuucugacuccuggguuuguugggauauuaugugaaaugcacauauuuucauaaauuauaaaccaaacauuuuucuauuucaaugacucacauucugcuuuuuugcuguagaacacacccaccuuauuuuuauuuuauuuauuuauuuuuggggacagggucucgcucugcugcccaggcuggagugcaguggcaggaucacugcagagguggcuuacuacagccuugaacuccuggguucaagcaauccuccugccucagccaccagaguagcugggacuaugggugcaugccacuauaccuggcuaauuuuuuauuuuuauuuuuuguagaaacagaguuucacucuguuguccaggcuggucuuaaacucuuggccucaagugauccucuugccuugagccuacaaagugcuaggauuacagguguaugagccaccacacccaguuagaacauacccaccuuaaaaaaaaagugggggucuggggggaaacucugaggacucagagaaguaugauuuaggcagagaagccacaugguaugucuggugucugaugcagauaacugugccuuacaaaugggcauagguacccgggggcagagcugugagccucuaaaaggacacagcaucuuuuuuaagugacuauuuguauaucuucucugaagaaaugucuauuuaaauccuuuccccauuuugaaaaauugguuauuuaucuuuuuauugaguguaagccuucuuuauaugcucuagaaacaaguuccuuuucagauaagugauuugcaaauauuucauucuguggguugccuuucacuuucuugacacuguuugcagcacagaaguuuuuauuuugaggaaguacuauuuauuuuuaaaaucuugucucuuguguuuuuggugccauaucuaaaaaacccaaagacaugaagauuuacuuauauuuuuucuuugaagagucuuauaguguucucucugacauuuaggucuaugauccauuaugaguuaauuuguguguuuugugugagguagggguccaacuucacucuuuuguauguggcuauccaguugucccagcaccguuuguuaaaauuacaauuuuuuuccucuguaaaucuuaccaaaacccuugcaugaguggcuuuuugucauuuguuauuugcacaucucaaauuauuacuuuaucacagaggccuuuccuugaccuccuacccaaugccccacucucaugucauucucuagaugugcccuauuuuauggucuuucuaccaacuuuacucuuucaaaucauucauuugguuacuuaaauguuauuugugcuuugggaggccgagguagaaggaucacuugaggccaggaguucaagauuaucuugggcaacauagcaagacccuaucucuacaaaaaaauauuugaaaacuuaacuagucauggguaaaugguguaucugggauugaaacccaugucuccuggcucaaagcccauucucugcugccaugagcuucuggugacccuuaugccuucaugaacugugcucaccuaagaaccccaccuggccuuugaguugaaaacacccagccuggccuuucauuauucuuuuuguuucgaaugcauuaucccuaucuagacaauuggacuuuggcccuucuggguucaagaauuaagacugguguuccucugugucccaccuagaauccaacacaggggccacucgguacagggccuucuguaacccacauccugauuuuaccuuccagggagacuccuguggacccgcaguuugcgcagcagcacaucagaaauauuaggcaugacaucuaagccacucuuugacucuucuuccucaauagcuggggagaguucagaaggaagcccugaaaaaaaagugcuuacuuauaaaaugucucuuugaaaucacaguaguacuguuggcagcuagcuucaggagcuuugacauuuauaaguaucuaguucuauguuaagggcuuuuuaauuguuaucuuacauuauucucacaaugagcuagaacuuagucaucccauuucacauguagauaagccaaggcucagcaagguuaagucacuugcucaagauuacagaacuagcaaaugacauggccagaccucaaggucuaccugcuucaaauguuauguucuucccuuugcuucccacaguauuaagcuggcaauuggaagcugguuggcucuuuggcuauaauguuugggaaaaaaaccugcuccuuggcaggcuucucaggagaccuguuguucaauuauuccuccucggauaaauuaaaauguucuauauuauguauccuacuuagaaauuaacaucugauuccauaccccauagauaagagauuuuccagaguaaaccuaagguugcuagaucuuuuacagaucucagaaacauaaaugccuccuagucaacagagacaaugaacagcuuuuuguuuuuuaaacuucuaaaacuaucuugggucugugcuuugaagacagaaugaacaaaccaaguauucucuuuuccauaaaucuuucuccuguuugaaaacagcuccugugccucucuaaagcuucucuucuccagacucuagcuccauuuuuccaacaagcucacugugcuccacuguggcccauggucucuagauaccaucccauuccugcacacauucugguuuguugcuguuacagaggcccagauguucucuaacaagaucuuagcacaggaagacuuugguaaaugucccuggcauugauguuuguuauucaugcagcauagauuuugugugccugacuacgggcuuacaguacacuuagcauuaagcaaaacucucaaccucuuuaguugacccaaaucaguuauccucauccuguauaaugguuacuuuccauuugcauguagaacuucauauuuauccauguuuuacucuuucuccuggauuuuaaccugguagcuuuccaaucugcucaaucauuuuccaggauccuaggcuaggcuagagaccaggacuauaggcauaguuguagccaccugaagaguuaagacugggaaucaugugaauagaaagaagucucaccaaaggagaccaugaagagacaagaggcuaucuaguuuggcucaagguaaaauauguuuaaauacuuugagcuugccaguaagagaaugguaggcauggauuccuugguacucaagguagccaaguaagcuggaggaucaucugucagagaugggucagucagcaauucuucuuuggauaugagauucaacuagaaguucucuuagcuaccuguuaccucucugguucuguccugguauuuauagcucucugacaagguuucugugguaaaccuugugucaccccuggcaucauucuaccuuuauguauguaucccuaccacacucaacagagagucaacugaguagcaagcuccugagauaucuauaggaugaucgaaacauaugaggucuaauaaucaagugaaaugcauaucaggguuuuugccuagaaaaguuucccaaaauggugcuugaagaguaaugccagaauugguggauucuaggaaccaaccaccuuccuccugaauucaaccaaauuaacaacaaaaaauuucagaacaaauaaaaaauacacaagaaacucuaagauacaagaaaaggcaauagucuuuaaaaauagugacuagagaaagaauaaaaauuacuaggaauaaauguagagcuuccacccaugauaacccuuucuucuucuccaaagaaucaguacugaaaggaagaugggagagaaaaaauucuuacaaagaguucaauaccacagaauagagagggaaagggauggagggggcaaguaggcaguugucagaggagauucagaaaguuucccuagaauagaagguucuccauuccaucuuaccagcauuucgaagagagaaaaaacugccugggcugccugccauuuugcuuuucuuacugaugagaagaagagaggaaaggcagaaugaucgcacagaacacagaguggauuuucuugaaugauaugaagggauuuacaaggaaggaagacuaacgguaaaguaaauaaaacacgucccucugaaggagugaauggcaggagacacauggaaagccccaaccaccauguucucccccgacuccugaaaaacaguggcuaaacuccuuggauuugccguuuuuuccuuccuuucuuagcagaggaguagccguugggaagcauugggucaagucuggaaaauaaaccuacggacagcuugucucuacaauuccaaccuaaauuggugaaacaaucugaaacccacuacuaaccaccuccaaaggaauaagauaugcccccgauuugguauaacaaacucacguuuuggacuaugaacagaguuacggaaaaagagaagaaaccaauucuacaaacagcucuaucuuaacuuccccuuuuccccaccaccuaagcaguaacaaaacaaacacaaaauauacaauccucaacuaaagcacuaaagggaaggcuaagagaucccagcuaagguaggaaggagucaacaaaaacuaaccuacaauacaauauaucuagggaaagggaaucaagguagaaauauacaaaucagaaaaaaauaaaaggaaaacagauggcauggcaacuauacaaaaauacuauagacaaaagaggaaggaagguagaaaggaaggaaaagggaaaugugcaagagacagaugucaggauggaaacauaguugcaagaaacacaucaaaaaaugcaaaaguaugcuucugugcaaaauauauaccauaaauacuuugacucuagaaaaaauaaccugaaaaaaaauuaagaaauuagaguugggaugagaagaucaugcaaagauggaagaugauugcuauuuaaggaaacaaauuaaagaccaaaauaaaaggacuaaucaagaaauugggaaauauacaaccaaccaauuuauuggaaaaaugaaggaauaaagcagauauagcuucaagcugaauuagaggagggugguagagauugaguaaucauaacgaaugcaaagaaggaaagaaagauugaaguauauggagauaaaauaauggaccuggaguugagacucugaugacccaucuaugcauuauguugucuccgaagcagugaacaaaacaaauggaacaaaggacauauucaaagauauaacagaagaaaaauguuccucacuugaggggaaaguugaacccuucagguugacagaccgcaucauguuaaaaaauauauuuaaaugcuucauacaaaaaaaaaaaaaaaaacccagacaucuacaugggaaagugaagauuaagaggugcuggaaaucagcuggucccagcuuucuccauaacuuuaaauacaggggagcaacaucuacgcaguuccaaggaaaacagucaaccaagaauuuuguaaccacacaagcuguccuucaagaaaagacaaaauuuucaaaugugauagaacucagggaacacagcaccucugaacucuuucaggaaaauuguuggaaaacaaaauccagcuaaacaagacauaaaucgaauaaauuugggaaagggaccaguggugaacaugaaaucuuuuuacauuuaagucuaaggcuaaauaacuguggaaaccaugguuacagaauauggaauguaaauguuauaaccuuaaugauguacaaagaagaauucaagauguguagagguagaaauggaaauguaggaagaaaugugaaggugggaagauauucggccauucucaucuuuuccugcaggaagucaguagguaccauuguagugacuacauguucuuaucuuccguauucuugauguucugucacuuggugccuuaauccuggagugacagccccucucaaggcuagcuaauuccuagaaacaacucuccuucaagugugucuuugaaauacaaaccagccaauccagaacccacaccuguaaacaucaccuuuaucaaauucucacgcaccaagccaauacucccccuaaaucaccccagggccaguaccugacaacuacgggccacccuauagccuagguccugccaaaauuauucaaacuagccaacccuaaacauacugaggauaccuacccugccucuaccuuuccuuuccaagaaaaccccaguaaaggcuuggggccaucucuccccucaccacuucugccuucugacccacccuagcccuuccccaaggggcucuguaugaugugccacacauccugcuauuagggaucugugaguauaaaccuauuccuucaugagaaucauuugugggucucugugucauaccauaccugauuaaaacaaaugccagguccaaaguuuagauuaaauuuaaaaccuauaaugcaaaaaaacuaccucauaauuuauagauuucaugccauccccaucaagcuaccaaugacuuucuucacagaauuggaaaaaauacuuuaaaguucauguggaaccgaaaaagagccugcauugccaagacaauccuaagccaaaagaacaaagcuggaggcaucaugcugucugacuucaaacuauacuacaaggcuacaguaaccaaaacagcaugguacugguaccaaaacagagauauagaccaauggaacagaacaaagcccucagaaauaauaccacacaucuacaaccaucugaucuuugacaaaccugacaaaaacaagaaauggggaaaggaguccuauuuaauaaauggugcugggaaaacuggcuagccauauguagaaagcugaaacuggauuccuuccuuacaccuuauacaaaaauuaauucaagaucaauuaaggacuucaauguuagaccuaaaaccuaaaaacccuagaagaaaaccuaggcaauaccauucaggacauaggcaugggcaaggacuucaugucuaaaacaccaaaagcaauggcaacaaaagccaaaauugacaaaugggaucuaauuaaagagcuucugcacagcaaaagaaacuaccaucagagugaacaggcaaccuacagaacaggagaaaauuuuugcaaucuacucaucugacaaagggcuaauauccagaaucuacaaagaacucaaacaaauuuacaggaaaaaaacaaccccaucaaaaagugggcaaaggauaugaacagacacuucucaaaagaagacauuuaugcagccaacagacacauggaaaaaugcucauuaucacuggccaucagagaaaugcaaaucaaaaccacaaugagauaccaucucaccccaguuagaauggcgaucauuaaaaagucaggaaacaacaggugcuggagaggauauggagaaauaggaacacuuuuacacuguuggugggacuaugaacugguucaaccauuguggaagacaguguggcgauuccucaaggaucuagaaguagaaauaccauuugacccagccaucccauuacuggauauauacccaaaggauuauaaaucaugcuguuauaaagacacaugcacacguauguuuauugcagcacuauucacaauagcaaagacuuggaaccaacccaaauguccaucaaugauagacuggauuaagaaaauguggcacauauacaccauggaauacuaugcacccauaaaaaaggaugaguucauguccuuuguagggacauggaugaagcuggaaaccaucauucucagcaaacuaucgcagggacaaaaaaccaaacaccgcauguucucacucauaggcgggaauugaacaaugagaacacuuggacacaggaaggggaacaucacacaccggggccuguggugggguccgggggaugggggagggauagcauuagcagauauaccuaauguaaaugacgaguuaaugggugcagcacaccaacauggcacauguauacauauguaacaaacuugcacguugugcacauguaccuuagaacuuaaaguauaauaauaaaaaaaaguauauuacuaagugaaaaaagcaagguuuggaacaccuuguauaauauacuacgauuuauguuuaaaaaauccacuuuuggcugggcgcgguggcucucgccuguaaucucagcccuuugggaggccgaggcgggcggaucacgaggucaggacaucgagaccauccuggcuaacguggugaaacccuagcucuacuaaaaauacaaaaaauuagcccggcgugguggcgagcgccuguagucccggccgaggaaggagagcggcgugaauccgggagguggagcuugcagugagcugagauggcaccacugcacuccagccugggugacagugagacuccaucucaaaaaaaaaaaaaaagaaaaauccacuuuuacauauaugucuauauuuagaaaugcuuggaauauaucuagaaguuacacuaaaacauagugacagugguugccucugcuacugggggacagagauguaaugagacuuacuuuuuccuaugucucauuuuguacuuuuugaauuuuguacuauggacaugauuauuuauaaaaauugaauuaaaacucauaccaaagcaaaaacaaaaaacaaaaaacaaaaaacaaaaaacuaccucaguaacuccaaacccuuuaugcauuucauaauacauuuuuuauacuuuuagaaaccaauuucucuucuuuggaggaagcaguuaccaaaauucagcaagucuuauaguuucacuucaaguucaauuaaauucuaauaguuuuaauuucaaacaaguauaucuaguauaaucucccucuuuuucccuuccuccuucuguauuaguggggaaggagguguuuaguguaagcuauuuuuacuuucuuccuuguauuuuucacuauugguugaauuuuuagauaugaacauaagccacuuucaacaaaaaguaauaaauuuauuuucaaauauaucucccaggacuagcucauuccaaugaaaauauuuguuucugaccaugucagggacuuggaaaaauuacuuuuggagcucugaaagaugcucugagucccaggaugguuccuaaaagucaaagcugcuaguuggggauaaacuuuuuuuuaccucuuucuucucagggaggccucuuuccugcccaagaccugaggcucugagucuagacuggggguuuuggaaggacuguccauucgauguacuucucugccucagccuacgugucccucaaaauccagguccagauagccaacuaccuucuagacguugccaccugguuaaggagaauaaaaaucauuucaagagccaccauuuacugaacaucaacuaugcaguagauacacuuugucauuucuuacaauaguacugcaaauaaaaaauagcuuaaacaccuccuuccccacaaauacagaaggagcaagggaaaaagagggagauuauacuagauauacuuuuuugaaauuaaaaguauuagaguuuaauugaacuugaagugaagugaaacuguaggaccugcugaauuuugguaauugcuuccuccaaagaagagaaauugguuucugaaaguacaaagaauguauuaugaaaugcauuuucuggagaaacugaagcucagcugaguuaaagugauuuacuaggguccagcuuaucagcaguacagccagaaugcaaaaccagguuugucuguugcauucaagcugcuuuccgugggcauuugacauguccaaacucaaauucacugucuuccuucucaagcaaacuccuccuccugucucacaauucaucacccucacaaccaugcagacaggugccuggugguauuccuggucugccucucaacuccaucuccucaucaaguccugacaagcugaucuccaauagcugucaaacuauccuguccacauuuacuaccaccucauuaccucucaccaggcuauuucccuauccuuuuaccuggugucucccugucucuagccucugcuguuucaggccagcucucacaaucuguccagaagaauuauucuaaaauauagauuugauccugaugcuuccuuaccugcaggcuucucuuuccaaaguguccuaaaugaaauucaaacucauuaauuggccuucaaagccuucaauuuccuuggucucagcccacuguucccaccuuguugcccaucucucugggacguguagcucacacuuaguucacaugacauuccuucuguuccugaaguaugccaagcacuagaagaugccuacaugcuuuugcuucugcugucccccugcuugggaugacuuucucuuccccagcucaagguggcuccuccugaaaaccuucccugacucaaccccacugagcuagcugcuucuuccucuuuguucccagguacuuuauggccuguuaaaguuuuaucacaauuuaucguagugacuuugucuauucuuauguuuccucuccuagacagugagcuuauucguucauacauuuguuuaauguuuauugaguguuuacuaugucccuggcaaugagcugggagcuaaggauacaaugcuaagcaaaacugacaugccacauccucuggagcucauuauucaggggaacagagauuaaucagagaaacauccaaacaauuucacacugagagauuuuacaaaggagaagggauccgaagguaccagcaaacccuucccaagaaaagugacaugagcagauaucuaaagauugaguugggaguucauuaggcaaagagggagagaggaagaacauuccaugcagaagacagaaugugccaugcguaagaagaggaaagaaugagcugccgaaggcaggccaaaauauugugagugagagugaguguggcccuagaauaugcuggggaagugggugggguuaacuauucagggccuuguagguucuacugaggauucaagugcucuuccuaagagcagaaugaagccucugaagaugcugaaacagauuugccuucuagagaucccugcggcugcuguguuggccauggugugagcuggguuggggguugggagugcagggagaggggaccagguugcaggcuguugaguuagccaaggggacugauaaugguagcugggacaaggccuucucccugaugguggggccugaacccuuuucacuuaaugcauccccagcacacagccuaagaacuggcccacagucagucucacauauuuggcuugaaauaaccugcaacugaucaaagaucaaaacagcauacaauauaguuccugagaagggaacugauuggguuguuggaaagacuagaugcagcacagaaaugagccucccaguccucacaaacugaaggagagccaaaauucuucagacuccagaauguucugauaaguaucuuuucccauuucucaaaggaacagccaacaaccaucauaagagacuggauuuuuccccaugaguucauaugcagggcuguauuuagugccuauaaauacaaucugagccagcucucauaaaaugcucccaaagccuuuuauccuggguaugggaggggacggggcucuuugauggggcuuucagaauauaagaaaagaaagucacaagucugcaaguauucauuaaacacggaggguugcccaccacaucucuagcacuguggagcacaguguacaagaauaucccauuugguuggcaagauagaguucuacaaccuaaaugacagaaaugaaaauguaugccagguuccugcuggaauaaagaccaguaucacaugcaaacauuacagcagcuuagugaaguagguacuguuauuaaccuccuuuaaaagaugaacaaacugaagcguggagagaauuagaaccuugaccaaggcuaugcagcugguaagugaugaagucugagcucuuaagcauccagacccuagaacugagagaaaaugagagggaguguauauuguuggacacugaccaugguuaauuuuauuuuuaaaauuuggugcuuauaggagucacauucauuugccugauaauuuuacuucuaagauccaucuuaugcccuauuaauauuggauaauaaaguuuugcuguagguaguggaugucuaaauugguauaauuuuguaagcuaaucuggcagugugcacauauacauuuaaaaguaaauacuuuuaaccaaucaauugcaagucuagaauaguagcccauggaaaaaacagauuucuauaaagaucuauguaagauaguauucauuauaacaguguuuuuaauagagaaaaaaaguggaaauauuauuacaacuggggagaaguaguauuuuuauaaugauugaaauaauagaagacuucucaaagggaaagauaggcaaacaugauuauguaaaaucuuuacaauuccucuaaaauaacacaaaacguauuaaaaagcaaaaaaaagauugaaugaaaauauauuaaaauacagccccccccaaaagaaagaaagccaauuaagggcuaauaucuauaauguaucaaguuuacauauauuaccaacaaaaaccaaacaaaucaacgaaaaaccccagaccuaaauggguacacgggcaaagauguaagaaguuaagucacccaguaagaaaacaaagugacuauuuuaacauuuuaaguuugagcuuccuagcaaauuaauugaaauaauaaugaaauuucacacuaauaauaauaaacuuaaaacaaugacaauuauugauuauucuuacuauauucugaauaauaaggagcagaagcaaacaccagcacggguaaugcguaagagaaagauguccauucagucuuugucaguagcguuauucauuguaaguaauuugggaaaugcaaauguuucuacucuuuaaccuugugauucucaagucugaacacuuaucucaagggaaugauuuaaaggaagaaaaaagaacaacuaacgguccauaauuguuuauacuagcauuguuaauccuaguucaaagaacaauagauaggucaauacaagaggaacuaugcacccauuaaaucauaacugaggagaaauugcugaguauaaaauaacaaguaaaaaaaagaagcuguaucuauucaucaaaucaacugaaaacauuauaaauaugggcaaauauugcaaagaagaaaaauuguuaguuuuucagaauugaugggguugugggugaaauuuuaaaguguuuuuuccaguguuuuaaauaugcuuuaguaaauuuaaaauuauaauuagagaaguauaugcugcauuuucaaaagaucucuuuaaagaugguuauuuaaaauauuuugcccuugggaaaaaacacuguuugaaauuuuacuucugggaaccuucuuauuaaugcugaauaaauagguagguguaaguuacuacaguucagaccaggggcuuccaccauuguuagugacauccuggacacauucacccaagaauccauagggcucuuaugcugagacuggcccccagcagcuugaagcggggcaaggauuuucaaauggugcucugugaagccugggucccuggagguaccuugggcccacagucucagaagaugaaggauccaagcccuucuauccccuucaaccagagcagccccauuugcaucuccccaacacgcuggccuccuacagaucagcuugucugaaauguugugcagcuuaaaaaaaguuuuaaaacuguucaugagauggccaaaccaugagauuuggagucaggagauccucgggccucaguuuccucaacuauaagagcaagaaucccugccccucuuagcugacugggaagauuacauaaaaucagagguaacaaaaugguuuauacuguggaaaaugcuaugggaaguuuauuaauuaagauugaauuaaaaggacuaggugacacggaugaaccuugaagauguuuuacuaauugaaaugagcucgacacaaaaggacagauacuguaugauuccauuucuaggagggaucuagaagagucaaauacauagagacagaaaguagaaggugaucaccaggggcuggggagggagggaauaaagaguuauuguuuuaaugaguauggcauuucaguuugcaaugaugaaaacguucuagaaauggauaguggugauggcuucauaauaugaauguacuuacugccacugaacuguauacuuaaaaauggcuaaaauggcaaguugaauguuauauauauuuacaauaaaaaauagucccccacccccucugaaaaagggaguacuauauagaguaaaauacaaaagaaagucaagaaaguagaagauugcagagcuggugggacuaacccacugcuuuaaggaacagguaccauaugacucagagaggagggagauagcccagcaggagggagaugccgcggggacagaggcacagaggcuagagggugaguggccacagagaagaggcucugggaagagggaagagccaggagccuggccuguuggaaacacucaucucucuccacucacccaugccucuuugcccaccucauggcacuaugguuacaguuacaaauuauuuucauguaccuaucucaaugcuccugccacaucuuuuuaaaaauguuucuuuugagacaggaucucacucuguaccccagagcgagacccuagaguacaguggcacgaucacaguucacugcagccuugaccucccaggcucaagcgauccucccaccucagccucccggguagcugggacuacaggugugugucaccaugcccagguaauuuuuguauuuuuuguagagauggggcuucgucaugcugcccagacuggucucaaaguccucagcucaagcaagccaccucccucccaaagugcugggauuacagguucaccuagcccccugccacaucucauacaauuucauucguucauucaacaaauaccuaugcaggcccuaguagugccaggcauuguuguaagcaguggacacacacacacacacacacacacacuccugcccuugggggcuucuucucuagggauaauagcugacaccuagauaacaccugucauguaccagguauuguuuuagguacuuuauagauauuagcugcuuuaaucuccauaaucaccuaagaaggcagguacuguucuuagccugguuuuacaugcccagggagguugaauagcuugcccaggucaccugagugguagcagggcuuacaguuccaacucgugguggggcucgacauacucaugcaggagaauggggccgaggaaggguguugggggcacugggagcagggcuggacuugcccagcuagaucuagaggggucagaacccuacugagaacaucggcagaggugagugcagagagggaggcagugcgggggcugaagccucauuuucagaaccauuuuccccgccaugguucuggcagaagguggacagggaaccagaggcuuggaggaaggggccugcagcuacccagcagggcagggcugggguauggacuuuguggugacagcagauuaguaagcaagagauggccgugaugccuugaaaagaggaacucuucaguuugggcagcuuccuggguguacgaggaaaaggaagugucaaaaguucaggccugaggcacccuuccaggcccacuagaugccagcauggcuuagggagggcugacagcgaggccugggggcugguuggaaggaggcagguuuggaggugcugagcgggcagaagacacaaucggauucauucauucaccagcaaauguuuccugaggaagacacaggaagucuuguguuuacacauucaccuuccuugaucuggcacagacaaaucagcacucgcugagacagcaucugccccaaccccaccuaccuuuuuccugcucagcugcuucacuaaggucuggaagcuugagccccacuaaguucugauuucucaucaggaugugcuccuuugugguaaaagaaagagauaacaauuucagaugaugacacugggcugggcuguucucuuggcucugucuaugguucugcgaccacuaucuuaggugggaaagcggggcagccugagaggugggugggcaggcauggcauggugaggccugagaagcaccaggaaauaguuccucucccaguccgugaaggugccugaaacgccacugucagcaccacuuuccaugggucagggacuacccuuggcauggucuuuuuaaacaagucugugggcuucaggguaaaugaacugcuuggccucacuguggcugagguuugcaaaggacacacaggggcagaacuaagggcucugggacaggaggguccccuggguguguauggcgcugcuccuggaaacagcuuuggcgaucucauggcuggcuggaucuuccugcccugucauuccgggcagugacugcucacuuccaggagcugcgauugccccacacacucaggucaucaauggccuuuuauggcaccucuugaguuuuuaaacucuccagaaaagugaggccugagaauugcuggcuuagggccucagcuggcagagcccggggagagaugggauguggcccaagugggcucacaccugcucuaagccaauuagcaccagaccaaggaccugaguggaggcaccuggcagagcuccuugccccugugacuuauggaucuucagucugcuguguggcagagggcacuugggaaugguuugucccccgagaagggaggaaaggaaggggccagcagagggugcucaugauccaaguggaagucauggucaaggacccuuuacccauuugguuagcaagccagaggcccacagcccaucagcuucagcacacuggagucggguaggggcugggcacucaggugccaggguagugguuagugacauggggccuccagguucccuguaacuucucugggugggcgaaaucugcaggaguguagggagugaggaggcucugauaaccagaggcccaugaaggcaaaucccuggcuaucggccccuuggcuccaacuuccgcuagagauccgggacuguggcaacuccucugggcccugugcuguuugauccgcuaguuaguugggucuuucugacuaggaggaguuuuguguguaaaauguuaacaucagcagccacgccccagcuccccugugccuccaguucagagcaucaugaagguaucugaauaggauaguggccagcauuggaaugugucccugccagcacacaaauccccucaauugugcuugagugcuaucgggcaccuucuuuucuucccugccccacauuucccucuguagaggagccaggagaagccuccugcucugagggugcugggccucacucuguggaauccaggugccuugguuuauauuccaagugggccuucuggaggagacaggacuggucagaauugcuuuguccuguuaucuggucucuaucucuggaugcccccaaucauacccugcauaggguggcaaccccacaggagaccgcugugccugguuugauggccaacagaagcugaggggacaccaugggcacuggaagaaacucaccaugggcggagcagccuucacacuugcagauggacuuaaagcuuuuguuaacaggcaucaggaaggaaggcuugggggcaucacaaaggaaaucacuauuucacccuugcuagcuaauccuaggcaugacugggcacuccaucaagggauuccuguuuaugagccacugacuccgguuggaggaggaaagcagcccaggacugaggggcccacaugucccuccacacgucugccuuccccugagauguggcuuuguguggcaacuagauuuuagacugagcucugccugguaacuggcauaaaaaagcaccuaaaacugguauuuaggaaagagaugccacauaaauaggccugacuucucagagugggaaaauuuacgcccucacaaggcccaaguccaggccagagcugcccuggccaggggcccagacucagcccugaggucuucagcccagggaguaccuggaguacacacucugcccaacuggcccccaggaacccaccucucggagcuuggucaguuucugcauccgcacgggcugcacuuguaucugaaagucuuugagaccaggggccuuggccagcuugccgccggccuugccugcaaaacgcuuuucuuccucugccaguggcagcuuggcaagcacuuucugcagccgggggccagguucuucagggccacugucccaggagagcccucgcagcagcgggggccgggacacaguggguggaagcucagcuuuggagccagccucgggccccaucggcucuccagcugggccucuccccugggaggcugggggacccacuccugccgcauccuggguuggacuucucggcagagggcugcccucccagcccguuuucaagagcugcuuccccagcucgcucuccacggggccaggcugagggcuguucagggccauuuucccacugcuguuuguaacaggagcuaggccuuuggguguggucucgggguacuggaggggaucgaaguuuuccuuuuguucuauugcaaucucuuuggacuucucaacuggaggaggacgaggagccagccugcccugagacacuuuccucuggucauucugcuuccugucagcuagcccuuuggggacguucugaaaaagacaagguagagcuggaacccucgggggcagguugaggggaaacaggugaggccacuucugcuguggagucucugcccccacacaccuugccaaggggcccauuuguauaaguguguaugggguaugaguggacgauguggaaggagagggcuucugcccgagguuugucaaacagacaggaaaauggaaccugcaauccaaaaccagccaagaauuucccaagggauaggagcugaggaaaacugaauagaaggcagcuuuggcccuaacucaguugccccagaucuagccuuggugcugcuuagcaaggcccuuaacucuuagggacccagguuugugaacccucugaaauuauguauguguaugucuguguguggagggguguuuuucuaggaaaaacauccacagcuuucaacaauuucucagaguuccaugauccaaagagguuagggaucauuggauggggugauucuugcaaaggugaugucuuccugcucagaagcucuaagauucugcaguguuaguuuacuuuguucauuccccaagggaaaccugggccgugagcagcacgugggucugggggucuguguggcugccucgugugugcugagacucuuccagaggacuguaucccagacccaguuccaggugacacuaaauucuacugcugcccuugaaacacugagcacgugggccccucgaugugagcaggguggggcgcuucuguugcucaucaacaaagaugagguuuucccggcuuccccagacagaaucccaggcaggggcuggcgcuuuccugcccuuuucacuggagcugacaggagccacagucucaccuggccuggaggucccccuugucuccaaccagcagccugacugggggucagcgcugugaguauugccuccacggaguucaccccccugaauccugccuccccaccccuccaccuuagacuucuagucacuauaaggcaggggaaucugcuguuuccccagcccugacccuccacucauacgugugcaugcacacacacuugaaggcugcccaggagccagccuaggcuucuaggagacugugccccccacacucaaaucauccaaagggagcaaagcucaaacucacaggcucgccagggugaggugaagagacgucggccucaucccccuucugcuggagaaggugaacaggagucagucagcaaugggaagagaccguguuuccucuugaaauauccccaaggaggcccccuagcagugguguucaugcccuccacccagcacccucaucuccagugggucacgaagggccuccugguguucgggguaaggggagagacccauuggcauagaaacagcacagcaggugggggguccugucaccugugguggugcuccaggcagaggggauggcgggccacugcacacauccaaaccuggaaggguccagacacuagugagugaggcccagcagcccaggcccucagcugugcuuucagccacaucucccuccccgggcuauccucccuuugcaaucucaggccuggaagauuugcugacuaccucccgugugccagguucucaggugggcccucacagaauguucacagagaccacaggaggaaacugaggcacagggaaaucaaagucucauggccaggaaaugucagcacugagauuugggcccaggcugccuggccccgaccugagcgugcccugccgcacugaugagggccgguugcccuuccuggcacccucccccuuuccuuguuggcuggagggugugacucuggguacagccuaaugaaagggaagaagucagaccccaaagaggccuuucuguauaagcucuugagggcuucucugagccucccugagccagagaggcuguccuaguccccuuucccacccagccuuccugacccugggguacaccugccucccgacacaagcccaagaugcuaacagaaagucuaucugccuccucuggguggcccagcaaaugcccccccuggagaggggucuugcucugggugugaaggggccaucagaguucuugaaggggaagccugcaggcugggaggcaugcugaucuguccaggcugagcugccacccagagcgagaggcagggcaggaaguccccgggcagcugggccucaccuggcgggguggggacuguaagugaguugcuccgagaggauguaggagaagcgcuggggcugagguucggggaaacagcugugaagacagacacaaauuggcuggcauucaugaagguuuaggacuucaaccuggcaaaggcauccuuuuagguauucccaggcccugggaacugggucugccuugcugggcucaggggcugaugcuggacugcaauaugaugcuccuguuacagcccaaccccucccugcugcugcucaagagaugggugcccucaggccauuuggggguucgaggauagagucacacuucucagccugccuggccugaccucaaggcacuguccagaaacugaggccuggcguugguuggcagguacagcuccagaggcugcuccuucucgacuucccaggguggcccugacuucaaaagcuccccuuguccuccuaaguacacuuacacacuugcccaacuuuuugcucaggaagaaaagugacucuagcauagaggaagcaggaggauuucugggcccaggaaaaccuucccucuaacccagaaauuccccaaagaccaucuccucuuccccagagggccuaggauccuucccagcacccacagagaucaagggaagggagcccaggacagaauccugaccucugcugaggagagcaggugaguccaaggcgaccuccucggaggugaggcgcccacugcagcuggugccaggcccuucccucccgacccuagaggggcucagggcagccaccuguacauccugccacccuaccugauggggagucuccggggcugcuccuggacuuccucccacggcgggucaggaaucgcucacucaccaacuuggcuucuuccagcagcgccagguuuuucuucuuguccuccucugagaugcugaugucuggcagcuggucauucaccaggucaaugaugugccccgcggggucugcagaaggaggaugagcuggggugagagccacugcauccguggccccaggcugaggucaugccauaccaugccucaucccagggacucugcccacagcugacccagccagccaaaccucagcccagugccaucaagaggguugcauggggacagacaguggcuuccucugcaggccuggccccuauggcuuauggccugugguccuccgucacaaaugguccuggagccaucucagguucccagaauuuuccuaaacucugucaggaagggaaggccacccaggagccuuaccuccggcaccaucugcgcccccagugcauucuugcuucuggccuguuucuuucacaagcuaaugcgcuuaagguuugugaauaaaagaaggagaccaaagaucauuggccacggccacaaccccguggccaccuucccuccagucacauuguucaccccauuuuucuccaaaacugccccucuggaugaggugggugaacggcaccaccucucaccuggcugcucaggaucacaggagucacuccccacuucucccucuuccucccucccccaacauccaaucaguugaucaaguccucccugcauuuaccuauaaacaucucuggagccuguuccucaucuccauucuugcucauuagcucuuuuuuuuuuuuuucuuuuuuugagacagagucucacucuguggcccaggcuggagugcaguggcacaaucucggcucacugcaaccucugccuccuggguucaagugauucuccugccucagccucgcucguacuuguuagcucuuuccuggacaauuaugucuucuaccuaagaggucccugcccucaggcgagcuccuccaucccaucccccacugccuaucagaguggcuaucagagccacaucuggccaugccauucuccaccucaucucauggggauuucucaugcuccucagugugguauccaaacccuaaacugggcucagccagucuugcuggcccccacauacuccucccaagucccuccacuucagcugugucugcagugaacagcucccauuucaccuccaucggguuccauucgucuuugggcagcagauccuugguuuucacuugguaaaaaccucucugauuccccauuagcuaaccccccuccccugugccaagagugggaauguggacuagucuuggccaaucaaugaacagaauccccuuggccacagggauuggcucggggauggccaugugaagccauugaggggcaauccugguguggaguauauggggaagaagaacucuccacugauggggcguaagcuuggaguugcugguagcuauuggcuaccauguguugaagagucugccaagaagaaagcuaacacacaagaaaaaagguucaagagauggaaugggacaauugcuaauaacccacuuugagcaccuggauccagcacuaccugaaaucacaagcccuggcuuuuguaaauuuuuuuuuggugugagguaguuugaguuggguuucuaucauuugaaaaagucccaauugguacacauggcagaguuucaguugccagcaacaugcuccagggagguuccugcucuuucaguguguuuccuauucccccuggaaugccuuuccucccucgccuaucuguccagcucucuaaggcacaacucaaaugccaccuccucuggaauaccuuccuaaaacuuccucuccucagagagacucgguccccuucuugccuuggcuggccuagcucuucugugcagucucuuaucauacagugucccaauuaucuguucauuucucagucucuucauagucuaugagcagcaugaaggcagggaccaacucuauaugagaucuauguuccaacagcccagggcagaucgugagccaccaucuggggaugagcagaugaccagggcagccggccuuacacucaggcaccuacuccaaccuggaugugggccucuuuagcagaggcuggaggacucugcccccuaaaccccagaaaugaguuucacucagcuguucuuucuuucuuugacuucugcaucuuccucuucaugcccuggucuugucuuuugagcaaugaaaacugaauuaaauaugcuucuccuagacccagacacggaggggcugaucuacccuguccuguuggacuuaucgggagggagcgccuuaaagagcaggagagaggaaggagucaagcccagccacgcugccagaccugucuuucuacucaacaugccuuagauugcccugguccuuacccacagaugucagggaggcaguggacaccuucaagugucggugagaaagccucuuguggggacugugaacucugaaagacagaacagucaucuuguucagaaaaucaauccacaacuugaaaauaggugaaaagaugccuguauauucuuuuucuuuuucuuucuuucuuucuuuguuuccuucuuuccuucuuucuuucuuuuuuuuuuuuuuugacucaguuuuacucugucacccaggcuggagugcaguggcgcaaucucagcucacugcagccucugccucccagguucaagcaauucuccugccucagccucccaaguaucugagacuacaggcaugugccaccacacccagcuaauuuuuguauuuuuaguggagaugggguuucaccaugucagccaggcuggucuugaacuccugaccucaggugaucugcccgccuuggccucccaaagugcugggauuacagguaugagccacugugcccagccagaugccuguauauucuuucaaagucauccuagaacaucaucuuacaagcuucucgaggguuucucugacucucaacuugggaacgucuuagaaaugcaaauucucaggccccaacucagaucagaaauucuggaggugggcccagccagcuaugauuuuacagcucuccaggugauucugacgcgugcuaaaguuuuccaaccacugcccuaagaggaugugacuuugacuuacuauuuccuacucauuaggucccagacucugagcuaacaucuaacuuguagaagccucauaaaauguaaaucauuguugucugacaaagacgcagaugauuucuguuugggaaaaaagacaaaaauaugguuucauugcccuguagaacauucaccuauuuuauaucuaacuuagcaguuuuauuccagcacuuuccuccccacugaugauauauguauauccauugcuuguauccuccuuugaaccggcuuuguuauccagaugcuucuuguauuaaugagguaaguaaaucuuugacauaugcucaguauauuuauaugagaauuaucuuuuuccuuuucuuuuucuuucuuucuuuuuuuuuuuuuuuuugagacggagucucgcacugucgcccaggcuggagugcaguggcgcgaucugggcucacugcaagcuccgccucccggguucacgccauucuccugccucagccucccgaguagcugggacuacaggcgcccgccaccacacccggcuaauuuuucuguauuuguaguagagacgugguuucacuguguuagccaggauggucucgaucuccugaccucaugauucacccgccuuggccucccaaagugcuaggauuacaggcaugagccacugcgcccggccgagaauuaucuuuuuaacuuuuugaaaauuagacagucucauuucagcgagcccaguucgugggcuagugcucugugaaaccaaggcggagacauuccucuaccugugagcccaugucccugccaagagaucauauuucacacguuuuggccaggggcaggauucuacauucaaacaccugcaccuuucauguuuggcugcaaauagcuggacaguuauuaugggaaacucuccugcggugauuuaugcuuuucuuaaaggcuagcccuuuccaugggggaacaaguccuucuggggccccugggcauuaaauguuuuaaccuccacuagcccugcugggggaggaggcugcaaaugggcuggagccgucgcagagccaaaaggaccacauccaggagaggaaaaaucauuuuaggaggaagauaauggaaaaauuccuauuucuaucuuguauuuugaaaaacugcuugauuauaguuuagucaauaaaaugauacaagaaaaaagaaaagauuuauuuaaaaauauagcugucugauccucauguucuaggaaauauuguuugucacaaugcaaggaucaggcaccuguaccuguuggccagguuuuugucgguuucuccuucuggugaaguggcauccccagucaggacaaucgugggaguuggacugcaagauacuccugcggcaggaggacccugccgguuuagaacaaaaacacagaguuaggcuugggcuggugggacuuccagggacaggagccagagcauuuauucucacaucaugaugcucagagccaucuugauaaggggacaaaugcaguuuacucuuuauucccccagcuuuauugagguauaguugacaaauaaacauuguauauauucaaggcacacaaugcgauguuuucauuaccuugauacaauguuuugauacaaugugacauauucacggcauacagugugauguuuugaugugaaaugauuaccacagucaggcuaacuaauauauccaccaacucacauaguuaccuuuuugugugguggacaauacuuagcaaauuccaaguauacaauacauuauuaacuacagucaccgugcuguacguuagauccccagaacguauucaccucauaaccaaaauaguaaguugaauucuuugaccaacaucuccccauuucucccacccccagucacuggcaaccaccauucuacucucuguuucugcaaguuugaccuuuuaagauucuacauauaagugagaucaugcaguauugucuuucugugccuggcuuauuucacuuagcauaguguccugcaggcucacccacauuguugcaaaaggugagauuuccuucuuuuuuuaaggaugaauaauauucuuguguguguguguguguguguguguguguguguauacagacacaauauuuuauuguguauauauuuuucacauuuuuuaauucauccauugacagacauuuagauuguuuccauaccuugucuauugugaauagugcacacauauagguuauuuggauuacucagaaaacaaaaaaggcaguuucuccuuuauuccccagcaggcccucaccugagcuuaacacgguccacuauucaugcacuaagauuagggacacuacaagcuaucccugguuaguucucacuagcaaugcaggaaaagaaugguacagaguccucagauugaggccagccuggcuggggaagaaugauggccuggggaaaagguaguggcacccacacaccccugagguuccacgacaguccuaccuuuggguaacuuugacauuucagugaucguaauuuguuagaagacucuccugggguuuucucuuagguccuuccaucaacuuaagagggugccugucauuuuccuucuccuccuucccacccccuugacuggcaugugcugccacugcucccucugugagcaccugacugccuuugccaaaggccugccuccuagcgucccagagcauguugcugccaccuccacuauuggugcugccucccgcagcuucaaagcagugggugcccacugucucuauugccacuuucccuggugggccaaauccuucuagagccccugcauaugaaauguuuucaccuccacuagccccacuggcggugggagcugccaaugggcuggagccucuggcagagccaggcuguguucuugagccuucagugugcagguguugguucccugcaagguagggaggaggccugcucuccuuuugacauuaugccuuguugugaaaugggucucauacagugcuaucuggacuucuuacgucccacaauuuuuagugaacccagcuuuucccauuuucauuuucaucucuucccuucuuuggccccaagcauaaggccacaugagcuggagaagucucugggugagaguccagcuggggagcaccaugcugcuucucuuguggaaaggaugcuuuuauguggaaacccagagccagauccuugaggagauguucauugggcucuguguucuuauccgggagcgauucagugcagaaagcuacaguggcugaaggaagaggaggcacucagaaucucccgggacauggaagggaagcuugggcagggacgugggcuguguagaagcagaaggaagcagcauugccuauuggaagggucagacaaaccugggcucaaauuucaacuacuagcuaugugucguggacaaguuauuuaaccucucuaugauccaugauuauaaagucuaacucacaagguuagugugaagauuaaaaauaacauugauaagguaccuaugcaugauugacauuuuuauuuauuuaauuuauuuaguuucuucagugcaguggcacaaucauagcucguuguagccucugccuccugggcucaagugauugcccugguucagccuccugaguaguugggacuacaggugugcaccaccacgccuggcugacuuaaaaauuuuuuuuuuagagacagggucuuacuauguuggccaggcuggucuugaacuuccagaaucaagcgaucuucccacgucugccucugaaggugcugggauuaaaggugugagccacgaugccaggccaugauugauauucuaaaugugcuaagcaucuagcauaugauuaauguuuuaaauaaauguguacauuacuuuagauuucuuucucuuucaacaaacacuuuaugguuauccaccaugugccaaaagcaacuugagauaugaagagaagacccuaaagggcucgcagucaagcaagggauacagggaaguaacucauaauaaauauaaggaaacaagggauggaccacauucugugaaagcucagaggaaggaaaagaaaacucuuuagugaggggaguuaaagaagacucuauagaggaguggacauuugagcuaggucuugaaggaugaauaggagcuugcacgacaaagauguuagaggacaggauuuggccaaagggaaucgcauuagcaaaaggcauuacugggaaucagggauuugucaguguagcuggugcaggugcauggacuaugacaugugagauaggagaggucagggcugggggaauugugaaaguacaauaagagauugagccagcuucugaaggaccucgaagcuacucuaaugaguuuggucuuuaugguuuuggagaugggaagcccugaagguuaggcuugagaauaacuuaacuacccaaagggaaauacagaaauguugacagcagaucauccaugcaucccucuauucacacugguugagaugacagaagaggcccaguuauuagaacaucuaucauccccuauaggaauucugaggagcucccugguaaauaggagcugugucuccauuuggaaaccuagagcuggccaagagggagugacaagaagucagcacgugcuuguggcugaaaccaagacuggcugaccuguccucaugaucccagagcuccagucccucugaggacacagauacccauccuucugucaaggacucccccuagaagagacacccagggaguuuucugaaaagcaacaacucauucucuggauaguaugccuugaugggcuggugauaagcuuguccuccuguggcuuuaucccuccguuccuauaauggcacaauggccaaaggccugcucucucucacaggaagauuaugcaaguaaaaagaaaugacgaauguguaugcacuuugauaagugucauauggucuacaaguacccuugagucaugauuauuauuaaaaugaaugauggcucuauucaaggugagccaguuuuucccaucuuuuguucagugggcuccccuggugggaggccagcaagcagcagaggcugggguuuccaggggaccagaagagaaguggaacaaugaucuggggccccgaggacaugcaguggaacaguauucacaagggcuggggagguuaagaaggggaagcagugugucaaauggcagguagccagauagagggggcagcaggcagggccaggggcaggugccaagcuaaaugggagagccagggaagaagaaggaauagggaguuuucuacuguguggguuuucuggugaguaggaagagcugaagucuuuccagaggaaucucuucacaucauuaaaaaggaguagcauuagcaaaaggcauuacugggaaucagggauuugucaguguuucuggcaggugugaucucuuggaugucaauuaagcaaucagcauccucugaugcauauucugagcucagaggugcaaauuagagacccaugugccuguuugcuaguaguguuuacaaguuuuuaaauuaguuaucaacauuccauaauuguaagaauucacauaaaggucuggauagccugcuuuuccuuaaacugaaagaucaaacaaucuuaggcccauauuucugcagaguaaccagguuugagcuauccuaaauuggcuuucuucagugauuugugcucccuggccccaaaugcaucugaguuacugcccugugucauguaguuuucauccuggccugguuuuccagagcacaggagguuugugcuuaaaaucucucccacccacaucaucugggcagccucaugccuaucaccaugggaacgccaauggaaacucugacugugcuuauagcaugcgcgggcuucuuucccuggauuuuauucugacugugaaaauuugagcucugaaaguugccuuuuucaugucugucauauuuagagaauuucuuucuuguaugaguccucugaugaacaagaagaaaugcauuuugucuaaaauaucauuuuuuacaugcauucuaucauaugguuuccaccaccccuugugguggggcuuuacaaauuccuggcaugcauugaugaggauaagcugugucuauuuaaaggggcaggaugggccaaacaugagcuaauuccauguuguauucugaaaaaauaauuguggugguauuaggagaguuauagcauauauccauuucuaacaguuucauauauucaggcugcuaaauaaguaaaauacauauuuuauuuuauuuuuauguauuguuuugagauggaggcucacucugucucccaggcuggagugcagugauaugaucuuggcucacugcaaccuccgccucccggucaagcaauucucaugccucagccucccgaguagcugggacuacaggcaugcaccaccaugcccagcuaauuuuuguauuuuuaguagagaugggguuucaccacauuggucaggcuggucuccaacuccuggccuaaaguaaucugccugccuuggccucccaaagugcugggauuacaggcgugagccaccaugccuggccuuuguuuauuuuuaaucuuauugacacuaucuacuucucaaagcaacuugaaguaaccaacaauaaaauauaagauauaaaaacaugagacuauauaaaugggggaaugauggaugauuugacaaacauaaauaucccuagcagacaaggagaaccucaugcuccuaacagucuaugguugggaguugugguuaaacuauuugcccugaaaccuaaugaagccgugauccacguggcgcagacucugagaaggcucgccuuacggaacuguucaacagaaagaaaaccagcauagaaggaacuucauucuuuacucucaccucucaaagaacaugaaaggggaacaaaucuucacucccauccugaccucuccucugcccuuuucucuuuccuuaacgauucucacgcccccucucugaugacucuuccccugcuugccucccugcccagauccucugucuaccuucuuucucuuuuucuccugcuccagccuuuacucccccagcuccauccaguuauuuuuugugcagauugucuucauuuguuuguaugauugacucacaaacauuuacugaagagucuuacagagcaaagaccuucuuggagaagagaggggcacugggcuggcaaugaucagauucuguuuggcguccaagaaagggauguggucugugaacacucccacauuauuggaccuuauucuguccaaucauccggcaaacauuuauugaaugccuauuguggccagggucuaugcuaaggucugggaagacaaaggugaacugagcgggccucugcaaugcuucccauucauuagcaugaaggaauggggagagaaggggaaguaaccuccacugcuauuacuaauagugcccucgguguugauaccuaccagguaaauggguacaaggcacgggagugagcugccuucugauaggagcuuucucugcuugcuggcuaaugguuaccugaagcaaagcucuccugacuguaggcaucucacuggggaggaggaccauggcagaggugcccauacaaaaaggcagaaacaagccauggguggcaagugccaagcagguaaccgcagacacucacaauuccaaguggcuuacaaagcaggaagcauaaagcgauuaggaggaaauccucuaaucccuugauggaacauccuggaagguucuucacacuugccuucuaaugugugcaaaauacacaacucauaaaaucauaguguucuuucccucaucagcugacagaaucguugagcaagcucugggcaacuucuccuuuucugcaaaacuguuuuggugggaacauucaggucuugugggggcuguuuuucacucuaucagggacuggggagacaguaauccaggagagagugugugggaagauucuaggggcccucuggggugaauucugccagauuuucaugcagugcacacacgcaucccugcucccauucugagcugucaaacacaaggcaggccuucaagaaagcuugggagagcaguaagaccaaauagcguuggccagacaaccuacuggcuuaggggcuucagggccucaggcucagaagccacacuaccuuaugguauacuuuuuagcuggauaaccuugggcaaguuaccuugccucucugugccucaguuaccuaaucuauaauggaacuaucucacaggguaguuauaagaauuaaacaaguugauauagaaauaggauuucuggauaaagcacaggaugccccaguuauauuugaauuucaaauguacaacagauaauuuuuaguaugugugucucaaauauuccauggacauaacuguauucucucucucucucucgacugaaucuugcuaugugcccaggcuggucucaaauuucugggcucaggugauccucucaccugaguagcugggacugcaggugugagccaccauguacagcauauaaucauauuuucauuuuccaaaucuggcagcccuagauggcaagccuguggaagugcaccuagcacugagcaaaugcucacuaagcauuagauguuauguucccuuauuauucccuucgggauugaauuaaugacuuuggcauuugguuuugaaaagaugguugcucuuaguucugggucuccucaaccaucuggaguuaaauugggagagcccagccacuguggucacggcgcaauggagcaucucuccuggggcaucugaccacauaagcccaagugaucaaggacccaccaccaaggccaccuucacccggcuccacucccucucacccucugccucucaaaccaaucaaugcccuuuguggguuacagacauggaagcacagaaacaaacauggcuagagggaauuggcaguuacucaggcccacuguguggugggcccugucccagaccccccucguguuuucucaccgaauccucccagaaacucaguggguaaaccugaggacaccaccuacaaauugggggugauaaugccucccaaacucauagaauugugaagaggaaacgagaagaugaaagugaaggccaugagcaugggguagaagauugauaucuuucuuuuuucucuucugcuuuucuauuuugaucuccacuuuaucaaugcaaaaacugacuuguccagggcugugccgcuuguaaauaggggaagugacugaacacaggcuguguccuucccacgacaccacgcuacucuuaaagcugcauccccaguuuuuggucucaccuccccugguuccuggugcccugcuggccucugacacucuuauucuuccaagcugcacucuccuucacagaagguaccucuuccuccaggaagcccucaaaccagcacaaggcugaacacacagcuggagaaaaggacagcaugggcagaggaugcccuuggcucacugcccuucucacuccuccaugggcccagccucccuggggguccauuucccuucccuggaaucagccaagcacugagggcugggucaucucccagcaagcucacccucuaauaagccagcaggccacauuuuguucuccuuaaauaaaucuuauagaaacauuuaaauguuuauuucacucauagauucucaggaaugcacaauaguuuuccuaaccgccugggcacagggauaaauauaggccagugucauagaugggaauauuagcuuccuuuccccagagucacauggcuaggcccaggcuaggaaacuguaaggaacacccccagccccagcuccagcccacuccagcucaggcaggcaugggggguuuagauccuguagaugggcgcuggcagacagcccaggagaggaggacccugcuggaaggcaaugugggcuagugaagaagucggguaggccuagaccagaaucccaccugggugaccuugggcaaguuacuaguuacuaaacuucucuuucauggucuaaaacauuacauagagcuaauaaucacuauucucuaggcuuguuuuaaguauuaaaugagagaaagcaauaauaaugacggugaaaguggugguggugggugcgugcugugagacuguauccccagaucccugucuuguagccuggagggcaaacagggacugccuugguagagaggagauccagcagcaaaagcagccagugcucuuacaacaggauaaaaggacucucugggccgggcacgguggcucacgccuguaaucccagcacuuugggaggccgaggcauggccucgguggaucacaaggucaggagaucgagaccaucuuggcuaacacagugaaaccccgucucuacuaaaaauacaaaagcaaaauuagccgggcaugguggcgggcaccuguagucccagcuacucgggaagcugaggcgggagaauggcgugaacccaggaggcggagcuuacagugagccugaucgugccacugcacuccuccagccugggcgacagagugagacuccgucucaaaaaaaaaaaaaaaaaaaaaaaggacucucuggggacuugaaagaaaaugauuaucccagcggcaaguccuaggggcacaggagagagcagaagugccucugcugaguucugcuggacauggggcuccucccugccaagcauagagggccaguucccuggcuccccaaaggcuccccggugucuucccuauaggcccucccuugcaccaagggccugcucugccucugguggauccucuuuccugccauuguccauuuauuucuagaagucagauauaaagaacaacugccuuguucaucacuguuuuuacucucaugccaacagacucugggaguguggaaaagcacacaauauauguuagcuuuauuccaaggagaguaacucagcuagucguucauccgucauaucuacuauccucccuuccuuccucccuuccuaacacuacuccacccuccauuucuucugccuuuuaaugcagucauuuagucaucuagccagccaauuaucuacccaaccuaucacaacacaaucaagcauccauccaccuuuccauccauccaucccucccucccucccuaagcuccgaccgcaugcuggagccuaugcuuauggguggagauacacaugugaaaggcacagucuguggcccgcaaguagcucacacauagccugauguguggagacagaaaaacaaagaacagcaaucuguuucauugcucacaauaggaacuaagggaaaacaauuuuuauaugcauuuccgacugucuguaaccgucaacauuucuaaaacacuuucugccuuguuuuaggcacuuccacgcuaaauucucacagcucuuacccugugaccagaaccacuagaggccagccugguggaacuguccucuugagcucuuuuuuauaaugauggagcaucaagcaccuguuucccaugcauggggccucugguguccuagcuagggccaggaaaggaaggaaaaccuggcaggaugacaucagugggaaacuugaguuugaaucucuauuugaccacagcacagcuaggugaucuuugacaauuacauaaacucucagagacuccauuucuucaucuaaaaaauagagauaauaauaucuaccuuggagggauuagaccacauaccaggugcccaguaguugcuaccauuaucuuguauaccagauacuaauauuuuauugauaauuuauuuuaaauuauuuuauugaaggccuuaauugaggcuguucuugcaaaggaugugaugagauaaguagaaaugaacucagagaagaugaauucaaaauccucgaugggagcauccaaguacuuccugguuucuggugaguauagugcccuuaccugccuguuuucucaucuauaaagugggauagccaucaugccugugucuuggaguugucgugagguugcuauguguaaagugccuagagcagugccuggcacaugggagguaccguaugaggguucucacuggggaagcuggggggcagggggaucccuacucuacacaguccuuaccagguuccaaguguuuuacaugcuuuaucugguuccucuucaucucauuccugacagauaauugauccuuugggucacacaccuuuucucuagucgggcagcacacgguucccaaggaguuuccagggagguacaggcagaaccucucuguuggccagugaggacagggcuugaacagccaaaaggagucaaauggauagagaagcuggcaaucugccuucagcaguaaaguauauggcuaaacucgagauauucccauagacagcgcagaacaagucuccuccagguccugaugggagaaggccgugggagaacacaagagcaaauuggaucugacagaacuggcauuugguaguaaaucuaccaggaagugagcuuccugagagcaggaccuuaguuaguuaaugcucaauaaacauuuauugagcaaauucaauaaacauugacugaguaaauguacuucaauuccucgauuccauauuuauugagugccuaccauguguaugugaauaaucaucccuugccucugugcucaaacucuauugcauauaaugggguauuuuuggaauagaaauaggaaaacaauuaauuauagcccauuuccucagcuuacaaccaugagacaguggaauccgggccuugcuauuucccuauuaugugauuuucagcaacuggcuuaaccuuuccaagccucaguauccugaucugugaaaugugcauagucaucacuaccauguacgacugcguucugaagguuaaaugcuagaaaacacuaggaaccuguguguuaguuucuuucccuucaucuggauaagauaccuaacugcucuaaauucgcacuuucaugggggugacucucucugcucugucuaccucacagugguuuugcacuugcaaugucauugcacuugcagugacacauguggaaacuuuuugcaaaccguuuugugcuauagggacugagcgccuauugugagcuaaguacuuugcucaucacuuuauauauauuauuccaguaauuaaagucaagcugccuggguuugaauuuagccucaaccacuuccuuagcuaugucacccacugcacauuacuuuucugugcuuaaauucuuuaucuguuacuggaaauacuaauaguuuucccaggaguauugcgagaauuaaaugagauaauguaacauauaaaacaagccuaauaugguaccuggcacauaguaaguucuccauaaagguuagcuguuguuaguggcuauuccuauaacucuuaguuucuagaugaggaaacuggggcaaggaauaaugaggaaucacuuauccaagguagcagucaaggaugugaagcccaaguucuuccugcucugccaugcugcuuauaccuuacauuucuaugagccuuuccuguaccuucuggaacucccuggcugcuuggucauccuccucuucuuaaaggacagacagguuggcucugagcccagcccacugacugaggguguaagccaggauaggccuccuacaacccuuguccacuguuuuuacucucaugccaacagacuuugggaguguggaaaaacacaguauguguuagcuuuauuccaaggagaguaacucagcuagucauucauccaucauaucuacuauccucccuuccuuccucccuuccuaacauuagcccucccuccauuucuucugcccuuuagugcagucauuuaaucaucuagccagccaauuaucuacccaaccccagauuuguuaugguggcacuuacaucagucccuauuucugagccaaaacaggaggaaggccagcaccuccauagccagagguucuaggugcuccacaagcagaucccuuccuauaagggccacacaaacaagacugcuucuccagagcacacuccaaccacaucucaguuacuuaaaaguuacgggaggggaggggugcagaugccacucaucaguggagugcugcagugaccuuaagucacaagagcuacugcguaacagggcugagcauccaugucugccuagagcaucaacgaaugaaacacaaaguggaugcucggagagacccagagugccucaugcauguggccuaaaccaggcaauagcaugguggccuguguuucuaggaguuaaugugcccuuccccuuccucaauguguccaugucccuuccucauucuccuucagcuaagcaaucagacagcccacucaaguuaaaguugggcuguuugauuaccugacugaaggagaaugaggaaggggcauagacaggcaugugacaugcagcuuugguugcuggccccacgagcuugugcuccugaggggcuggcaggcagaagggguuugguggugcuuuggcauuccccugacagcgagcucugaaguuggcccuucugaggugaguggcuuugggaacacaggacaacguacuguuggcccaggucccagagcucucacugaggacccaggggcaguaacagugcucagugcggguauggacuaagcaugggcuuuggggucaggcugccugggcccagauccugggccugccacuuaugagcuguaugaccuuggaggaagguaguuaauuucuuugugccucaguuuccucagcuaugaaaugggaaugauaauaccuaccguaaggcuaauuauauguuaaaugaguuaauaugguagacgaguaucuggcacaggguuagcuauuauuauuaaguggcuuugugugcagcggagguaggggaacaggggaggugguagcugggugcuggaaugggugauaugaagaggugaagucugcuuaugaguucacacugaccugccccugggggcuucuaaaacccuuuggaggaggaugggaguuguucagguggaagcuagagccggugaaaauugggcucuuacagcuaacaugagccucuuuguacccucagguuuacaaggcacuucagaggaugcugcacugucugggugagucagcuuccuacuguggcugcuggucacaguccaggaacucaucuaggccuagguaagauugcaucuggagccuggggccaggucuggggcccuacaguaaggcggagaugggcugguauguguccugagcggagguuaggaaggcucugaacacugucaugggagcaaagacugaagaaacuagagaaaaagagacucugagaagacucagaacugccuuucugcaucuguaggauuucaccccacuauagguuguauggagggcagaaccgagggagagucuugggggaggcagauuccagccugaccaggacagagcuggccaaccagugcacaggcuuccuugggaggcggugagcuuuucauuauagaaauauuccuacagauuccuacccugggcccgguggcucacgccuguaaucccagcacuuugggaggccgaggugggcagaucacuugaggccaggaguuugagaccagccuggccaacacggcgaaaccccauaucuacuaaaaauacaaaaauuagccaggcgugguggugcaggccuguagucccggcuauucgggaggcugaggcacaagaaucauuugaaccugggagacagagguugcagugagcugagaucacaccaaugcacuccagccugggugacaaagcaagacucugucucaaaaauacaaagauauauuccuacagauuccuaagaccuaccucaagagauuccaauucaguaggucuuggauggcugaggaaucugguguucaaaaaauucccagggugacugaguggggcucacguuauagagagcuuugccugccugggcggagcuuagaugugaccugggauucuucuagcacuggcagucugucauucugugguccccucaggucccaggcuuguguucugacagcuucuauuccugcuagaaccccuuggcuacaaacucuucccuuugagucucucccuguucaagggccaaugcagaaaaccccacucaggacauagccuuacaaagugcauuguuggggggcuuuuugugguauuugauugcagcuucugauuaaggaccugaagaguacgucugucugugcaugccuguguaucugcgugugugucuguguguguguaugcguguguacgugcagaaagagaaacaggaucuaguccuacagauuuuguguuugugugugagaaggccucggcuagugcucaugccagugaugggaaauaggggcugggaccugaggaaucacaacuagggcuggaccccggggagcuguaaacuuagaaggaugcucuguucuuugccugcuucacagacugggaauucaggcaggauugggacuuccagccgagucauccuggccaaccccgcuuccuuggcugccuggccucggaugcucccagggacucagguuccagcccccugaaggcuccaggccagcuccugaggccugacccucccgaggccgugacuaccugagaaacccaauguggguggucuggugggugcaauagugggagaagcacuuuacucaccaugccugguugccuucugaaaagcuuugaaauguccagggcguggcaguaagggaagaggguaaaagaaaguugaguuugauguggccuuugguugggggggucugaacugccccagcuucauggucccucaggcuauagaaggcacuugagggcugggcugaacaggcagagucuaggaggcagcaacuaacccuuguacuggguaacacauaagaaaccagcagcacagcaaaguuaacagacuuggucucaaaguuucuuggccaagacaaggucucuugaccagaauguagaggagcugggauugaagcccagcuugguaugacugcacaguuuacauucuuaaauccugugcuagguauccucccugauaggaccugggcuucucggcucccggcuccccugaauuccugcuggccuuccuaaccaucacagcuucaaaaugcauauagguacagugccauuagguuggcaugaugaauuucuagagguugccacaauggggggaggguuccaugagcuugccugccacaaaguugagaguaagcgaucccugauuggcuagugggagcuccaaauuccaguuccccacaaguucagucucccugugacccugagccagaaccagacucuuauuaaauaacggauggucucugaaggcccuucaagugccaugauucucucugugcccaugggaaaucaagacuauagagagaauguuugcagguacugauagcuucugcauuauuggggcccagcagaaggacccaugagggaagaaugcaugagugaacauuauuuuuacaaauggguagauucuuagugaauauucucauguuaugauuacauuuguuuucuuacacauuacaacucugggaacuuaaguaacaaacacuuuaaaaagaauggcccuuuggaucuccauaucccaaacccaugggaucaagauguuguagaacuuggcagucuuguggguggggagaugcccuucccuugaaugucuaagugacaggugucuauguugucuuguuuuauguuuccugaggauauacucugaaagaacuuuuaauuauaaagcauuguaagcaggaagaauuuaauauaaaagccugucuucacugacagcaggggugcaucuuugcugaucuuuuauuaucuuauauuuuaggaaugcuuuuagucuuggggcagcuguuugggggaguugcccaggauuuaagagcuacauuuugccugagaaucugauucaaggguacuaccauuguuaguaaaguagaaggggccagggauggccauuuucagaggaguccagggcgaggaaauagggaugcuaaggagacagaggccaagaaagucauggccugagggucuggaagcagucgcauuugaaugcaguugugaguguuuugucucuccuuuccuuaauccccaagcuuuuggaacuuggcacccucagcagcaggacccacuauuucccagaaugggggccuggacuugauaaaacccugggcugggcugccugaggcugaagggcuaggggguuggcccacugucacuuagacauucaagggaaggacaacccccucaccccuaaggcugccaaguucugcaacaucuuaauccgaugagcuugggauaugcagauacaaagggccauucuuuucuaaguguuuacuaucuaaguucccagagucguaaugugucagaaaacaaaugccaucauaacaugaaaauacucacuaagaaucugcccuuuuguaaaaauaaugcuccacuuauagauucuucccucacuuaaaaagcgucuaucccaccuggcucaggucaguuuggaugacuguccgauauaacaggacaauaccauuucaaugcaaaucaacugcaaaguucaugaagucaaagaaaacagugauggagaauuuuacaugcaaggucuuugaccaaggagaucagauagagcuuaucaauuaagugaagaaaauacgacgaggaugaugcucaaauagguucuucaaaagggaauaauuugaauaucgagggacugaaagagauccuuggggaaauggaugaagcccuuaaguauuaaacagacguagacucuuaauuaggugcuguaaaguaaaaugugaagagcgaguuacuaugugaacagaucacuuugcugguauaauaaauaaauauacccacaccaaaaucaacauuuuauucuuucuucaaucugaaaauuagcacauaaccuauauuuuguaaucuguauagcuaaaaauagcuuguuuugaaugccucauuuguacaauaaaaaucuugaugucucuuuaaauuaaucugcuuucaucauuuccuuucuauaauaaaauuucacugaaaaccuuuuuugcuauuuacuauacaauuuugaucuccauuuuaaguggauucacuuuaaguggccuuuucucgugcccacucaccugacauaagagguucucagugcuaaugguucucauauaaguccuucuccgguuucagagggagccugcaugguuugugguuugacuucugaggccucagucagacacagccuagaugguugguucuauacccagaauauuuggggccucggucaauucaaaccaacucagaguaauugauuccucaguauggaagccacacaccuucuccagguacccacugcaaccuacaugagcugucagcaaacccucuggccagccuaaaagcuguggccucagcccagggugcuuggcuuggcccccagccaggcuagcugagggcagggagggggcacuuacuuggccggcagggcucugggcugccuguggcucuccggggggcuccucguccucgggaauguggggcauggcagccuccugcugggaguggccacgugugcccggaaccuccgcugcgucagccccaaagaugcuccaagaggccugggcuccacaggcuggggagaugccaaaaggacaagucaaauccauucccaucccugucccaagcuggguuccauuucccggagccacaagccacagugagagccggcuugaguuugcaucaacaccggaggucaaaccaggcuaggagagggcauuuggaauuucauuuccuccggcucucuggcuuuguuuacaaagucagaggugaccuuagagauuuugcaucuaauuuggucuuuacaguaaacacagcuaucccagaagggagaaaugugcuucgaacuccucaaagcuguagcuaauggaagauacuccauugagaucacauuggcaguuguuuaccacuuacugagcaccuacugggugccaggcccuguccuaggagcaucaccaucaucugauugaauccucaagaugaccucugauguaggcauuaauauucccauuuuacagaugagagaaccgccccagagagugaaagucacuugccccaaaucauacagagaaccaauaauuugaacccagaucuuccugauuuugaggcuggggcuuuuucugcuauacuacacaguguuccucagccauguggauggggaguaagaggugcuguuuccugacuuccucccugacaccuccccucaugcucuucugacccucagcacaggcucucucauuugaguucagcccuuauggggacuacaccagcccuacuaaaaccugggggcucaggcagggugaauuccaugugcccugugcccaccccuggcaaccuuagauugacucccagaagccaggcuaucccuuccccauggugcagcagccugggggcacuggggucccagugcugauugggacugcaaucagcauaaucucauccaccucccacagugacuggcucagggauagacaauggacccagccuacaucgaugagcuuaaagugguguucuaggaccagaugcuuucuccugcucugagugguggagugugaagauaugagaccuggugcuacggacacuauuuugcuuccaugaggaaagccagacagaaucuaaaugauacacacagaggagggcagagcgaagggaccugcagagaaacagaacuggagcccugauuaaagugugccugaagccugaacacuuucuggacuagcugguuacaugaacaauuaagccucuugguguugaaaucacuuuguguuggguuuuuguuccuuguaacugaaaacaugcuccacuacucuuucgugcuucuugucugucaagaugccuaggaguaugauccugccaacagaccugagccaaugggucuagcuccucugcuuccucuuagaagaggagacuagcaaugccagguuuccauagggaaaggcaggauagcaauguagaaagaacacaggcuuuggaaccagauaucucggugugaguccucacuuugccacucacuggcuauguggccuuggaaaguaggcuucaucucugagucccaguuuucuugucaaaacagauaagaaugccucccaagcaggaugcuccaaggaugaaacacacucaguucacaguaguucccacagaggccaccugcacgggggucugcagcccaggaagcuuggccgaagcuccaagggcucugccuggccucuccccauccuuaaacucccuccuucuuuuauuaguggggugggcaauaccuucaggaaucuauagaacuaacaacuggccugguucugcaacuuuuagagauucccugaaggagcugcuccacugcacaguagauuaagaccaccaugcagauaacauagugaggugaccuuuggcugaugggacaugguggguggggguggagaugaaggacacugucauuuacugagcaccaacuguguuccagguccucuggaagguacugcugacugcuggaggcuguaggaggaagaaccggaaagcccugccaccucccauaauacuugguguucuuccuguccuucagaaagggcucggaaagccccuagagucagggcacuggagaaaaggccugagcugccaucagcccagcucugacagaccccccagccaacacacauaccucuagacuccuggacugagcuccuugagcuaggcaaggugucagauucauccuagguacccaaaagauucagcaaagaaugauuguugauuuauguuuaaagaacuagggacuuuuagccccaggauuggucaaggugaccaccaucuugauugcugucuuucucugcaaugaacaaguuagcccacacagcucuggaacaguuagggugaccccuacuggucaccucaagaaaucucaaguagaccauccauagagucauucauucuuucacugccaaaauuuuacaccuacucuaccaggccugugcaaggggcuggugacauaaagauaaucuuggccuucaaggaacauagagcccagugguaggagacgcuggagaacaguauaaugggguaaauauuuugaaagugagaaguugcaggaccccagaaaaggguuaccugugggaacugggauggugggacaugauuuuagcaaauauuucacauuacaaauguuugagcugagccgugaacacaaaugcugaguggaauuucuuggaacagauuagcugggugucuaguggggaagauaagacaggauggggagaagccacauuggacagacuucaccuggcucuugggaaugagaacuacggggccagggcaugcugucugugucuuccaugccaaauucuuacuguaugaauaaacugagcaucagguucacccaaaggugagcucugugauuaauuucuaucaucuuuacuuggauuucagcagcaguggcaucaguggugcuggguaaaguauuugguaacagggguugaggguagcaaaagacuagccacaaacccugauucuacuaaaggaaguuggcuacaucucauaggaaaccuuuuaaaauuaugugugacguauguacagguccaggcugucuuaacaggggcaugguuucuaaaacaugggaggugacuauuccacuuuucuuuugucuuaaucuacacaaaguauauugugcucugccuguuaagaaggauuuagacaaauugggacauguuuugaaccugggaagcaggaagcaaggagaacaaaaauuuguguuuaaagaacuagagaacuuuagcccggagaagaggaagugcagggagaaauaaaaaucucuucucagauguuuggaaagcauucaugugguuuuacuguucccaaagaauagaugucauaacuaaugacugaaaggucagaugaaggcaagggacgaccuucuagugguuggaaccaccugaagaugaaacaggcuguucuuuaagguagugaguccccauuccuuggagcguucucguaaagccugggacaagggucacaggauuccuaaccacuucaggggccuuuucuaacccugggagucccugaaauccuggacucuuuuuagcuacaacaaacugaaagaccugacgauuccaucccaggacucugggauuauggucugaagucucaugagaaauaccucauuuuuuaacccucuacuuucuuccuccaccucccucucuuccaaaaagagcuuaagucagucccugugacagaaagcagaauagaacaaaugaguuaagucagaugucagcugccacaacauaaaaguagaguggaugcuugcugaggccccacucuugacaagauggaaccccaggcuccucaggggagccccagcagcccugccugcaggggccauucccacgcugcuccugcccuguuugcugucucucccauccauuauuauaaacucgcugcuuaaaauagcaagguaaaaggagagucccugccccagggugacaucuggguucugcuggagcuugugggcacacggaccucacauccaucacugcaaaguuuagaauauaaucuccaggaagugcugaucuagagcaccaacccauaaaaggaaaaaauauuuaguaauguuuggucuccaagcuguuccuucuuuaacccauuuucagggcccuucuugcugccucuccagucugguucggaaaggguuagguaggccagugccaagagcuaaucagcuuuuaugacucuacucauucugccuccagcuagugccuaacuagaaccuggcccauuuuacaggccgggaaacugaggugcagaaacggaaacaacuugacugguucagcuacccuuguaucuggugcaaaucuuccaagagacucugcugggauaacuauccaguaauuugugcaacugaagaggcuagaaguuccuaaaccauauuuaaauauuuuaucugccccugcucaugaaagaaaacaaacuaauaugcuuuuguucaugcuuucauucuucagcuacuucuaagucgccuacugagcaucggacacuaugcuaaauguauuucaagugcuauuuucuuuaacccccaugagauagguuuuauuauuuccauuuaauauauuaaggaucuagggcucagagagguuccgcaaccugcucaagaucacacagcuaguaaguagcuggugaagggcuauaauccaggcuagucugacuccuaggcccgccaucuuuccucucuuccacucuggcuucuucaccaggaguucugcuugaguguggcagaaaagacuagcacgggggcccugccucccaggggagggcuggagugaguacucccagugaggcuaaggauggugggaggcagaggggaggaaacaggaccuacacuucgguugucgggccggggucuuaugagggcuaaagaguggccuacaguugagccugcauguccucugguaggugguagcagcagguggaggacgcggaggccggcccugccuuguaggcuucaaaggccuuacuguaucccagaaaguauagagccaucaucgggacgcacgguucaggaacagaauuuacagagacuaucucuuucagugcugucagcagcccugugagauggggagaguaaguacuauuauuauuaacauuaaaguuagacccauguuacagaugaggaaacagaggcccagagacuugcccaaugucaucgcucaugaauggcagugcugggaauucaccgaaucugggucugaugcuccccuuccuugcagggccaagccuguucucggcaggcagcagcagccucucaucauggcgccaaagaugccucucccagagccuugcaaccugccuaggagagaccaaacuccucucugaaaccacaguaucccaggagcacagcccguaagcuaagcggcucucagauucucucugugaaucuuugagcauugagggaagagccaagaagcccuuucgggaaaccauggguuaaccuagccuccacugaccuuucuggagugacucaguauucucagaagggaguuuuuuuguucuuccagcuuugaauuuuugcuuucauuuuagcagcacaaagaaugugaaagagauuagguugcuauuaauaccacgggucuaucucuagauggacaacugauggggggaauuguugggggugacugcacguggagcucucuuagcccuucugcaaauccagagggugauggagggacacugagaacucaccagucuuaccccugcacccauuuuuaccaauggggaaccgaggcccagaggggcaggcaugugaccaaggccacaucuaugagugaggggcagagucagaaaaguccccagagcacccaugccccgagcccggcugcauguggcagcuuucugacuuuucauuuugacgguuuugcucauaguaaaggguaagccauugugucugugcugugaaagcaggcguccuucggcagugacucgucauuguucuugcucucaugcucucauggucacucucgcaggagagaggaugcuccccacaggagaucugcugaaagugcugggaggugccucuggggguccccugggccuggccaacugcagagcuggguuccgcgacuccacaagugagccggaugggaagccugccuugggaaagccccauccugcuuccuaaccuuggccugcucacggggcuuuguugcuuggcagauuccguucuaauccuuccucugccucucccuugcuggauaaaucuccccuggccucaguucccucauuugaaaauggagguaauagcacccaccuuuuagcguuguuguaacgauuaaaucaggaaauacaugcaaggugcugguacauagaguccacucagugcccucgccauucuccaaacagggcagcugaguucucuaagcaugcacagcaucaacaaaaccaagccaaggcucagagagacucugguguucauccuaguggcucagagcucccagauuugucuccugcaaguaaaagagacucaguccuggucuuugcuguggacagucccaggucugugcugggcuugccccaugucugugcugugcucagucccagguccgugcuguggucagucccaggucugugcuguggucagucccaggucagugcuguggucagucccagguccgugcuguggucagucccagguccgugcugugcuugccccgugucugugcugugcucaguccuaggucugugcugugguuaccccaugucugugcugugcucaccccaugucugugccgugcucaguccuaggucugugcugugguuaccccaugucugugcugugcucaccccaugucugugcugugcucagucccaggucugugcuauggcugcccaaggucugugcuguggcugcccaacgucugugcugugcucagucccaggucugugcugugcuugccccagaucugugcugugcuuagucccaggucugggcugugcucagucccagguuggucugguuucaaagccccaguucuuuccacuaucccuguacucaugaugacucccccaaaacagagguuuuuguuccacaggugagacaugaggccuaguguggaaucccuccuggaagagagccagccacagugucuggccaaguagguauuugugcugugcugaacaaguggguaagugagugacugaaggggguacagccaccccccagugugugguggaagccccaggauucucuccugaaaguggaucuagauugaagggaauugugcaggagcaggaauggugaagggcggagaugcagggagaaagccucgguggcaacagaaaagggaggaugaggaaguggaagucacuucccccaagacuguguccccuaaacaaagucacguuucgggaggcuggcccugagaaccccgacaauccugggguuugcaccucugugggaaaccuucuuagggcccgauuuucuccagcccugcucuccgcuccuguggagcucguauaggcuuuguuggcugggggugcccugggaaggagccagcaccugcucagaccaaugacaggaaauaagccuaaacaucuccccagguuuccuuuccagcuuguucacuucaggaauucuuuuuuuaaaaauagguccacuugaaaaaauuuuuucuucuucaaaauauguacaauugcucaaucggaggcaguucaaaggcaccgagaauagcagcaaaguaucugagccucccauuuagcgccuagcagauauaaaucuugcccaguucuguuuguuccaggcugcucagcagccucuucccugagucacucacucaagagugacaugagucaucauccuggggucaaggaccacacggcauucugggucugugagaucccauaaagggcagggcaccgaggggucuccaggaagacauggaggaucaggaacugucuccuaggcccuaggcuuggcucugccuccccacaugggugacuuuagagagucacuaagccugagaaguagguggauuucugggcccuucuaacuuguacuuuggaggaaucucuuuaguggugcacaggagccugcuuguuccagcucauaagagucuaauguaauuuucaagaauucugugaacuggugguuaaacacagacauuauuaaaaaauaaauuacaugaacucacauuaaacaaaaaggagauaaauacucaaaauaacugcuuuuuaauuauuuuacuacauuuuacuauuaucuaugcucuucugaagauuuauuucuauugucucugcauagcggaaacuauauaaugauuugcuacugcccaucucuucucaguuccaugaucagugagggugaguuaguagcuugccauuggucauagugggaguaucuauaccauggaaauuggcaaacacuauguacauaucagggccuuuuccccccagagagcuggccguggaacauugccagcacaccacugagcuacucagccccaggcucccugauucuugcuccuaccagggugcagaaggaacacagaugacuuuaguaucaccccaagauagcacaguuauggagacuucauugccaauugucuuuggacaacuuuucccaaguggacuaugaaucccuuauccucaacacaucccugacagagcucauuguuucuuucccuccccagcccacuccuccugugccccagagaauggcacucaagcuacaaaccuagaagucaccgugacuccuucauuucugucacccuccacauucaauuagaugacucugagucccaucaauccuaguucagaaaugcccuuccucccaucccuggcaccccugcccauggcucugugugaccugagucacugcaacagccucauuugucuccuuaccucuggccuggucccuuccaaugacccuccauaaugauaccagagcagucugucugaaacacaaauuggaucauccuuccccuucauaaacuccuugaggauugauucccuuuuaccaugggggggccaguucugagucaagcuccuagccccucucucgaggcugauccccucuuucaaccuuuguacaccuuaugccccaaccacaguggaccaaaagccaaccuccaaacaugcccugcuuuuuuacacccuuugcauacauccuccuccuuauacuugggcugccuucuguccuccuucuauacuuuauggguuccuacuuguccuccaagacccaguucacauaucuccuccuucauaaacccauuccuccucuucaccucaggaaaaguuacucccuuccuguaguaguuuccuacugcgucuguaccaaauuuccacauauuugguggcuuaaaacugcacaaauucauuaucuuacaauucuugaggucagaaguucaaaauccaucucagcaggcuaaagucuaagcaucagcagggcugugcuucuucaggaggcucuaggggagaauccauuuccugccauuuccagcuuuagaggcugccuacauucguuggcuggugacccuuuuuucuccauccucaaagccagcagagucgcuggcaucuuuucuccccucugaucucugcuucccccuucacauuuccuucuccucugacuuucaccguccugccuccuuauaagaacucaugauuacauugaacccgcucaguuaauccaggguaaucuccaucuaaguauucccaauuuaaucauaucugcaaaggcccuuuugccauuuaagguaacaucuucauagguuccuggguuaggauguagacaucuuggggaggggggaguauucagccuacugcccuauccucccaggguacuuugcccagaacucaacccaacuagaauuugaacaucucaagagcagagacucugccuuauucauagcuuuaugaauauucuuauaauauucauauuuuuaugaccugccuccaguacagggucaaacacagaauaggcauucacuaaauguuuauugaguuaauaaaugaaugacaccguauuucuaaaaagcagagaagaagguuuuacauaggcugggugcaguugcccaugccuguaaucccagggcuuugggagaucaaggcggguggaucacuugaagucaggaguucaagaccagccuggccaacauggugaaaccccaucucuacuaaaaauacaaaacuuagccaucaucuggguugcuauauaagcaaguggguggccuugccugcccucauucucauugagcuuccccagguuaauggccaaguuuuucucucucucgaugauguacccggguuucaugucuucucugccacacagaugugcaaauuucucccauaguauucuacaacuaaaaccucacaaaaggccagggccuccuucucugacaccuucaugcuucuguucugccauccaggaguaauuugcaaagugaauuuucagauuaacuuaucaauggcucuucuagcuuuaaccuaagccuaacagaagaccacagagcagccccaccagccccucuggcuccgcuuggaaugcugaccaaagcauuuccucaaacaguugguuauguguguucaaaugcggcagcacccucgugucugcugcugugguacucuggaaccaccuccuuccugacagagcagagccgggaggcuuugcaagguggucauugccuuuaaacccagaccuggacucauggcuugauuccugcuccagcaaaggcacagacucugguauuagggguccuggcaauccagcaccugggauugcccauucccaugaagcaggccucugggaaauguaccuuauuucagguagaaggcaggaggcacuguacccacuugaugggaucgcacuaggccuugauggccuugguucuuucagaagccaacaugugggcugaaucugagccaacggccucuuccuuggaucucccggccucugaaccugaagaugcccuuuucuuaggaugggagcaaggauggauaaaggcaagcugguguuuuguccaggcccagagaucugucaagggccaucuagaccaccaggaaccagaagaggcacccuauugccuuggauucuuuagaaacuuuguuccaaauaaaaauaaagcuuccuugacuuggcaacaccacagcccaauaaauaaauaaauaagcaaaaaaagaaaagaaaauuaacacccaguucccagugugccucucucauucaguuccuccuacuucuccaucaucuccccuucccuuccuaguuuucuucuaggaagaggucaucagggucuauuaggaaccuguaggaauacauauaggaauauaggaauauauguaggaacugguuugggaaagucagaaggaaaagauggccuccauggugccugccuaaaucauucacccauucuagaaaagcuuguugagugcuuccuauguguuagguacugugcugggcacuggggcucugggguguguccuccaaggccaccuccuccaggaaggcuucccugaccucuccuggaagcuauauucuccucuggucuaugacagcacuguguggcuaucccaaucugccaagcagugguuucuguuucucauuugcaaagccugagggcagauagcuuucuuuuguaacacagguacagagaaaguucucaauaccugguggaucucuucuuuugaaagcaaggacucuaggaaucaagccucacuuuucacauggccuacuacacacccagcacaauguagauacgcuagcucuugaaccaucucaggucugugagaaaggaauuacuuguccauuuuacagaugaggaaauggagccuuagacaagcaaagugacucgcucuaggucacacagucagaaggcagagucaggauuaaacacugggucuccucugcccaaaaugggauguuuggcucuuccuuagagagagcuuauuccuaugcuucucuaaucuuagcaaagacagaacaaggguauuaggagauguuuuuugauagggcagugcucuugaucauucuagaucccagcucuuccucagggccagcacagccaacaagaacaacagcagccgagacgcagccccucuccgaggaacuggaaguccuucucacggcauccccugggguagacaggaagcagcugcgacugugaucaucuaagaccagcaggagagaguguucuucccugcugggauggagcaccccagcucagguccccgccuccuguucaucuccacucugggaaucccaguucuccaaagccauggaaauaggcccaauaaccuugggcugggcugcugggcaaagucugguguaaagcaugcuacagaaagcuacagcaggauugagauagggguucagggacagggccuuguggggagugaagagcagacugccaugcuaacugccuguguaggaaugaguuccuucaccauucaggccucagucucuccaucucaauaguaaaggcugggcuaacuugccagccugagcccugcuuucugccccaugaguucaaguucacguugccuauugaaagcagucacacaguaggaaguuaggggccuuccuggcaucccagggcuggaagcagccaucacaucccccugaucacagugauuggcuggagggugagcaugugagcugacaagaaccaaugagaugcaagaagacauuacugggcauccugggaaagccauccuuaacugcagccuugaguuccagagggugaaagcagaaucccucuuaagaugaugaagaagaacuugucuaaggauggaaucaaugugagacagagcacagcuaagagccagaaagaaacuagguccugaggcuaucuucucagauccugaucaagccaugccugauauccccagccuuuucuguuuugagaaccaaugaauaccccuuuuuucuuaagcuggcuuguacgagcuuuuuuggcacuugcaauaaagaguuccaacuggugcaaacagccuauccuuuauaaugcugccuguggggacuuucuuggcaccaagucuucucucaccucucuacugugcugcuuaccuaacccuaacccuaacccuaacccugagaguuuaagcugggaacucagaucuagaguugaugagcuuacccuaaguuauucccuaacuuagaauaucaccaugcccuuuuccucagaaccuguuccucuuucugcauucccugcuaccauuggugggcccagcaucuggccagaaaccccagcccaaacacagaaccuucucccaccucuccaggaugccuguccccacuucuuuuuacuaauacacacaucuaaacuguuagggcuccagaggagugacucgguuugaccaaccuccauguuccugccuagacgauagacugguacacaccaagauauguuuguugagucaaauuucaaccuucaaaugauuuucaaacaucauuacuuccugggggcgaccacuccaccuaccuaucccucagcucagagcuggauaggcucucacucucaacccuccccagaagagcagaccccaagaccgggacaaugauuggcugugugaacaggcucgcagcccugugcuuggaaccccagcaccagaguuuaggguggagacucccaugugcaggacaggaaggaagcucacaccuugccgacugaggccagcagcagggugggagcagcuguggaucuuggccagggucuuuuuuucaccaauagacucugagcugaacugcaggaugguggguguguacacaagaagacacgugauaaaguaaaagugagcagucccuugguuauccagauguaugcaaacagcugcauuagcugagucuuuagacccaaguugagaacagguuauggugaacagugauaugcaauggcagggguggguggaagccgggaggguagagccugggaauggcucucccaacagcaagcuuuggugauuagaggcccauguauuucaagguccuacugcuuaaaugggcaugugcaacugugacugccuaaugauaugagauuggaaguaaccauagagaauuucuccgcaggggagucauuuuuccaccauggagagguggggauggucugggaguaauucugaggcauuagcaggagagaaacugacauuuauuguaccaggugcucuaccugacucuuuacauccuuuaucuuauccaguccuuacaacagcccugcaugguacgauuauucccaucuuacaggugagaaaauugaagcucagaaaggugaaguaauuuguuucagacaucacaauuacuaaguaauguuaacaggguuugagcucaggggagccugacuccaagcccaggguucugcucaguauaccauaaugaaggcuucuaggucaauacagagccaggcgacagcagcagcaacaacuucaaccaaaaaugaaaugcuaacacaggaccagaagagguuuuucuggcuaaggcuucaccaguuugucaucguggagaagguaucaucccuaacaaucagauuuaccuauguucuuuguuaaccugcaguuuguuauacaugcaauagcucugcuuaaguuaacugguaaauagcauagaguuuauccaacggguuaagcugagucauucucgugaaguauuuucuuguuuuuagaaaagacugaguaaagagagcucugagggcagguuaaggccagggacugccuggagaugccucagcaguuuugcuggagcuguucugggcugugagugggcaggcaggugagcagacccccuuccuggcccagguuccacaaggagcauaggcacugggaaaucacuggguuuuggcaggguuuucuuggaucacacuagcaacauuaccaaggccugaguggagcuccugcacccuggggaacauuuucccaggguagcccccaggcuccuuaggucggcucagacaccccucuuuccugugcccacaguugguauuuccuaguuauaaaaugauuuuuucauuaaugcuaugauagaauguagaggaauguagauauuuuuaauaugacaacauauguuuauagaacagaaguuuuuuuuuucguuuuuuuguuuuuguuuuuaaagcaccuaauuuggagucacccuggaucccagaagccccaaaguccugggacauuguucucguggccuuucaucucuuuuccucugaucuucuggauccccuacacagggcccuuccucuaggguuggcagaguuugggaaaagcaaaggccuucuagggcccugggcuggaaugcuggcugggguauggcuggcaggcuuugugguugggacugguugggagcagcagcucugcucugcucagccugcaggucagcacuggaaggcccaaguugggcaggggccccaggacaggagggagggagccgcuacucaaugcuuuccugauauccucuuacugccucaguuaccucccaauucccuacucauaaaaaucuagccauccugcagcccuauucauucuacauguccagaugagaaaagcugauaaccagaaaaucgacuccugggguagguggagggugguucuccuaugaaguaauccaucuuccacacagcuggaauucuaaaacauagguguggucgcaggccucccucaagucaaacauuucaauggcuuucugugugcugacucccaagucuggcugcuuacuaaaagcaccugaggugcuugauaaaaugaagauuccuacacccuucucagauagacugacucagaauaucugggaauagggccugggaaucuguauggcuaaaagccccuaaaggggaaucugauccaaagaccagagcuggagaagcccucguccacagaugaaguccaguuuccugggcacucaugcaaaacuuucugcucugagacugccaaaccucucuguuuuuucuccagccacuaacaccaagguauccugcaccccagccucaccuaaugcucacuuuccagaauauuccacgugcuaucaaaccucagugucacucccucugccuagaaggccauccccccaucugucuccaugaaagacccuacucauccuucaggagccaccacaugauucucaccagauuaaacccucugccccauuuccuuuuagcauuuuaaauuguuuaguuggaaacauagacuuuaaccuucuauuugccacuuucuagcucuaugacuuuggcuguugacuuucaauguccucacaaauuauuaugaaaaauauucaaauuugaaaaguauguaaauguauguaaauuagauauacagugucuagcacaaaauaacuaacagaaugguaacuuuuauuauuauuauuccuauauuaugauggcauuccucuaacacagaguucaacaaacuauggccuuugggccaaaucugaccaacuaaugguuuuuguaaauaaauuuuuaucaaaauacagcacaaccauucauuuguauauugucuauggcuguuuucaugcuaugagggcaauugaguaguugaggcagacacucugacuuauaaagccgaaauauguacuagcugccuuuuuucagaaaaguuagccaacccugcucuaacauaauugcaauuauuuuuuuauaguuucgucuccccuauuuggcugagagacacucaaggaucuucauggcagacuccuguucauccuuuuaaacuaagucuuucucaucuuuguaucucuaacauuugguauauaauuagggcuugguauauguuaaauugaagugaauaauucuuuaacccaguuuaaaugcacacaucuccugaaagcccugaugggaagaugggguaagugccagcagaccuggcucugaggcugccucccuccuggcuucagcaucccacagucucacugccucccaccacccaaaacccagcacucugugcuuugcagcuguaauauuuccccugauagagaggggaggaagaaguccuucaaagguuaguauauucccauuauccaagaguguacaaauggauggucuaaugguccccaugguccuuacagggggcaauuugguggacccauuuuuaauaaauaaacuaauggauugguauuuuuucucuggagaucuauauuuuguuuaguuucaacuacccaugaauuugcauuccugacaaaagcuccuuuugagaagagaacuaggauuuccaagcagugagaccauuucuuugugagcuguuuaugaaacuacucugugaccuugggccagucacccgccucucugggccuagcuuucaguuucuguauaacaacuuccagacuugacucccuggaguucuagccagagggaugaaccaacucauggugagugaaaacaguggccuggcaacaggcagcuugacagagugucuucccucuuccaugcugcaguagcacauucccuguccuccccagcaaauacagcgacucauuucuacugccuuuucuugaggcuuaaggaagauacuuuagcccuaaaguagaucuucagaagauaagaaaaugccaugguguggaaaacucugugcuggaugaaguggaaacacucagcucucccccgaggccagaugaaaagcacauggaugaaagccaaaguccaucccuuccuugagccuuugggagcagcaguccacccucucuuucagaaaguaguucccccccuuacccuucacccuccuugcagacacccccaugggauaaaauacugagccugcaggauccugguuaucugggggcaaaucgguguaacuguggauugaacugacuuuuauugauuucccagcaggugauuuauaacugccugcuuccuaaaagggcuuguggccagauggcaauaaaaacacucagaggccaagagaguuaaaaauaaaugcugaaaaagagagcagaggaaagagggagauagacagcugcacuaaccgaggugggaugacugcucagucuggaucacagggaugggaaucuugcuuuucaguuccuacugacauaaccaauugagaucagcagcaccuuguuuuuggcuuuugcaagaauugcagagcaaggaguagcuacaucuugagcuuccaaaacuaacccuuaguccaacagagaacaaaauugagugagauuuugcauuuuagaacuuuauaaagcucacuucacagagggacuccucauacaacuaugucaccguacuguuuacacaacaggaucuggaaguacuuuaaagccggcaguguaaaucaaauucuagguguuauguacaugucugagucuaauggcuggucauccacccuccuugacuuggcuuuagaguaguccuuaacuaaaacgaguucuagggucaugcaaaaccaugcacaaggauccuuuagcuuagugaaaauaggcagugcuuucuaauucuggccauaggucacugucauuugguggucacggugaauugguuauuuaacaaauucuguuuucacuaguugcaacuaaccagaaaucagaucucucaaaggaaaaccaagaaggcuauugcuaugggcuuaauugugccccccaauacuccuccuaguucuuaugucaaaauccuaacccccaguacauaauaaugugacuguauuuggagacagggccuuuaaagaggugauuaaguuuaaaugaggccauuagaauagacccuaauccaaucugacugguguccuuauaagaagaggaaauuuggauguagaggcaccaaggaugugccuauacagaagaaagaccauaugaggacacagagagaagguggccaucuauaagcaaggagagaggccgcagaagaaaccagaccugcugauaccuugaucugggacuuccuuagaacuguuagaaaauaaauuuccauuguuuaagccaccuggcuugugauauuuuaauacaguagcucugacaaucuaauauagcuauugauagaaucucucagccauaucagauuuaaauucaagucuguuucaaacauuuaaucuuugaaauagggaucaauacauuuuggagaauaauugcuuuaguauuuuuccaggcuaaccacaaaacuccuuucagaaccuuucuaaugaaauaaaaauucucuagacuaggucccaagaauucuaccuuugaagaaguaaaauuaucucuauuugcaggugauaugaucuuauauaugcaaaauccugaggaauccacuaaaaaacuauuaggacuaauaaaugagcucagcaaggcugcaggauauaugauugauauaguacaaucaauuauauuucuauacauuagcaaugaacaaucaaaaaaugaaauuaauaaagcaauucuauucacaauagcaucaaaagcauaaauacuuaggaauacacccaacggcuggccgggugugguagcucacaccuguaauaccacaacuuugggaggcugagguggguggaucaccugaggccaggaguuugagaccagcuuggccaugauggcaaaaccucaucuaaacuaaaaauacaaaaauuagcagggcaugguggcgcgcaccuguagucccagcuacucaggaggcugaggcaugagaaucgcuugaacccaggagguggagguuucagugagccaagaucacaccacugcacuccagccugggugacagggugagacucugucuuaaaaacaacaacaacaaacacaacaacaacaacaacaacaaaaaccagaaauauacuuaacaaaauaaauguaaaacuuuuacucugagagauaugaaauauauuugaaagaaauuaaagcccuaaauuguuggaaugccaucucauuccaauuucauauggaaacacaaggaagcaacaauaaucaaaacaaacuaaaaagaagaaaaaaauuaucuacacaucccaauugcaaaacuuacuauaaaacuaucguaauauaguaugauacuauacacuauacaagaagagacauacacaucaaugcaacagacuugagaguucauacauaagcccuuacauuuauaguuaauugauuucaacaaggaugccaagacaauucgauggggaaagaagucuuuucaacaaaugguucuggaacaacgggauaaccacauguaaaagaauaaaguuggaccucuuccuauaccauacacaaaaauuaacucaaaacaucuaaaugggagagcuauaacuauagaauucuuaggugaaagcaugugaguaaaucuugguguccuugguuuagacaaugccuucuuagauacaacaccauaaaugcaggcaacaaaagaaaaaguaaauaaauuggacuucaucgcgauacaaaaaauucuguauugaaagugaugcuaucaaggaaguaaaaugacaacccacagaauagaaaaaaauuugcaaauagcauaucuaauaaaggacuugaauaaagaacucuuauaaugauaaaaagacaaguaauacaauuuuuaaaugggcaaaauauuugaauacacaugucuccaaagaauauaugccaaugaccaauaagcacaugaacagauguucaacgucaucaacuaucagggaaauacaaauuaaaacagcaauaagguaccacuuuacacccaugagggugguuaaaauaaaaaagacaacagcaagugucgacuaggaugugaagaaacuagaacccuuauauauugcugguagaaauguaaaauggcguaaccgcuuuggaaaacagcuuagcaguuccucaaaagguugaacauaggauuacugcaugaucuaccaauucuucuagauauguacccaagagaaaugaaaauguauauccacauaaaaacauguacacaauguucauagcagcacuauuuauaauagccaaaacauggaaauaaacuaaauguccauaagguaauuaauggaugaauaaaaugugguauauucauacaauagaaucuauucggucauaaaaaggaaugaagagccaggcgcgguggcucacacuuguaaucccagcacuuugggaggcugagacgggcgaaucacuugaggucaggaguuugagacaagccuggccaacaugguaaaaucccgucucuacuaaaaauacaaaaauuagcugggcuuggugccgugcgccuguaauuccagcuacucaggaggcugaggcaugagaauugcuuuaacccaggaggcgaagguugcagugagcugagaucaugccacuugcacuccagccugggugacggagugaaacuuugucucaaaaaaaaggaaugaaguaaugauauaaguuuuaaguuucaugcuaaaguaugaaacuuaaaaugaaugaaaggaugaacuugaaaauauuaugguaagugaaagaagccagucacaaaaaaccauacguauuauuuuauuuauauaaaaugcccauaauagagaaagcuauagagauggaagguaaauuaaugguugcuuagggcugagaggauggggaaaugggacguggcuguuaauaagugugggguuucuuuuuggaugauaaaaauauucuggaauuaguuagccaugauggcugcacaacucucugaauauacuaaaauccacugaauuguacacuuuaaguaggugagucauauggcguguggauuauauuuuaacaaagcuguuuaaaauuuuuucuaacuuccauuaaaaaaaaaagagaaggaagcuagcuuugguccuuagugccuugugaccucucugggcauagcuuccucaaacauaaacauuagaaauuaagcucgaugauuuauaacgugccuuccaucucugaaauugcugaggauacauaauguaagaaaacagguugagggaaagagauagauuaugugucuaggaugggcucgugugaggagaaaugaaggaggaggcaacaauaagaagacuaagagaaauagagaugaagggacagggacacgggcucagagagacagacagagacauggagacaagacuacaccccaaaagaaagacagacucacugggaugaaugugcagauuacucaucuguucuuccauuuaacaaauauuuacagagcgccuaccaagugccaagcucugugcaguaguaaaccagguagaccagggcacugagcucagagguaagagacauagcaguaagcaggcaauuugcaagcaagcacagagagcgagagcugggaugcaguaauucaagaugcuccagaagugcacagaugcaacauacaccccacaccacacuccacaugcacaaaugucccaaagguagacucauuuuuguagggagcgccauuccucaucugaggcauuuagaguucugcuagcaaagacauucaaauaaacggguuuuuacaaguaugggcacaaaugggggugacaccuuucaguucucacccugaagucucuauaaaaugaggcugaaggacaggauucaucccucacuccagagcuucccaguacucuuucccccucaucgggagggacuggcuuuggaaacagagaggaaugugaccuauuacagccacaccagcaccacuccucugggcuuucagcuggaaacuucccagaacacauuuuguuccacccuccuuccaucccauccagaccuggcgaccuggcccaaugaaggcaucacauguugccccuuccccugucuuguggcuucucugcugcugacaggcacaugaaagggaauugaagcucaacagaaaagugacugcuuccugcacggugucggcucccugccugacucagauucagccaacucugaggagggaaggcaagggacguuucuggauaucucuugcccgggucccucuucuccuaacuccagauuuagcgagaguccaagcuacacaauauuccugaaauagccccaagucacauccuaagauggggguucauccccucauaugaaggauucucuuuggagaagauguugggggcuuuggacgccgugcacuggcacacgaauaggaaacgcagagugacccggagcaggaaggaaugggcaccgcccugcagauucugggcaggcugcaccagugcugggcugggaaacagccccugggcucccugaagaucucccuggcugugcaccauuuggagcagcagugaauuaaugugauucaggcuccaaaaauaguagccagagcaucuaaaauugcuuuccacccuggacugggccaguccccugggaaugucagcauuucuaaaauguccccauucacccagagugccuuugucagaccccaaguagaaucugggccaccguuaagcucuccugguuccguuggcuccugcccgguuccccucuccugugugucacgugcacugccucccaaacaggaaaugcuaauucaugccugccacuugcuguuaccagguccaagaacuuuaacccugcaaauggcuuggaagggcagaaauggucccuugcagaaguggccuggguggcucucuaucacugaguugggauuuaauuccuaacaaugacgacuggggaagcaggucaccugaggaacccugagccucuggucugcugcugaugccaaagggagucauuuccacaguggcuugucuuucucugacaaaauuauuuggggaucucagggaauuucaucaucaugaagacuugucacucuaggccuaccucagugcuuuugcacauccuguacucuacgcaggaaacaccauuuacgcccucuucccugacugacaaaugccccuucauccucuuauucagcgccuuccuaagagugcugcggucuuuacuaaguuugucugcaaugaaugcucuggaauggccaccuuugcccagguuacacucccaugccuagagauucacacccugcauucuccuacccacugaucgaccacgacucucagcugccuuauucauggacaggagugaggcaaggaacaagccucuccccugccucauggaggcuggccucccaucuaacaauuaaauggccagagucuguaaccacugcaugggguuccugauuuaaaugcaguuugggaaucucucugccuagagaaucgugauuugaucuuugugaucauguccuuuaguucucagguucuuagcugugaugcucguacugccucuuaguggcuucgcuuugccucccuaagagauuccagaagcgcaggacacagaaagugauggaggagugaggagggagaaugaguuagucuacaccuugguuucucccugugcggugggagcuaacgguuucuccgucagaaugguugagaggauggcaugagaugcguacaugacucagcacagucagugcuuuggggggcagcugcauuuucgcccaugcgguccccagucccccuucuucuggcgacagcagcacauccaucauacuugugcuugggaugggggugguugaccccacugugggauuggagcuaugacacuggacuggccccacagaauaucccaugcucccagcucuggguuguaauugaggaaugagcacgugacucagaccaggccaauacauucaguucggugacuucuguuggaacuguugggggaguuccugcugcaagcguugcugaaaggagaggcugggaacugcaggugccacagugccaccacacaggagaggucaccugagaauacaucuaaugccaaggacagcugagagacaaggggaugagaccguggauccagccauguccgagauugcccuagaacucucaaugauaugauccagaacauucugcuaauuugcuaaucuaauuugaauccguuucuauucuaggcaaaccagaauccuggcaaaugccaagcucaauauguuuggagguucacccuucccacggccauugcucuggggcgagcgguguuccuuggccucugcagagacgaugccacagcucaucucccuguccucagucucucguucuucagucuuuuacugcacugacuguucucaaacacaggcuuagaagaugccuugacuccccacugccuggagaucaugucccaacuuccucagauccaccugcaaagcucuacaucugacucuaauuuccuuugugcgucucucccaugaccuuccccucuggguccaugcauacucugugccccacccauauuaaccucuuccccacucugaaacgcucccuccacucucccaacccuguacuuuuccugggaaguuccucacuucuuucuuaccuaccugccagauccacaacuaccuucucuucugagaagucuucauggauggccccagacugagucaaugucuccuucuccugaaucaaugucucccuuguacauacuguaguaccucuugguguuuaugacuugagaguaauuuauacauuuuuuuugagagcagggagcaugucuuacuccuuucaggauccccugggauccuuacacaagauuugcucacucuagacccucccugaauuugcugacacaagaccuuggcuuccagcugacaaacucugacuaccccguccccuccccucaaccauacucuaggagaggggugccuaaacuuugggucacauuuccucuucaccaguaaacuucuuuuuuaaaaaauuaugauaaaauaugugugacauaugauguaucauuuuaaccauuuugaaguguacaauucaguggcauuaagcacauucacaaugcugugcaccuaucaccccuaccuaguuccagaacuuuuucaucaucccaaauggaaacucuguacccaguaagcagucacucccuguuccuccuuucuggcaggcccugccaaccacgaaucugcuuucugucccuguggcuuuaaccgguucuggauaguuauaugaaugcaaccauacaauaugugacauuuucggucuagcuucuuucacuuagauaauguuuuugagguuuauccacaugguagcauguauccauacuucauuccuuuuuauggcugaauaauauuccaucauuaucuaucucucuaucugucuaucuaucuaucuaucuaucaucuaucugucuauccaucccacauuuuguuuauucauucaucaggugauagacauucguguuguuuccuccuuuuggcuauugugaauagugcuguuacacugugauacaacuucuguuugaacaccuguuuucaauucuuuugcauauagaccuaggacuggaauuaaugggucauauggaaauuuuacauuuacugggaagcugcuuauccuugcuuucuccaagccucaacaacaugcugggucuauuuaacugcuuucacgcugagagagcccaagguucuuagaagggagcgauuucaucuugucgucuccugauggcaaucccuaaaggauguuccuaguuuuuaauacugcccucuugcuguuuagagcuuuccuuugucuaagcuauuucagacauauuauuuaauuuauuccucacagaaauacuguaaggaggaaacgauuacgucugcuuuuugauguggaggcugacagauucagaggaugaagugaugcggcaaggucacacagccauuaggagcccagcugagacugaccccagcccagugcccuuuccacgccaccacagcggcccucucucaauuugccucucuuuucaaagucuuuguaaaauagccaccaucugaaauguauucucagacccaccauuguuuagaaaugcccucuugguaggcaacugguugaugcuggcauggaccucugcaaacacucuaccaguuggcaccucauuuguaaucgaagcuuuuuccuggggcagauucugccuguaccaaacagaccaauguuuaccuuuucugggucuucugucaccuucugcaauccuggguuaauguucccuuuugaugcugcuaugagucuaaaucugagugugucccacaagcucaaccucagcucucuaaauuuccucccuguucuuuuguucaacccaaggucaacccaagagcuuccccuucccuuucucaggaagaaacuaucccuuggaccaagggguccccugaccucuuuggaguagaaaagaggcacaaugcccuucagccugacauggugaaguugugucuauacugcuccuuggaagcuuccaaucuuaguguccuaguucuacaugagaccaggagacuguagaaauaagcaaaacaggcaaugauaacaauaacaacauucucuauccaucagaagcauagagcuuuuuaaaagcauacgauucaguggcauuagguacauucgcaauguugugcaccuaccacccuuaucuaguuccagaacacuuucaucaucccaaauggaaacucuguaccaaugaagcagucacucccuguuccccuuccccccaggcccuggcaaccacagaucuggugccuggugcuuuaggcauauuuacucacucaaucccccaacugcccuaugagguggaugccacuuugcagauaaggaaacugaaguucaaugugaugcugugaccuccagagucacagagcuaauggguggccaaacagggauugaagccgucagagcccauggcuuccccauuccagcccacugucugccucucaggcagaagguuugugagcugaccuugcucacugagagcuuuccuuagcaguucugcaagcagcaaggacucucuagaugccacgugauccauccuguguccacccaaguaggaauaccacuaaccacuuaucccaaaguuguauagaguucuguacaacuccagaucugggugauguugucaggagcucugaaaagaaagcuuauguguuucacucuauuugggaauaucagcgggagauagguuucugucuugcaggacaucucagagccuuuaaaaguaaaugugcaguauaaaucugcaagaaggggugaaaggauauaauguuucccaaauuuauuugaccaugaaacguuuuuccaaggaguaucucaaaguguccucuuuaaaacuccacucugggccaggcacaguggcucgcaccucuaaucccaacacuuugggaggcucaggcagguagaucaccugaggucagggguuugagacuggccuggccaacauggugaaaccugucucuacuaaaaauacaaaaauuggccaggcaugguggcgcaugccuguaaucccagcuacuugggaggcugaaguaggagaaucgcuugaacccaggagguggagguugcagugagcagagauuacaccacuacacuccagucugggcaacaagaaugaaacugaggaaagaaagaaagaaaaagagagagagagagagagggagggagggagggaggggggaaggaaggaaggaaggaaggaaagaaagaaagaaagaaagaaagaaggaaggaaggaaggaaggaaggaaggaaggaaggaaagaaagggaaagaaagaaagagagggaaggaaggaaagaaagggaaagagaaagaaggaaggaaggaaggagaggaagggagggagaaagagagagaaagggaaaaagaaaggaagaaaggaaggaaggaaggggaaggggaaggggaaggggaaggggaagggaaaucuccauucagaaaugcccuaaacccucuuagguuagaggguguccagaggugagagaggacaguaauuauguccauuggcccuggagcugggcugcccggguucauaucccagcccugccaugugaccuugggcaagcuguuucaucuuucuaugccucaguuuccucacuuguaaaacauggauaauaacaaucuugugaauuauguaauauaaacuucuuagaacaaugccuuuugugacauagggcucacaaacauucuaauaagguccuuggggccgggcggguuagagggggcagugagagggauuauguuaccuauaaugcauaaaacuguaaaacuccagauaauucaugaaagauuacacagauagcaugguuucauuguccucagggagggucagugaguuccagugggaggagaaagugcuaugcagaugguaguuagcugcuugauccaucuuccugggucuuuucaaguucaccaggucuccucuacuuagggagugcccgacaccuccuggaggccccucaaauucuggugccuaugaguuucaccacuuccaaggaacagaaaucuuguccuuuugucaccacccacuacuccuguagggcauacucaucugcccccagagcuggagugcugggagaagcuggcccuguagugugagggcagaguggccaggcucuagcggcugccuggaccaucauuuccaaucugagcaguaaaugucuaacgcaugagucaagugccuuguuaauaaaaaagagaauaaauaggcauucccuuuagcaguaaauguuuuuuuuaaaaauacaaccuuccauuaacuuuggaccugaugcccauucuaacugucaccaaaggacuugaaugggauuguagaaaauaaacaauaacagcugacucuucaaacacaccugcaguccuccuccuugucacugacagugcccagcugucaauuauugcucugagaugggcucuaucaugcaacuauugggaugaaucacugggcccuguagggugaaugguucacagaugaggaaaaugaggacuuggaaagaagauuugauuugcucaagagcacaacaugaguugaaggcagaaccaggccuacaacucaggaccacugcuuauacggucucuucauuucagcuuaggaaguggcaccagggacggaugcuggaagaccuugacugcccuuaaaccugagagguuucauucaugcaugcauuuguucauucauuuaauguaucuaccaaauaccugcuacaaacugccauggugcuagcuucccuuaauaccuuucuauaaaaccauaaugaucuaacccuuuuugaaaucuuauugucccagcucuacucucucccggccugaaaaacuccaaguaugaguuucuaucuguugaugggcugcaugcacuuugcaccaagggcaauauggccuuggcucugccacuuucuagcuguguaauccugagugaacuacucagccucacaaagucuccauuuucucaucaguaacauagagauaauauuauaaccuguaucacaggaugcugcaaaaauaugagauaauguauguaaagaacuuaacauaguauuuagcuggugcucaauaaaugacaguaauuuacagacagaaaugacagaaaguuacaguaauaagcacauuauuauuacucuugucaugugaaacaagucucuggagauucagcaaauggaaucuuccccucugggacucuaaaaagucaggcucucuuuguucaugugccuaagcaacuuuugugcuuuauaaacuauaggaaucgugauauagggacaacuugccaaauguuuucaggucuaaugcaacagauccuugaugucuauaaccaaccguaucuuuuuuuccuuucugggaccagcuggccugagaaauagucuuccucuaagucugauaaggucugugaaccccagaccuguuaggaauguuggcuauacauggagauaacugcaaggaaauggggcugcccuccaauguauuaacaagguuuaaaaaaacccauaaacaauggacaugguuaguuaucuauggaaguaacccaagaaauucucuguauaugggguugcagaguugagaggcuuaacagacaucucuagaaggcaggacagaaagacaacuauaaauaagugggugaugacauucuuugaagacacuuuuacuuuaagcaauuuucccuucuuuaguaagaaccccuauauaugagggauggcuuccccaugaccacauuuauaccccacaauccuguccccuggccaugacugauugacccugauccaagcuggacuuaucagauuauuucuuucaagaacuuagagaccaggagcuucuggaaccuagucauacugggccuguggccugggcagugaucuucagaguagaguaugucauccagggaaugcaggaugacuugguggaguauaggaaggaaauuuaaaauaaaaaccuucaauuuuuaauuaaaaauaguaacaaaguacacuuccuuaauauuuaauaaacagauuggcaguggugcugguucauguauugaaaggccaguuauauccaguuugugagcuguuguauggggaauucuacaguguuacggaacugauguagcacccucauguauccauuuguuuuuccugaagggugacacaguuugugugugcccaaguaaguagguuaauaaaacauauuuaucuaguuuuaaccaaaccuacuaucauaaaauguguaugcggcuuaaaagguuugugccaaaaaaaaaaaaaaaguacaaugaaaauacuucuacuaauaaagcuaacaguaauucucaaaaaaaaauuuuacaaaguaguggauaaaacugaaaauuuaauauaauaauucaggaaguaaggaugucccucuuccacaugagguaucugagcugguuuuccucugcccuccuucccuuucucccugcccugcccccugguucucugcugugugcuucaggaugacaccuauggaauguauaacuugggcuccuuugcuugcaggcugaguuuggccaagggaccaguaggggaugggaggagagagaggccugggccuuuccucccuugcuccagcaccacaucucuggcagugacugugacucuccuuagcuacagcucauucuggauggaaccucuucccuggcuccagagcucacuagcuucugguaauacgauuuucuucucuuuccccuugaagaagcacauagaaucaugaccaaagaauacuuauuuagggaaagcaggaaaauuguugacacuuuaaaaaaaaaaaaaaaagcaugauuuucaaaauauuauuucaucuuucuuguucuuuaaaaauuucuauuuuuauguuuuauaaaguaacgcauuaguacaauagcucaugaauaugauuuauaauaaagaaauauacauaaauuggaggugcaugcuaaaaaaauuuucucuaaacuaauaagaugcaacauccaaaaaacuugaagaccucuccuguagagaaaaggcuggcaaacuauaaaucaugcugcuauaaagacacaugcauacguauguuuauugcggcacuauucacaauagcaaagacuuggaaucaacccaaauguccaacaaugauagacuggauuaagaaaauguggcacauauacaccauggaauacuaugcagccuuaaaaaaugaugaguucauguccuuuguagggacauggaugaaacuggaaaucaucauucucaguaaacuauugcaaggacaaaaaaccaaacacugcaucuucucacucauagaugggaauugaacaaugagaacacauggacacaggaaggggaacaucacacucuggggacuguugugggguggggagagcggggagggagagcauuaggagauauaccuaaugcuaaaugacgaguuaaugggugcagcacaccagcauggcacauguauacauauguaacuaaccugcauauuguacacauguacccuaaaacuuaaaguauaauaauaauaauaauaauaauaauaauaauaauaauaauaauaaagagaaaaggcuggcaaguuccugcugcugggaucugaaagcugcccuggguccugccuuccugaggcauugcuggcuaccuaccuuuuccuuugauuuucucaaauaccuuauaauaaauccuacuuucucuuaaguuagccaacauagccuucugagaucuggcaaucaaagaacuuuaaccaauauauaggugggaucugcaauuucuugugugcugggacagacuaugugaauaucacauaauaacuaccauuuuauagagcauuuuucuacagcaaagagaaaggcuuguccaaacuucccagaggaaagaggcccuuccugagcucuggaagagucucucugcuguaggcagagguggcucaucaggccacaucauagcuuaggugacccaccccucagaacuuucugccuucuuaccuaaaucucuaucuaucaagcauuuuggucauuggaaaggguuugucuccuaucauauacuggcacauagacauucagaauugcauacuuggcugggugcaguggcuuacaccuguaaucccagcacuuugaaaggaggcugaggcagguggaucacuugagguuaggaguucgagaccagaauggccaacauggugaaacccugucucuacuaaaaaugcaaaaaauuaucugggcaugguggcgcaugccuguaaucccagcuacuugggaggcagagguugcagugagccgagaucgcaccacuguacuucagcgugggugaugcagcaagauuccguucccaaaaaaaaaaaaaaagaauuaaaagaauuguauacuuuaguaaucucagugcuuuagcaggcugaggcaagaguaucacuugaguccaggaguuugagaccagcaugggcaacauagcaagacccugucucuaaaacaaaaaaacguuuaaaacauuagccaggugagguaguauaugccuguaguccuagcuacuugggaggcugaggugggaggaucacuugagccagggaggucaagccugcaagucagcugugacuauaccacugcacuccagcccaggggucagagugagacccugccucucuugaaaaaaaaaaaaaaaaauuguauacuucagucucuugugaguuugauuauugugagucagucucuacauaagcaaucaacuaaucaauuccaggucacuaaccaggcuuagggauagguccaggacucuagaacauccccaaggugaugcuccuuggggaagucucuuagaagccaacuagccagguuuaucuugacaacaccuagccuuaucaucauugccuuccaaacuacaacggggaccaguuagaucucaggugggaaacaagaaagaugucuuagguaagaagcccaggaagacauuacauucuuucuaccauacccauacaagucaaaaauaugacaagagaguccuuggggaaaccugaccauuugggggcauccaaaauagaggacucccaugugcucaauauuaaucugggcuucaauaauaauaauuacuuauuggguacuuauucagguauaaguacuuuagaucuagcaauccauuucauagguaaggggacucagagguuagaucauucgcccacgucaaacaguaaguuguggggcugggauuugaacagacugggugaccucggcaacauuuacagacuuuuagggcacaaacuuuggagagccauagaaagugacucaagacacacaauguaggacauggcauuucuugccaguaaaaagcuugugauucuaaauuuguauuuuuccuucuaaauagaggaaggaacuuguucauaaacaagacuaggagaccugauaaagaucauuacauacugaaagaaaccaagagaagugcaaaguagagcaagccuaguggggaagcugcuccagugcccugccccgagagcucaggaccucagcucugagcagcagcacugggaccuccagggcuuuguucuuauaggggcaggaacaaagggucaggcauuaucacucuguccugcagccaggucuauaggccacagagagauggaaagagauggggcuugguggucugaugguuuugguuugacucucauucuucucauacuaguuacuauccuccuugaaucaguuuguucacaaauaccucccuugcauggcuaaaguacagauuugaugagauauuguauaaaaugugccuggcacauacaaacuugcucaaacaaugguaguuccuuucccauauauuuucucaucuaucuguaagaaguaacccagaagaaaggaguuaagagaucacuugcucccugucuggaguugccuaaaugaaacuucugugaaaaaaggaaaauucaucgccgcagaaacuucuagucagaugcuugccuugucuaaggaaggacucugcauuaaacaaguuccccaccaggcaucucuggagaaaagaugaggauugauuaacuggaaaagggaggagagggggugcccaugggaccauguggcaaccccugcagccucggcccugccugucucucacuagggcaggacacaagucuugccaggugcccaugggagaccagccuugcaagugggcuuuagccaggcccucauagugguaccccagagugccacgcucuuccacaccaagagaauggcuaucugauggugaguucugagaaguaccugcaugaauagcucagcccucccucuucuguuucucuagggaauuagcugcuuucaggggacacacauucugcucuguuucuccaagcuuuaauauuuaaagagcccuacuuuccccagugggcacccccuagggcugggggauaaaucugcucaaugcaauauuagaaaaccuacuugccuguugauccaaacacuuuccaacaccagcuucaucagucauacgggugauauuagucucugaauucccaacaagccuuaaagcuucagugaaggaaagagguguuauuuauugggccuccuuaaagacuucaccagacacagaugcccaauccucuugagaggaaguccaccacucuccuugcgguguuuuuggaguugagaauaggacccaggacuguggauggucagagccucaaacccagugcagaagucuucuugauggaaucucuggaggggaacagacaggggcuagaaauaauaagaccuaauguauaccgagugcuaagaauagacagugggcuaagggauuuagcuuugcuuuuuuuugggggggggugguauuuaacuuuguaaaauggacacuaucauuacaggucgagcauuccaaaucugaaaaaucugaaaucuaaaaugcuccaaaaugcaagaauuucuggccacuggcaagacacucaaaggaaaugcucacuggagcauuucagauuuuggauuuuuggauuugggaugcugaacuggguaaauaugaugcaaauauuccaaaggccaaaaaaaaaaaaagugaaaucugaaacaccuguggucccaagcauuuugguaagggauacugaacccauauuacaggagaagaaacugaagcgccaacagauuaggugcagcucaagggauacagcuggucagugguggagccacacggucacuccaggguccacacuuuccauagggacacugugcugccuccauuacaagaugucaucuccccacugugauaauaagggaagagcuggccaacacugagcccaccuccugacucagagcccgggguuauuuucaccacaccuguaugagcaaagucaagaaugucuucaggcuuucuucuccuccugaugagccaggaagcuugggcucucuggaaacacccucuugauuugcuuaucagccacagaacucucuguggccucucugugucccuucccugguggccacucugggaaccacaucccaccccuagagccaggcugugugcaguguauagucucaucccucucagccucucucauugagcccauugguuccuaaauuccuguugguuuugcugggaugacucaacuuccccaacacccugcacucaccaauaccuggauuccaccaaguucauacaacccgauuuccaccaagccgugguggaaugaccugacucauuuauacacuaugcucacaauuuuucccaugccuguguuuuaccuaugccuuuauuuacuuaauauucuuucauuugaguagcaaugggccagaaaaucaagacugaaaccccgguuggccauuuacuaacuuuguguuguuaggcaaguuucuugcccucucugugccccaguuuccugaucuguauaaggaggacaaugacaguaacuacuucagaggguugcugugaggacugaaugagcgacugcagguaaagcauuaggacagugccuagcacacgguacacacucaccaaguguuagcuaccauugucauuacuuuuauuuaaaagggaaacuuuauauuccuaccuuaaauggaaaaagcaauaccacuuaccacaaauagaguuauaaaaauaaauaaaaugaaaacgguuauuaaaccuuagcuaaggccugcucucauuuuuuuaagaagggaaacaaacagaaagauggugaaggcauaugaggcuuaaaugagggugaccaaccuuuugaauuuguccaggaccugucccaauuuuagcacuggaaguccugcagcaauucucauucccggcugacccuggacagucggucaaccuaccucaaauagaggcuuucucuccuucauucaaaggaauaaaaagaacuuaagaaggaauaauguucuuacaaugugauguuguguguuuaaggcugggucaguaucccacauacgaucaucuugcagaacaagcucacaccuugggccacaccacacaaacccaccucugagagcugagucuccaaaugcuauaaaccuauggaagagccaucaugucacaugugccacugagaaaguccccaaagaaaaaucacauuuguaaaugccaagaagaggaacagugauuaaauuguugcacggcuaaaaugacucuauguuauaaaaccauugaaaaaucauguuuuggagaaucuuuaaugauauggaaaaaggauuauauuagaaugcucaguuuuaaaaagcagacuaaaaaauagcauauacacuaagauccuaguuuuacaaaauauagagaaauguaaaggaagaaacacaccauaauauaaacaauacuuaucacugaggaaugguauucuagaggguuuuuuauuucuuuauauuuauuucugaauuucuuauuuauauccacuucuauauuuuccaagaaagucuagcaaagaacaugcauuacuuuuuuuucuagaaaaaacugaauagaaauuacaaauuacaaauaaaaaaguaauaggaagaaaguaaccagagcugauuaagcccagccuuagcagacuuuuuuuacaugucuucuccgcuaggaaaaguuuucagucuggccgggugcgauggcucacgccuauaaucccagacuuugggaggcugaggugggcugaucacuugaggucaggaguucgagaccagccugggcaacaugacaaaacuccaucuuuacuaaaaauguaaaaauuagccaggcauggugguacucaccuguaaucccagcuacuugggaggcugaggcaugagaauugcuugaacccgggaggugggguugcaccacugcacuccagccugggugacagugcgagacccugucuaaaaaaaaaaaaaauguuuccuguccgaccaacuguccucugcuuuccaccucccuuggagaaagcccuugcagagaaggcagggcuuguccagggucaugggcgugaguuaccucugcuaagacucugaauuugaaggcccauuugugaggcugcccuggacugucgccugaacucagagucuagccuccaagguccacaggacuaacaugauauccccuuucccucuauucgugauuuuccugugauuuggacugugacacucaguaacugccccaggaccuaaguuacuaacuagcggcagggugacaucuaaugcaggaagcgcccgcuuuggaccaagguggcuugagcuggaguccaccaccuaccagcuguaugccucucuccucaucucuaacaugaggcuuaaauuaaauaacagaucuagcacagauccuggcacaaaguagaagcucaauuaauaccaauuuucucccguuuccuuuuacauucacuaccugagaacucagcucuccaucucccuccucugacucagcuccccaaggggcaggggcagggccagagucugggggccccaagcucucuucucccuaucuacccaggccucugcuucuauucagucagcaaacaaucccucugcugaccaauaagccccagagagagcggcugaggggcaguccaggcucugugaggugacccaggagaggaggcagggugagagagguggguaacuucaggcccccaccuuguguucuuuagggucaaacuagaugaaucugaucaucaggcacauguacaaaaucaacccagggcccuguguaaccagaacccacuuuauaagcauuguguccauuuauucacagaaacaugauugaaccugagcacuucgugugcucccggcauucugggugcuagacacacaacgggugaggaacgggauaaggucuccgcccuugcagggcucagucugcuccuccaggagguguggggugcuucuguccaccucuguuacaaagacuuagaggagaaaggcagggcuuuuuagaaagcugaggacccaucacguauaguucagcccaucagucaaggaaccuagcuuccucacacagacccacagaacuccucauccccaaaccaugagccuccucagccucccagggauucaguuucaaguagguuucacauggcccuaacuuccucacccaagauacuauuuaaauucccugcuuugucacuugguggcugggugagcuuggacgagucauuuaacauccccuagccccacuguccucaccuggagcaguaagguaaagauacaucccccauggcauucugugagggggcaugugaaaucccucguggaaagccucagaugcaccauguugcaagggggccggugauucccccgcugcacucugacauggggucccaagcagacgggagcugaccauggaggucaagagcagagccuccagagaccauggccuggggcugagcaucagcugugcagucucucugugcuaaaguguccuccucuacaagaccaggguggaaagaaugaccccugcuuuguagagcugugggagucaugaguuacuguaugggaaggggaacaguguucaauacauaguaagaaccauguguuugcuguuuauuuucuuucagaaauauauuuauggggauaaccaaucauguaguagcagcuagcacaugguuaucccuccaagaugauaaaggauacaggaaugccucccuuaccuccaagcauaaagauaggugcauccgcugugaauauaaacagccacccaccaaauaugcaugcacacacacacacauacacgcacuauggaaucauggacaguacaaacaugauaaugacaacuguuuuguccauuaggucaaaaaucgcaagacacaauuggaggcagcaucauacccuggcauucacgucuguguugagaggcaugggcacuggaguuagagucauacaaacucauacaggguuugaguccuagcuccgcuccaucuugguggaacgaccuuaggcaagucacuuaaccugaguucccucccccauagaacuguugggguaggggagugcagggggaugggcaacuccaccugccucacuagcaugucaucgucccucggugggggcaauacaauccuuggcagguccugacuccuuuggacccccagccucacagucccaggaagcuuccuccuuuucccugcaaaagacucugcucagaccagauuuacuucccugugccaccccagugagcagccugaagaguguucagcagcugccgagcucugggaggcuggagugcuggccaggggucccagaccccgggcugcuguuuacucaaacugcagagccucuauagccuuuacaacuguuuccugggcaggagggagcaagacagcugggccucucucuggccucuggcuuccacuggcuuuuccuuuggaaaaagccaguucaaauggugcucacucuaggaaucgcuucaacucggagcccuggaggugagcagggccgggcacgggccgggcacauacacccccucuagggagcagggaagggcacaggccaggggaagcuggagacaaaagaggagacagggacagagauaaaaacagggacugugacaagaacacaggaugggaagggcagagacagaaauagaggcaggcuuaaggaucuagacaggucaugccagcccagguucaaggcagaggggcguagggggacagagagagagacacaggaagcacagaggggagaaagcucugcuuagcagacuugccaaagcugaagaccccacuguugccacaaaggggcccacaggaaagcuagggguugcaaucgccugucaggacccacauuuucacccugagcugugcacacuuuccaacggcaagcaaaaggagcacaaucuaguuaaguuaggacuggcaagauucacuucugauuuaaaacuuaagacagcaacaauaaagauacucagcugaaaugccacccaacaaagccagcuccccuggaaaguuaaaguuuagcacccccaucccagcacccuguaccuuuaaggaagagaagguucccuccgcuucccagccgaagaggcagguuauucuaggauauaggggaggcuuaccuaaa

SEQ ID NO: 21430 - RNA, 11535 nt, Homo sapiens
caggcuuuuguaacguucccagcgccgcguuugaauucggggaggagcggagcggugcggaggcucugcucggaucgaggucugcagcgcagcuucgggagcaugagugcugcagugacugcagggaagcuggcacgggcaccggccgacccugggaaagccgggguccccggaguugcagcucccggagcuccggcggcggcuccaccggcgaaagagaucccggagguccuaguggacccacgcagccggcggcgcuaugugcggggccgcuuuuugggcaagggcggcuuugccaagugcuucgagaucucggacgcggacaccaaggagguguucgcgggcaagauugugccuaagucucugcugcucaagccgcaccagagggagaagauguccauggaaauauccauucaccgcagccucgcccaccagcacgucguaggauuccacggcuuuuucgaggacaacgacuucguguucgugguguuggagcucugccgccggagggugagugucgcugcuggggaacuggaacugccugcggggcaguuggagcgcccagaccuggagcugcuggaaagaguacccagcaagggagagccugggacuuggagcugcuagagaagggugcugggagccucccgcuuacguauggaaagugucuuugguaagggcuucuuggcucugggagcugcuagaggaggggguuccagugaaguggagucugagucauguugcugauagggaagucagcuucuggacgcgaggugcuggggggaggggugcugguaauggacgcuagggcccuggaguacccagggaggagucccagguuagugaugccgcgcccugggagcuucugggguggagcugggucaguggggggguaguuggagccagacuucgggccuuccgggggagauacgagucaggaaagggaucuggugcuggggacucggagcuuccggaguggggcugagagaggacccccagguaaggggggaagcuaguaggagaaggggugcugcgaaugguuguggacaguguuaaggcaggguccagaugccgcugugcuggagaaggaauggggugggggcauagggaaggagagaaacccaccaagaccccucuuucaucccuugggaguccagaguccaguccugugcuuccuuugccugguaacccucucccuuccccaccggccucaauccaccuccccaucccuccugcccucuccuucccacccacagucucuccuggagcugcacaagaggaggaaagcccugacugagccugaggcccgauacuaccuacggcaaauugugcuuggcugccaguaccugcaccgaaaccgaguuauucaucgagaccucaagcugggcaaccuuuuccugaaugaagaucuggaggugaaaauaggugaguugcugagccugcaggggugcuugacaucacuacaagaggcuggaauuuggaggaggcugggagaaaggaaggagacaacccacaagucaguaucuugccuacagaugcauuauuuuuuugugccccaaugcaauauuuuuuuuuuacaaagaauuugaauuuguuuuuauuuuuuaaauuggaagguuugauugaacaaaaaguuugauucagaacuccuuuuaaacaggugaaagcuucaguaauacgaggacagcauuuucuuagggcagcccuuugcugggcuggaaaacagcuguccccuucagacuucuuugccacagucucuacuccucccuauucuucacagacuugccaagucuuggagguuaacuugcuugauccuugaaggcauuggaguuuuacuaucccugucaguuccuguuucaaagcauagccccuuucuaaaaggaggggugagaagugucacuggaggcaccucccuggugucagcaugggaggaagauuccugggcaagccuugcuacauacaaggagcagaggcuugugggaucagauggcccugguucuggauggucaaaccuuaacuagccuucugcauugacagaugucagaggcuggcaucuaaguaccaacucuuccucccucugucccaggggauuuuggacuggcaaccaaagucgaauaugacggggagaggaagaagacccugugugggacuccuaauuacauagcucccgaggugcugagcaagaaagggcacaguuucgagguggaugugugguccauuggguguaucauguaaguugggaguugucucuggaccaaccuggucucagcaggggcaacuuugggacauccuaccuggcugaccuuuucuguggaccuuucggccugcuuuacagaaagccuacuccaagggacaagucauccccaaacaaagccuaauugucauaucuuucccugucacugguguauccugucggauuucugcagccuaggucauggguacagcggaggaggaggagggagagucuccacaaccuuacuguaguccuuugcuagaguuguccacagggcagcaucaccaucaucugggaacuuguauacacaaucucaggacccagacuacuuacuggaucagaaucuggauuuuuaacaaggucccuuggugauucccuugcacaauaaggucuuaaacaccgaugagcauuagcauggugggggaaauuaggccaggaguuacagauggaaagaugaugugccaguggucugucuggauuaagaccaucagcagcgguugguggcaggcagaggcuugggccuuuucagguguuaucuuucuuguuuugggccuagguacuggagaguuagaaaugaguuguagcaauggcuuucauacgucuuugcagugggguuuuuucaaaugaaaacuugaagacuuaaguacagaacugcuaaagguggagcugcuucuguaagcgcagguagcccuuugaccuguuuugcaugacaggcagcaucugaggcccuugcacagaguccuagaugaccacaggcuauagcuaaaaaaucacuggcccuuaagaauccuggucucaccauguguauucugcugagggcuuauucuagccaaugucauggcuucuggggcugcucaguggacuuagggauugucuucaggggccccagaguuagagugaguguccagaggaugccugaccuuuguucugacccugagaugauuucucucaugucuggguuguggcugggagacuggugccaaauccuaccuugugcuuacagguauaccuuguuagugggcaaaccaccuuuugagacuucuugccuaaaagagaccuaccuccggaucaagaagaaugaauacaguauucccaaggugacuaaugaugcuuuaaguuuacauuuauuuuguuuuccccagaagcuguuuauggagcccagcaauauccuaggaccagaaauaggucuaucccaccucuaagguagccacagagcuugagagggccugugucugaaauugcauacagaacuugacauguaugugcacauaagcauuuuuucuagggggagagaguuggcagauucucaagagauuggguaacccaaaaguuguguaaaaagcaaaaaacaaaggagguaggaaggaguaggaggcaaaagugcuuaaucuuuagaaaugguuuaucuuaauucaaauggauucugccacuuagcgagaucacauugggcaaauggccugcaucuuuuuuuuuuuuuuuuuuauuugagguggaguuuugcucuuguugcccagugcaguggcaugaucuugacucacugcaaccuccaccucccagguucaagcgauucuccugccucagccucccaaguagcugggauuacaggcacccaccaccucgccuggcuuuuuuuuuuuuuuuuuguauuuuuaguagagacgggguuucaccauguuggccaggcuggucucgaacuccugaccucaggugauccacccgccuuggccucccaaagugcugggauuacaggcgugagccaccauacccagccuggccugcaucuucugaaccauaguuuccauauauaaaguggaguuccugccuuggagcaccucacagagugccuugcauguggugagugcucucagaauuaugaaucacugugaaucccagggcuuccuaauggcauaguugugugcauuuucuuuuuuuuuuuuuuuuuuuuuuugagauggagucucgcucugucgcccaggcuggaaugcagugguacaaucucggcucacugcaagcucugccucccagguucauggcauucucccgccucagccuccugaguagcuggaacuacaggcaccagccaccaugcccggcuucuuuuuucuguauuugugguagagacaggguuugaccguguuagccaggauggucucgaucuccugaccuugugauccaccugcuucggacucccuaagugcugagauuacaggcgugagccaccgcgcccggccauggugugcauuuucacaaccaccaacagaaauacauuuaaaggaauagcugguuccugcagaagccuagcacacagccaguuugaaguguaguguccuugugugaagccaggaggccugucaccauaaggacagacauaguaaauccaucacaaagugucaguucacugucagagacagcauggaaucaagccagcuagacaaggccuucacccucucugugccucacuuuccuccucugugaaaaagggaugauaauagauccccaccccuuagaugaguuggugagggcuaagugagcuaaacacaggagugcuuagaaugcuuuccuggcacauagugagugcuaggaaagugaguugguguucggccacaguccauugacccuucugucaauggugcucaguaaagcugacaguggagaacuuggcauugaaccaaguugugaaccacugaccugugguguauuugagacugggggcugcaugugggcuggggaccugcagcuccuuugaggccguacuguacuccagguccccuucacauucugcuuauggcugucccucucucugccccagcacaucaaccccguggccgccucccucauccagaagaugcuucagacagaucccacugcccgcccaaccauuaacgagcugcuuaaugacgaguucuuuacuucuggcuauaucccugcccgucuccccaucaccugccugaccauuccaccaagguuuucgauugcucccagcagccuggaccccagcaaccggaagccccucacaguccucaauaaagguacaacaagggucuggguaagagagcagaccccccagagaaagcccagguuguaggggugugugcagcuuagucccuggcccugagagcucagguguggaguaggacaggccucuguccuucaauccgugguuccaaugcccaucugcuucucggcccugccaggaaagacugaccuuaccauggcuggauaaacguaccaugcccaagaagaagaaaauggauugaaugccaagccugaaaaauucuuucaaaucacuuuaauuaauuuaauuuuuuggagacagggucucuccucuauuuuccagguuggagugcagaggcacaaucacagcucacugcagcuuucaacucuagggcucaauugauccucccaucucagccucccaaguagcugggacugucaggcaugcaccaccaugccuggcugacuuuucuaauuuuuguagagacaguguuuugccauguugcccaggcuggucuuggaacuccugggcucaagcgauccuuucaccuccaccaaaguguugggaugacaggcaugagcugcuacaucuggccuuuaaaaaaauuucuaacacuuuuucaugauucauugaaaaacauaaaaauuuccuuuuuuuuguggcgugaucccggcucacugcaagcucugccucccggguucacgccguucuccugccucagccuccugaguagcugggacuacaggcgcccaccaccaugcccggcuguuuuuuuguaucuuuuaguagagacgggguuucacuguguuagccaggauggucucaaucuccugaccucgugauccgccugccucggccucccaaagggcugagauuacaggcgugaaccaccaggcccggccuuuuuuuuuuuuuuuuuuuuuuuuuuuuuuuuuuuuuuuuuugagacagggucuggcucugucuccuaggcuggaggggagugguaugaucucgauuucacuaaggauacauaguuuuaaaaagucacuugaaauacuuuuuuucucuguggauauaucaccaauuugauguacaacuucaguucauuuuucaguuuucaauuuuuagguauugguuuuucuuaaacuucauuuuggaauaauuuuaggcuuauacagaaaaguugcaacaacaacaaaaaacuccccagaguuccuacauaccuugcagcaauuauuacaguggaauuuuuuuugagacaggucucaggacuugcugucacccaggcuggaaugcaguggcucacucauagcuuacugcagccccaacauccugggcucaaacagucccccugccuuacccuccagaguagcuaggacuacaggcaugugccaccauacccagcuaauuaaaaaauuuuuuucuuugggaggccgagguggguggauugcccgagcucaggaguucgagaucagccugggcaacauggcgaaacgcugucucuacuaaaaauacaaaagacuagccgggcgugguggugugcaccuguaaucucagcuacucgggacacugaggcacaagaaucacuugaaccuggaaggcggagguugcagugagccgaggucucaccacugcacuccagccugggcaacagagcgagacucugucucaaaaaaaaaaaaaaauuuuuuuuuuguaaagacaagaucucacuaugucgaccaggcuuaucucaaacuccugcccucaagugauccuccucggccucccaaaguguuaggauuuacaggugugagccacugugcccugccuagaaugauguucuaaugguaauuuuucuuuuccucacuuuuuuugcauuuaauaauuggaauucuucuguaaggaagagcuguuccuucucuccgauugauuuauuuauuugguuaugucugaaauagacucauggauauuuuuauucuuugggcuauauuuuaaaggauuacuuauuucucugcuuuuauuuauuuuuuuaaauuugagacagggucuugcucugucucccgggcuggagugcaguggcacagucguaccucacaguagcuuugaucuccugggcucaagugauccuccagccucagccucccaaguaguugagacuuuaggcaugugccaccgcgucugaccaauuuuuaaauuuuugguagagaugaggucuugcccacacuggucucaaacuccugagcucaagugauccuccugccucagacuccuacuuuuuuucuuucaguuuuaauuuuuuauauagcauuuuaaaaacuuaaggaaauuuucaguuacccgaagguggagagaacuguaugaugagucccauguuucaucuauuuuuacuaguuaucaacauuuggacagacuguuuuauuuauuccagccuccugccuuuuuuguuaccgguguuuuaaaaaauuauuauuuacuauuuauuauuauuuauuugagacauucuugcuuuguugcccaggcuggagugcuguggcaagaucauggcucacugcagccuccaccuccugcguucaagugacucucccaccucagccucccaaguagcuaggacuacaggugugccaccauguccagcuaguuucuguauuuuuaguaaagacaggguuuugccauguugcucaggcuggucucaaacuccugagcucaaacaaucuaccugccucggucucucauaguguugggauuacaagugugagccacugggccuggccuugcuggaguguuuaaagcaaaucccuaauaucuuauuauuucauacccaagucccuaucaugacaucguuuuuuaauugaaaacuuaaacauuuuauauuauacaaggagaauuagcacaugguggugggggaauaaauaaauaaggaaaaagacaauaagaauaaucuguguuucuacugcccagauauaaucagcguuaaaauuucauguuaucuuuucaagcuuuuuugguuauaaauaagcauauaaagcaaauuuugggguggaaaaaaauuucuuguguuuuuauuuaaaugccuacugaauccauucuguggaugaacugaacuacucagcccuuccaucugccuggaugcugaagaugcuuuccauucuuugcucaaagcugggcagcucugagcugcuggugccuucaagcuguuugccugaguggcaggucauccugcagggccacaccguugggucagaggccacggcuucugaagaucuguugccucacagugagcacuaugugccugucaccugagcauggcagcugcugcucuaguaaccaggcacugauucaguuuccccaaagcagugguagcuaagagaauuuuucuuucggaagaguuucagcuguggcaggggagucccgugcccuucccaacgccccuguuuuugucaccuuccuaggcuuggagaacccccugccugagcguccccgggaaaaagaagaaccagugguucgagagacaggugagguggucgacugccaccucagugacaugcugcagcagcugcacagugucaaugccuccaagcccucggagcgugggcuggucaggcaagguggguacugcggggcccugggcggggcaggauugcuuggggcaucuggaaaaggcaggaggaggcuuggccaacaaagcacuggugacuuguucaggcccugucugcauaggaccauugguuuccccauuuccugauauccaaggcccugcuuccguggcuccugccgccuuuucugauccgucuuuuuuacucuagcaccucgaugugccaccuucauacgcuguuucuuuugcucaguaaguuccuauuguaucuucaagacccuugaaauaacagacccagauguacugcagccucagggcuuucucccugguccuggcacgaaagcacuucuuccagacaccacauggcucacacuguggccuccuucaagugucugcuccagugucagcucugugagcaucucccuggccccucugcuggugcuucucauccucuugcccacugcauaguucuccauaacacuucucacccaacauaguccaacauguccuucuuuguuuauuggauuuaaauuaagggguuuguugcaugcacugaacguaacauuuugauguguuugcaacuggcuucugucuucacaguuucuuaauuacuccaaacuggaaaacuagaugccucugacucuuaccaugauagaagucacugauauuuugcccauacuuaaauugauuagucuuugccccuacaaccacaguguaagcuccguggaggcugggguuuugucuguugcucacugaaccugcaacagugccuggcacgguaggccuucaguaaaugggucaguggaaugaaggagugaguggaacuuggugcgcugugcugagacuuucucugcagagauaucugugcugcugcuugucugagccugcuggcagcagaggcccugcuuugcucuucucuggggcccuaggccucucaacugagcccagguggggugcccagcaggcuucccuguucccuggugugggccacauguguggagcagaggggaagaggcugguccugaccaacuaacugucugucuguuucugucucagaggaggcugaggauccugccugcauccccaucuucugggucagcaaguggguggacuauucggacaaguacggccuugguagguuucuuccagaacaggugggugacucaggcacagccaggugaccuuuucaguuguuacagacucuggccuuuuugagcucccagguacuguucucagugcccuccucucuccaucccaggccucccaguuccagcucccagugcucccugacuccccagcuuuuuuuuuuuccagagacaggguccugcucuguagcccaggcuggagugcaguggcacaaucauggcucacugcagccucaaacucccaggccccuaaguagcugugacuacaggcgugcaccauuaugcucagcuaauuuuuaaaauauuuuguagagauggggucucauuacguugcccaggcuggucucaaacuccugggcucaaacaauccuccucccucagccucccaaagugcuggaaucacaggcaugugccaccacgcccggucccacuccccacuuucuauucccccuuucugagaccucucuccaccgaucccuaggguaucagcucugugauaacagcgugggggugcucuucaaugacucaacacgccucauccucuacaaugauggugacagccugcaguacauagagcgugacggcacugaguccuaccucaccgugaguucccaucccaacuccuugaugaagaaggugagugccguccggcccauggggggugguguugcagaagugggaccugugcuggaggaucagacucuaauucuggaaccccuuaccuacuuuucauccagaucacccuccuuaaauauuuccgcaauuacaugagcgagcacuugcugaaggcaggugccaacaucacgccgcgcgaaggugaugagcucgcccggcugcccuaccuacggaccugguuccgcacccgcagcgccaucauccugcaccucagcaacggcagcgugcagaucaacuucuuccaggugagcuggaggucaccaggcgcaggagagagcugggguaggcuccgcaugccuggcaguggcccauguggguugaauguggagugagcggcucagguaccuauaaccuguugugucuucccucuacucccuaacauacacuggccucugggaucgccaaccccugcugcucuucucuugcaggaucacaccaagcucaucuugugcccacugauggcagccgugaccuacaucgacgagaagcgggacuuccgcacauaccgccugagucuccuggaggaguacggcugcugcaaggagcuggccagccggcuccgcuacgcccgcacuaugguggacaagcugcugagcucacgcucggccagcaaccgucucaaggccuccuaauagcugcccuccccuccggacuggugcccuccucacucccaccugcaucuggggcccauacugguuggcucccgcggugccaugucugcagugugccccccagccccgguggcugggcagagcugcaucauccuugcagguggggguugcuguauaaguuauuuuuguacauguucggguguggguucuacagccuugucccccucccccucaaccccaccauaugaauuguacagaauauuucuauugaauucggaacuguccuuuccuuggcuuuaugcacauuaaacagaugugaauau

SEQ ID NO: 21431 - RNA, 4227 nt, Homo sapiens
uuugauauuuucuggauugugaaagcccuguugggugccuuccuuacccguacuaccucuuuuuuucaggauucgcccaggaccugacuaaaaccaguccuggcuuagaaaacaaccauaucugucaaaggaaagggagguggagcugaggacagcgacguucguucggugacaguauuuucuaaaccugauaugggggcucuuauuuuaacaacucuaagacaacagugucucuaagggauuuuggacauggccucugucauucugcagcugcagugaguccaaauagcaaucagaaaaggccaccagaugcagcccagugggugcccagccuggcugguagaagcugguuccauccgagcucagcucuucccacccacuaagcaagccccuucccgcucccucccuccgucuccucucccacugcacgagcccaucccccaccugacccuuucccccaucuccugcccaggccacagagcagggcugucacacucacaugccuccccugucuuuuuuugcaggucaaccugucugcucucagccaccgcaagcucuaacucaacaacuuccucuuugaaaauuuccucuuuguccucgggaaauaccaacugcccuggcccaugugugcuccugggcuguagccugggcuggucucaaaggcagcaccauugaguucuccccucuccacccaggccccacaggggaagucccuggcuccaggccccuccuucacucacucucacugguuccucuuggaggauggaaggggcucagccccugggauggaagaggagacacagacaaacuaaaccuggaaacgugcaguggggaagcgccagccagaccaguccccgagaccagggcaaaccccucucccccugccucuguucgcaggagagcgcgcgcgcgcgcgcgugugugugugugugugugugugugugugagagagagagagagagagagagcgcacaugcauguguacugcagaaauggagacuucaaggaagggauuaccauggcugagcugaagaacucauauuugggucacacauacgaucuuuccaugaagccuggcuuucuuuuucuuuucuuuuuugagacaggggcucacucuguugcccaggcugaagugcaguggugcaaucacagcucacuucagacucgaacuccugggcucaagcgauccuccugccucaacuuuccaaagugcugggauuaaaggcaccagccacugugcucacccuggcauucuguauggggcuacagacagaguuagauuuucugcuauguccaccccaucagagcaaagaugacacgcacguucucagcagucccugugucccccaugcccagguugacccucuucagucucugcaccacuucccacccccacaccgucuguacccacaacuaccccucccaagcaucgccaaauccucagcucuugcacacaaaccacacccacgaguggacacacgcaggcacugggguuucugagaacuacacccagccagaaacucggaggagaaaccgugaggccucuggcugccucuguccauggcuggggagagugugguggugugggccagggccagccuacaguccaugugcccugggaaagaucacaggcccgccugagagcaugggcugguggccccacccagccaugcuccaggcuggccuggggggcccagagcuaaaggugguugcgggcugcccagguuccacagcccuugcagcuacagggcaagggugcuuuacaaaguuaauccuaggagggaguuugccggguucucuuguccuucuucccagacucuggucaacccaggguggguucugggggaaaaggagaauugucaaagaaaucacagggcagauaaguuuggccgauggagacucagcagccguuuccaggaacaagaaagagggggaaauggugauggagauaaauagggguggaugaggaggguuuauucauucaguccacagacguugagaggugccagcccugcccugcccaggcgcuaguugugggugcugggugaggauggcagcaggaaauccagggcugagaagccucaugaggauucagagugaagaggugggugaggaggcaaggcgcggaggcucaugucuguaaucucagcacuuugggaggcugaggcagguagaucaccugaggucaggaguuugagaccagccuagccaacauggugaaaccccaucucuaccaaaaauacaaaaaagcagcugggcaugguggugggugccuguaaucucaguuacucgggaagcugaggcaggagaaucgccugaacuuaggaggcagagguugcagugaacugagaucgugcauugcacuccagccugggcgacaaagcgaaacucugucucaaaagaaaaaaaaaaaggagauucgggugaggaucagggugccggguggaaacaugggagcgagggggcagugggauggugagagggaaggugcuggaggcuggcugagauuccggccuccagccucacuauucaccgacacuuaaggggcagccccgucucccccuucgggcucaucaggagcuggggcguccacagccccauccucacuggccaccaguggcuccuccuccccuuugaggcuggggccugacccagacuucagcuccuccaucgccagggagcccuggcgagacuuccgucugccaaagaaaguggugagcgugggccgacggcuagaccccuccccaucggggaacccagagcccuugucgcccccggacccucccacggucacugucacggcccccuccucagggaccugggcuggcccagcccaggcguccaccaccccguuacgcuugccgccucugcucagcacgagggccccaguccgccgcuucugccgccggcgccacagcaggagcagagccacgaggacuaugaccgccagcagggccacaagcacagccacuggcagcaugccucgugaguucucaucuggguuccggaagggcacagugcuugcguugguggaggucguuggagacaucauuguagauaguuuuacgcuagagaccugggguccacuggccccgcuggagggcuccagagagccaguugucaugguaacaggggguccaguggucccaguggaggucuccagagagucaguugccaugguaacaggggguccagaggugccuuuggaagucuccagagagacaguugccaugguaagaggggguccagaggugccucuggaggucuccagagagcuagcugccgugguaacaggggcuccacugguccuacuggagguuucuggagaguucguuguuaugguuccaccugucacggugugggauccuagagaguuugcuguuaugggaacagcaggaugacugguugcaugagggguuuccuggggcacugaugacaucuugauggaaacuuccugguagguuguuggcucagguaaaggggaaccagugcuggcaccaauggaaguccaaagaggggaucccucauugauggaaguugagggagguagggcugaggucugguccccagugcugucggccuuagggucacuuguuauugaagugguguacaucuuugagcucaggggcucgcuaguagagaccaaaggcucuccggaggugggugucugcacugcuguugugcuccccagagcgucugggcuuaccaccagcaccccaaggagaaggagaagcguggccauuuccaggcaaacaggcaggagcaagagcugggaccugcaggugggcagccggagaagcagaacacgcgggaguugccggaggaccuggccgggccuccccucugcccacuucccugccaacggccaggcccaaccugcgguuuaacgguuuuuuccaugcuggcuuuuacuguuaucagaaaugacagaggaacagaugcuggcagcucccccaucagccccauccugaggcucccuccagccucagcagcuuagauuccagcagugaccagccccuccuggccuucccugacccugugcagcccaauggcucccaaucucuucccaucauaaccugucagagucuuuucaagccacaggcacauucccaggcccacugaggccccuaccccaccaagucucacccucuuaccggcucggcugauaaggacgcagcacuggggccaggucacuccaccaccucccgaggcuggggcaagacuggg

SEQ ID NO: 21432 - RNA, 12854 nt, Homo sapiens
caagauggcggcgcuaggcugacccuccugcuggugagggcucuggcgccgggggggacgggauccagcaggugugugcaggguggaggguguuuggggcuguggaacaccagccguucccacaucucugcucugugucuucugcaggugacggaaguaccgccuccucccguuugacgccccucaggggacccugcaucgcuccagccgccgcggccaugucugggccaggcaacaaacgcgccgccggcgacgggggcucagggcccccggaaaagaagcugagucgugaggagaagaccaccacgacucuuaucgagcccauucgucuuggaggcaucucuuccacgguucgugggcucuugccuuaacccucagaacuucccagagcccucccucuguucucuggccaaacugugcggaaucuuacacccacuuccccaaguuuagcaagguccgcguuacaggaccuugaaagaaagguuagaaagaagcucagaacacgacgccugucuucccuuuacagauaggaaaacagguuuccagggggcgugugacuugucaaagacuaaggauuuacaaggggacaggcagaaacaacgugagccuccucacaacaaagacacuuucgcuguguguugucugagccuccuuagauucuguuagcgguuagugugggaauaccuccaucucccaugcauugcagaugcucugcuccucuuucucucucugugauugguuugugggcccugcuugacgcucucgucggccccuuuguuuccuuugguaggaggagauggaccugaagguacuacaguucaagaacaagaaacuggcagagcggcuggaacaacggcaggcuugugaagaugaacuccgagaacgaauugagaaguuggagaagcggcaggccacagaugaugccacacuccucaucgucaaucgcuacugggcccagguggauaccuucugcuuucaaagaccaggccuugauucagcugccaauccccagauuccccugcuaggaaaggaguaucauguuggaaagcacuaagggauucauaacauuuuugauguuuucuccuuccagcuggaugaaacuguggaagcccuucuccgaugccaugagagccagggggagcugucuucagcgccugaggcaccugggacccaggaggggccaacaugugaugggacuccucucccagagccggggacaucagagcugagagguaggaccagagugcugggaucuggggagcuuaaguucugggagaaguccuggggaggaggggacuuugguguugggccccugaauugccuaucuuacuacuucucacgaaauggauuucauguuugggcaguaaagugcagugcacaaaaacacaggcuuuagacucugacuaacuugguuuauagagcaauucauguuuugacacccauuuguuucaaaacaguauuaugguugaguauuaaauauguauuugacgcuuccuagaaaugaguguugcacuugcuauaagggaggaaauuauaaacauaguaagcagaaaguacuggggcuccugaaacggaaugauugugugugcaugcaugugcgugugauucuaauuauauugguaaaguacaggaagcuucccugaggaugugauacgcaacucuguagcuuugaggaaauuacuuuaccucccugaauuucauuugucucacuuucaggauggagauaauagugcacuauagguuguguugauuaagugaaccaugaguauugaagggcucagucuggaacuugguacagagugguaguaacugcugcucuuauccucaugagggucuguccauuccuuccagaccccuugcugaugcagcugcggcccccucucagugagccggccuuggcuuuugugguggcacugggugccagcagcagugaggagguggagcuggagcugcaaggccgaauggaguucuccaaggcagcugugucucgugugguagaggccucagaccgccuacagcgccggguggaggaacucugucagcgaguguacagccgagguggguucuuugugcccauacugaagggguguccauccccaccugcaucuugauggcaccccuuccugauuccccuaaugcccgaguccaagggcggccagaauuucccaaggaauaaaucagccauguucuuggaagagguagguuaggcuguagauggggguuccaacuuugauuccgggauugaaugcuagagagauggguuggaggaguuguugaugccgguagaggcuccuggccagaggccccucuggagcacuugguguggguugcggauccacaaggcauagcuucaagggcucaggccuuguagguugacaggcuucucccaccuuaguucugccacccucaccuggacaugcugggaaaguggcuccccucucugagcugguuuccuucucugugcaguggggauaaagacuccuggcuuugucaugagaaaugggcaagacagcugguggaucacacuggguauauagcagacuccagaaugaguuaguuguuugccccauugcccugagcugggcucuuaccugggcccugccuucccaggggacagugagccccucagugaggcggcucaggcacacacccgagagcugggccgugagaaccggcgacugcaggacuuggccacucagcugcaggagaaacaccaccgcaucucauuggaggugaggagccgggggcuuugggggugugauuagaaucaggcaggauuuggguuagaugggcacucagggaccucaggaaccaagucccccauccaagcaucugcucccucauuguucccaguacuccgagcuccaggauaaagugacaucggcagagaccaaggugcuggagauggagacaacaguggaggacuugcagugggacaucgagaagcugcggaagcgagagcaaaagcucaauaagcaccuggcagaggccuuagagcagguggggcaggggugcuggggcaggugaggcaaggcugggcccuugggccuuagcuccuccccucuacauccauugccugucuguuuucucuccacagcuuaacucuggcuacuauguaucugggagcuccucaggcuuccaggggggccagaucacacucagcaugcagaaggugagcggcguuuuccucccaccccuucucacaaccucuucucuguugcacucuugaaauuccccucaggacaaaggacaaacauccaucucugaggcccuuccuggucacuccugcugcucuuuuuuucaugcauucauauacuuguugaguagauuuuugaacacuuagugcuaggcacuaggcauauuggcgagaacaaaauagaggucaaaacuuucauggaccagacaagaaauaaauaaaagaauauaucuuuagguucuacuugugguaacagacaagaaaucaguaaaauagcauaucaguguguuaugaguaccacaaagauaaagcacagaagagagagcuaagagugaguuggagucaguuggcaucugguggucacugugcccuuuuucccuuuauuagcacuuuaggccuuucuggaaugccuuccgugacuccccaucaguuaagagccuuaguucccagcaccgaccaugcaguauugaauuuucucccauuuuucugggagcccuuaggaaaguacuugguuuggggugucagaaucgaucauugcccugcacggggugcuugggguggaguguaugcuggggauguaagggaggccugcugccacgucuggcccugccucccauggcccugccucccacuccuuaguuugagaugcugaaugcagaguuagaggaaaaccaggaacuggccaacagccguauggcagagcuggagaaacugcaggccgaacuucagggggcugugcggaccaaugagcgccucaaggugggcugcuguaggggcugagagguccugggccuguaagggagggacugagcccugaauccuguugcugaucccauuugggcaucccugccccagguggcccugcggagccuuccugaggagguagugcgggagacgggggaguaccgcaugcugcaggcccaauucucacugcucuacaacgagucucugcaagugaagacccagcuagacgaggcucggggccugcugcuggccacaaagaacucccaccugcgacacaucgagcacauggagguauggcccuggaacaggcguuagggcugggcuaagggccaaaccguuaguguugacguguuugugccuuccgaggcccugugugccagccaggggucccuggggaauagauucuuccuaagauacugaguccugaggugggaccgaggggcuguguggguccuuaacacaucaacccacagagcgacgagcuggggcugcagaagaagcuacgcacagaggucauucagcuggaggacacgcuggcccagguacgcaaggaguaugagaugcugcgcaucgaguuugagcagaaucuggcggccaacgagcaggcggguauguggugaggauagggcggagguggggccuuaucugggagugcugggcccugguguggggcugcugcuuauccagaugcaagaggcuaaggccuuuuuuuucacagagccucggcuuccuaugcaaaacagggccugcacugcuuggcucccaggcacagugaggguccgccagcugggguggcugauggagcaggcacaugcagagucugagcugucagcccuguccucauucuucuggucugaugacgucucugucucucagauacuuguguuacaaagauuuaucaaaugccaccucugagccaggcucuguucuaggguuugggguuaugccagugaacaaaacagaauuccugccauguggagcaacauucugguagaagacagacuagaggaagacgaacuaguagaagaaaaauggaaaauguguuagcucuugacagauaggaaaguaaagcagaaaaggaagauaggaaguaucaggagaaaggguguugcaauuuugaauaggaggccagggaaauguacugggaaggugauauuuaagaaucuagaagaaguuaacuaacuuuugugaauguuacaguuaccuucucuauuaaagggaauuggauguauaaaaaaaaaaaagaaaaaaccuaggccagguguggugauucaugucuguaaucccagcacuuucggaggccaaggugggaggaucacuugaggccaggaauuugagaccagccagggcaacaaagugagacacuguuucuauuuaaaaaaaaaacaaaaaaccccacauauucuauauuagcaaaaaucguaugaauaggcagugucaaguuaauuuugggugaguuuccuugaagucagcauuauuuacuuugaugaguucaugcuccguugaggccgcaauguuccccuccugcacagugggagugauggcauagccucuuaccccacugagggguuggaguccuaacccaggaacugguucugacaccuuuacuugcugaugcuccuccagggcccaucaaccgugagaugcgccaccugauuaguagucuucaaaaccacaaccaccagcuaaaaggggacgcccagcgauacaagcggaagcuucgagaaguacaagcugagauuggcaaggugagaaggggccugccugggaaaagguuuggcuagacuccagugaacaccaucugacuucaucccucuuccucucugccuuugcagcuccgggcccaggccaguggcucugcccacuccacccccaaccugggccacccagaggauucuggcgucagugccccagccccagggaaagaggagggugggccaggcccugucaguacccccgacaacagaaaggagauggcuccagugccuggcaccaccacuacuaccacuucagugaagaaggaggagcugguccccucugaagaggacuuccaggguauaaccccuggggcccagggcccuuccucccggggccgagaaccugaggccaggcccaagcgggagcuucaggaacgggaaggucccagccuaggaccuccaccuguagccuccgcucucucaagggcugaucgggagaaggccaagguggaagaaaccaagcggaaggaaucagaacuccucaagggucuccgagcagagcucaagugaggcucuguuccugucuccuuccugacccugccagguggccuccagucccacucacuaagacuuccuccuguaccuucuugccaggaaggcccaggagagccagaaggagaugaaacugcugcuggauauguacaagucagcgcccaaggagcagcgggauaaggugcagcucauggcagcggaacgcaaggcuaaggccgaggugagggcagcuggggcuuguggggcauucagaaaggcagagcagaguccuagcucagcaggaagcagugucaagagaguuucuucuucccugugcuauagguugaugagcugcggagccgcauccgggaauuggaggagagggaucgaagggagagcaagaagaucgcggaugaggaugcccugcggcgcauucggcaggcagaggagcagauagaacaccugcagcgcaagcugggugccaccaagcaggugcggcccauguggugcccucgcgucggagcgcagggaguucccuucauacccuguuuggugccucuagugccugcaggaccuugaugaucuggguccccucuguaguucuuugcuucgcugcguuuucccaugguucccccacagccauccuguccacuucccacguuccaucuugucucugcccacuugcugcaggaggaggaggcucugcucucagagauggaugugacaggucaggcuuuugaggacaugcaggaacagaacgggcggcugcuacagcaguugcgggaaaaggaugaugccaacuuuaagcuaaugucagagcggaucaaggccaaccagauucacaagcugcugcgggaggagaaggaugaguugggcgagcagguccuuggccucaagucccagguauggccgccgccagcuugcagacuggagcuggagaggugggggucauggcccugaguccuccucugguccuuagguggaugcccagcugcugacugugcagaagcuagaggagaaggagcgagccuugcagggcagccucggggguguggagaaggagcugacgcugcgcagccaagcccuggagcucaacaagcggaaggugaggcugggccagggggacacacagcuugggcugcuggcucaccuccucaccuuccgguucugcucagagcacccgaugcaauagccugaggugaagccaggcugucacagaacagcucacacauauugaacauuuacaugugccagaccacaugcugaguacuugacaugcuuggucacauuucagucucacuaauccuaucaagaugguguuuacgggcgugguggcucacgucugugaucccaacacuuugggaaacagaggcgggagguuugcuugaggccaggaguuggagaccagccugggcaacauagugagaccccaucucuacaaaaaaauuuuaaaauuagcugggugugcuggugcacgccuguagucccagcuucucgagcaggcugacaggugagaggaucacuugaacccaggagguugaggcugcagugagcuaugaucgcacugcacugcagucugggugacaagagcgagacucugucccuagggaaaaaaaacaaaagauuuuugaguuggagucuuguucugucgcccgggcuggagugcaguggugcgaucucggcucacugcaaccuccgccucccagguucaagcaacucucccaaccucagccucucaaguagcugggauuacaggcgcgcaccaccacgccuggcuaauuuuuguauuuuuuuuuaguagagacaggguuucgccauguugaccaggcugguaucgaacuccugaccuugugauccacccacauuggccucccaaagugcugggguuacagcgugagccacugcaccuggcuggauuuuguuuuuagccucguuuuauaaauaaggaaacugaggcucagggagguggauuguucugcucaagagggaguggcccuaauauuuggguccaagccuccuugacuccaggcucuaccuucuaaccacucgcuggugaacuguaaaguggggaugauguucuuugucacauaguuguauuaaauagaagaaaugucuagcuuuggcuaaaggcuuaagauuaacauugauuuccauuuccucugaagcuguuuucuucuccaguuaguucauucauuuaagcaguauguuugugguuuuuuuguuguuguuuuuuuuagacggagucuagcucuguugcccaggcuggaguacaguggcucggucucaguucacugcaaccuccgccucccagguucaagcgauucuucugccuuagugucccgaguagcugggacuacaggagccugccaccucgcccagcuaauuuuuguauuuuuaguagagacgggguuucacuguguuugccaggcuggucucaaacuccugacaucgugauuugcccgccuuggccucccaaaguguugggauuacaagugugagccacugugcuuggcccauuuaagcagcauauuuuacaucccugcuauguacuaggccuugcgcugauugcuguggagacauugggaacaagaaggucccugccuuccagucaaagcuggaacuucaggucuuggcaggcagagcaggccaguaaucccccaaauaaaauagugcaugucacaguaagccuugugcaggaaucugaggugcugucaaagaaaaauaggggagccuuuuaggaggugacacuugagcugaggcccaggggagcugcaugugugguggggaaguugaggggagcagagaggagagccuugugaaagcucaaaaaccagacagcaggccaggcgugguggcucacgacuguaaucccagcacuuugggaggccgaggcgggcagaucaugaggucaggagaucuagaccauccuggcuaacacggugaaaccccaucucuacuaaaaauacaaaaaauuagcugggugugguggugggcgccuauagucccagcuacucgggaggcugaggcaggagaauggugugaacccaggagucggagguugcagugagcugagaucgugucacuggacuccagcgugggggacagaguaagacuccgucucaaaaaaacaaaaaacaaagaaaccccaaaaaacagcaucacacgggaggaacuggagagggagaacaggaggggagggcuuagggcucaggaggcaggagcagcuccagggcaggugucacuggggcccuggacagaagcauuggugggccgugacuccacaugccugagucaccaggcucagaccagugccuccuuccuguuccacccuacucaggcuguagaagccgcccagcuggccgaggaccugaaggugcagcuggagcacgugcagacucggcugcgggagauccagcccugccuggcagagagccgggcugcucgugagaaagagagcuucaaccucaagagggcucaggugugugcaggggugaggggccaggccagggugguccacggucacggaccuauccugggggcaagcggcucaagguugaggacccuugcccuuagccaggccucuccugccccaggaggacaucucacggcugcggcgcaagcuggaaaagcagaggaagguggaggucuacgcagaugccgacgaaauccuccaggaggagaucaaggaguacaagguggggcugugggccaaguugugcccuauccaccugagaauuguagaugcaggauugcugagacuaguggagagucuggggacccuggaaguaauguagggcagcagaaagugggcagcacaguggucacagagucaaaugcuguuugcuguacauguacugugagccaggcacagugcuuggcuggguguggguugggaggcuaggaacuggcccuggucucugacuucuugaaacugacagucaggggaggaggcagccaaguaauucucucaucccagauguguaauaugauggcagaggccagaggggcugaggggacucaggggaggcccuuccccuggcccuggggucagcaggcuuccuggagugaaugucaccacagcagaccugaagaauaggccagacguggcugugaggaacgggagugaguagcuuuaggcaaagggaacagcagauguggacgcuugagcggagggguugcugggacagcaccggagguuguaaucagaggagccaauguggagagguugggccgugucaccuccugaagagugcgguacgccagguugagaccucaaaggguuuuaaacaggagagugaugugguuagauuuguuguugguuuugggcuggaagagguagacuggaggcagggaaauuguuaagguauugcagucacugaggcagaaaccagaguagauggguucaggagacauuucagaggcagaauugcuuggacucggggguggaucgaaugcauggagugagggaaagggaacacuuggaggacuccugguuuccugguuugagaaacuagguggauaguuaguaccauuuaggggguuaggaggccugcgggggagcagguucuaugggauggugucaaaggaugcugagaaggugccugugggaccccuuugggaggcugggaaggugcucaaggcaaaagggccgggcuggagaacaggcuuggggaaugucaguagaggcagagguggaagccacauaugacuuggucaucccuuggaagcaguugagccuugaagggcagaggcagcuggaggcagccaugggguagaggcaggcuugggagccuguucagugcugguguguaggguccugggagacaggagugauggcagggaggcugcugaggcggcaggcugggcugggauuuuagcaggcuggaggagcacuguugggggaugcugaguugagucaauccaugucuggaguuggaggugagacccuccugguggcggaagagaggucucaggcuaagaagggacccacggcagggucucuggccagugucgaggcugggcccaguugaggguagagagaacagauuucuaguugcauugccauuccagcugugacuuagcaagugcaggugaagagguagacaagauugggauuucaccagaggcggccaguggggcaggagaugaagccccaaggcagaguccaggcugggccuguggguccuuguccuuuugaggggacacaugauagccaucacugcccagugaugaauccggacucugcugauuucuaguguugagaccuuggccucugcaccucaguuugcucauucauagagugcucguccuuaccuccaggguuaugggaggaugaggugcagucuccaguguggugggcuuggccuggacuccuccugcugucagcuuggggucugggcacugucagaguuguucccaagcugaugccuuugccuggcccaggcgcgguugaccugccccugcuguaacacccgcaagaaggaugcaguccuuaccaagugcuuccacguuuucugcuucgagugcgugcggggccgcuaugaggcccgccagaggaagugccccaagugcaacgcggccuuuggugcccacgacuuccaucguaucuacaucagcugaaccugaaacucaggggacucuggaacaccauggacccugggggcugugcccccaucuccuccccaccccaggucuaguggccccacccuccauuccggaccccaugggcccagccccugcccaucuaguugguuuggggacccuggugcaugcuagugggcaugggaucagccaagcuucguuccaucuuuuccuaaaggucagagcugcagccuagggggcacugcccuacagaaaaggucugccugagaggccugaggagcccagagcacuugacugagcuucccggaaacuggcccuaaccugucugucuccguggaugcauccuaacccuaaggaaaauuccccaggcugugaucuacccuagagaaggcucgcucccugccuacuggcucacaaaugaggaccagugagccauguccuuguuccuuguuugagacugggcugcaggccccaggaagacuuuccuucacccaccaucccccuaaccucggcagggcuucuguccuguggaguucccuggacaccuuggucuggcucuugugccaagggcugaaggagguacccucuuggcagaugggggcaucacuugcuuccuuugggaagcucuaagguugcugcagucaccuuccucaucuugcaggugcugaaccaacaucaucaguuucuauucuaaucaggccccuucccaaucuccauuucucugccaagcccauuuacccccaccucaugcaucccaaggcucuacugggucccuggaccuaacccugcuuucauccugguggccuuaacuacaguggagguggaacuucccaggaggggaagggacagaccagccccagccgcugggccaacuuccaaucauuccagcuagaagagcuucccccugacacccugugacugagccuguguccugucugccugcccagccaugcuccaucggcugugagggcagugcccggagaggccagaggguuggagcugcagggacccguuuggacccacagccucuguucuagagaugcuuguauaggcuguuaauugugaugaauaaacguucaacccuc
